(12) United States Patent
Zieler

(10) Patent No.: US 9,200,291 B2
(45) Date of Patent: Dec. 1, 2015

(54) COMPOSITIONS AND METHODS FOR CREATING ALTERED AND IMPROVED CELLS AND ORGANISMS

(71) Applicant: Helge Zieler, Encinitas, CA (US)

(72) Inventor: Helge Zieler, Encinitas, CA (US)

(*) Notice: Subject to any disclaimer, the term of this patent is extended or adjusted under 35 U.S.C. 154(b) by 0 days.

(21) Appl. No.: 14/134,619

(22) Filed: Dec. 19, 2013

(65) Prior Publication Data

US 2014/0170708 A1 Jun. 19, 2014

Related U.S. Application Data

(60) Provisional application No. 61/739,671, filed on Dec. 19, 2012, provisional application No. 61/761,175, filed on Feb. 5, 2013.

(51) Int. Cl.
*C07H 21/02* (2006.01)
*C12N 15/81* (2006.01)
*C12N 15/70* (2006.01)
*C12N 15/10* (2006.01)

(52) U.S. Cl.
CPC .............. *C12N 15/81* (2013.01); *C07H 21/02* (2013.01); *C12N 15/102* (2013.01); *C12N 15/1027* (2013.01); *C12N 15/70* (2013.01)

(58) Field of Classification Search
CPC ................................................... C07H 21/02
USPC ...................................................... 536/23.1
See application file for complete search history.

(56) References Cited

U.S. PATENT DOCUMENTS

| 6,645,766 B2 * | 11/2003 | Luo et al. ...................... 435/466 |
| 7,846,712 B2 * | 12/2010 | Zhang et al. ............... 435/254.1 |
| 2014/0186915 A1 * | 7/2014 | Mori ............................. 435/167 |

FOREIGN PATENT DOCUMENTS

WO 01/30998 A1 5/2001

OTHER PUBLICATIONS

1970 Lehninger translation descriptoin by Albert Lehninger, Worth Publishers, inc. New York, New York, 3 sheets of paper.*
Anderson, J. Christopher et al., "BglBricks: A flexible standard for biological part assembly," Jan. 20, 2010, Journal of Biological Engineering, vol. 4, No. 1, pp. 1-12.
Dymond, Jessica S. et al., "Synthetic chromosome arms function in yeast and generate phenotypic diversity by design," Sep. 22, 2011, Nature, vol. 477, No. 7365, pp. 471-476.
Hoogenboom, H. R., "Selecting and screening recombinant antibody libraries," Sep. 1, 2005, Nature Biotechnology, vol. 23, No. 9, pp. 1105-1116.
International Search Report issued Apr. 22, 2014 in International Application No. PCT/US2013/076526.
Kondo, A. et al., "Yeast cell-surface display—applications of molecular display," Mar. 1, 2004, Applied Microbiology and Biotechnology, vol. 64, No. 1, pp. 28-40.
Marks, J. D. et al., "By-passing Immunization Human Antibodies from V-gene Libraries Displayed on Phage," 1991, Journal of Molecular Biology, vol. 222, No. 3, pp. 581-597.
Werner, S. et al., "Fast track assembly of multigene constructs using Golden Gate cloning and the MoClo system," Jan. 1, 2012, Bioengineered Bugs, vol. 3, No. 1, pp. 38-43.
Golden et al. Genetic engineering of the cyanobacterial chromosome. Methods Enzymol. 1987; 153:215-231.
Hammer et al. Synthetic promoter libraries—tuning of gene expression. Trends Biotechnol. 2006; 24 (2): 53-55.
Haun et al. Rapid, reliable ligation-independent cloning of PCR products using modified plasmid vectors. Biotechniques, 1992; 13(4): 515-518.
Heidorn et al. Synthetic biology in cyanobacteria engineering and analyzing novel functions. Methods Enzymol.2011; 497:539-579.
Hong et al. Identification of gene targets eliciting improved alcohol tolerance in *Saccharomyces cerevisiae* through inverse metabolic engineering. J Biotechnol. 2010; 149(1-2):52-59.
Inaki and Liu. Structural mutations in cancer: mechanistic and functional insights. Trends Genet. 2012; 28 (11):550-559.
Irwin et al. In-fusion® cloning with vaccinia virus DNA polymerase. Methods Mol Biol. 2012; 890:23-35.
Ishiura et al. Expression of a gene cluster kaiABC as a circadian feedback process in cyanobacteria. Science 2000; 281(5382):1519-1523.
Jang et al. Bio-based production of C2-C6 platform chemicals. Biotechnol Bioeng. 2012; 109(10):2437-2459.
Jensen and Hammer. Artificial promoters for metabolic optimization. Biotechnol. Bioengineering 1998; 58 (2-3): 191-195.
Jensen and Hammer. The sequence of spacers between the consensus sequences modulates the strength of prokaryotic promoters. Appl. Environ. Microbiol. 1998; 64 (1): 82-87.
Jia et al. Systematic engineering of microorganisms to improve alcohol tolerance. Engineering in Life Sciences 2009; 10(5): 422-429.
Jovanovic et al. Identification, nucleotide sequence, and characterization of PspF, the transcriptional activator of the *Escherichia coli* stress-induced psp operon. J. Bacteriol. 1996; 178 (7): 1936-1945.
Kamarainen et al. Physiological tolerance and stoichiometric potential of cyanobacteria for hydrocarbon fuel production. J Biotechnol. 2012; 162(1):67-74.
Knoshaug and Zhang. Butanol tolerance in a selection of microorganisms. Appl Biochem Biotechnol. 2008; 153 (1-3):13-20.
Kondo et al. Circadian rhythms in prokaryotes: luciferase as a reporter of circadian gene expression in cyanobacteria. Proc Natl Acad Sci U S A 1993; 90(12):5672-5676.
Kuijpers et al. A versatile, efficient strategy for assembly of multi-fragment expression vectors in *Saccharomyces cerevisiae* using 60 by synthetic recombination sequences. Microb Cell Fact. 2013; 12:47.
Kulkarni and Golden. mRNA stability is regulated by a coding-region element and the unique 5' untranslated leader sequences of the three *Synechococcus* psbA transcripts. Mol Microbiol. 1997; 24(6):1131-1142.

(Continued)

*Primary Examiner* — Ardin Marschel
(74) *Attorney, Agent, or Firm* — Gorman IP Law, APC

(57) ABSTRACT

The present invention provides compositions comprising randomized in-frame fusion polynucleotides and methods for introducing them into a host organism to identify desirable phenotypic changes that disrupt or alter existing genetic or biochemical mechanisms or pathways, thus creating novel characteristics of the transformed organism. Methods for using the compositions for increasing diversity within populations of organisms are also presented.

25 Claims, 11 Drawing Sheets

(56) References Cited

OTHER PUBLICATIONS

Kutsuna et al. A period-extender gene, pex, that extends the period of the circadian clock in the cyanobacterium *Synechococcus* sp. strain PCC 7942. J Bacteriol. 1998; 180(8):2167-2174.

Lan and Liao. Metabolic engineering of cyanobacteria for 1-butanol production from carbon dioxide. Metab Eng. 2011; 13(4):353-63.

Lan and Liao. ATP drives direct photosynthetic production of 1-butanol in cyanobacteria. Proc Natl Acad Sci U S A. 2012; 109(16):6018-6023.

Lee et al. Systems metabolic engineering of microorganisms for natural and non-natural chemicals. Nat Chem Biol. 2012; 8(6):536-546.

Li and Elledge. SLIC: a method for sequence- and ligation-independent cloning. Methods Mol Biol. 2012; 852:51-59.

Li et al. FastCloning: a highly simplified, purification-free, sequence- and ligation-independent PCR cloning method. BMC Biotechnol. 2011; 11:92.

Liang et al. Activities of constitutive promoters in *Escherichia coli*. J. Mol. Biol. 1999; 292 (1): 19-37.

Lindberg et al. Engineering a platform for photosynthetic isoprene production in cyanobacteria, using *Synechocystis* as the model organism. Metab Eng. 2010; 12(1):70-79.

Liu and Qureshi. How microbes tolerate ethanol and butanol. New Biotechnol.2009; 26(3-4):117-121.

Liu et al. Proteomic analysis reveals resistance mechanism against biofuel hexane in *Synechocystis* sp. PCC 6803. Biotechnol Biofuels. 2012; 5(1):68.

Liu et al. Fatty acid production in genetically modified cyanobacteria. Proc Natl Acad Sci U S A. 2011; 108 (17):6899-6904.

Ma et al. Plasmid construction by homologous recombination in yeast. Gene 1987; 58(2-3):201-216.

Machado and Atsumi. Cyanobacterial biofuel production. J Biotechnol. 2012; 162(1):50-56.

Marschalek. Mechanisms of leukemogenesis by MLL fusion proteins. Br J Haematol. 2011; 152(2):141-154.

Mascal. Chemicals from biobutanol: technologies and markets. Biofuels, Bioprod. Bioref. 2012; 6(4):483-493.

Melo. The diversity of BCR-ABL fusion proteins and their relationship to leukemia phenotype. Blood 1996; 88 (7):2375-2384.

Menart et al. Constitutive versus thermoinducible expression of heterologous proteins in *Escherichia coli* based on strong PR,PL promoters from phage lambda. Biotechnology and Bioengineering 2003; 83 (2): 181-190.

Mitelman et al. Fusion genes and rearranged genes as a linear function of chromosome aberrations in cancer. Nat Genet. 2004; 36(4):331-334.

Mitelman et al. The impact of translocations and gene fusions on cancer causation. Nat Rev Cancer 2007; 7 (4):233-245.

Model et al. The *Escherichia coli* phage-shock-protein (psp) operon. Mol Microbiol.1997; 24(2):255-61.

Mutsuda et al. Biochemical properties of CikA, an unusual phytochrome-like histidine protein kinase that resets the circadian clock in *Synechococcus elongatus* PCC 7942. J Biol Chem 2003; 278(21): 19102-19110.

Myllykangas et al. Targeted sequencing library preparation by genomic DNA circularization. BMC Biotechnol. 2011; 11:122.

Natsoulis et al. A flexible approach for highly multiplexed candidate gene targeted resequencing. PLoS One 2011; 6(6):e21088.

Newberger et al. The Human OligoGenome Resource: a database of oligonucleotide capture probes for resequencing target regions across the human genome. Nucleic Acids Res. 2012; 40(Database issue):D1137-1143.

Quan and Tian. Circular polymerase extension cloning for high-throughput cloning of complex and combinatorial DNA libraries. Nat Protoc. 2011; 6(2):242-251.

Quan and Tian. Circular polymerase extension cloning of complex gene libraries and pathways. PLoS One. 2009; 4 (7): e6441.

Rabbitts. Commonality but diversity in cancer gene fusions. Cell 2009; 137(3):391-395.

Raymond et al. General method for plasmid construction using homologous recombination. Biotechniques 1999; 26 (1):134-8, 140-1.

Raymond et al. Linker-mediated recombinational subcloning of large DNA fragments using yeast. Genome Res 2002;. 12(1):190-197.

Robertson et al. A new dawn for industrial photosynthesis. Photosynth Res. 2011; 107(3):269-277.

Ruffing. Engineered cyanobacteria: teaching an old bug new tricks. Bioeng Bugs.2011; 2(3):136-149.

Sambrook et al. Molecular Cloning: A Laboratory Manual, Second Ed., 1989, pp. 1.21-1.52. Cold Spring Harbor Laboratory Press, Plainview, New York.

Babushok et al. Current topics in genome evolution: molecular mechanisms of new gene formation. Cell Mol Life Sci. 2007; 64(5):542-54.

Beekwilder et al. A phagemid vector using the *E. coli* phage shock promoter facilitates phage display of toxic proteins. Gene 1999; 228(1-2): 23-31.

Li and Elledge. Harnessing homologous recombination in vitro to generate recombinant DNA via SLIC. Nat Methods. 2007; 4(3): 251-256.

Lobban and Kaiser. Enzymatic end-to end joining of DNA molecules. J Mol Biol. 1973; 78(3): 453-471.

Oliver et al. Cyanobacterial conversion of carbon dioxide to 2,3-butanediol. Proc Natl Acad Sci U S A. 2013; 110 (4):1249-1254.

Alper et al. Engineering yeast transcription machinery for improved ethanol tolerance and production. Science 2005; 314:1565-1568.

Andersson et al. Application of bioluminescence to the study of circadian rhythms in cyanobacteria. Methods Enzymol. 2000; 305:527-542.

Arai et al. Design of the linkers which effectively separate domains of a bifunctional fusion protein. Protein Engineering 2001; 14 (8): 529-532.

Ashby and Houmard. Cyanobacterial two-component proteins: structure, diversity, distribution, and evolution. Microbiol Mol Biol Rev. 2006; 70(2):472-509.

Aslanidis and DeJong. Ligation-independent cloning of PCR products (LI-PCR). Nucl Acids Res 18 1990; (20): 6069-6074.

Aslanidis et al. Minimal length requirement of the single-stranded tails for ligation-independent cloning (LIC) of PCR products. PCR Methods Appl 1994;. 4(3): 172-177.

Atsumi et al. Evolution, genomic analysis, and reconstruction of isobutanol tolerance in *Escherichia coli*. Mol Syst Biol 2012; 6:449.

Atsumi et al. Direct photosynthetic recycling of carbon dioxide to isobutyraldehyde. Nat Biotechnol. 2009; 27 (12):1177-1180.

Belyaeva et al. The *Escherichia coli* cysG promoter belongs to the 'extended -10' class of bacterial promoters. Biochem. J. 1993; 296 (Pt 3): 851-857.

Brachmann et al. Designer deletion strains derived from *Saccharomyces cerevisiae* S288C: a useful set of strains and plasmids for PCR-mediated gene disruption and other applications. Yeast 1998; 14(2):115-132.

Brissette et al. Characterization and sequence of the *Escherichia coli* stress-induced psp operon. J Mol Biol.1991; 220(1): 35-48.

Bustos and Golden. Expression of the psbDII gene in *Synechococcus* sp. strain PCC 7942 requires sequences downstream of the transcription start site. J Bacteriol. 1991; 173(23):7525-7533.

Bustos and Golden. Light-regulated expression of the psbD gene family in *Synechococcus* sp. strain PCC 7942: evidence for the role of duplicated psbD genes in cyanobacteria. Mol Gen Genet. 1992; 232(2):221-230.

Chenna et al. Multiple sequence alignment with the Clustal series of programs. Nucleic Acids Res. 2003; 31 (13):3497-3500.

Clerico et al. Specialized techniques for site-directed mutagenesis in cyanobacteria. Methods Mol Biol. 2007; 362:155-171.

Dahl et al. Multiplex amplification enabled by selective circularization of large sets of genomic DNA fragments. Nucleic Acids Res. 2005; 33(8): e71.

De Mey et al. Construction and model-based analysis of a promoter library for *E-coli*: an indispensable tool for metabolic engineering BMC Biotechnol. 2007; 7: 34.

Degryse et al. In vivo cloning by homologous recombination in yeast using a two-plasmid-based system. Yeast 1995; 11(7):629-640.

(56) References Cited

OTHER PUBLICATIONS

Deng and Coleman. Ethanol synthesis by genetic engineering in cyanobacteria. Appl Environ Microbiol.1999; 65 (2):523-528.
Dexter and Fu. Metabolic engineering of cyanobacteria for ethanol production. Energy Environ. Sci. 2009; 2 (8):857-864.
Ding et al. Tolerance and stress response to ethanol in the yeast *Saccharomyces cerevisiae.* Appl Microbiol Biotechnol. 2009; 85(2):253-263.
Dismukes et al. Aquatic phototrophs: efficient alternatives to land-based crops for biofuels. Curr Opin Biotechnol. 2008; 19(3):235-240.
Dolganov and Grossman. Insertional inactivation of genes to isolate mutants of *Synechococcus* sp. strain PCC 7942: isolation of filamentous strains. J Bacteriol. 1993; 175(23):7644-7651.
Ducat et al. Engineering cyanobacteria to generate high-value products. Trends Biotechnol. 2011; 29(2):95-103.
Ducat et al. Rerouting carbon flux to enhance photosynthetic productivity. Appl Environ Microbiol. 2012; 78 (8):2660-2668.
Dunlop et al. Engineering microbial biofuel tolerance and export using efflux pumps. Mol Syst Biol 2011; 7:487.
Dunlop. Engineering microbes for tolerance to next-generation biofuels. Biotechnol Biofuels 2011; 4:32.
Eisenbeis and Höcker . Evolutionary mechanism as a template for protein engineering. J Pept Sci. 2010; 16 (10):538-544.
Eldridge et al. An in vitro selection strategy for conferring protease resistance to ligand binding peptides. Protein Eng Des Sel. 2009; 22(11):691-8.
Elhai. Genetic techniques appropriate for the biotechnological exploitation of cyanobacteria. J. Appl. Phycol. 1994; 6 (2):177-186.
Elsaesser and Paysan. Liquid gel amplification of complex plasmid libraries. Biotechniques 2004; 37(2):200-202.
Elsharawy et al. Accurate variant detection across non-amplified and whole genome amplified DNA using targeted next generation sequencing. BMC Genomics 2012; 13(1):500.
Flores et al. Gene transfer to cyanobacteria in the laboratory and in nature. In: Herrero A, Flores E, eds. The cyanobacteria: molecular biology, genomics and evolution. 2008. Norfolk, UK: Caister Academic Press. pp. 45-57.
Fullwood et al. The use of multiple displacement amplification to amplify complex DNA libraries. Nucleic Acids Res. 2008; 36(5):e32.
Funk et al. Vector systems for heterologous expression of proteins in *Saccharomyces cerevisiae.* Methods Enzymol. 2002; 350:248-57.
Gao et al. Photosynthetic production of ethanol from carbon dioxide in genetically engineered cyanobacteria. Energy Environ. Sci. 2012; 5(12):9857-9865.
Geerts et al. Inducible expression of heterologous genes targeted to a chromosomal platform in the cyanobacterium *Synechococcus* sp. PCC 7942. Microbiology 1995; 141(4):831-841.
Gibson et al. Chemical synthesis of the mouse mitochondrial genome. Nat Methods. 2010; 7(11):901-903.
Gibson et al. Enzymatic assembly of DNA molecules up to several hundred kilobases. Nat Methods 2009;. 6 (5):343-345.
Gietz and Schiestl. High-efficiency yeast transformation using the LiAc/SS carrier DNA/PEG method. Nat Protocols 2007; 2(1):31-34.
Gietz and Woods. Yeast transformation by the LiAc/SS Carrier DNA/PEG method. Methods Mol Biol. 2006; 313:107-120.
<sGIETZ and Woods. Transformation of yeast by lithium acetate/single-stranded carrier DNA/polyethylene glycol method.Methods Enzymol. 2002; 350:87-96.
Gilbert. Why genes in pieces? Nature 1978; 271(5645):501.
Baer et al. Effect of butanol challenge and temperature on lipid composition and membrane fluidity of butanol tolerant *Clostridium acetobutylicum.* Appl Environ Microbiol 1987; 53:2854-2861.
Brissette et al. Phage shock protein, a stress protein of *Escherichia coli.* Proc Natl Acad Sci U S A 1990; 87(3): 862-866.
Sawyers. The bcr-abl gene in chronic myelogenous leukaemia. Cancer Surv. 1992; 15:37-51.
Shao et al. DNA assembler, an in vivo genetic method for rapid construction of biochemical pathways. Nucleic Acids Res. 2009; 37(2):e16.

Shizuya et al. Cloning and stable maintenance of 300-kilobase-pair fragments of human DNA in *Escherichia coli* using an F-factor-based vector. Proc Natl Acad Sci U S A 1992; 89(18): 8794-8797.
Steen et al. Metabolic engineering of *Saccharomyces cerevisiae* for the production of n-butanol. Microb Cell Fact. 2008; 7:36.
Stemmer. DNA shuffling by random fragmentation and reassembly: in vitro recombination for molecular evolution. Proc Natl Acad Sci U S A 1994; 91(22):10747-10751.
Stemmer. Rapid evolution of a protein in vitro by DNA shuffling. Nature 1994; 370(6488):389-391.
Takahama et al. Construction and analysis of a recombinant cyanobacterium expressing a chromosomally inserted gene for an ethylene-forming enzyme at the psbAl locus. J Biosci Bioeng. 2003; 95(3):302-305.
Tan et al. Photosynthesis driven conversion of carbon dioxide to fatty alcohols and hydrocarbons in cyanobacteria. Metab Eng. 2011; 13(2):169-176.
Tewhey et al. Microdroplet-based PCR enrichment for large-scale targeted sequencing. Nat Biotechnol. 2009; 27 (11):1025-1031.
Thieme et al. Quick and clean cloning: a ligation-independent cloning strategy for selective cloning of specific PCR products from non-specific mixes. PLoS One 2011; 6(6): e20556.
Thomas et al. Overexpression of groESL in *Clostridium acetobutylicum* results in increased solvent production and tolerance, prolonged metabolism, and changes in the cell's transcriptional program. Appl Environ Microbiol 2003; 69:4951-4965.
Tian et al. Quantitative proteomics reveals dynamic responses of *Synechocystis* sp. PCC 6803 to next-generation biofuel butanol. J Proteomics 2013; 78:326-345.
Tsinoremas et al. Efficient gene transfer in *Synechococcus* sp. strains PCC 7942 and PCC 6301 by interspecies conjugation and chromosomal recombination. J Bacteriol. 1994; 176(21):6764-6768.
Vieira and Messing. The pUC plasmids, an M13mp7-derived system for insertion mutagenesis and sequencing with synthetic universal primers. Gene 1982; 19(3):259-268.
Vioque. Transformation of cyanobacteria. Adv Exp Med Biol. 2007; 616:12-22.
Vroom and Wang. Modular construction of plasmids through ligation-free assembly of vector components with oligonucleotide linkers. Biotechniques2008; 44(7): 924-926.
Wang et al. Application of synthetic biology in cyanobacteria and algae. Front Microbiol. 2012; 3:344.
Wang et al. Enhancement of engineered trifunctional enzyme by optimizing linker peptides for degradation of agricultural by-products. Enzyme and Microb. Technol.2010; 47 (5): 194-199.
Ward. Single-step purification of shuttle vectors from yeast for high frequency back-transformation into *E. coli.* Nucleic Acids Res. 1990; 8(17):5319.>.
Weiner et al. Analysis of the proteins and cis-acting elements regulating the stress-induced phage shock protein operon. Nucleic Acids Res.1995; 23(11): 2030-2036.
Weiner et al. Stress-induced expression of the *Escherichia coli* phage shock protein operon is dependent on σ-54 and modulated by positive and negative feedback mechanisms Genes Dev. 1991; 5(10): 1912-1923.
Whitworth and Cock. Evolution of prokaryotic two-component systems: insights from comparative genomics. Amino Acids 2009; 37(3):459-66.
Wingler and Cornish. Reiterative Recombination for the in vivo assembly of libraries of multigene pathways. Proc Natl Acad Sci U S A. 2011; 108(37):15135-15140.
Zhang and Fisher. The bifunctional enzymes of antibiotic resistance. Curr Opin Microbiol.2009; 12(5):505-511.
Zhao et al. Expression of a cloned cyclopropane fatty acid synthase gene reduces solvent formation in *Clostridium acetobutylicum* ATCC 824. Appl Environ Microbiol, 2003; 69:2831-2841.
Zhou and Li. Engineering cyanobacteria for fuels and chemicals production. Protein Cell. 1(3):207-210.Lathe R, Kieny MP, Skory S, Lecocq JP (1984). Linker tailing: unphosphorylated linker

(56) References Cited

OTHER PUBLICATIONS oligonucleotides for joining DNA termini. DNA 2012; 3(2): 173-182.

Zhou et al. Designing and creating a modularized synthetic pathway in cyanobacterium *Synechocystis* enables production of acetone from carbon dioxide. Metab Eng. 2012; 14(4):394-400.

Zhu et al. In-fusion assembly: seamless engineering of multidomain fusion proteins, modular vectors, and mutations. BioTechniques 2007; 43:354-359.

Zhou and Li. Engineering cyanobacteria for fuels and chemicals production. 2012. Protein Cell. 1(3):207-210.

Lathe et al. Linker tailing: unphosphorylated linker oligonucleotides for joining DNA termini. 1984. DNA 3(2): 173-182.

* cited by examiner

Figure 9

Yeast active fusion genes conferring heat resistance

| Fusion gene name | Fusion gene SEQ ID | 5' ORF description | 5' ORF SEQ ID | 5' ORF length (bp) | 3' ORF description | 3' ORF SEQ ID | 3' ORF length (bp) |
|---|---|---|---|---|---|---|---|
| Y1-5A | 25131 | Putative protein of unknown function | 108 | 198 | Protein required for the general stress response | 3444 | 1461 |
| Y1-7A | 25132 | Putative protein of unknown function | 675 | 477 | Protein required for the general stress response | 3444 | 1461 |
| Y1-13A | 25133 | Dynein intermediate chain | 3750 | 1599 | Protein required for the general stress response | 3444 | 1461 |
| Y1-17A | 25134 | Protein required for the general stress response | 3444 | 1458 | Putative protein of unknown function | 1840 | 882 |
| Y1-18A | 25135 | Zinc-finger protein of unknown function | 2338 | 1029 | Gamma subunit of the oligosaccharyltransferase complex of the ER lumen | 2403 | 1053 |
| Y1-19A | 25136 | Protein required for the general stress response | 3444 | 1458 | Helicase-like protein encoded within the telomeric Y' element | 2746 | 1179 |
| Y1-20A | 25137 | ER membrane protein | 4168 | 1815 | Protein required for the general stress response | 3444 | 1461 |
| Y1-23A | 25138 | Helicase-like protein encoded within the telomeric Y' element | 2746 | 1176 | Protein required for the general stress response | 3444 | 1461 |
| Y1-25A | 25139 | C-4 methyl sterol oxidase | 2005 | 927 | Protein required for the general stress response | 3444 | 1461 |
| Y1-28A | 25140 | Subunit of ISW2/yCHRAC chromatin accessibility complex | 731 | 501 | Protein required for the general stress response | 3444 | 1461 |
| Y1-33A | 25141 | Protein of unknown function | 3561 | 1506 | Co-chaperone that binds to and regulates Hsp90 family chaperones | 1153 | 651 |
| Y1-38A | 25142 | Component of the EKC/KEOPS complex | 1158 | 649 | Protein required for the general stress response | 3444 | 1461 |
| Y1-39A | 25143 | Dubious open reading frame unlikely to encode a protein | 13 | 114 | Protein required for the general stress response | 3444 | 1461 |
| Y1-40A | 25144 | Putative lipase, involved in lipid metabolism | 4378 | 1941 | Protein required for the general stress response | 3444 | 1461 |
| Y1-43A | 25145 | Putative protein of unknown function | 44 | 147 | Protein required for the general stress response | 3444 | 1461 |
| Y1-45A | 25146 | Putative protein of unknown function | 1573 | 795 | Protein required for the general stress response | 3444 | 1461 |
| Y1-47A | 25147 | Component of the kinetochore-associated Ndc80 complex | 1201 | 663 | Protein required for the general stress response | 3444 | 1461 |
| Y1-48A | 25148 | Multidrug efflux pump of the major facilitator superfamily | 3806 | 1626 | Protein required for the general stress response | 3444 | 1461 |
| Y1-56B | 25149 | Lsm (like Sm) protein | 206 | 258 | ATPase involved in protein folding and the response to stress | 6386 | 1950 |
| Y1-58C | 25150 | Mitochondrial ribosomal protein of the large subunit | 575 | 441 | Mitochondrial protein | 4459 | 2010 |
| Y1-66C | 25151 | Putative protein of unknown function | 815 | 534 | Mitochondrial hsp70-type molecular chaperone | 4413 | 1974 |
| Y1-67B | 25152 | Protein essential for the cellular stress response | 2670 | 1383 | Non-essential protein of unknown function | 2558 | 1107 |

Figure 9 (continued)

Yeast active fusion genes conferring heat resistance

| Fusion gene name | Fusion gene SEQ ID | Total fusion protein length (bp) | 5' ORF complete? | 3' ORF complete? | In-frame? | Linker sequence | 5' cloning junction | 3' cloning junction |
|---|---|---|---|---|---|---|---|---|
| Y1-5A | 25131 | 1719 | yes | yes | yes | perfect | perfect | perfect |
| Y1-7A | 25132 | 1998 | yes | yes | yes | perfect | perfect | perfect |
| Y1-13A | 25133 | 3120 | yes | yes | yes | is | perfect | perfect |
| Y1-17A | 25134 | 2400 | yes | yes | yes | perfect | perfect | perfect |
| Y1-18A | 25135 | 2142 | yes | yes | yes | is | perfect | perfect |
| Y1-19A | 25136 | 2697 | yes | yes | yes | is | perfect | perfect |
| Y1-20A | 25137 | 3336 | yes | yes | yes | is | perfect | perfect |
| Y1-23A | 25138 | 2697 | yes | yes | yes | is | perfect | perfect |
| Y1-25A | 25139 | 2448 | yes | yes | yes | perfect | perfect | perfect |
| Y1-28A | 25140 | 2022 | yes | yes | yes | perfect | perfect | perfect |
| Y1-33A | 25141 | 2237 | yes | yes | yes | perfect | perfect | perfect |
| Y1-38A | 25142 | 2170 | yes | yes | yes | perfect | perfect | perfect |
| Y1-39B | 25143 | 1535 | yes | yes | yes | perfect | perfect | perfect |
| Y1-40A | 25144 | 3462 | yes | yes | yes | is | perfect | perfect |
| Y1-43A | 25145 | 1568 | yes | yes | yes | perfect | perfect | perfect |
| Y1-45A | 25146 | 2316 | yes | yes | yes | perfect | perfect | perfect |
| Y1-47A | 25147 | 2184 | yes | yes | yes | perfect | perfect | perfect |
| Y1-48A | 25148 | 3147 | yes | yes | yes | is | perfect | perfect |
| Y1-58B | 25149 | 2268 | yes | yes | yes | perfect | perfect | perfect |
| Y1-58C | 25150 | 2311 | yes | yes | yes | perfect | perfect | perfect |
| Y1-66C | 25151 | 2568 | yes | yes | yes | perfect | perfect | perfect |
| Y1-67B | 25152 | 2310 | yes | yes | yes | perfect | perfect | perfect |

COMPOSITIONS AND METHODS FOR CREATING ALTERED AND IMPROVED CELLS AND ORGANISMS

CROSS REFERENCE TO RELATED APPLICATIONS

This Nonprovisional application claims priority under 35 U.S.C. §119(e) on U.S. Provisional Application No. 61/739,671 filed on Dec. 19, 2012, the entire contents of which are hereby incorporated by reference in its entirety and also claims priority under 35 U.S.C. §119(e) on U.S. Provisional Application No. 61/761,175, filed on Feb. 5, 2013.

This invention was made with government support under NSF contract IIP-1321480. The government has certain rights in the invention.

BACKGROUND OF THE INVENTION

Numerous agricultural and industrial production systems and processes depend on specific organisms, such as plants, algae, bacteria, fungi, yeasts, protozoa and cultured animal cells, for production of useful materials and compounds, such as food, fiber, structural materials, fuel, chemicals, pharmaceuticals, or feedstocks thereof. In the process of the current shift to biological production systems for a variety of chemicals and fuels, a wide assortment of organisms will be used for production, most of them microbes, with an increasing tendency towards photosynthetic organisms (Dismukes 2008). The ability to grow robustly, and the ability to efficiently produce the materials and compounds of interest, are desirable properties of these organisms.

Optimization of the growth of these organisms and augmentation of their yield of useful materials and compounds is an ongoing activity of many companies and individuals, with the goal of achieving a higher productivity or yield, or lower production cost of commercially important materials and compounds. Such improvements can occur through the modification of production systems, or through the modification of the organisms themselves.

Genetic or epigenetic changes in organisms can be particularly powerful ways of improving the organisms' performance and raising their productivities. All organisms in use by humans have been selected for specific genetic compositions that maximize their productivity and usefulness. In addition, various techniques can be employed to increase the range of characteristics or phenotypes displayed by these organisms, enabling the selecting of superior strains and varieties. Among these techniques are mutagenesis, genetic engineering, transgenesis, metabolic engineering, breeding, adaptive mutation and others. Application of such techniques has allowed rapid progress in the improvement of organisms.

Deregulating genetic checkpoints is a general strategy for modifying the growth properties and yield of useful organisms. Genetic checkpoints have generally evolved to allow an organism to alter its growth, metabolism or progression through the cell cycle, enabling it to survive periods of stress or nutrient limitation. In multicellular organisms, checkpoints are also in place to inhibit cell divisions once a tissue or organ is mature and fully formed. Relieving these checkpoints is often desirable for maximizing growth, yield and productivity of an organism being cultured or grown in cultivation, where conditions of stress may be controllable and avoidable.

Among the genetic engineering methods developed in the past are gain-of-function approaches, through which one or more homologous or heterologous polynucleotides are introduced into an organism's genome. Typically, such polynucleotides are constructed in a manner that the polynucleotide product will be overexpressed in the organism, thus imparting a novel or altered function to that organism. Mutagenesis can also result in gain-of-function changes in a cell or an organism, although such changes are rarer in response to mutagenesis than loss-of-function changes, in which the activity of a polynucleotide or polynucleotide product is impaired or destroyed by the genetic change.

Polynucleotides tend to have specific functions which are a product of the polynucleotide sequence and of the biochemical properties of the encoded RNA or protein. The sequence and biochemical properties of a protein or RNA govern its structure, biochemical activity, localization within a cell, and association with other cellular components, allowing appropriate activity of the protein or RNA, and proper regulation of that activity. Alteration of a polynucleotide sequence resulting in abnormal properties of the encoded protein or RNA, affecting its biochemical and structural properties, sub-cellular localization and/or association with other proteins or RNAs, can have profound consequences on the characteristics or phenotype of the organism. Polynucleotide fusions, involving joining of intact or partial open reading frames encoded by separate polynucleotides, is a known way of altering a polynucleotide sequence to change the properties of the encoded RNA or protein and to alter the phenotype of an organism.

There are two general mechanisms by which polynucleotide fusions can alter an organism's phenotype. These two mechanisms can be illustrated with the case of polynucleotide A (encoding protein A') fused to polynucleotide B (encoding protein B'), in which proteins A and B have different functions or activities and/or are localized to different parts of the cell. The first mechanism applies to sub-cellular localization of the two proteins. The fusion protein encoded by the polynucleotide fusion of the two polynucleotides may be localized to the part of the cell where protein A' normally resides, or to the part of the cell where protein B' normally resides, or to both. This alteration of cellular distribution of the activities encoded by proteins A' and B' may cause a phenotypic change in the organism. A schematic illustration of the altered localization of two proteins as a result of their fusion is illustrated in FIG. 1.

The second general mechanism by which fusion proteins alter the phenotypic property of a cell or organism relates to the direct association of two different, normally separate functions or activities in the same protein. In the case of proteins A' and B', their fusion may lead to an altered activity of protein A' or of protein B' or of the multiprotein complex in which these proteins normally reside, or of combinations thereof. The altered activity includes but is not limited to: qualitative alterations in activity; altered levels of activity; altered specificities of activity; altered regulation of the activity by the cell; altered association of the protein with other proteins or RNA molecules in the cell, leading to changes in the cell's biochemical or genetic pathways. A schematic illustration of phenotypic changes arising in a cell as a consequence of expressing a fusion protein is shown in FIG. 1.

Gene fusions, the function-generating principle that the technology is based on, is not a regularly occurring biological mechanism (Ashby 2006, Babushok 2007, Whitworth 2009, Zhang 2009, Eisenbeis 2010), but it has been observed sufficiently often to confirm the validity of the strategy. Apart from occurring in evolutionary time, for example in the evolution of new gene sequences by exon shuffling (Gilbert 1978), gene fusions are frequent events in oncogenesis where the fusion of two proto-oncogenes contributes to uncontrolled cell proliferation of cancer cells (Mitelman 2004, Mitelman 2007, Rabbitts 2009, Inaki 2012). Examples of alteration of activity of a polynucleotide fusion are the BCL-ABL oncogene involved in promoting uncontrolled cell growth in chronic myeloid leukemia (Sawyers 1992, Melo 1996), the mixed-lineage leukemia (MLL) polynucleotides coding for Histone-lysine N-methyltransferase that are involved in aggressive acute leukemia (Marshalek 2011), prokaryotic two-component signal transduction proteins (Ashby 2006, Whitworth 2009) and multifunctional bacterial antibiotic resistance polynucleotides (Zhang 2009). Despite these examples, however, polynucleotide fusions are relatively rare in biology compared to other genetic changes such as point mutations and tend to occur at a frequency that is more appropriately measured over evolutionary time as opposed to per cell generation (Babushok 2007, Eisenbeis 2010). As a result, a system for creating artificial polynucleotide fusions has the potential to create many phenotypes that are rarely or never found in nature. Fusion proteins capable of bypassing a variety of genetic checkpoints in various useful organisms will allow the isolation of faster-growing and higher-yielding strains and varieties.

To date, no attempt has been made to take advantage of the function-generating capability of fusion genes or polypeptides in a large-scale and systematic manner. There are no published examples of large-scale collections of randomized, in-frame polynucleotide fusions. Previous examples of fusion proteins have been generated in a limited and directed fashion with specific outcomes in mind. The present invention describes the creation and use of systematic, randomized, large-scale and in-frame gene fusions or polynucleotide fusions for the purpose of altering gene function, generating new gene functions, new protein functions and/or generating novel phenotypes of interest in biological organisms.

The present invention is distinct from gene and protein evolution methods such as gene shuffling (Stemmer 1994, Stemmer 1994a) that randomly recombine homologous sequences in order to create new variants of specific genes and proteins. The present invention uses collections of sequences that are substantially non-homologous as input sequences to create random, recombinant and novel coding sequences.

BRIEF SUMMARY OF THE INVENTION

The present invention relates to methods and compositions that bring about changes in phenotypes in an organism through the introduction of randomized in-frame fusion polynucleotides into the genome of the organism. The random association of multiple sequences results in randomized in-frame fusion polynucleotides that disrupt or alter existing genetic or biochemical mechanisms or pathways in the cell or organism, thus creating novel characteristics of the transformed cell or organism. This method is useful for increasing diversity within populations of organisms, and creating new and useful phenotypes or characteristics in such organisms.

The present invention uses randomized in-frame fusion polynucleotides to create previously unknown phenotypes in a target cell or organism. The present invention is directed to a composition comprising at least 2 discrete random polynucleotides randomly fused in-frame to form at least one randomized in-frame fusion polynucleotide. The randomized in-frame fusion polynucleotide can be operably linked to at least one regulatory sequence that controls expression of the randomized in-frame fusion polynucleotide where the regulatory sequence is a promoter, a terminator, or an untranslated sequence. In one embodiment, the randomized in-frame fusion polynucleotide is operably linked to a vector. The randomized in-frame fusion polynucleotide can be introduced into a host cell. In some cases the host cell can be regenerated into the organism from which the host cell was derived. The randomized fusion polypeptide causes a phenotype that is not present in a control cell or a control organism.

The invention is also directed to large scale methods of producing randomized in-frame fused polynucleotides by isolating polynucleotides from an organism, optionally randomly fragmenting those polynucleotides and then randomly joining the fragments in-frame. Another embodiment presents a method of altering the phenotype of a cell comprising introducing into a host cell the composition containing the randomized in-frame fusion polynucleotide. Yet another embodiment presents a method for altering the phenotype of an organism by introducing a randomized in-frame fusion polypeptide into a host cell and then regenerating the organism from that cell. Yet another embodiment presents a method for identifying a randomized in-frame fusion polypeptide responsible for an altered phenotype by comparing the life cycle of the cell or organism containing the randomized in-frame fusion polypeptide to a control cell or organism, selecting the cell or organism containing the randomized in-frame fusion polypeptide that displays a phenotype absent in the control organism, isolating the randomized in-frame fusion polynucleotide encoding the randomized in-frame fusion polypeptide from the selected organism, introducing the isolated randomized in-frame fusion polynucleotide into a host cell and, if appropriate regenerating the organism from that host cell, and then comparing the randomized in-frame fusion polynucleotide containing cell or regenerated organism to a control organism to confirm that the observed altered phenotype remains.

In some embodiments, a collection of coding sequences (open reading frames or ORFs) is generated, and random pairs of ORFs are cloned into an expression vector as randomized translational fusions. This is done in a manner that each ORF present in the starting collection can be positioned in a 5' orientation with respect to the ORF it is fused to, or in a 3' orientation. The resulting library of randomized in-frame fusion polynucleotides is introduced into a target organism, and transformed cells or organisms are selected for presence of the randomized in-frame fusion polynucleotide. In another embodiment, populations of transformed organisms are selected or screened for a novel phenotype. Transformed organisms with the desirable phenotype are of direct utility in a process that the target organism is typically used for.

BRIEF DESCRIPTION OF THE DRAWINGS

FIG. 9: Table listing fusion proteins isolated in *Saccharomyces cerevisiae* in a screen for heat tolerance. Each row in the table lists a separate fusion gene isolated in the screen described in Example 2. The fusion genes are identified by name, SEQ ID NO: and their component 5' and 3' ORFs are listed, including their length, SEQ ID NO: and a brief description of their cellular function, if known. All of the listed fusion genes have complete, full-length 5' and 3' ORFs, and are fused in-frame. All cloning junctions are perfect. The linker sequence separating the two ORFs is complete and perfect in all cases where this part of the fusion gene was completely sequenced; in several cases, the sequence was incomplete (SI) and did not allow determination whether the linker sequence was correct.

DETAILED DESCRIPTION OF THE INVENTION

The present invention provides a method for screening and sampling a large number of biochemical, genetic and interactive functions for a desired phenotype. The present invention discloses a novel method of producing altered or improved cells or organisms by creating randomized fusions of open reading frames (ORFs), or fragments thereof, to create large libraries of polynucleotide combinations, which can be used to generate novel phenotypes and characteristics in useful organisms. The present invention describes methods to generate collections of randomized in-frame fusion polynucleotides.

An ORF is defined as any sequence of nucleotides in a nucleic acid that encodes a protein or peptide as a string of codons. The ORFs in the starting collection need not start or end with any particular amino acid. The ORF or polynucleotide sequence encoding a protein or peptide may be continuous or may be interrupted by introns.

The term "in-frame" in this invention, and particularly in the phrase "in-frame fusion polynucleotide" refers to the reading frame of codons in an upstream or 5' polynucleotide, gene or ORF as being the same as the reading frame of codons in a polynucleotide, gene or ORF placed downstream or 3' of the upstream polynucleotide, gene, or ORF that is fused with the upstream or 5' polynucleotide, gene or ORF. Collections of such in-frame fusion polynucleotides can vary in the percentage of fusion polynucleotides that contain upstream and downstream polynucleotides that are in-frame with respect to one another. The percentage in the total collection is at least 10% and can number 10%, 11%, 12%, 13%, 14%, 15%, 20%, 25%, 30%, 35%, 40%, 45%, 50%, 55%, 60%, 65%, 70%, 75%, 80%, 85%, 90%, 95%, 96%, 97%, 98%, 99% or 100% or any number in between.

Figure 1:
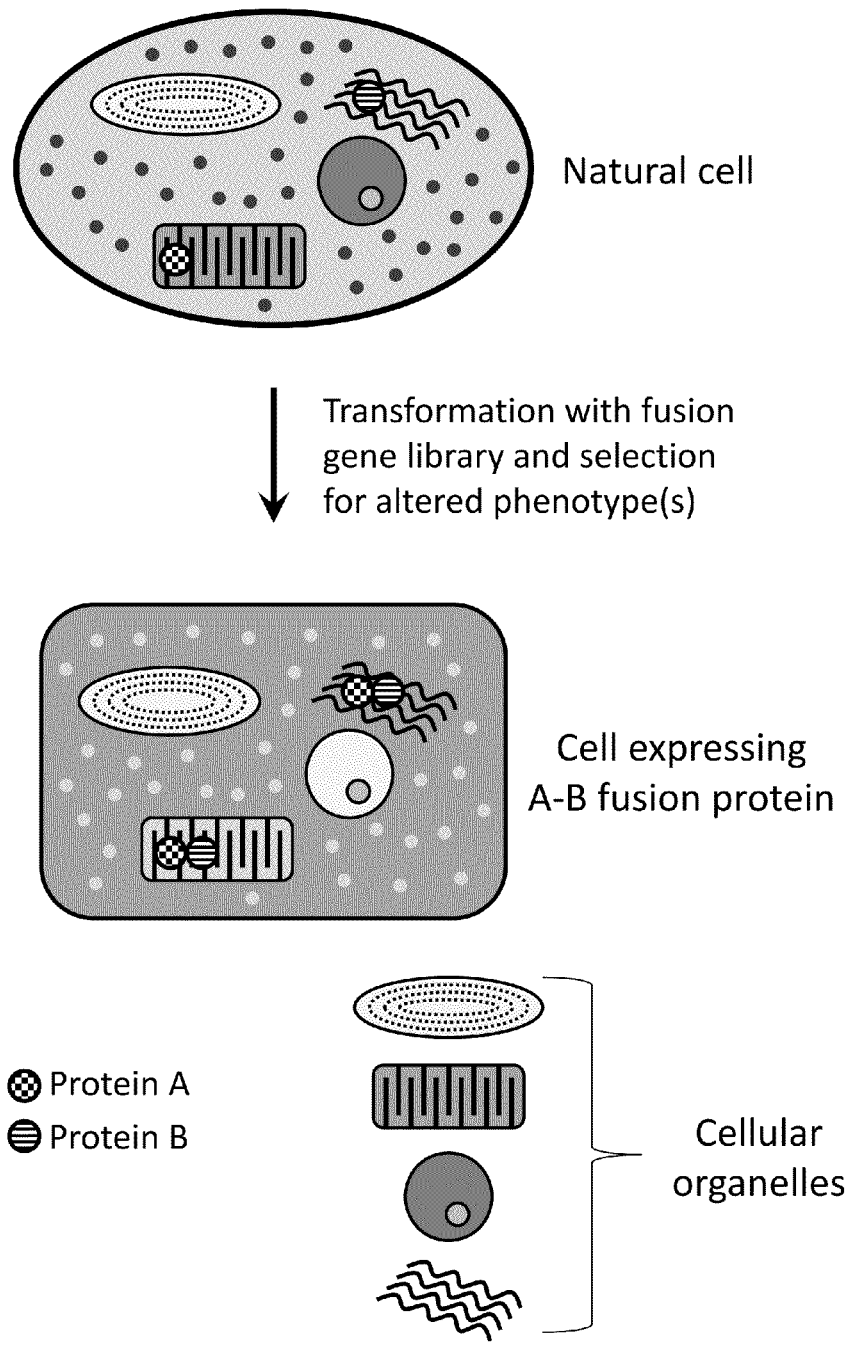
FIG. 1: Illustration of a change of phenotype of a cell expressing a randomized in-frame fusion polynucleotide. A natural cell (top of diagram) expresses two hypothetical proteins, protein A and protein B (shown as small round objects, see the legend at the bottom of the figure) which in this example are localized to different parts of the cell and have different functions. A population cells is transformed with a library of randomized in-frame fusion polynucleotides, and variants of the cell are selected that have altered phenotypes. In this particular example, the cell with altered properties expresses a polynucleotide encoding a randomized fusion between protein A and protein B (cell expressing A-B fusion protein at the bottom of the diagram). The randomized fusion protein is present at the subcellular location normally occupied by protein A as well as the one normally occupied by protein B. As a result, the cell expressing the randomized fusion protein has altered properties, depicted in this schematic diagram by changes in cell shape, shading and changes in the organelles.
Figure 2:
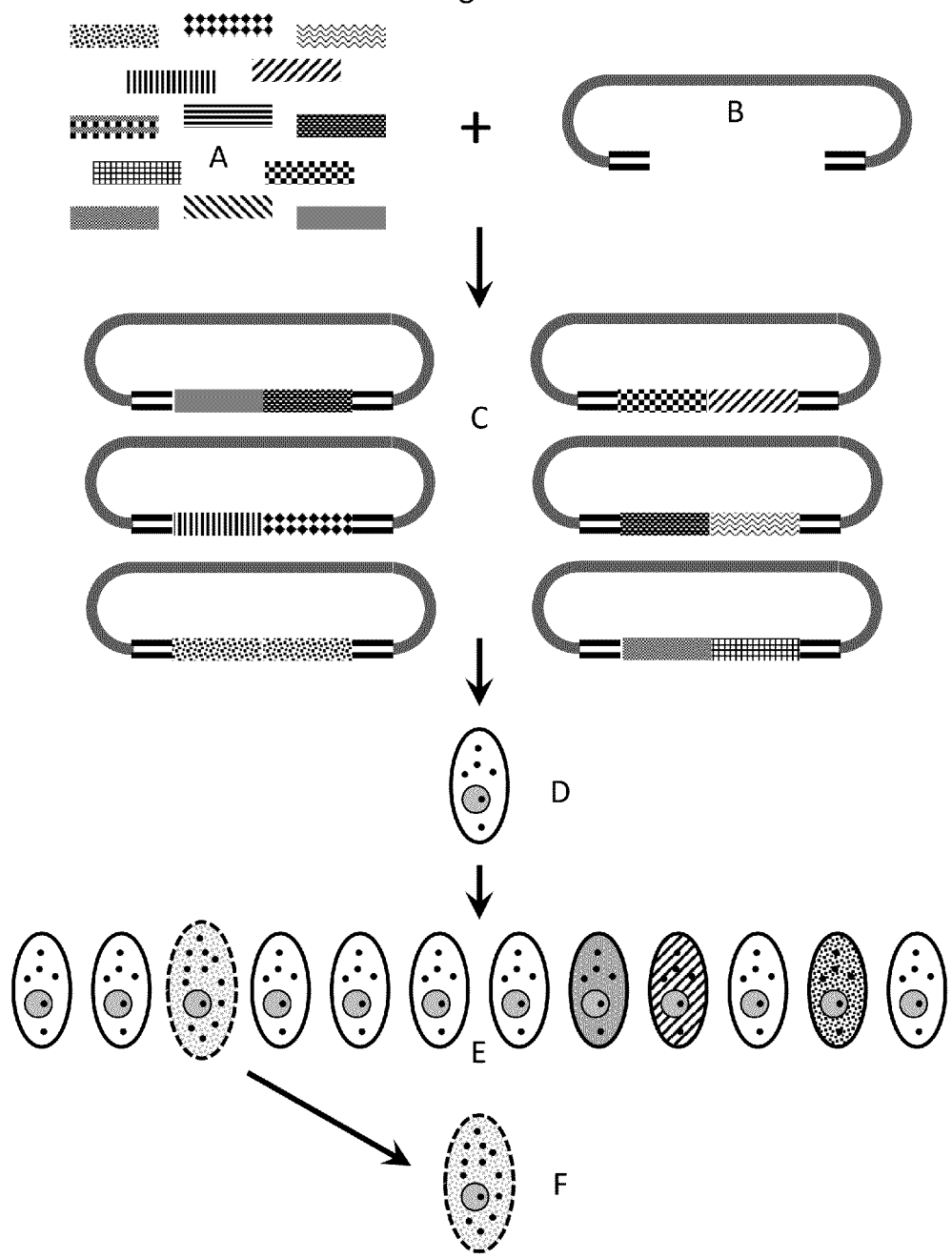
FIG. 2: Example of randomizing a collection of ORFs into randomized in-frame fusion polynucleotides and using these to alter an organism phenotypically. A collection of ORFs (A) is combined with a vector DNA molecule (B) in a manner that ORFs are combined in a randomized pairwise fashion, resulting in a large collection of randomized fused ORFs (C). The vector molecule in this example contains sequences mediating expression of the ORFs (double lines). The collection of randomized in-frame fusion polynucleotides is introduced into an organism (D), and transformants are isolated (E), some of which have altered phenotypes. Modified organisms with phenotypes of interest are isolated from this population (F). The randomized fusion polynucleotides expressed in transformants with altered phenotypes can be re-isolated and validated by re-transformation into the original cell population (not shown in this diagram).

A collection of ORFs is generated as separate DNA fragments, or separate sequences on larger DNA fragments. A library of randomized in-frame fusion polynucleotides is then generated from one or more collections or pools of polynucleotides encoding ORFs by combining two or more random polynucleotides, or fragments thereof, in a manner such that the combined polynucleotides can be expressed in the target cell as a randomized in-frame fusion peptide or polypeptide. The library of randomized in-frame fusion polynucleotides is generated in a fashion that allows many or all of the possible sequence combinations to be formed. The library is then introduced into an organism and allowed to express. The resulting collection of organisms expressing the randomized in-frame fusion polynucleotides is selected or screened for desirable phenotypes or characteristics. The polynucleotides responsible for the changes in the properties of a specific transformant can be recovered and used repeatedly. The general concept of this approach is illustrated in FIG. 2. As an example, all polynucleotides encoded by an organism can be used in the construction of the randomized in-frame fusion polynucleotide library. In the case of the laboratory bacterium $E.\ coli$, for example, every one of the 5,286 proteins encoded by $E.\ coli$ can be the initial collection of ORFs used to make the randomized in-frame fusion polynucleotide library. The randomized in-frame fusion polynucleotide library thus contains a very high number of polynucleotide combinations ($5,286 \times 5,286 = 2.8 \times 10^7$ total combinations), and the presence of novel functions within this combinatorial set of polynucleotides is consequently high.

The polynucleotides used to make up the initial set of ORFs, or fragments thereof, can be from any source (genome, metagenome, cDNA, etc) and can be any subset of polynucleotides from such a source, selected by sequence composition, function or other criteria. The method can thus be tailored to capture specific biochemical functions, or functions from specific source organisms or source environments. The invention disclosed herein is therefore very flexible in the manner in which novel polynucleotide functions and phenotypes can be created.

The polynucleotides used to make up the initial set of ORFs will consist of sequences that are primarily non-homologous and distinct from one another, as opposed to ORFs that share extensive sequence homology. The term "non-homologous" in this invention is defined as having sequence identity at the nucleotide level of less than 50%.

Percentage of sequence identity: The term "percent sequence identity" refers to the degree of identity between any given query sequence, e.g. SEQ ID NO: 102, and a subject sequence. A subject sequence typically has a length that is from about 80 percent to 200 percent of the length of the query sequence, e.g., 80, 82, 85, 87, 89, 90, 93, 95, 97, 99, 100, 105, 110, 115, or 120, 130, 140, 150, 160, 170, 180, 190 or 200 percent of the length of the query sequence. A percent identity for any subject nucleic acid or polypeptide relative to a query nucleic acid or polypeptide can be determined as follows. A query sequence (e.g. a nucleic acid or amino acid sequence) is aligned to one or more subject nucleic acid or amino acid sequences using the computer program ClustalW (version 1.83, default parameters), which allows alignments of nucleic acid or protein sequences to be carried out across their entire length (global alignment, Chema 2003).

ClustalW calculates the best match between a query and one or more subject sequences, and aligns them so that identities, similarities and differences can be determined. Gaps of one or more residues can be inserted into a query sequence, a subject sequence, or both, to maximize sequence alignments. For fast pairwise alignment of nucleic acid sequences, the following default parameters are used: word size: 2; window size: 4; scoring method: percentage; number of top diagonals: 4; and gap penalty: 5. For multiple alignment of nucleic acid sequences, the following parameters are used: gap opening penalty: 10.0; gap extension penalty: 5.0; and weight transitions: yes. For fast pairwise alignment of protein sequences, the following parameters are used: word size: 1; window size: 5; scoring method: percentage; number of top diagonals: 5; gap penalty: 3. For multiple alignment of protein sequences, the following parameters are used: weight matrix: blosum; gap opening penalty: 10.0; gap extension penalty: 0.05; hydrophilic gaps: on; hydrophilic residues: Gly, Pro, Ser, Asn, Asp, Gln, Glu, Arg, and Lys; residue-specific gap penalties: on. The ClustalW output is a sequence alignment that reflects the relationship between sequences. ClustalW can be run, for example, at the Baylor College of Medicine Search Launcher website and at the European Bioinformatics Institute website on the World Wide Web (ebi.ac.uk/clustalw).

To determine a percent identity of a subject or nucleic acid or amino acid sequence to a query sequence, the sequences are aligned using Clustal W, the number of identical matches in the alignment is divided by the query length, and the result is multiplied by 100. It is noted that the percent identity value can be rounded to the nearest tenth. For example, 78.11, 78.12, 78.13, and 78.14 are rounded down to 78.1, while 78.15, 78.16, 78.17, 78.18, and 78.19 are rounded up to 78.2.

The ORFs in the starting collection can number at least 5 or higher, including at least 5, 6, 7, 8, 9, 10, 15, 20, 30, 40, 50, 100, 200, 300, 400, 500, 1000, 2000, 3000, 4000, 5000, 10000, 20000, 30000, 40000, 50000, 100000, 200000, 300000, 400000, 500000, 1000000 or higher. The number of randomized fusion polynucleotides in the library typically equals at least the number of ORFs in the starting collection and can be as many as the square of the number of ORFs in the starting collection, which would be the expected number of all possible polynucleotide combinations, assuming that each ORF is present in both possible positions (5' and 3') and in combination with each other ORF. The number of randomized in-frame fusion polynucleotides in a library generated from fragments of ORFs would be expected to have an even greater number of combinations.

The ORFs in the starting collection can be derived from a single organism or from multiple organisms. The source of the ORFs includes but is not limited to: random pieces of genomic DNA or amplified genomic DNA from any virus, bacterium, archaeon, prokaryote, eukaryote, protozoan, yeast, fungus, animal, alga or plant or mixed population thereof; bacterial ORFs present as complete or partial collections or pools of protein-coding sequences derived from the genomes of one or more bacteria, archaea or other prokaryote; collections of cDNAs present as individual clones or pools of protein-coding sequences from bacteria, archaea, any prokaryote or any eukaryotic organism; randomized or partially randomized oligonucleotides; partially or fully random DNA sequences derived from randomized oligonucleotides by amplification.

The ORFs in the starting collection can comprise the entire collection of ORFs from an organism's genome, or a fraction thereof. The ORFs in a collection or pool can be pre-selected based on known function, sequence composition, sequence content, sequence homology, amino acid composition of the encoded proteins, amino acid content of the encoded proteins, sequence homology of the encoded proteins, length, presence of specific motifs, charge, hydrophobicity, isoelectric point, 3-dimensional structure or fold, ability to associate with other proteins, or any other property.

The ORFs in the starting collection can contain natural sequences or mutagenized sequences, including known variants of certain polynucleotides known to have a gain or loss of function, or an altered function. They can also contain degenerate sequences or sequences altered by mutagenesis. Degenerate sequences in this case are defined as populations of sequences where specific sequence positions differ between different molecules or clones in the population. The sequence differences may be in a single nucleotide or in multiple nucleotides of any number, examples being 2, 3, 4, 5, 6, 7, 8, 9, 10, 20, 30, 40, 50, 60, 70, 80, 90, 100, 200, 300, 400, 500, 600, 700, 800, 900 or 1000 nucleotides. Multiple, degenerate nucleotides may be adjacent or separated by constant or fixed sequences that are not degenerate. Sequence differences in a degenerate sequence may involve presence of 2, 3 or 4 different nucleotides in that position within the population of sequences, molecules or clones. Examples of degenerate nucleotides in a specific position of a sequence are: A or C; A or G; A or T; C or G; C or T; G or T; A, C or G; A, C or T; A, G or T; C, G or T; A, C, G or T.

The ORFs in the starting collection can be free of introns, such as the ORFs typically found in prokaryotes, or they may contain introns as are typically found in the ORFs of eukaryotes.

The ORFs in the starting collection can be derived from PCR fragments, PCR fragment pools, cDNAs, random pieces of genomic DNA, synthetic DNA, cloned DNA, DNA isolated directly from source organisms or from the environment, or from any other source, or any combination of sources.

The ORFs in a starting collection can be added in molar amounts corresponding to the concentrations of other ORFs, or in lower or higher amounts that change their representation within the final randomized in-frame fusion polynucleotide library. For example, if a polynucleotide coding for a specific protein conferring a desirable phenotype is suspected to have a particularly high chance of conferring that phenotype in a target organism, it is possible to over-represent this sequence in the ORF collection to ensure that most or all polynucleotide fusion combinations are tested in combination with the prioritized sequence.

The randomized in-frame fusion polypeptides can be designed in a manner that the ORFs are fused directly to each other, without any sequence inserted between the final codon of the upstream (5')ORF and the first codon of the downstream (3') ORF (or the other way around). Alternatively, the randomized in-frame fusion polypeptides are designed to have sequence insertions that encode additional amino acids between the two ORFs. These sequence insertions can range between 3 and 3000 nucleotides in length, and encode "linker" peptide or polypeptide sequences that are suitable for separating the two parts of the randomized fusion polynucleotide. Small amino acids, such as glycine, alanine, serine, proline, threonine, aspartic acid or asparagine are suitable for linker peptides because they tend to form flexible and unstructured domains, or alpha-helical domains lacking bulky side groups, that allow separation between the two parts of the encoded randomized fusion polypeptide and that allow each part of the encoded randomized fusion polypeptide to move independently relative to the other. Accordingly, sequence insertions separating the two fused ORFs may contain codons specifying these amino acids. Alternatively, the linker peptide sequence may be designed to contain a specific secondary structure, such as an alpha helix, beta sheet, coiled coil or turn, or combinations thereof, that permit the two domains of the encoded randomized fusion polypeptide to be separated by a specific structure or combinations of specific structures.

Each ORF can contain conserved 5' and 3' flanking sequences that match those at the 5' and 3' ends of other ORFs in the starting collection. These sequences are not part of the natural ORF and allow the ORFs to be amplified, cloned, isolated, and/or joined to other ORFs or to pieces of vector DNA. The conserved 5' and 3' flanking sequences can contain restriction sites, recombination sites, or any other sequence that permits specific joining to other ORFs, to vector sequences, or other sequences aiding in the transfer into an organism, replication within that organism, stability in that organism, or expression within that organism.

The ORFs in the starting collection can be full-length ORFs or partial ORFs and can range in size from 15 nucleotides to 100,000 nucleotides.

The ORFs in the starting collection can be configured to allow them to be placed at the 5' end of the resulting randomized in-frame fusion polynucleotide, or at the 3' end, or randomly at either end. The conserved sequences at the ends of the ORFs can be designed to allow such specific or non-specific placement. The library of randomized in-frame fusion polynucleotides may contain the same collection of ORFs at the 5' end as at the 3' end, or distinct collections of ORFs at each end.

The randomized polynucleotide fusion polynucleotides can be generated by a variety of methods for joining or cloning DNA molecules known to those skilled in the art including, but not limited to, traditional cloning using restriction enzymes and DNA ligase (ligation-dependent cloning), agarose gel-free cloning, ligation-independent (or ligation-free) cloning, site-specific recombination, homology-dependent cloning, recombinational cloning, homology-dependent end joining, annealing of single-stranded ends, linker tailing, topoisomerase-catalyzed cloning, enzyme-free cloning, and others. "Joining nucleic acid molecules" as used herein refers to any method that results in the molecules being operably linked at room temperature. Such methods include, but are not limited to, covalent linkage (ligation), annealing of complementary strands of nucleic acid molecules and other ways of associating two or more nucleic acid molecules.

In a specific embodiment of the invention, homologous sequences at the ends of the 5' and 3' polynucleotides to be joined can be used to direct or mediate the joining event. A large number of methods exist that can be used to accomplish such homology-dependent assembly (Lobban 1973), including linked tailing (Lathe 1984), In-Fusion cloning (Zhu 2007, Irwin 2012), Sequence and Ligation-Independent Cloning (SLIC, Li 2007, Li 2012), FastCloning (Li 2011), Circular Polymerase Extension Cloning (Quan 2009, Quan 2011), the Gibson assembly method (Gibson 2009, Gibson 2010), Quick and Clean Cloning (Thieme 2011), and others (Vroom 2008).

Randomized in-frame fusion polynucleotides of this sort can impart new functions to an organism and change the organism's phenotype(s) in many different manners. To achieve such a change of phenotype, the library of randomized in-frame fusion polynucleotides is transformed into a target organism. The target organisms can be the source organism of some or all of the polynucleotides, sequences, or ORFs used to make the randomized in-frame fusion polynucleotide library, or it can be a different organism. Target organisms include but are not limited to: *E. coli*, yeast, any species of bacteria, archaea, yeast, fungi, algae, cultured algal cells, insects, nematodes, vertebrates, animals, cultured animal cells, plants, or cultured plant cells. The target organism is generally an organism which is used for specific purposes, including, but not limited to, use in industry or agriculture, or in the production of chemicals, foods, fibers, structural materials, fuels, pharmaceuticals, agrochemicals, dyes, cosmetics or other useful substances.

Transformants of the target organism are generated which express members of the randomized in-frame fusion polynucleotide library. The transformants are be selected or screened for presence of the randomized in-frame fusion polynucleotides encoding the randomized fusion polypeptides, and allowed to express the polypeptides. The population of transformants is then selected or screened for any observable, selectable or measurable phenotype. Such phenotypes include, but are not limited to, changes or alterations in the following properties: growth rate; rate of cell division; generation time; size; color; texture; morphology; population density; productivity; yield; shape; growth habit; composition; metabolism; uptake or utilization of nutrients, minerals, salts, ions, toxins or water; photosynthetic efficiency; sensitivity to or resistance to abiotic stresses such as temperature, osmotic strength, salinity, pH, electromagnetic radiation, organic solvents, oxidation, oxidizing agents, detergents, drought, wind, desiccation, flood, nutrient limitation, starvation, oxygen limitation, light, pressure, compaction, shear or ionizing radiation; tolerance or resistance to biotic stresses such as diseases, pests phages, viruses, infective agents, parasites or pathogens; appearance; reflective properties; fluorescent properties; refractivity; light-transmitting properties; electrical resistance, impedance or conductance; growth in the presence of specific nutrients; binding or adhesive properties; permeability; association or symbiosis with other organisms; pathogenicity; physical properties such as density, strength, hardness, brittleness, flexibility, rigidity, turgor pressure, electrical impedance, electrical resistance, electrical conductivity, magnetism, permeability, viscosity, color, texture or grain; behavior; response to environmental stimuli; expression of a polynucleotide; activity of an enzyme; rates of genetic or epigenetic change or mutation; ability to take up and/or integrate homologous or heterologous nucleic acid sequences; phenotypic diversity of a population; ability to be stained by dyes or compounds eliciting a change in color; resistance to antibiotics or toxins; resistance to penetration; quality of or production of products such as food, feed, fuel, fiber, structural materials, pharmaceutical compounds, cosmetics, dyes, chemicals, proteins, lipids, nucleic acids, fertilizers, or combinations thereof, or precursors thereof, or feedstocks for the production thereof.

Organisms expressing one or more specific randomized in-frame fusion polynucleotides can be re-transformed with the same library of randomized in-frame fusion polynucleotides, a similar library, or a different library, and the process of selecting or screening for altered properties of the organism repeated. In this manner, an iterative approach of transformation, selection, re-transformation, re-selection, etc. can be used to continue altering properties or phenotypes of the organism.

A randomized in-frame fusion polynucleotide can also be re-isolated from an organism transformed with the randomized in-frame fusion polynucleotide. The re-isolation can be done using any of a number of methods including, but not limited to, PCR amplification ad plasmid rescue (Ward 1990) followed by plasmid transformation into a laboratory organisms such as *E. coli*. After re-isolation, it is possible to re-transform the randomized in-frame fusion polynucleotide into the same organism and/or a different organism to confirm that the randomized in-frame fusion polynucleotide reproducibly confers the same phenotype in repeated experiments.

An organism expressing a randomized in-frame fusion polynucleotide and having an altered phenotype as a result of the randomized in-frame fusion polynucleotide can be used as a starting point for further phenotypic changes by transforming this organism again with a library of randomized in-frame fusion polynucleotides. The library of fusion polynucleotides in the second round of improvement can be the same library that was used to generate the organism with an altered phenotype, or it can be a different library. Such iterative rounds of transformation of an organism with randomized in-frame fusion polynucleotide libraries and selection for phenotypes can result in multiple phenotypic changes, or phenotypic changes that are more profound than can be achieved with a single round of transformation and selection.

In another embodiment of this invention, a collection of organisms transformed with a library of randomized in-frame fusion polynucleotides is selected or screened for alterations in the expression of polynucleotide sequences, either homologous to the organism or heterologous, compared to control organisms transformed with empty vector sequences. In this manner, for example, it is possible to obtain a phenotype of promiscuous expression, by which many polynucleotide sequences are expressed that would ordinarily not be expressed. Such a phenotype is useful for isolating novel genetic or biochemical pathways, or transferring novel genetic or biochemical pathways into a heterologous organism. Alternatively, this approach enables a phenotype of promiscuous repression, by which many polynucleotide sequences that are normally expressed are reduced in expression or are silent. Alternatively, it is possible to activate or deactivate transposons naturally present in the genome.

In another embodiment of this invention, a collection of organisms transformed with a library of randomized in-frame fusion polynucleotides is selected or screened for altered rates of genomic or genetic changes. These genomic and genetic changes include but are not limited to: point mutations; sequence insertions, deletions, or inversions; repeat copy number variation; chromosomal translocations; chromosome crossovers; gene conversion; alterations in the distribution, prevalence, position or expression of transposons; uptake of foreign nucleic acid sequences; integration of foreign nucleic acid sequences; or combinations thereof resulting in complex sequence changes and genome rearrangements. Such evolver phenotypes conferred by specific randomized in-frame fusion polynucleotides may be useful for generating organisms with high rates of evolution and an increased genetic and phenotypic diversity of organisms, or for generating organisms suitable for the introduction of targeted genetic changes, or organisms predisposed to a specific type of genetic change.

In yet another embodiment of this invention, a collection of organisms transformed with a library of randomized in-frame fusion polynucleotides is selected or screened for higher yield of a material or compound produced by the organism.

In a further embodiment of the invention, a collection of organisms transformed with a library of randomized in-frame fusion polynucleotides is selected or screened for the absence of genetic checkpoints that limit the growth rate, productivity or other properties of the cell or organism. In particular, this allows isolation of organisms with constitutive production of a material or compound that is naturally produced only in certain physiological or growth states, or is produced at maximal levels only in certain physiological or growth states.

In another embodiment of the invention, a collection of organisms transformed with a library of randomized in-frame fusion polynucleotides is selected or screened for altered activity or specificity of enzymes or biochemical pathways expressed by the cell.

In a still further embodiment of the invention, the collection of randomized in-frame fusion polynucleotides is made by randomly fusing one or a small number of polynucleotides of interest with a larger collection of polynucleotides. In this manner it is possible to create a collection of variants or mutants of the polynucleotides of interest, which can be screened for specific properties. In particular, in this manner it is possible to screen for enzymes with higher activity, altered activity, altered temperature optimum, altered pH optimum, resistance to high temperatures or extreme pHs, resistance to acids or bases, resistance to desiccation, resistance to organic solvents, resistance to high salt concentrations, resistance to proteases, or other desirable properties of an enzyme.

EXAMPLES

Example 1

Isolation of Randomized in-Frame Fusion Polynucleotides Capable of Conferring Stress Tolerance to *Escherichia Coli*

Bacterial Strains and Genomic DNA Preparation:

A complete collection of *E. coli* ORFs is generated based on the reference sequence of *E. coli* strain K-12 MG1655 (available on the internet via the genome section of the University of Wisconsin website). This strain is available from the American Type Culture Collection (ATCC), and is used as a source of high-purity genomic DNA from which ORFs of interest are amplified. A sequence annotation of this genome is used to identify the start and stop codons of each ORF. For example, one particular annotation prepared by the J. Craig Venter Institute (available from the cmr-jcvi website on the internet) lists a total of 5,286 protein-coding ORFs, including both verified and hypothetical protein-coding genes, ranging in size from 93 bp (encoding 31 amino acids) to 7152 bp (encoding 2384 amino acids).

Figure 4:
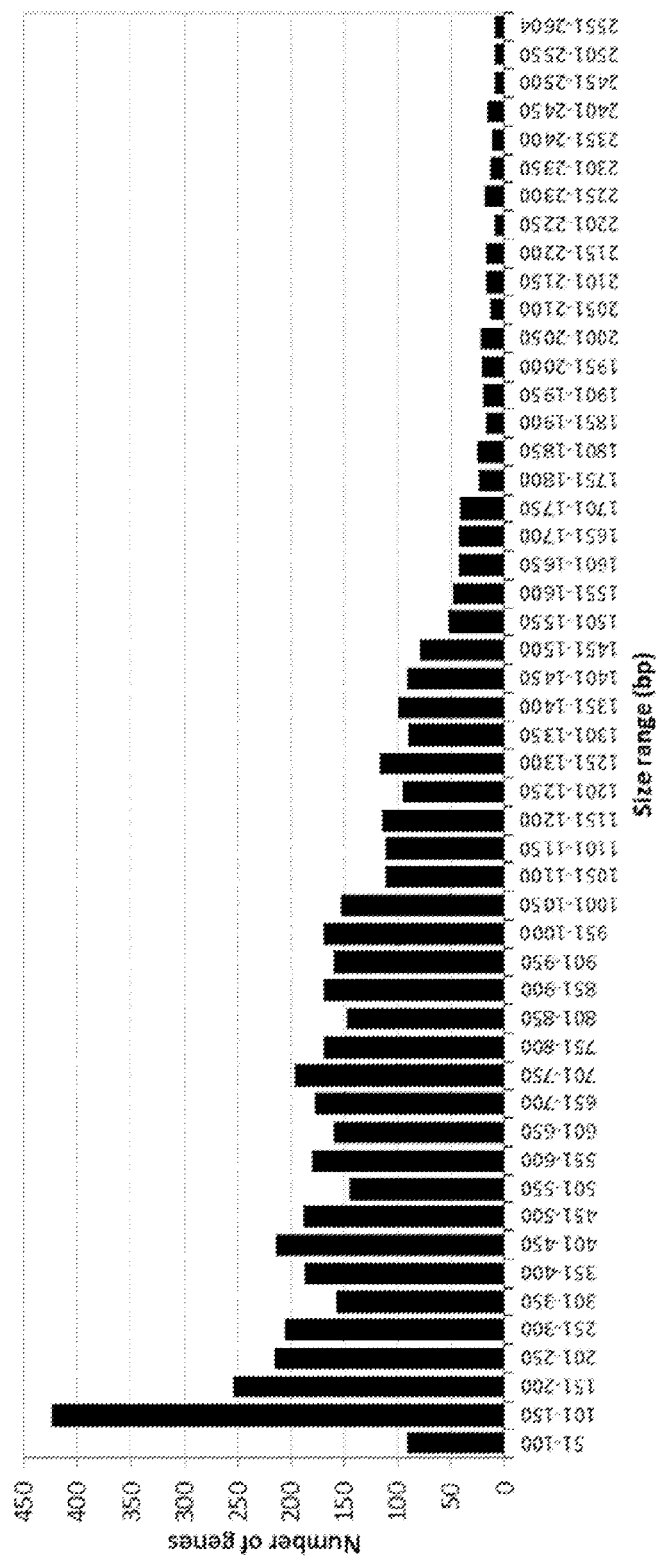
FIG. 4: Size distribution of selected *Escherichia coli* genes, 93-2604 bp in length, used as a starting collection of sequences for a randomized in-frame polynucleotide fusion library.

The length of genes used as input sequences is capped at 2604 bp, which increases the likelihood of successful PCR amplification and correct folding of the resultant in-frame fusion polypeptides or proteins. The result is a final collection of verified and uncharacterized ORFs for a total of 5095 ORFs for PCR amplification. The average length of this sequence collection is 791 bp and the median length is 711 bp. The size distribution of these *E. coli* ORFs is shown in FIG. 4.

When screening for polynucleotides conferring specific phenotypes in *E. coli*, it may be advantageous to include polynucleotides with known roles in the phenotypes of interest in the collection of ORFs to be screened. Examples include polynucleotides known to be involved in stress tolerance in organisms whose genomes have been sequenced. The current collection of sequenced microbial genomes includes a large number of thermophiles which may be a good source of chaperonins, heat-shock proteins or other stress-tolerance polynucleotides that confer stress-tolerance to other organisms and in combination with other ORFs.

The bacterial strain that serves as the source of ORFs is grown in liquid culture, cells are pelleted by centrifugation and then resuspended in 1/10 of the original culture volume using 20 mM Tris pH 8.0, 10 mM EDTA and 100 mM glucose. The cells are lysed by adding 1/100 volume 10 mg/ml hen egg lysozyme dissolved in 10 mM Tris pH 8.0, 10 mM EDTA and adding 1/20 volume 10 mg/ml DNA-se free RNAse A, mixing well and incubating at room temperature for 15 minutes. Cell lysis and release of genomic DNA is completed by treatment with proteinase K. To the lysed cells is added 1/10 volume of 1M Tris, 0.5M EDTA, pH 9.5 and 1/100 volume of a 20 mg/ml solution of proteinase K. The lysed cells are mixed gently by capping the tube and inverting it, and the mixture is incubated at 50° C. for 2 hours with occasional gentle mixing. The DNA is then extracted twice with an equal volume of phenol-chloroform (pH 7.0) followed by one additional extraction with an equal volume of chloroform. The DNA is precipitated by the addition of 1/10 volume 3M sodium acetate pH 5.5 and 2.5 volumes ethanol (or 1 volume isopropanol). The tube is immediately inverted after addition of the alcohol, and the DNA is visible as a stringy white precipitate. To avoid co-precipitating other impurities from the cell (residual protein or carbohydrates), the precipitated DNA is removed from the alcohol solution using a clean pipet tip or a pasteur pipet and is transferred to a clean tube containing 70% ethanol. The tube is capped and inverted multiple times to remove salts from the DNA precipitate. The pellet is collected by centrifugation, the ethanol removed by aspiration and the pellet is dried in an air flow hood to remove excess ethanol. The pellet is dissolved in 1×TE (10 mM Tris pH 8.0, 0.1 mM EDTA). Further purification of the DNA can be performed using column chromatography or cesium chloride density centrifugation (Sambrook 1989).

Expression Vectors

Figure 3:
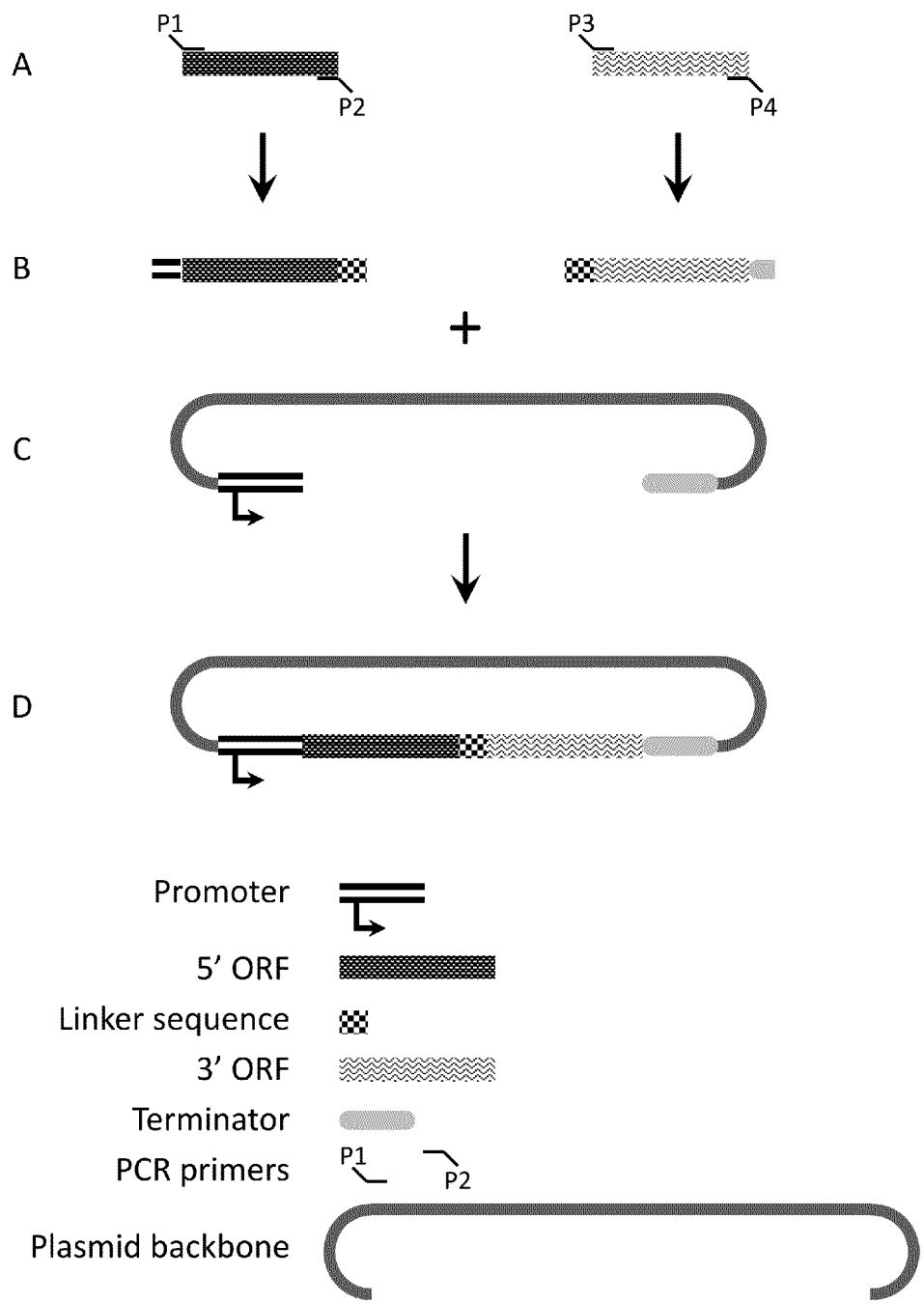
FIG. 3: Example of assembling two ORFs into an expression vector in a single step by homology-dependent cloning. A 5' ORF and a 3' ORF (A) are PCR amplified using sequence-specific primers (P1, P2, P3, P4). Each primer contains extra sequences at its 5' end that specifies homology to sequences in the other ORF or in the vector, corresponding to the order in which the fragments are to be assembled (see B). The PCR-amplified ORFs (B), containing the sequences homologous to each other and to the cloning vector (C) are combined with the cloning vector and assembled into a final construct (D) by allowing the regions of homology between the three fragments to direct each fragment into the correct position and orientation. For simplicity, the figure shows only a single 5' ORF and a single 3' ORF, but the same method will work with mixtures containing any number of ORFs.

A simple and standard expression vector is used to express all fusion proteins. The *E. coli* lac promoter/operator is present on most standard cloning vectors and is capable of high-level expression of heterologous polynucleotides in the presence of lactose or lactose analogs. The pUC19 vector (Vieira 1982) is a convenient source of a plasmid backbone (pMB 1 replicon), an antibiotic-resistance polynucleotide (e.g. β-lactamase from Tn3 conferring ampicillin resistance) and the *E. coli* lac promoter/operator and terminator sequences. These sequences are PCR amplified from pUC19 and used as a source of the plasmid backbone for cloning and expression of randomized in-frame fusion polynucleotides as illustrated in FIG. 3. For example, the PCR primers listed in SEQ ID NO: 25124 and SEQ ID NO: 25125 can be used to PCR amplify such a fragment from pUC19 to result in a 2391 bp linear vector fragment (SEQ ID NO: 25126). The regions of homology to this expression vector fragment that are included in the 5' end of the 5' ORF and in the 3' end of the 3' ORF (see FIG. 3) share homology with the ends of this vector sequence (SEQ ID NO: 25126).

As an alternative to the lac promoter system for expression of randomized in-frame fusion polynucleotides, other *E. coli* promoters can be used, such as the cycG promoter (Belyaeva 1992), the Tn3 β-lactamase promoter, the $P_{spc}$ ribosomal protein promoter or the phage lambda $P_L$ and $P_R$ promoters (Liang 1999, Menart 2002). The promoter of the stress-inducible *E. coli* psp operon (Brisette 1990, Brisette 1991, Weiner 1991, Weiner 1995, Jovanovic 1996, Model 1997, Beekwilder 1999) may be particularly suited for expression of randomized in-frame fusion polynucleotides under conditions of abiotic stress, when constitutive promoters dependent on vegetative cell growth may be not be very active. Alternatively, synthetic promoters can be developed from partially randomized sequences containing the consensus elements for bacterial expression (Jensen 1998a, Jensen 1998b, Hammer 2006, De May 2007).

To test a candidate promoter for suitability for the expression of randomized in-frame fusion polynucleotides, the selected promoters and their associated 5'UTRs are synthesized as 250 bp DNA fragments and cloned upstream of the lacZ a fragment in a high-copy plasmid such as pUC19. *E. coli* terminators are placed upstream of the promoter fragments to prevent read-through transcription from promoters present elsewhere on the plasmid. The resulting constructs are tested in *E. coli* for their ability to confer a blue colony color phenotype in the presence of the chromogenic substrate X-Gal, which is indicative of expression of the lacZ a fragment.

The plasmids described here for expression of randomized in-frame fusion polynucleotides are based on high-copy number plasmids such as those containing the pMB 1 origin of replication. However, other plasmid systems are also suitable for this work. For example an F'-based plasmid such as pBeloBAC11 (Shizuya 1992) can be used to express randomized in-frame fusion polynucleotides using the same promoters as described above, or using a different set of promoters.

Fusion Gene Structure and ORF Amplification Strategy:

Two different sets of primers are designed for each ORF, one for cloning the ORF into the 5' position of the randomized in-frame fusion polynucleotide and the other for placing it 3'. The primers are designed to contain 15-100 bases of conserved sequence at their 5' ends. This conserved sequence is homologous to sequences at the ends of the other ORF they will be paired with, or to the ends of the vector sequences. This sequence homology is illustrated in FIG. 3. Because each ORF is to be placed at both the 5' and the 3' position in combination with all the other ORFs, two different PCR amplicons are generated for each ORF, one destined for the 5' position and the other for the 3' position (see FIG. 3).

For example, a hypothetical polynucleotide sequence A, coding for a peptide or protein, can be part of a starting collection of polynucleotides intended to be used for the construction of a collection of randomized in-frame fusion polynucleotides. The goal of generating the collection of randomized in-frame fusion polynucleotides is to have each polynucleotide in the starting collection, including polynucleotide A, present at the 5' position of a series of randomized in-frame fusion polynucleotides, and to have the same sequence present in the 3' position of a different series of randomized in-frame fusion polynucleotides. In each of these two series of randomized in-frame fusion polynucleotides, the polynucleotide A will be fused with as many other members of the starting collection as feasible with the available methods for generating such fusions. In order to enable these separate series of fusions, with polynucleotide A in a 5' or in a 3' position with respect to the other polynucleotides present in the starting collection, two different versions of the polynucleotide sequence A are generated. The version of polynucleotide sequence A intended for use in the 5' position will not contain a stop codon and will have 5' homology (or other sequence compatibility for cloning purposes) to the promoter region of the expression vector. The version of polynucleotide sequence A intended for use in the 3' position will contain a stop codon and will have 3' homology (or other sequence compatibility for cloning purposes) to the terminator region of the expression vector.

The sequence separating the two ORFs in a randomized in-frame fusion polynucleotide (labeled as 'linker sequence' in FIG. 3) encodes a short peptide that is rich in glycine and serine residues. Such a peptide is expected to be unstructured and will provide a flexible protein spacer separating the two members of a randomized fusion protein while being relatively resistant to proteolysis. Examples of suitable linker peptide sequences are GGGGSGGSGGSGGGGS (SEQ ID NO: 25117) or SGGSSAAGSGSG (SEQ ID NO: 25118) or SAGSSAAGSGSG (SEQ ID NO: 25119, Wang 2010). Alternatively, alpha-helical linker sequences can be used, for example the sequence A(EAAAAK)$_n$A, n=2-5 (SEQ ID NOS: 25120 to 25123, Arai 2001).

Each primer contains 16 bases of conserved sequence at the 5' end that serves two purposes. First, the extra sequence allows efficient PCR amplification of pools of ORFs using conserved PCR primer sequences that are able to amplify all the ORFs in a collection without biasing the representation of different ORFs with respect to one another (Dahl 2005, Myllykangas 2011, Natsoulis 2011). Second, they contain homology to the expression vector (a derivative of the cloning and expression vector pUC19 (Vieira 1982, SEQ ID NO: 25126) and to the conserved sequences at the ends of the randomized in-frame fusion polynucleotide partner, enabling rapid and efficient, homology-dependent assembly of the randomized in-frame fusion polynucleotides in the vector (see FIG. 3). The two amplicons for each ORF only differ in the presence of a stop codon (occurring only in the ORFs destined for the 3' position of the randomized in-frame fusion polynucleotide library) and in their conserved flanking sequences.

The conserved sequence added to all 5' PCR primer of ORFs destined for the 5' position in a fusion gene is GCTGGATCCTGCTAGC (SEQ ID NO: 25127). The conserved sequence added to all 3' PCR primer of ORFs destined for the 5' position in a fusion gene is CAGGAGCTGCACTTCC (SEQ ID NO: 25128). The conserved sequence added to all 5' PCR primer of ORFs destined for the 3' position in a fusion gene is TGGAAGTGGTTCAGGA (SEQ ID NO: 25129). The conserved sequence added to all 3' PCR primers of ORFs destined for the 3' position in a fusion gene is CTACTCGAGACTGCAG (SEQ ID NO: 25130).

The 5'-terminal 16 nucleotides in the 3' PCR primer of ORFs destined for the 5' position in a fusion gene, and the 5'-terminal 16 nucleotides in the 5' PCR primer of ORFs destined for the 3' position in a fusion gene, form part of a linker sequence that separates the two ORFs. This 60 bp linker sequence, (SEQ ID NO: 25103), encodes a 20 amino acid peptide (SEQ ID NO: 25104) rich in glycine, serine and alanine, which is loosely based on sequences used by others when connecting two ORFs in a fusion gene (Arai 2001, Eldridge 2009, Wang 2010). This linker sequence is fully encoded in the second or conserved stage of PCR amplification (see below), resulting in the addition of conserved coding sequences to the 3' ends of the ORFs destined for the 5' position of the randomized in-frame fusion polynucleotides and the 5' end of the ORFs destined for the 3' position in the randomized in-frame fusion polynucleotides.

Because two entire sets of *E. coli* ORFs need to be generated, one for the 5' position in the fusion genes and the other for the 3' position, all procedures described below are performed in duplicate for the two ORF positions.

Sequence Amplification:

Each ORF is PCR amplified with polynucleotide-specific primers containing 20-30 polynucleotide-specific bases at the 3' end and the conserved sequences at the 5' ends. The amplification is performed for each polynucleotide individually, or for pools of polynucleotides simultaneously.

For individual amplification, the two primers, each at a final concentration of 0.5-5 µM, are combined with 10-1000 ng of *E. coli* genomic DNA, PCR buffer and thermostable polymerase in a total reaction volume of 1-50 µl. A high-fidelity thermostable polymerase such as Phusion® polymerase can be used. For Phusion® polymerase, the PCR amplicons are generated by 2 minutes denaturation at 95° C. followed by 10-35 cycles of 20 seconds at 95° C., 20 seconds at 60° C. and 1 min/kb at 72° C. (minimally 30 seconds at 72° C.). The efficiency of formation of the PCR product is measured by agarose electrophoresis or by fluorescent spectroscopy using a fluorometer such as a Qubit® fluorometer (Life Technologies). Successful PCR reactions can be purified using silica resins suitable for DNA purification. Unsuccessful reactions are repeated by varying the $Mg^{+2}$ concentrations in the PCR reaction and/or other reaction conditions. Following successful amplification of each ORF, the concentration of each PCR product is normalized, and products corresponding to specific size ranges are pooled for cloning.

Individual amplification has the advantage that the amplification of each ORF is performed and monitored separately, allowing approximately equivalent representation of each ORF in the final pool of ORFs. It has the disadvantage that a large number of PCR reactions need to be performed and assayed in parallel, requiring robotics and optimization of a large number of amplifications.

For pooled amplification, ORFs are pooled by size, because the efficiency of PCR amplification is strongly size dependent, and because the PCR conditions (extension time at 72° C., see above) depend on the size of the amplicon. The ORFs are separated into any number of size pools. A smaller number per size pools has the advantage that the amplification can be done in a smaller number of samples, saving time and reagents. A large number of size pools has the advantage that the complexity of each pool is lower, implying higher concentrations of each primer pair and thus a higher likelihood of successful amplification of each polynucleotide. A convenient number of size pools corresponds to the number of wells in one or two 96-well plates. For example, 192 pools of 26-27 ORFs each (192 pools×26.54 ORFs on average=5095 ORFs total; this corresponds to 103 pools containing 27 primer pairs each, and 89 pools containing 26 primer pairs each).

PCR amplification is performed in three steps: 1) an initial amplification using gene-specific primers followed by 2) bulk-up of each ORF pool using conserved primers, followed by further pooling, size selection on gels and 3) a third amplification step resulting in the final length PCR products. The three amplification steps are referred to as $1^{st}$ stage, $2^{nd}$ stage and $3^{rd}$ stage amplifications, respectively.

All PCR amplifications are performed using Phusion™ Hot Start II thermostable high-fidelity polymerase (Thermo Scientific™). The enzyme is supplied with a 5×HF amplification buffer which is used for all reactions. Amplifications are performed in 20 μL or 50 μL reaction volumes, as noted below. All amplifications are performed on T100 thermal cyclers (Bio-Rad Laboratories) containing 96-well blocks. The deoxynucleotide triphosphates (dNTPs) used in all amplifications are a stock containing 10 mM of each dNTP, also obtained from Thermo Scientific®. Deionized water is used in all reactions and to make all solutions not supplied with the polymerase.

All PCR amplifications follow the same general procedure:

1. A PCR mix as described below is prepared for each stage of the PCR reaction, and is kept cold until inserted into the thermal cycler.
2. The samples are mixed thoroughly and then centrifuged at 4000 rpm for 1 minute to bring the reaction contents to the bottom of the tube or well in a plate.
3. The plates or tubes are inserted into a thermal cycler.

$1^{st}$ Stage Amplification:

First stage amplifications are conducted using pools of sequence-specific PCR primers as noted above. Each amplification is performed in 20 μL total volume, using 2 μL of 10 ng/μL *Escherichia coli* strain MG1655 genomic template DNA per reaction. To each reaction are added 2.5 μL primer pools from 100 μM stocks to provide a total final primer concentration of 12.5 μM. Each primer pool contains either 26 or 27 primer pairs; and final individual primer concentrations are approximately 0.23-0.24 μM.

The 1st stage PCR reaction mix is set up in 20 μl total volume and is mixed from the following components: 4 μl 5× Phusion® HF Buffer, 0.4 μl 10 mM dNTPs, 10.7 μl deionized $H_2O$, 2 μl 10 ng/μl genomic template DNA, 2.5 μL primer pools (100 μM), 0.4 μl Phusion™ Hot Start II thermostable polymerase (2 units/μl). The PCR cycling conditions are as follows: initial denaturation at 98° C. for 45 sec, 10 cycles consisting of three steps each (98° C. for 10 seconds, 60° C. for 30 seconds and 72° C. for 3 minutes), a final extension step at 72° C. for 3 minutes and a soak at 4° C. until removal of the samples from the thermal cycler. After the PCR amplification is complete, the samples are removed from the thermal cycler, mixed thoroughly, and centrifuged at 4000 rpm for 1 minute to provide the $1^{st}$ Stage amplification product.

$2^{nd}$ Stage Amplification:

The primers used in $2^{nd}$ stage amplifications are single primers with homology to the conserved portions of the $1^{st}$ stage amplification primers. The $2^{nd}$ stage primers are prepared as pairwise mixes, each containing equimolar amounts of the two primers and containing a total primer concentration of 20 μM.

The $2^{nd}$ stage PCR reaction mix is set up in 50 μl total volume and is mixed from the following components: 10 μl 5× Phusion® HF Buffer, 1 μl 10 mM dNTPs, 22 μl deionized $H_2O$, 10 μl $1^{st}$ stage reaction product, 6 μl $2^{nd}$ stage primer mix (20 μM) and 1 μl Phusion™ Hot Start II thermostable polymerase (2 units/μl). The PCR cycling conditions are as follows: initial denaturation at 98° C. for 45 sec, 25 cycles consisting of two steps each (98° C. for 20 seconds and 72° C. for 3 minutes), a final extension step at 72° C. for 3 minutes and a soak at 4° C. until removal from the thermal cycler.

After the PCR amplification is complete, the samples are removed from the thermal cycler, mixed thoroughly, and centrifuged at 4000 rpm for 1 minute.

To allow more efficient downstream processing of the samples, the 192 multiplex PCR samples are consolidated into 24 larger pools by pooling 8 samples into one. The amount of product in each multiplex PCR reaction is first quantitated to allow equimolar pooling of the different sized fragment collections. This is done either by conducting gel electrophoresis on each multiplex reaction and quantitating the fluorescence in each band of expected size, or by capillary electrophoresis, such as an Applied Biosystems® 3730 DNA analyzer or a QIAGEN® QIAxcel® instrument. The concentration of desirable product in each multiplex reaction is used to calculate the relative amounts of each multiplex PCR reaction that are to be pooled together to result in equimolar amounts of each product added to the pool, taking the average size of each multiplex pool into consideration. Products are grouped and pooled by size to minimize amplification biases in downstream PCR amplifications.

The 192 multiplex reactions are combined into 24 larger pools as follows. Large Pool 1: multiplex pools 1-8; Large Pool 2: multiplex pools 9-16; Large Pool 3: multiplex pools 17-24; Large Pool 4: multiplex pools 25-32; Large Pool 5: multiplex pools 33-40; Large Pool 6: multiplex pools 41-48; Large Pool 7: multiplex pools 49-56; Large Pool 8: multiplex pools 57-64; Large Pool 9: multiplex pools 65-72; Large Pool 10: multiplex pools 73-80; Large Pool 11: multiplex pools 81-88; Large Pool 12: multiplex pools 89-96; Large Pool 13: multiplex pools 97-104; Large Pool 14: multiplex pools 105-112; Large Pool 15: multiplex pools 113-120; Large Pool 16: multiplex pools 121-128; Large Pool 17: multiplex pools 129-136; Large Pool 18: multiplex pools 137-144; Large Pool 19: multiplex pools 145-152; Large Pool 20: multiplex pools 153-160; Large Pool 21: multiplex pools 161-168; Large Pool 22: multiplex pools 169-176; Large Pool 23: multiplex pools 177-184; and Large Pool 24: multiplex pools 185-192. The resulting average ORF sizes (with and without added primer sequences) of each Large Pool is calculated based on the sizes of its component ORFs.

Once pooling has been completed, an amount of each ORF Large Pool corresponding to 10 μg of total desirable product are purified using a silica resin column or plate such as the Macherey Nagel NucleoSpin® 96 PCR cleanup kit, following the manufacturer's recommendations. After elution of the purified PCR product, each sample is mixed thoroughly and its concentration determined spectrophotometrically.

To eliminate unwanted size products and primer dimers from the 48 Large Pools, 2 μg of each pool is electrophoresed on a 1% agarose gel and stained with ethidium bromide, the bands visualized under UV or blue light, and gel fragments corresponding to the correct size of each larger pool are excised from the gel. The gel fragments are weighed and DNA is purified from them using silica resin gel purification methods such as the Macherey Nagel NucleoSpin® Gel and PCR clean-up kit, following the manufacturer's recommendations. When the purification is complete, the concentrations of all samples are determined spectrophotometrically, and the concentration of each purified $2^{nd}$ stage Large Pool amplification product is adjusted to 10 ng/μL for $3^{rd}$ Stage Amplification.

$3^{rd}$ Stage Amplification:

The $3^{rd}$ stage amplification adds the final sequences to each PCR product to allow efficient assembly by end homology and to increase the amount of each Large Pool. The primers used in $3^{rd}$ stage amplifications are single primers with homology to the conserved portions of the $1^{st}$ and $2^{nd}$ stage amplification primers. The $3^{rd}$ stage primers are prepared as pairwise mixes, each containing equimolar amounts of the two primers and containing a total primer concentration of 20 μM.

The $3^{rd}$ stage PCR reaction mix is set up in 50 μl total volume and is mixed from the following components: 10 μl 5× Phusion® HF Buffer, 1 μl 10 mM dNTPs, 22 μl deionized H$_2$O, 10 μl gel-purified, pooled $2^{nd}$ stage reaction product (10 ng/μl), 6 μl $3^{rd}$ stage primer mix (20 μM) and 1 μl Phusion® Hot Start II thermostable polymerase (2 units/μl). The PCR cycling conditions are as follows: initial denaturation at 98° C. for 45 sec, 25 cycles consisting of two steps each (98° C. for 20 seconds and 72° C. for 3 minutes), a final extension step at 72° C. for 3 minutes and a soak at 4° C. until removal from the thermal cycler.

After the $3^{rd}$ stage amplification is complete, the samples are mixed thoroughly, centrifuged, and purified using a silica resin purification, such as the Macherey Nagel NucleoSpin® 96 PCR clean-up kit, following the manufacturer's recommendations. After elution, each sample is mixed thoroughly and its concentration is determined spectrophotometrically.

For more efficient downstream processing, the 24 Large Pools are then consolidated into 5 "Superpools", by combining the 4 smallest Large Pools into one Superpool and combining successive sets of 5 Large Pools to form additional Superpools. The relative amounts of each Large Pool added to each Superpool is calculated, by considering the final concentrations of each large pool after $3^{rd}$ stage amplification and purification, and the final average size of each Large Pool (including sequences added by primers), with the goal of adding equimolar amounts of each Large Pool to each Superpool.

As in previous steps in this example, Superpools are prepared based on ORF size, with similarly sized ORF Larger Pools grouped into the same Superpool. To minimize cloning biases based on insert size, size fractions are cloned separately into the expression vectors, by combining each size pool of the 5' ORFs with each size pool of the 3' ORFs pairwise, in each case together with the cloning vector.

Randomized in Frame Fusion Polynucleotide Library Construction

After amplification and pooling into Superpools, the relative concentrations of the ORFs are normalized for molar concentrations of DNA molecules (as opposed to mass concentrations). Specific ORFs, including ORFs from cloned polynucleotides or ORFs from other organisms that are added to an ORF collection generated by individual or pooled PCR amplification as described above, can be added to the ORF collection in varying amounts. For example, specific ORFs are added in molar amounts corresponding to the concentrations of other ORFs, or in lower or higher amounts that change their representation within the final randomized in-frame fusion polynucleotide library. For example, if a polynucleotide encoding a specific protein that confers stress tolerance is suspected to have a particularly high chance of conferring stress tolerance in *E. coli*, it is possible to over-represent this sequence in the ORF collection to ensure that most or all randomized in-frame fusion polynucleotide combinations are tested along with this prioritized sequence.

One-step assembly of two ORFs into a pUC19 expression vector molecule is directed by conserved/homologous sequences that are located at the 5' and 3' ends of each fragment and that specify the structure of the circular, assembled product, shown in FIG. 3. Any one of a large number of methods can be used to accomplish this homology-dependent assembly, all of which are derived from cloning methods that are based on the annealing of homologous, single-stranded DNA ends, such as linker tailing methods (Lathe 1984) or methods dependent on complementary homopolymeric single-stranded tails at the ends of DNA molecules (Lobban 1973). In addition, modern homology-dependent cloning techniques are conceptually related to the ligation-independent cloning methods described in the early 1990s (Aslanidis 1990, Aslanidis 1994). Such homology-dependent cloning methods include but are not limited to: In-Fusion cloning (Zhu 2007, Irwin 2012), Sequence and Ligation-Independent Cloning (SLIC, Li 2007, Li 2012), FastCloning (Li 2011), Circular Polymerase Extension Cloning (Quan 2009, Quan 2011), the Gibson assembly method (Gibson 2009, Gibson 2010), Quick and Clean Cloning (Thieme 2011), and others (Vroom 2008).

Library assembly is performed in vitro with each combination of the five 5' and the five 3' ORF superpools, for a total of 25 assembly reactions. In each reaction, 150 fmol of the 5'ORF superpool DNA and 150 fmol of the 3'ORF superpool DNA (molar concentrations based on average size) are combined with 75 fmol of the PCR-amplified single fragment pUC19 vector DNA (SEQ ID 25126). The volume of the DNA mixture is adjusted to 10 μl, to which is added 10 μl of assembly mix (200 mM Tris pH 8.0, 20 mM MgCl$_2$, 0.4 mM each of dATP, dCTP, dGTP and dTTP, 20 mM dithiothreitol, 2 mM nicotinamide adenine dinucleotide, 0.02 units/μl T5 exonuclease, 0.05 units/μl Phusion® thermostable DNA polymerase, 0.4 units/μl Taq ligase). The reaction is mixed gently and incubated at 50° C. for 1-2 hours. The reaction is then kept on ice or frozen before use for *E. coli* transformations.

This in vitro assembly procedure can be performed as described, or with other enzymes with exonuclease activity that may be suitable for this procedure, such as T4 DNA polymerase, Exonuclease III, lambda exonuclease, T5 exonuclease or T7 exonuclease. Exonucleases with 5' to 3' directionality of their activity (i.e. T4 polymerase, lambda exonuclease, T5 exonuclease or T7 exonuclease) are preferred as they result in higher numbers of base pairs of annealed sequence between the two nicks at each cloning junction, thus stabilizing the desired product. The procedure can be performed without the addition of Taq DNA ligase, with satisfactory results. The reaction may also be supplemented with polyethylene glycol (molecular weight 4000-10000) at a final concentration of 5-10% to promote annealing of single-stranded DNA ends. However, given sufficiently high DNA concentrations as noted above, PEG is not necessary.

The assembly reactions are transformed into *E. coli* by electroporation by mixing 1 µl of the assembly reaction with 25 µl electrocompetent DH10B cells (Life Technologies Corporation) or EC100 cells (Epicentre Technologies) on ice. The cell/DNA mixture is then transferred into a 1 mm gap width electroporation cuvette and electroporated at 1.5 kV using a Bio-Rad Micropulser electroporator. The cells are suspended in 1 ml LB broth, cultured in a 10 ml culture tube for 1 hour at ° C. shaking at 250 rpm, and plated on LB agar containing 50-100 µg/µl carbenicillin. Transformation efficiencies can be improved by desalting the assembly reaction, either by DNA precipitation with ethanol, or by microdialysis, or by centrifugation through a Bio-Rad Micro Bio-Spin P6 gel column following the manufacturer's recommendation.

Library Transformation and Screening

Following assembly, the different libraries are pooled for transformation into *E. coli*, to reduce the total number of transformations and samples that need to be handled. The separate ligations/libraries resulting from the assembly of specific ORF pools contain approximately a number of sequence combinations corresponding to the number of 5' ORFs× the number of 3' ORFs×2. For example, if 1000 5' ORFs are combined with 1000 3' ORFs there are 2 million total combinations. Typically, the goal of a screening project is to screen 3× as many clones or transformants as the library complexity to achieve a >90% chance that each combination is represented among the transformants, assuming equal sequence representation among the DNA pools. With the example given above that means that 6 million transformants are needed for selection or screening.

The pooled libraries containing randomized in-frame fusion polynucleotides are transformed into laboratory strains of *E. coli*, selected for presence of the plasmids, and allowed to express the encoded randomized fusion peptides or polypeptides. Transformants are plated on solid media in the presence of IPTG or lactose to induce expression of randomized in-frame fusion polynucleotides from the lac promoter. The growth of colonies on plates is monitored, allowing for screening or selection of colonies with altered growth and resistance properties. Traits that that can be selected or screened for on solid media include, but not limited to: growth rate (rate of increase of either cell number or cell mass or both), growth yield (final cell density or final cell mass after the culture reaches stationary phase), stress tolerance (ability to grow or survive under conditions of high or low temperatures or high osmotic strength) and product tolerance (ability to grow or survive in the presence of organic solvents such as ethanol and butanol or toxic chemicals).

Alternatively, transformants are cultured in bulk in liquid culture under conditions selecting for various types of growth and resistance properties of the cells. Traits that that can be selected or screened for on solid media include, but not limited to: growth rate (rate of increase of either cell number or cell mass or both), stress tolerance (ability to grow or survive under conditions of high or low temperatures or high osmotic strength) and product tolerance (ability to grow or survive in the presence of organic solvents such as ethanol and butanol or toxic chemicals). Examples of selections and screens using solid and liquid media are given below.

For selections and screens on solid media, following transformation of the randomized fusion polypeptide library, transformants are pre-cultured in liquid media lacking antibiotics for 1 hour at 37° C. Antibiotics and IPTG are then added to the liquid culture to select for presence of the plasmid and induce expression of the randomized in-frame fusion polynucleotides, and the transformants are cultured for an additional hour. The culture is then diluted appropriately to allow for manageable numbers of transformants per plate (approximately 2000-20000 colonies per 10 cm plate depending on the trait selected or screened for). The culture is plated on solid medium whose composition depending on the trait being selected for, for example LB agar, or LB agar containing the additives listed in Table 1. The plates are incubated at for 12 hours to several days and colonies are selected at that time for colony picking, plasmid isolations, phenotype validation and characterization of active randomized in-frame fusion polynucleotides (see below). Colony selections are either made based on colony size (reflective of growth rate and growth yield, used to identify polynucleotides affecting growth rate, low temperature growth and growth yield traits) or on positive selection i.e. in the cases where the majority of transformants fail to grow on the plate and only those that grow contain a randomized in-frame fusion polynucleotide of interest (used to identify randomized fusion polynucleotides affecting tolerance of high temperatures, salt or organic solvents).

Because screens on solid media allow visualization of individual clones or transformants, they are particularly flexible for identifying transformants expressing randomized in-frame fusion polynucleotides contributing to rapid growth which are clearly visible as larger colonies. A difference as little as a few percent in doubling time can lead to a measurable difference in colony size prior to stationary phase. For example, a 12 hour growth period for a strain with an average doubling time of 30 minutes would allow 24 doublings, while a strain with a 5% faster average doubling time of 28.5 minutes would double 25.3 times, leading to a 2.5-fold difference in cell number which is clearly reflected in colony size. Such screens can be performed with any media conditions, for example it is possible to screen for growth rate in the presence of sub-lethal amounts of inhibiting agents such as salt, ethanol or butanol, or in sub-lethal high or low temperatures.

Selections and screens in liquid media are generally performed as bulk selections. Following transformation of the randomized in-frame fusion polynucleotide library into competent cells, transformants are pre-cultured in liquid media lacking antibiotics for 1 hour at 37° C. Antibiotics and IPTG are then added to the culture to select for presence of the plasmid and induce expression of the randomized in-frame fusion polynucleotides. The culture is then diluted 2-10× in fresh medium containing antibiotics and IPTG and containing selective agents such as those listed in Table 1 if appropriate. The culture is allowed to grow either at 37° C. or at a selective temperature for an additional 12 hours to several days, depending on the type of selection imposed on the cells. At that time, the cells are harvested by centrifugation, plasmid DNA containing the randomized in-frame fusion polynucleotide is extracted using standard mini-prep plasmid isolation procedures, the plasmid is then introduced into a fresh batch of competent cells, and the selection is repeated. Two to 10 cycles of batch selection can be performed in this manner before a transformation is plated on solid media allowing selection of individual transformants, followed by colony picking, plasmid isolations, phenotype validation and characterization of active fusion polynucleotides (see below).

Selections in liquid can be done either as survival selections or as selections for rapidly-dividing cells. Survival selections are performed in the presence of a lethal concentration of a selective agent (salt, ethanol or butanol, in this example) or at a lethal high or low temperatures, and for a specific period of time (generally 6-12 hours). Following the selective period, the selective culture is diluted in fresh, non-selective medium, or the temperature is returned to 37° C. to allow any surviving cells to resume normal growth. This culture containing surviving cells is grown up, plasmid extracted and the batch selection repeated if necessary, as described above.

Alternatively, a selection in liquid culture is performed to select for rapid growth in the presence of a sub-lethal concentration of a selective agent (salt, ethanol or butanol, in this example) or at a sub-lethal high or low temperatures. In this case, a liquid culture of transformants maintained under selective conditions is allowed to grow to mid-log phase only (generally 6-24 hours of growth, depending on the severity of selective conditions). At that point, the majority of cells in the culture are expected to be alive, but the culture is enriched for cells capable of normal, rapid growth under the selective conditions. The cells are pelleted by centrifugation, plasmid is extracted and the batch selection repeated if necessary.

randomized in-frame fusion polynucleotide insert. Candidate plasmids are then re-transformed into *E. coli* to validate their phenotype. Re-transformation can occur either into the same bacterial strain used for the selections or into a different strain. The re-transformations can be performed in 96-well or 384-well format to same time and reagents.

The re-transformations are then tested for growth or tolerance phenotypes. For growth rate and growth yield traits, this involves plating the transformants at low cell density and observing the sizes of the resulting colonies compared to a control transformant, or alternatively comparing doubling times or cell pellet size in liquid culture, with or without selective conditions, to the rate of growth of a control strain. For resistance phenotypes (temperature, ethanol and butanol), the re-screen involves replica plating of transformants (i.e. replicated from a 96-well plate onto a plate using a 96-pin tool) on to solid media and growth under selective conditions to compare the extent of growth of each transformation to controls. Alternatively, the transformations are exposed to selective conditions in liquid culture, followed by replicating by pin-tool on to non-selective solid media to assess the degree of cell survival in each culture, reflected in the number of surviving colonies.

A specific candidate randomized in-frame fusion polynucleotide can be tested either for conferral of the phenotype that it was originally selected for, or for another phenotype. Various phenotypes related to cell growth and stress tolerance can cross-react. For example, a randomized in-frame fusion

TABLE 1

Examples of media and growth conditions for isolating polynucleotides affecting growth and resistance traits in *E. coli*

| Selection type | Solid or liquid medium | Incubation temperature | Media additives | Incubation time | Colony selection based on: |
|---|---|---|---|---|---|
| High temperature | solid | 45-55° C. | none | 2-3 days | Colonies growing on plates |
| Low temperature | solid | 5-10° C. | none | 5-10 days | Colony size |
| Salt | solid | 37° C. | 0.5-2.0M NaCl | 2-3 days | Colonies growing on plates |
| Ethanol | solid | 37° C. | 10-15% | 2-3 days | Colonies growing on plates |
| Butanol | solid | 37° C. | 1.5-2.0% | 2-3 days | Colonies growing on plates |
| Growth rate | solid | 37° C. | any | 12 hours | Colony size |
| Growth yield | solid | 37° C. | any | 24 hours | Colony size |
| High temperature | liquid | 45-55° C. | none | 12 h-2 days | Surviving cells |
| Low temperature | liquid | 5-10° C. | none | 3-5 days | Surviving cells |
| Salt | liquid | 37° C. | 1.5-3.0M NaCl | 6-24 hours | Surviving cells |
| Ethanol | liquid | 37° C. | 5-10% | 6-24 hours | Surviving cells |
| Butanol | liquid | 37° C. | 1.0-1.5% | 6-24 hours | Surviving cells |
| Growth rate | liquid | 37° C. | any | 4-8 hours | Surviving cells |

Plasmid Isolations and Phenotype Validation of Active Randomized in Frame Fusion Polynucleotides Following isolations of clones containing randomized in-frame fusion polynucleotides conferring desirable growth or tolerance phenotypes, individual colonies are placed into small cultures, grown, and plasmid isolated from them. This is possible to do in individual tubes containing small cultures (1-5 ml) or in 96-well plates containing 100-2000 µl of liquid medium. Plasmid DNA is extracted from each clone using standard plasmid isolation procedures. Plasmid DNA is characterized by restriction digestion gel electrophoresis, if necessary, to confirm the plasmid structure and presence of a polynucleotide selected for conferral of temperature tolerance can also confer salt tolerance, etc. By extensively cross-testing randomized in-frame fusion polynucleotides under various conditions it is possible to find randomized in-frame fusion polynucleotides with a broad ability to advance cell growth under various conditions of abiotic stress.

As noted above, the screens described in this example are based on use of high-copy number plasmids, such as those containing the pMB1 origin of replication. However, other plasmid systems are also suitable for this work; for maximum applicability of the polynucleotides discovered here it is useful to test them with other plasmid types. For example an F'-based plasmid such as pBeloBAC 11 (Shizuya 1992) can be used to express randomized in-frame fusion polynucleotides using the same promoters as used on high-copy plasmids or a different set of promoters.

Characterization of Positive Clones and Additional Screens

Randomized in-frame fusion polynucleotide expression constructs conferring the most dramatic or broad phenotypes are sequenced to identify the active polynucleotides. The results are tabulated and the best fusion polynucleotides chosen for future work. Sequences identified repeatedly within distinct randomized in-frame fusion polynucleotides are used in future screens as part of the ORF collection. ORF collections containing randomized in-frame fusion polynucleotides already known to contain ORFs capable of conferring a desirable phenotype may be smaller than the whole-genome ORF collections described above for *E. coli*.

There are many advantages to limiting the size of an ORF collection, the most important of which is the smaller number of pairwise combinations that are represented in the resulting library of randomized in-frame fusion polynucleotides. Lower-complexity libraries can be screened faster and less expensively than more complex libraries, and are amenable to screening for more complex phenotypes than those listed above that involve visual screens and positive selections. Lower-complexity libraries are also amenable to testing in organisms with lower transformation efficiencies where it may not be realistic or reasonably possible to screen libraries containing tens of millions of sequence combinations (resulting from ORF collections numbering in the thousands), but which may be suitable for screening libraries containing hundreds of thousands of sequence combinations (resulting from ORF collections numbering in the hundreds).

Example 2

Isolation of Randomized in-Frame Fusion Polynucleotides Capable of Conferring Heat, Salt, UV and Butanol Tolerance to *Saccharomyces cerevisiae*

Product tolerance traits of production microbes are important factors that contribute to maximal yields and titers of fermentation products (Ding 2009, Jia 2009, Dunlop 2011). The ability of a microbe to resist and continue to grow in the presence of toxic compounds is genetically complex, dependent on a large suite of genes in multiple pathways (Liu 2009, Dunlop 2011). Previous efforts of engineering product tolerances in bacteria, cyanobacteria and yeasts have met with mixed success (Alper 2006, Tomas 2003, Atsumi 2010, Dunlop 2011a, Liu 2012, Tian 2013). Resistance traits are inherently difficult to create, and some of the resulting resistant strains suffer from lower yields (Baer 1987, Zhao 2003, Atsumi 2010). This compounds the complexity of the problem and underscores the need for a pipeline of solutions for product tolerance, that can be tested first individually and then in combination to determine their effects on cell growth and product titers. Butanol is featured as a target of this example because it is representative of medium-chain fuels and chemicals, many of which have high toxicity and whose production is being attempted and optimized in microbes (Dunlop 2011, Jang 2012, Lee 2012). Butanol is a chemical feedstock used for the production of many other chemicals (Mascal 2012).

Sequence Identification and PCR Primer Design:

A complete collection of *Saccharomyces cerevisiae* gene sequences are generated based on the reference sequence of yeast strain S288C, available on the yeastgenome web site. The sequence annotation of this genome, also available on the yeastgenome web page, is used for identifying the start and stop codons of each gene.

This particular annotation lists 6607 total protein coding genes, of which 5820 are 2,598 bp or shorter. The length of genes used as input sequences is capped at 2502 bp, preferably at 2598 bp, which increases the likelihood of successful PCR amplification and correct folding of the resultant in-frame fusion polypeptides or proteins. In preliminary analysis, all transposable element genes, pseudogenes, ORFs marked as 'dubious' in the annotation and ORFs less than 102 bp in length, preferably less than 90 bp in length, are eliminated. Duplicated ORFs are eliminated based on the presence of identical sequence in the first 24 bp starting at the ATG start codon and the final 24 bp ending at the stop codon. Internal homology is not considered in the elimination of duplicates, since the objective is to include as many yeast ORFs as possible while avoiding redundant synthesis of multiple, identical PCR primer pairs.

Figure 5:
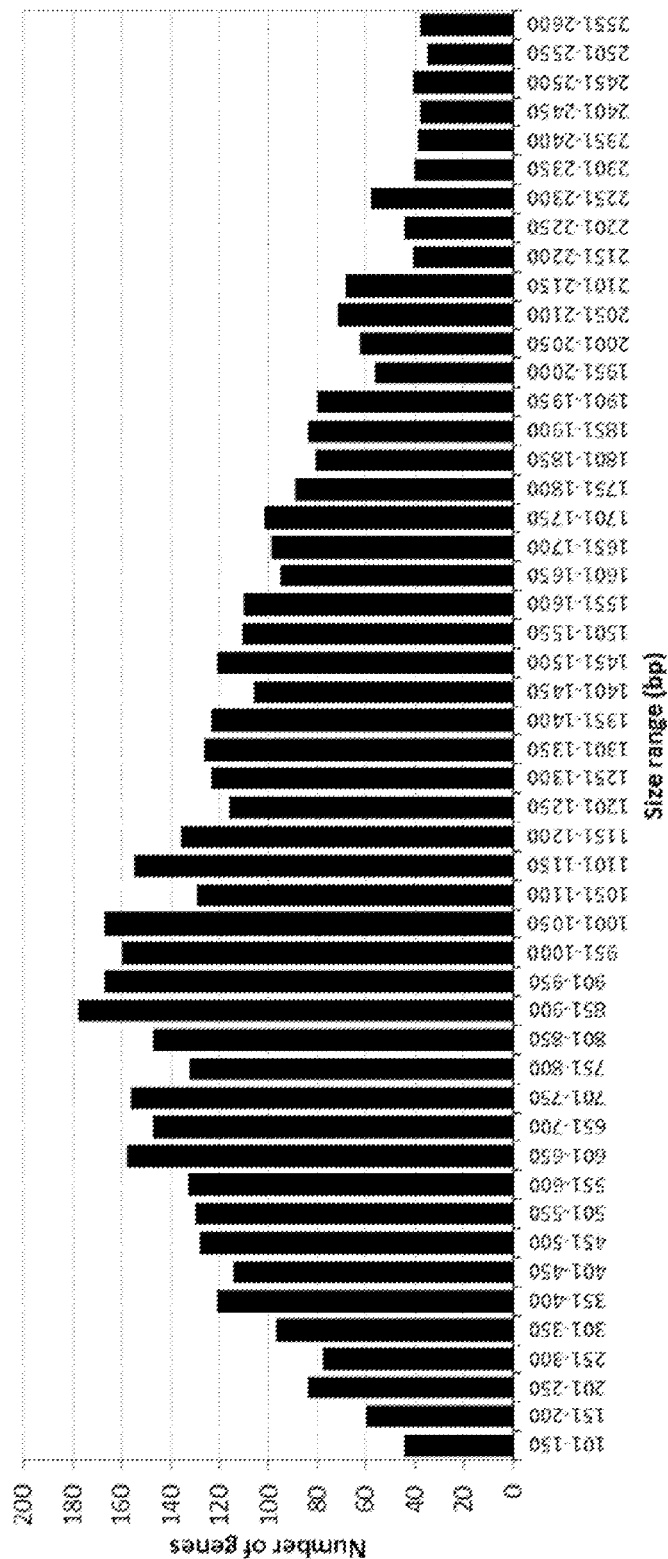
FIG. 5: Size distribution of selected *Saccharomyces cerevisiae* genes, 102-2598 bp in length, used as a starting collection of sequences for a randomized in-frame polynucleotide fusion library.

The result is a final collection of 5,095 ORFs for PCR amplification. The average length of this sequence collection is 1146 bp and the median length is 1074 bp. The size distribution of these ORFs is shown in FIG. 5. The ORFs are listed in SEQ ID NO: 1 to SEQ ID NO: 5019.

PCR primers are designed based on the known start and stop codons of each ORF, including 24 bp of coding sequence from each end. ATG start codons are added to the few yeast ORFs that, based on the annotation of yeast strain S288C, available on the yeastgenome web site, lack ATGs at the 5' ends of the coding region. Two different sets of primers are designed for each ORF, so that two different PCR products are generated, one for cloning the ORF into the 5' position of the fusion gene and the other for placing it 3'.

Each primer contains 16 bases of conserved sequence at the 5' end that serves two purposes. First, the extra sequence allows efficient PCR amplification of pools of ORFs using conserved PCR primer sequences that are able to amplify all the ORFs in a collection without biasing the representation of different ORFs with respect to one another (Dahl 2005, Mylykangas 2011, Natsoulis 2011). Second, they contain homology to the expression vector (a derivative of the yeast expression vector p426-GAL1 (Funk 2002, SEQ ID NO: 25096) and to the conserved sequences at the ends of the randomized in-frame fusion polynucleotide partner, enabling rapid and efficient, homology-dependent assembly of the randomized in-frame fusion polynucleotides in the vector (see FIG. 3). The two amplicons for each ORF only differ in the presence of a stop codon (occurring only in the ORFs destined for the 3' position of the randomized in-frame fusion polynucleotide library) and in their conserved flanking sequences.

The conserved sequence added to all 5' PCR primer of ORFs destined for the 5' position in a fusion gene is GGATCCAGCTAGCAAA (SEQ ID NO: 25099). The conserved sequence added to all 3' PCR primer of ORFs destined for the 5' position in a fusion gene is CAGGAGCTGCACTTCC (SEQ ID NO: 25100). The conserved sequence added to all 5' PCR primer of ORFs destined for the 3' position in a fusion gene is TGGAAGTGGTTCAGGA (SEQ ID NO: 25101). The conserved sequence added to all 3' PCR primers of ORFs destined for the 3' position in a fusion gene is AATTACATGACTCGAG (SEQ ID NO: 25102).

The 5' primers used for amplifying all the 5' ORFs are listed, in the same order as the ORFs, in SEQ ID NO: 5020 to SEQ ID NO: 10038. The 3' primers used for amplifying all the 5' ORFs are listed, in the same order as the ORFs, in SEQ ID NO: 10039 to SEQ ID NO: 15057. The 5' primers used for amplifying all the 3' ORFs are listed, in the same order as the ORFs, in SEQ ID NO: 15058 to SEQ ID NO: 20076. The 3' primers used for amplifying all the 3' ORFs are listed, in the same order as the ORFs, in SEQ ID NO: 20077 to SEQ ID NO: 25095. Thus, the ORF listed in SEQ ID NO: 1 can be PCR amplified with the primers of SEQ ID NO: 5020 and SEQ ID NO: 10039 when amplified for the 5' position; the same ORF can be PCR amplified with the primers of SEQ ID NO: 15058 and SEQ ID NO: 20077 when amplified for the 3' position. The ORF listed in SEQ ID NO: 2 can be PCR amplified with the primers of SEQ ID NO: 5021 and SEQ ID NO: 10040 when amplified for the 5' position; the same ORF can be PCR amplified with the primers of SEQ ID NO: 15059 and SEQ ID NO: 20078 when amplified for the 3' position. The ORF listed in SEQ ID NO: 3 can be PCR amplified with the primers of SEQ ID NO: 5022 and SEQ ID NO: 10041 when amplified for the 5' position; the same ORF can be PCR amplified with the primers of SEQ ID NO: 15060 and SEQ ID NO: 20079 when amplified for the 3' position. And so on.

The 5'-terminal 16 nucleotides in the 3' PCR primer of ORFs destined for the 5' position in a fusion gene, and the 5'-terminal 16 nucleotides in the 5' PCR primer of ORFs destined for the 3' position in a fusion gene, form part of a linker sequence that separates the two ORFs. This 60 bp linker sequence, (SEQ ID NO: 25103), encodes a 20 amino acid peptide (SEQ ID NO: 25104) rich in glycine, serine and alanine, which is loosely based on sequences used by others when connecting two ORFs in a fusion gene (Arai 2001, Eldridge 2009, Wang 2010). This linker sequence is fully encoded in the second or conserved stage of PCR amplification (see below), resulting in the addition of conserved coding sequences to the 3' ends of the ORFs destined for the 5' position of the randomized in-frame fusion polynucleotides and the 5' end of the ORFs destined for the 3' position in the randomized in-frame fusion polynucleotides.

Because two entire sets of yeast ORFs need to be generated, one for the 5' position in the fusion genes and the other for the 3' position, all procedures described below are performed in duplicate for the two ORF positions.

Genomic DNA for PCR Amplifications:

The chosen *Saccharomyces cerevisiae* genes are PCR amplified from strain S288C. This strain is available from the American Type Culture Collection (ATCC), and is used as a source of high-purity genomic DNA from which genes and polynucleotides of interest can be amplified.

To generate high-purity genomic DNA, commercially available yeast genomic DNA purification kits are used, such as the Zymo Research Corporation YeaStar™ Genomic DNA Kit, with additional cleanup steps to generate genomic DNA of sufficient purity. A 50 ml culture of *S. cerevisiae* strain S288C is generated by inoculating 50 ml YPD medium (per Liter of medium: 20 g Difco Bacto™ Peptone, 10 g Bacto™ yeast extract and 20 g glucose) with S288C cells from a plate or liquid culture and is grown for 2 days with shaking at 30° C. The cells are centrifuged at 3000 g for 5 minutes, and resuspended in 3.5 ml YD Digestion Buffer supplied with the kit; 150 µl Zymolyase solution supplied with the kit are then added and the cell suspension is mixed. The cell suspension is incubated at 37° C. for 1.5 hours without shaking. Then 3.5 ml YD Lysis Buffer (and here) is added and the solution mixed thoroughly.

An organic extraction is performed by adding 7.5 ml chloroform to the cell lysate, mixing vigorously for 2 minutes and centrifuging for 5 minutes at 4000 rpm. The supernatant is removed into a fresh 50 ml tube and distributed among 10 spin columns from the Zymo Research Corporation YeaStar™ Genomic DNA Kit inserted into a QIAGEN® QIAvac 24 Plus vacuum manifold. A vacuum is used to draw the lysate through the columns which are then washed twice with 300 µl DNA Wash Buffer. The spin columns are removed from the manifold, inserted into catch tubes and centrifuged at 14,000 rpm for 1 minute to remove residual ethanol. The genomic DNA is eluted in 100 µl TE buffer (10 mM Tris pH 8.0, 0.25 mM EDTA), and all eluates are pooled (~1.0 ml total). The DNA prep is further purified by extracting once with an equal volume of 25:24:1 phenol:chloroform:isoamyl alcohol and once with an equal volume of chloroform. The genomic DNA is precipitated by addition of 1/10 volume 3M sodium acetate pH 5.0 and 2.5 volumes ethanol. The tubes are centrifuged at 14000 rpm for 10 minutes, the pellets washed 1× with 800 µl of 70% ethanol and centrifuged again for 5 minutes; the supernatant is removed by aspiration and the pellets dissolved in 200 µl TE buffer. The DNA concentration is determined spectrophotometrically, and the DNA concentration adjusted to 10 ng/µl by addition of TE buffer.

Gene Amplification:

To save time and reagents, the ORFs are PCR amplified in 192 pools of 26-27 ORFs each (192 pools×26.14 ORFs on average=5019 ORFs total; this corresponds to 27 pools containing 27 primer pairs each, and 165 pools containing 26 primer pairs each). Because the efficiency of PCR amplification is strongly size dependent, and because the PCR extension time depends on the size of the amplicon, the ORFs are grouped into the pools by size. The average ORF size of each multiplex pool is as shown below in Table 2.

TABLE 2

Average ORF lengths of *Saccharomyces cerevisiae* multiplex ORF pools

| Multiplex pool # | Average ORF length (bp) |
|---|---|
| 1 | 117 |
| 2 | 149 |
| 3 | 171 |
| 4 | 191 |
| 5 | 207 |
| 6 | 222 |
| 7 | 239 |
| 8 | 260 |
| 9 | 279 |
| 10 | 296 |
| 11 | 310 |
| 12 | 324 |
| 13 | 337 |
| 14 | 351 |
| 15 | 364 |
| 16 | 373 |
| 17 | 384 |
| 18 | 396 |
| 19 | 410 |
| 20 | 424 |
| 21 | 436 |
| 22 | 446 |
| 23 | 455 |
| 24 | 465 |
| 25 | 474 |
| 26 | 485 |
| 27 | 496 |
| 28 | 507 |
| 29 | 519 |
| 30 | 528 |
| 31 | 538 |
| 32 | 547 |
| 33 | 556 |
| 34 | 568 |
| 35 | 581 |
| 36 | 591 |
| 37 | 598 |

TABLE 2-continued

Average ORF lengths of *Saccharomyces cerevisiae* multiplex ORF pools

| Multiplex pool # | Average ORF length (bp) |
|---|---|
| 38 | 606 |
| 39 | 613 |
| 40 | 621 |
| 41 | 630 |
| 42 | 638 |
| 43 | 646 |
| 44 | 653 |
| 45 | 661 |
| 46 | 669 |
| 47 | 677 |
| 48 | 688 |
| 49 | 698 |
| 50 | 706 |
| 51 | 714 |
| 52 | 721 |
| 53 | 730 |
| 54 | 739 |
| 55 | 749 |
| 56 | 756 |
| 57 | 765 |
| 58 | 773 |
| 59 | 784 |
| 60 | 796 |
| 61 | 806 |
| 62 | 815 |
| 63 | 824 |
| 64 | 832 |
| 65 | 842 |
| 66 | 850 |
| 67 | 858 |
| 68 | 866 |
| 69 | 874 |
| 70 | 881 |
| 71 | 887 |
| 72 | 895 |
| 73 | 903 |
| 74 | 911 |
| 75 | 919 |
| 76 | 928 |
| 77 | 933 |
| 78 | 939 |
| 79 | 947 |
| 80 | 954 |
| 81 | 962 |
| 82 | 969 |
| 83 | 979 |
| 84 | 986 |
| 85 | 996 |
| 86 | 1006 |
| 87 | 1015 |
| 88 | 1023 |
| 89 | 1030 |
| 90 | 1037 |
| 91 | 1044 |
| 92 | 1053 |
| 93 | 1063 |
| 94 | 1073 |
| 95 | 1084 |
| 96 | 1094 |
| 97 | 1101 |
| 98 | 1108 |
| 99 | 1118 |
| 100 | 1128 |
| 101 | 1135 |
| 102 | 1145 |
| 103 | 1153 |
| 104 | 1162 |
| 105 | 1177 |
| 106 | 1184 |
| 107 | 1192 |
| 108 | 1202 |
| 109 | 1213 |
| 110 | 1223 |
| 111 | 1234 |
| 112 | 1245 |
| 113 | 1256 |
| 114 | 1268 |
| 115 | 1279 |
| 116 | 1290 |
| 117 | 1299 |
| 118 | 1307 |
| 119 | 1316 |
| 120 | 1329 |
| 121 | 1340 |
| 122 | 1352 |
| 123 | 1362 |
| 124 | 1372 |
| 125 | 1382 |
| 126 | 1393 |
| 127 | 1403 |
| 128 | 1414 |
| 129 | 1427 |
| 130 | 1441 |
| 131 | 1453 |
| 132 | 1464 |
| 133 | 1473 |
| 134 | 1481 |
| 135 | 1494 |
| 136 | 1506 |
| 137 | 1517 |
| 138 | 1530 |
| 139 | 1542 |
| 140 | 1553 |
| 141 | 1566 |
| 142 | 1576 |
| 143 | 1586 |
| 144 | 1600 |
| 145 | 1618 |
| 146 | 1632 |
| 147 | 1645 |
| 148 | 1656 |
| 149 | 1667 |
| 150 | 1680 |
| 151 | 1693 |
| 152 | 1706 |
| 153 | 1718 |
| 154 | 1730 |
| 155 | 1744 |
| 156 | 1758 |
| 157 | 1769 |
| 158 | 1784 |
| 159 | 1807 |
| 160 | 1822 |
| 161 | 1835 |
| 162 | 1852 |
| 163 | 1867 |
| 164 | 1881 |
| 165 | 1898 |
| 166 | 1916 |
| 167 | 1931 |
| 168 | 1948 |
| 169 | 1972 |
| 170 | 1992 |
| 171 | 2012 |
| 172 | 2034 |
| 173 | 2056 |
| 174 | 2071 |
| 175 | 2090 |
| 176 | 2112 |
| 177 | 2129 |
| 178 | 2150 |
| 179 | 2180 |
| 180 | 2210 |
| 181 | 2243 |

TABLE 2-continued

Average ORF lengths of *Saccharomyces cerevisiae* multiplex ORF pools

| Multiplex pool # | Average ORF length (bp) |
|---|---|
| 182 | 2266 |
| 183 | 2286 |
| 184 | 2310 |
| 185 | 2347 |
| 186 | 2380 |
| 187 | 2415 |
| 188 | 2444 |
| 189 | 2478 |
| 190 | 2510 |
| 191 | 2546 |
| 192 | 2583 |

PCR amplification is performed in three steps: 1) an initial amplification using gene-specific primers followed by 2) bulk-up of each ORF pool using conserved primers, followed by further pooling, size selection on gels and 3) a third amplification step resulting in the final length PCR products. The three amplification steps are referred to as $1^{st}$ stage, $2^{nd}$ stage and $3^{rd}$ stage amplifications, respectively.

All PCR amplifications are performed using Phusion™ Hot Start II thermostable high-fidelity polymerase (Thermo Scientific™). The enzyme is supplied with a 5×HF amplification buffer which is used for all reactions. Amplifications are performed in 20 µL or 50 µL reaction volumes, as noted below. All amplifications are performed on T100 thermal cyclers (Bio-Rad Laboratories) containing 96-well blocks. The deoxynucleotide triphosphates (dNTPs) used in all amplifications are a stock containing 10 mM of each dNTP, also obtained from Thermo Scientific®. Deionized water is used in all reactions and to make all solutions not supplied with the polymerase.

All PCR amplifications follow the same general procedure:
1. A PCR mix as described below is prepared for each stage of the PCR reaction, and is kept cold until inserted into the thermal cycler.
2. The samples are mixed thoroughly and then centrifuged at 4000 rpm for 1 minute to bring the reaction contents to the bottom of the tube or well in a plate.
3. The plates or tubes are inserted into a thermal cycler.

$1^{st}$ Stage Amplification:

First stage amplifications are conducted using pools of sequence-specific PCR primers as noted above. Each amplification is performed in 20 µL total volume, using 2 µL of 10 ng/µL *Saccharomyces cerevisiae* strain S288C genomic template DNA per reaction. To each reaction are added 2.5 µL primer pools from 100 µM stocks to provide a total final primer concentration of 12.5 µM. Each primer pool contains either 26 or 27 primer pairs; and final individual primer concentrations are approximately 0.23-0.24 µM.

The 1st stage PCR reaction mix is set up in 20 µl total volume and is mixed from the following components: 4 µl 5× Phusion® HF Buffer, 0.4 µl 10 mM dNTPs, 10.7 µl deionized H₂O, 2 µl 10 ng/µl yeast genomic template DNA, 2.5 µL primer pools (100 µM), 0.4 µl Phusion™ Hot Start II thermostable polymerase (2 units/µl). The PCR cycling conditions are as follows: initial denaturation at 98° C. for 45 sec, 10 cycles consisting of three steps each (98° C. for 10 seconds, 60° C. for 30 seconds and 72° C. for 3 minutes), a final extension step at 72° C. for 3 minutes and a soak at 4° C. until removal of the samples from the thermal cycler. After the PCR amplification is complete, the samples are removed from the thermal cycler, mixed thoroughly, and centrifuged at 4000 rpm for 1 minute to provide the $1^{st}$ Stage amplification product.

$2^{nd}$ Stage Amplification:

The primers used in $2^{nd}$ stage amplifications are single primers with homology to the conserved portions of the $1^{st}$ stage amplification primers. The $2^{nd}$ stage primers used to amplify the ORFs destined for the 5' position in the fusion genes are PG0085 (SEQ ID NO: 25105) and PG0095 (SEQ ID NO: 25106). The $2^{nd}$ stage primers used to amplify the ORFs destined for the 3' position in the fusion genes are PG0096 (SEQ ID NO: 25107) and PG0088 (SEQ ID NO: 25108). The $2^{nd}$ stage primers are prepared as pairwise mixes, each containing equimolar amounts of the two primers and containing a total primer concentration of 20 µM. The 5' ORF primer mix contains primers PG0085 and PG0095; the 3' ORF primer mix contains primers PG0096 and PG0088 as listed above.

The $2^{nd}$ stage PCR reaction mix is set up in 50 µl total volume and is mixed from the following components: 10 µl 5× Phusion® HF Buffer, 1 µl 10 mM dNTPs, 22 µl deionized H₂O, 10 µl $1^{st}$ stage reaction product, 6 µl $2^{nd}$ stage primer mix (20 µM) and 1 µl Phusion™ Hot Start II thermostable polymerase (2 units/µl). The PCR cycling conditions are as follows: initial denaturation at 98° C. for 45 sec, 25 cycles consisting of two steps each (98° C. for 20 seconds and 72° C. for 3 minutes), a final extension step at 72° C. for 3 minutes and a soak at 4° C. until removal from the thermal cycler.

After the PCR amplification is complete, the samples are removed from the thermal cycler, mixed thoroughly, and centrifuged at 4000 rpm for 1 minute.

To allow more efficient downstream processing of the samples, the 192 multiplex PCR samples are consolidated into 24 larger pools by pooling 8 samples into one. The amount of product in each multiplex PCR reaction is first quantitated to allow equimolar pooling of the different sized fragment collections. This is done either by conducting gel electrophoresis on each multiplex reaction and quantitating the fluorescence in each band of expected size, or by capillary electrophoresis, such as an Applied Biosystems® 3730 DNA analyzer or a QIAGEN® QIAxcel® instrument. The concentration of desirable product in each multiplex reaction is used to calculate the relative amounts of each multiplex PCR reaction that are to be pooled together to result in equimolar amounts of each product added to the pool, taking the average size of each multiplex pool into consideration. Products are grouped and pooled by size to minimize amplification biases in downstream PCR amplifications.

The 192 multiplex reactions are combined into 24 larger pools as follows. Large Pool 1: multiplex pools 1-8; Large Pool 2: multiplex pools 9-16; Large Pool 3: multiplex pools 17-24; Large Pool 4: multiplex pools 25-32; Large Pool 5: multiplex pools 33-40; Large Pool 6: multiplex pools 41-48; Large Pool 7: multiplex pools 49-56; Large Pool 8: multiplex pools 57-64; Large Pool 9: multiplex pools 65-72; Large Pool 10: multiplex pools 73-80; Large Pool 11: multiplex pools 81-88; Large Pool 12: multiplex pools 89-96; Large Pool 13: multiplex pools 97-104; Large Pool 14: multiplex pools 105-112; Large Pool 15: multiplex pools 113-120; Large Pool 16: multiplex pools 121-128; Large Pool 17: multiplex pools 129-136; Large Pool 18: multiplex pools 137-144; Large Pool 19: multiplex pools 145-152; Large Pool 20: multiplex pools 153-160; Large Pool 21: multiplex pools 161-168; Large Pool 22: multiplex pools 169-176; Large Pool 23: multiplex pools 177-184; and Large Pool 24: multiplex pools 185-192. The resulting average ORF sizes (without added primer sequences) of each Large Pool is listed in Table 3 below.

Figure 7:
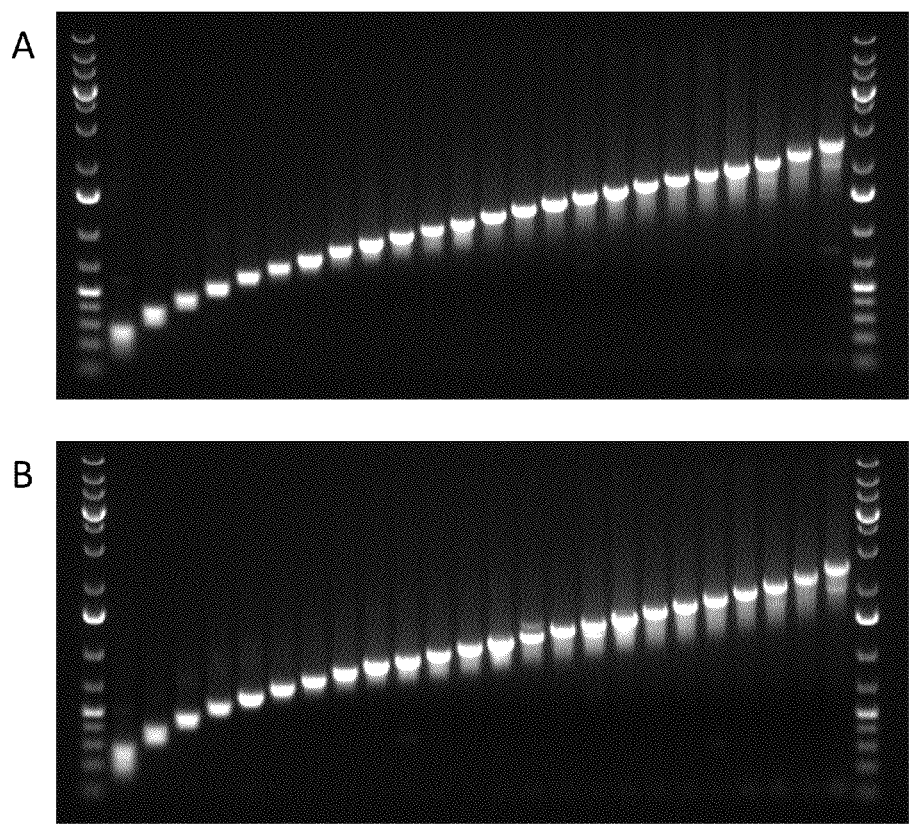
FIG. 7: 1% agarose gels showing 24 of the ORF Large Pools produced for the 3' ORFs (A) and 5' ORFs (B). Each lane contains 1 μg of DNA from the Large Pools. Each Large Pool contains the products of 8 different $2^{nd}$ stage multiplex PCR reactions grouped by size, with a total of 208-216 different *S. cerevisiae* ORF amplicons present in each Large Pool. The sizes of the DNA markers at the left and right side of each gel are as follows (from bottom, in bp): 75, 200, 300, 400, 500, 700, 1000, 1500, 2000, 3000, 4000, 5000, 7000, 10000, 20000.

Once pooling has been completed, an amount of each ORF Large Pool corresponding to 10 μg of total desirable product are purified using a silica resin column or plate such as the Macherey Nagel NucleoSpin® 96 PCR cleanup kit, following the manufacturer's recommendationsAfter elution of the purified PCR product, each sample is mixed thoroughly and its concentration determined spectrophotometrically. FIG. 7 shows an agarose gel with each of the 48 purified *Saccharomyces cerevisiae* 5' and 3' ORF Larger Pools.

To eliminate unwanted size products and primer dimers from the 48 Large Pools, 2 μg of each pool is electrophoresed on a 1% agarose gel and stained with ethidium bromide, the bands visualized under UV or blue light, and gel fragments corresponding to the correct size of each larger pool are excised from the gel. The gel fragments are weighed and DNA is purified from them using silica resin gel purification methods such as the Macherey Nagel NucleoSpin® Gel and PCR clean-up kit, following the manufacturer's recommendations. When the purification is complete, the concentrations of all samples are determined spectrophotometrically, and the concentration of each purified $2^{nd}$ stage Large Pool amplification product is adjusted to 10 ng/μL for $3^{rd}$ Stage Amplification.

$3^{rd}$ Stage Amplification:

The $3^{rd}$ stage amplification adds the final sequences to each PCR product to allow efficient assembly by end homology and to increase the amount of each Large Pool. The primers used in $3^{rd}$ stage amplifications are single primers with homology to the conserved portions of the $1^{st}$ and $2^{nd}$ stage amplification primers. The $3^{rd}$ stage primers used to amplify the ORFs destined for the 5' position in the fusion genes are PG0055 (SEQ ID NO: 25109) and PG0003 (SEQ ID NO: 25110). The $3^{rd}$ stage primers used to amplify the ORFs destined for the 3' position in the fusion genes are PG0004 (SEQ ID NO: 25111) and PG0006 (SEQ ID NO: 25112). The $3^{rd}$ stage primers are prepared as pairwise mixes, each containing equimolar amounts of the two primers and containing a total primer concentration of 20 μM. The 5' ORF primer mix contains primers PG0055 and PG0003 while the 3' ORF primer mix contains primers PG0004 and PG0006 as listed above.

The $3^{rd}$ stage PCR reaction mix is set up in 50 μl total volume and is mixed from the following components: 10 μl 5× Phusion® HF Buffer, 1 μl 10 mM dNTPs, 22 μl deionized H$_2$O, 10 μl gel-purified, pooled $2^{nd}$ stage reaction product (10 ng/μl), 6 μl $3^{rd}$ stage primer mix (20 μM) and 1 μl Phusion® Hot Start II thermostable polymerase (2 units/μl). The PCR cycling conditions are as follows: initial denaturation at 98° C. for 45 sec, 25 cycles consisting of two steps each (98° C. for 20 seconds and 72° C. for 3 minutes), a final extension step at 72° C. for 3 minutes and a soak at 4° C. until removal from the thermal cycler.

After the $3^{rd}$ stage amplification is complete, the samples are mixed thoroughly, centrifuged, and purified using a silica resin purification, such as the Macherey Nagel NucleoSpin® 96 PCR clean-up kit, following the manufacturer's recommendations. After elution, each sample is mixed thoroughly and its concentration is determined spectrophotometrically.

For more efficient downstream processing, the 24 Large Pools are then consolidated into 5 "Superpools", by combining the 4 smallest Large Pools into one Superpool and combining successive sets of 5 Large Pools to form additional Superpools. The relative amounts of each Large Pool added to each Superpool is calculated, by considering the final concentrations of each large pool after $3^{rd}$ stage amplification and purification, and the final average size of each Large Pool (including sequences added by primers), with the goal of adding equimolar amounts of each Large Pool to each Superpool. Table 3 lists the average size of ORFs in each of the Large Pools and Superpools. ORF sizes are given both as pure ORF sizes and as the final PCR fragment sizes which include the sequences added by the primers during PCR amplification.

TABLE 3

Average ORF sizes in *Saccharomyces cerevisiae* ORF Large Pools and Superpools

| Large Pool number | Average Large Pool ORF length (bp) | Average Large Pool ORF length + primers (bp) | Superpool number | Average Superpool ORF length (bp) | Average Superpool ORF length + primers (bp) |
| --- | --- | --- | --- | --- | --- |
| LP-1 | 195 | 312 | SP-1 | 365 | 482 |
| LP-2 | 329 | 446 | | | |
| LP-3 | 427 | 544 | | | |
| LP-4 | 511 | 628 | | | |
| LP-5 | 592 | 709 | SP-2 | 729 | 846 |
| LP-6 | 658 | 775 | | | |
| LP-7 | 727 | 844 | | | |
| LP-8 | 800 | 917 | | | |
| LP-9 | 869 | 986 | | | |
| LP-10 | 929 | 1046 | SP-3 | 1064 | 1181 |
| LP-11 | 992 | 1109 | | | |
| LP-12 | 1060 | 1177 | | | |
| LP-13 | 1131 | 1248 | | | |
| LP-14 | 1209 | 1326 | | | |
| LP-15 | 1293 | 1410 | SP-4 | 1472 | 1589 |
| LP-16 | 1377 | 1494 | | | |
| LP-17 | 1467 | 1584 | | | |
| LP-18 | 1559 | 1676 | | | |
| LP-19 | 1662 | 1779 | | | |

TABLE 3-continued

Average ORF sizes in *Saccharomyces cerevisiae* ORF Large Pools and Superpools

| Large Pool number | Average Large Pool ORF length (bp) | Average Large Pool ORF length + primers (bp) | Superpool number | Average Superpool ORF length (bp) | Average Superpool ORF length + primers (bp) |
| --- | --- | --- | --- | --- | --- |
| LP-20 | 1767 | 1884 | SP-5 | 2077 | 2194 |
| LP-21 | 1891 | 2008 | | | |
| LP-22 | 2042 | 2159 | | | |
| LP-23 | 2222 | 2339 | | | |
| LP-24 | 2463 | 2580 | | | |

Amplified pools of PCR products are analyzed by multiplexed short-read sequencing, for example using high-throughput Illumina® or Ion Torrent® sequencing systems, to determine relative abundances of the ORFs in each amplification reaction.

In this particular example, to determine relative abundances of individual ORFs resulting from $1^{st}$ stage and $2^{nd}$ stage multiplex PCR amplification, test amplifications of 3' ORFs were performed on 16 multiplex pools (pools #8, 17, 28, 41, 56, 70, 86, 101, 113, 125, 136, 146, 156, 164, 171, 178) comprising a total of 418 ORFs, and test amplifications of 5' ORFs were performed on 16 multiplex pools (pools #7, 16, 27, 40, 55, 69, 85, 100, 112, 124, 135, 145, 155, 163, 170, 177) comprising a total of 419 ORFs. The $2^{nd}$ stage amplification products of each group of 16 multiplex pools were prepared as described above, and were combined and sequenced using an Ion Torrent™ Ion 318™ Chip. The results were analyzed by aligning the sequences obtained from each combination of 16 multiplex pools to the target ORF sequences in these pools, using CLC Genomic Workbench sequence analysis software (CLC Bio®). In the 3' ORF multiplex pools, 395/418 (94%) of the ORFs were detected by at least a single sequence reaction, and 374/418 ORFs (89%) were represented at reasonable levels, after excluding outliers that were covered by very small numbers of reads. In the 5' ORF multiplex pools, 405/419 (97%) of the ORFs were detected by at least a single sequence reaction, and 386/419 ORFs (92%) were represented at reasonable levels, after excluding outliers that were covered by very small numbers of reads. As expected from a multiplex PCR strategy, the representation of individual ORFs in each pool fluctuated: the average standard deviation among 3' ORF multiplex pools was 75% of the average read number, and this number dropped to 62% when excluding outliers. The average standard deviation among 5' ORF multiplex pools was 69% of the average read number, and among the 5' ORFs this percentage dropped to 60% of the average read number when excluding outliers. These results indicate successful multiplex amplification of a high percentage of the ORFs within each sample, ensuring representation of a correspondingly high percentage of the ORFs in the fusion gene libraries made from these ORF collections.

Randomized in Frame Fusion Polynucleotide Library Construction

The yeast centromeric expression plasmid p416-GAL1 (Funk 2002) is used for all randomized in-frame fusion polynucleotide cloning and expression work. This plasmid expression vector uses the GAL1 galactose inducible promoter to direct expression of all randomized in-frame fusion polynucleotides. The entire expression vector (5538 bp) is amplified by PCR using the PCR primers PG0089 (SEQ ID NO: 25113) and PG0090 (SEQ ID NO: 25114). The amplified, linear vector is used for cloning complex libraries of randomized in-frame fusion polynucleotides as described below. Alternatively, the vector is amplified as two separate fragments; a 4295 bp first fragment amplified with primers PG0089 (SEQ ID NO: 25113)+PG0097 (SEQ ID NO: 25115) and a 1626 bp second fragment amplified with primers PG0090 (SEQ ID NO: 25114)+PG0098 (SEQ ID NO: 25116). These two fragments share 383 bp of end homology within the URA3 gene present in the vector sequence. Use of two vector fragments as opposed to a single vector fragment can have the advantage of lowering the background of colonies obtained with vector alone, and can give higher rates of fusion gene assembly.

Because the efficiency of the randomized in-frame fusion polynucleotide library construction step is also expected to be dependent on insert size, the sequences continue to be segregated based on length, see Table 3. For assembly of randomized libraries of in-frame fusion genes, the ORFs in each 5' Superpool are combined with the ORFs in each 3' Superpool for a total of 25 Superpool combinations. The average insert size ranges expected for the 25 libraries formed in the randomized in-frame fusion polynucleotide library assembly step are the sums of the average amplicon sizes for each of the Superpools shown in Table 3.

One-step assembly of two ORFs into an expression vector molecule is directed by conserved/homologous sequences that are located at the 5' and 3' ends of each fragment and that specify the structure of the circular, assembled product, shown in FIG. 3. A large number of methods exist that can be used to accomplish such homology-dependent assembly (Lobban 1973), including In-Fusion cloning (Zhu 2007, Irwin 2012), Sequence and Ligation-Independent Cloning (SLIC, Li 2007, Li 2012), FastCloning (Li 2011), Circular Polymerase Extension Cloning (Quan 2009, Quan 2011), the Gibson assembly method (Gibson 2009, Gibson 2010), Quick and Clean Cloning (Thieme 2011), direct assembly in yeast (Ma 1987, Degryse 1995, Raymond 1999, Raymond 2002, Shao 2009, Wingler 2011, Eckert 2012, Kuijpers 2013) and others (Vroom 2008).

In this particular example, two different assembly methods are used: direct assembly in yeast (Kuijpers 2013) and a modification of homology-dependent in vitro assembly methods (Gibson 2010, Li 2012).

Library Assembly and Cloning in *E. Coli*

Library assembly is performed in vitro with each combination of the five 5' and the five 3' ORF superpools, for a total of 25 assembly reactions. In each reaction, 150 fmol of the 5'ORF superpool DNA and 150 fmol of the 3'ORF superpool DNA (molar concentrations based on average size, see Table 3) are combined with 75 fmol of the PCR-amplified single fragment vector DNA (5538 bp). The volume of the DNA mixture is adjusted to 10 µl, to which is added 10 µl of assembly mix (200 mM Tris pH 8.0, 20 mM MgCl$_2$, 0.4 mM each of dATP, dCTP, dGTP and dTTP, 20 mM dithiothreitol, 2 mM nicotinamide adenine dinucleotide, 0.02 units/μl T5 exonuclease, 0.05 units/μl PHUSION thermostable DNA polymerase, 0.4 units/μl Taq ligase). The reaction is mixed gently and incubated at 50° C. for 1-2 hours. The reaction is then kept on ice or frozen before use for E. coli transformations.

The assembly reactions are transformed into E. coli by electroporation by mixing 1 μl of the assembly reaction with 25 μl electrocompetent DH10B cells (Life Technologies Corporation) or EC100 cells (Epicentre Technologies) on ice. The cell/DNA mixture is then transferred into a 1 mm gap width electroporation cuvette and electroporated at 1.5 kV using a Bio-Rad Micropulser electroporator. The cells are suspended in 1 ml LB broth, cultured in a 10 ml culture tube for 1 hour at ° C. shaking at 250 rpm, and plated on LB agar containing 50-100 μg/μl carbenicillin. Transformation efficiencies can be improved by desalting the assembly reaction, either by DNA precipitation with ethanol, or by microdialysis, or by centrifugation through a Bio-Rad Micro Bio-Spin P6 gel column following the manufacturer's recommendation.

The quality of this assembly method was assessed by picking and sequencing twenty random clones from an assembly of 5' Superpool SP-3 with 3' Superpool SP-3 and the p416-GAL1 vector (SEQ ID NO: 25096). Out of the 20 clones, 12 showed full-length 5' and 3' ORFs fused in-frame, with all cloning junctions perfect and separated by a perfect linker sequence, with no ORFs found more than once. The remaining 8 clones contained either intact 5' or 3' ORFs, but showed rearrangements, frameshifts or unknown sequences within the second ORF. These results indicate that in vitro assembly followed by cloning in E. coli can produce libraries which are substantially composed of fusion genes consisting of random ORFs fused in-frame.

The transformation efficiency of each assembly reaction is tested in pilot electroporations by plating out small volumes of the transformation mixture and counting colonies the next day. The electroporations are then scaled up to allow generation of 1 million or more library clones per ORF pool combination. A total of 5 electroporations were performed for each ORF superpool combination when cloning of the S. cerevisiae Function Generator library in E. coli, yielding the clone numbers listed in Table 4, for a total library complexity of over 65 million clones.

TABLE 4

E. coli cloning of in vitro assembled Function Generator library

| ORF combination | 5' ORF superpool | 3' ORF superpool | Culture volume (ml) | Colony numbers (200 μl) | Total # of transformants |
|---|---|---|---|---|---|
| 1 | 5' SP-1 | 3' SP-1 | 500 | 95 | 237,500 |
| 2 | 5' SP-2 | 3' SP-1 | 500 | 1488 | 3,720,000 |
| 3 | 5' SP-3 | 3' SP-1 | 500 | 1360 | 3,400,000 |
| 4 | 5' SP-4 | 3' SP-1 | 500 | 1056 | 2,640,000 |
| 5 | 5' SP-5 | 3' SP-1 | 500 | 1060 | 2,650,000 |
| 6 | 5' SP-1 | 3' SP-2 | 500 | 988 | 2,470,000 |
| 7 | 5' SP-2 | 3' SP-2 | 500 | 948 | 2,370,000 |
| 8 | 5' SP-3 | 3' SP-2 | 500 | 1012 | 2,530,000 |
| 9 | 5' SP-4 | 3' SP-2 | 500 | 948 | 2,370,000 |
| 10 | 5' SP-5 | 3' SP-2 | 500 | 1348 | 3,370,000 |
| 11 | 5' SP-1 | 3' SP-3 | 500 | 1000 | 2,500,000 |
| 12 | 5' SP-2 | 3' SP-3 | 500 | 1000 | 2,500,000 |
| 13 | 5' SP-3 | 3' SP-3 | 500 | 1000 | 2,500,000 |
| 14 | 5' SP-4 | 3' SP-3 | 500 | 1000 | 2,500,000 |
| 15 | 5' SP-5 | 3' SP-3 | 500 | 1000 | 2,500,000 |
| 16 | 5' SP-1 | 3' SP-4 | 500 | 1000 | 2,500,000 |
| 17 | 5' SP-2 | 3' SP-4 | 500 | 1440 | 3,600,000 |
| 18 | 5' SP-3 | 3' SP-4 | 500 | 1000 | 2,500,000 |
| 19 | 5' SP-4 | 3' SP-4 | 500 | 560 | 1,400,000 |
| 20 | 5' SP-5 | 3' SP-4 | 500 | 1440 | 3,600,000 |
| 21 | 5' SP-1 | 3' SP-5 | 500 | 1000 | 2,500,000 |
| 22 | 5' SP-2 | 3' SP-5 | 500 | 1000 | 2,500,000 |
| 23 | 5' SP-3 | 3' SP-5 | 500 | 1000 | 2,500,000 |
| 24 | 5' SP-4 | 3' SP-5 | 500 | 1440 | 3,600,000 |
| 25 | 5' SP-5 | 3' SP-5 | 500 | 1440 | 3,600,000 |
| Total | | | | | 66,557,500 |

After electroporation, each ORF superpool combination listed in Table 4 is allowed to recover for 1 hour at 37° C. shaking at 250 rpm, and the cells are then diluted into 500 ml LB broth containing 0.3% ultra lowmelt agarose (Lonza SeaPrep agarose) for library amplification in soft gel (Elsaesser 2004). The 500 ml cell suspension for each ORF superpool combination is distributed among three 2.5 cm deep 15 cm petri plates and incubated at 4° C. for 1 hour to allow the agarose to form a semi-solid gel. The plates are then transferred to 37° C. and allowed to grow for 16 hours. The cells are then harvested by centrifugation at 10,000 g for 30 minutes. Each cell pellet is resuspended in 12 ml Resuspension Buffer A1 used for Machery Nagel NcucleoSpin 96 plasmid purification kits (Clontech). For each ORF superpool combination, 0.25 ml of cell suspension are then processed using the kit, following the manufacturer's recommendations. The remaining cells are frozen at −80° C. for future use.

Figure 8:
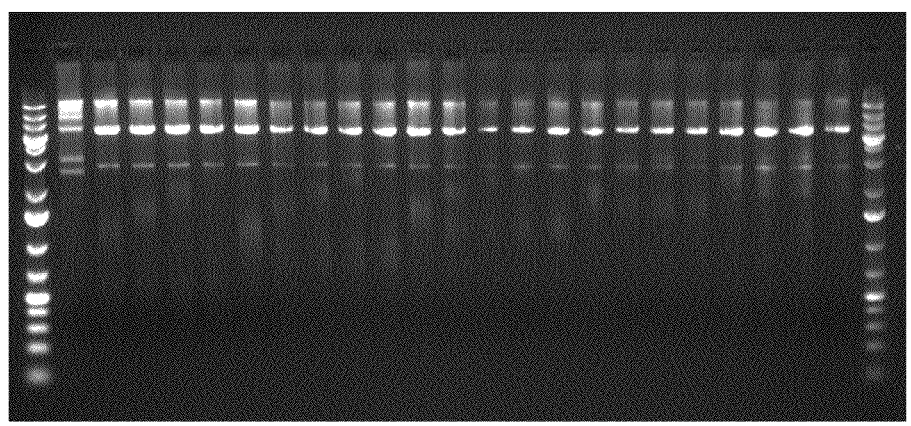
FIG. 8: 1% agarose gel showing the ORF Superpool combinations 1-17 and 19-24 after in vitro assembly into a fusion gene library and cloning in *E. coli*. Each lane represents 1 μg of library DNA digested with NheI, XhoI and PflMI restriction enzymes. NheI restricts the fully assembled fusion gene plasmid upstream of the 5' ORF; Xho I restricts downstream of the 3' ORF and PflMI restricts between the two ORFs. Thus, each ORF is excised from the fusion gene construct in the process. Each lane shows a characteristic smear indicating that many DNA fragments of varying size are present, which is characteristic of a DNA library. The major vector band is clearly visible at the top of the gel (5538 bp). Also visible is a smaller band of about 3 kb that represents a rearranged vector which arose with some regularity in the assembly reactions. The fuzzy band at the top of the gel is *E. coli* chromosomal DNA. The first and last lanes contain marker DNA of the following sizes (from bottom, in bp): 75, 200, 300, 400, 500, 700, 1000, 1500, 2000, 3000, 4000, 5000, 7000, 10000, 20000.

Following elution, the plasmid DNA is quantitated by spectrophotometric measurement. To check the library quality, 1 μg of DNA from each superpool combination is digested by NheI, PflMI and XhoI, restriction enzymes that cut upstream of the 5' ORF, between the two ORFs, and 3' of the 3' ORF in the fully assembled fusion gene vector, thus excising both fusion genes in the process. FIG. 8 shows the result for this digest for 23 of the 25 ORF combinations.

To transform yeast, the in vitro assembled and E. coli cloned library can either be transformed as separate superpool combinations or as a single pool with all combinations mixed together. Because of the size of the final fusion gene plasmids is dominated by the vector DNA (5538 bp), size differences between difference superpools result in less of a size bias than when working with the individual ORFs and as a result it is safe to pool all superpool combinations into a single sample for yeast transformation.

To verify that yeast transformants generated by transformation with either assembly method described above contain fusion genes consisting of random ORFs fused in-frame, 11 random yeast clones transformed with the randomized in-frame fusion gene library generated in vitro and cloned in E. coli, and 10 random yeast clones transformed with separate 5' and 3' ORF pools and vector fragment for assembly in yeast, were further analyzed by rescuing the plasmids contained in the yeast transformants into E. coli (Ward 1990, and as described below) and sequencing the inserts of these plasmids to confirm their structure. The results of this analysis confirmed that 4 out of 11 yeast clones generated by transformation with the randomized in-frame fusion gene library generated in vitro and cloned in E. coli, and 6 out of 10 yeast clones generated by transformation with separate 5' and 3' ORF pools and vector fragment for assembly in yeast, contained fusion genes containing 2 intact, full-length yeast ORFs fused in-frame and separated by an intact linker sequence. The remaining clones contained truncated 5' ORFs of unknown origin that appear to arise at some frequency when using either assembly method, as well as intact and full-length linker sequences and 3' ORFs. None of the ORFs observed in these 21 clones occurred more than once. These results confirm that both assembly methods described above result in a substantial proportion of yeast transformants which contain fusion genes consisting of pairs of random ORFs fused in-frame.

Library Assembly in Yeast and Library Transformations into Yeast

The yeast strain BY4741 (mat a his3D1 leu2D0 met15D0 ura3D0) is used for all transformations and screens (Brachmann 1998). To achieve assembly of a fusion gene library in yeast, this yeast strain is transformed separately with each of the 25 combinations of 5' and 3' ORF superpools. In each transformation, 200 fmol of a 5' ORF superpool is combined with 200 fmol of a 3' ORF superpool and with either 100 fmol of the single vector PCR fragment (5538 bp) or with 100 fmol each of the two vector fragments (4295 and 1626 bp) overlapping within the URA3 gene as described above. Each of the 25 combination is pre-mixed prior to transformation into yeast. Such transformations typically yield 4000-5000 colonies of yeast per transformation as described below, of which >90% contain fusion genes correctly assembled into the p416-GAL1 vector. For transformation with a library already cloned and expanded in $E.$ $coli$, the transformations procedure summarized below yield about 250,000-300,000 transformants per microgram of cloned plasmid library DNA. Because each of the two approaches (in vitro assembly and library cloning in $E.$ $coli$ vs library assembly by transformation of yeast) is expected to result in different sequence biases (i.e. some ORFs preferentially incorporated into a collection of clones or transformants compared to others), it is advantageous to use both methods when screening for a specific phenotype. Nevertheless, because of the 50-60× higher transformation efficiency of yeast of the in vitro assembled and $E.$ $coli$ cloned library, this method is preferred for generating a very high number of transformants.

Yeast transformations are performed by the lithium acetate—heat shock method (Gietz 2002, Gietz 2006, Gietz 2007). The yeast strain BY4741 (Brachmann 1998) from a plate or an overnight culture is inoculated into 50 ml of YPD medium (20 g Bacto Peptone, 10 g Bacto Yeast Extract and 20 g Glucose per liter) at 30° C. on a shaker at 225 rpm from a starting density of $5 \times 10^6$ cells/ml to $2 \times 10^7$ cells/ml. The cells are harvested by centrifuging them at 3000 g for 5 min, the cells are then resuspended in 25 ml of sterile deionized water, centrifuged again, resuspended in 1 ml of sterile water, transferred to a 1.5 ml microcentrifuge tube, centrifuged for 30 sec at 3000 rpm and the supernatant aspirated. The cell pellet is then resuspended in 0.4 ml of sterile deionized water. The cell suspension is combined with 3.26 ml of transformation mix (2.4 ml of 50% w/v PEG 3350, 360 μl 1M Lithium acetate and 500 μl 10 mg/ml sheared, boiled salmon sperm DNA) and mixed well. Aliquots of DNA (100 ng-1 μg) are pipetted into separate 1.5 ml microcentrifuge tubes and combined with 360 μl of the cell suspension in transformation mix. The cell/DNA mixture is mixed thoroughly and is incubated at 42° C. on a shaker at 250 rpm for 40 minutes. The transformations are then centrifuged for 1 minute at 3000 rpm in a microcentrifuge, the supernatant aspirated and each cell aliquot resuspended in 0.5-1 ml sterile deionized water. Depending on the desired density of colonies, 10 μl to 1 ml of the cell suspension are plated with sterile 4 mm glass beads onto one 10 cm or 15 cm plate containing synthetic complete uracil dropout medium containing glucose as a carbon source (for 1 L, 6.7 g yeast nitrogen base, 0.77 g uracil dropout mix, 15 g Bacto agar, 120 μl 10N NaOH to bring the pH to 5.6-5.8, and 20 g glucose) synthetic complete medium uracil dropout medium with galactose as a carbon source (for 1 L, 6.7 g yeast nitrogen base, 0.77 g uracil dropout mix, 120 μl 10N NaOH to bring the pH to 5.6-5.8, 15 g Bacto Agar and, added after autoclaving, 100 ml sterile-filtered 20% galactose). The plates are opened on a benchtop to allow the liquid to dry and are then covered and incubated at 30° C. or at a selective temperature for several days.

The total possible number of sequence combinations resulting from random pairwise assembly of 5019 ORFs equals the square of this number=25.2 million. Typically, the goal of a screening project is to screen through 3× as many clones as the library complexity to have a >90% chance that each combination is represented among the transformants (assuming equal sequence representation among the DNA pools). In our case this corresponds to roughly 74 million transformants, which is possible in yeast assuming transformation efficiencies approaching $10^6$ transformants per μg of DNA, which are routinely achievable with some protocol optimizations for a specific strain (Gietz 2007), especially when using a library that has been assembled in vitro and cloned in $E.$ $coli$.

Screening for Fusion Genes Conferring Heat and Salt Tolerance

Following transformation, the cells are centrifuged for 1 minute at 5000 rpm and the supernatant is aspirated. The pellet is resuspended in 1 ml synthetic complete medium containing glucose as a carbon source (for 1 L, 6.7 g yeast nitrogen base, 0.77 g uracil dropout mix, 120 μl 10N NaOH to bring the pH to 5.6-5.8, and 20 g glucose), and each transformation is cultured for 2-3 hours at 30° C. on a shaker at 250 rpm followed by centrifugation of the cells, resuspension in 1 ml sterile deionized water, and plating on the appropriate selective medium.

For heat selection, cells are plated on synthetic complete medium uracil dropout medium with galactose as a carbon source (for 1 L, 6.7 g yeast nitrogen base, 0.77 g uracil dropout mix, 120 μl 10N NaOH to bring the pH to 5.6-5.8, 15 g Bacto Agar and, added after autoclaving, 100 ml sterile-filtered 20% galactose). The cells are spread on the plate using 10-15 4 mm sterile glass beads. The plates are left open to dry and are incubated at 30° C. for 24 hours followed by incubation at 40° C. for four days. Individual colonies that are able to resist the high temperature are visible 5 days after plating.

For salt selection, cells placed on a rotating shaker for 1.5 hours at 30° C., and are then plated on synthetic complete uracil dropout medium with galactose as a carbon source and containing 1M NaCl (for 1 L, 6.7 g yeast nitrogen base, 0.77 g uracil dropout mix, 120 μl 10N NaOH to bring the pH to 5.6-5.8, 15 g Bacto Agar, 58.44 g NaCl and, added after autoclaving, 100 ml sterile-filtered 20% galactose). The cells are spread on the plate using 10-15 4 mm sterile glass beads. The plates are left open to dry and are incubated at 30° C. for five days. Individual colonies that are able to resist the high salt are visible 5 days after plating.

Colonies that arise under selective growth conditions are picked and re-streaked on synthetic complete uracil dropout medium containing glucose as a carbon source (for 1 L, 6.7 g yeast nitrogen base, 0.77 g uracil dropout mix, 15 g Bacto agar, 120 μl 10N NaOH to bring the pH to 5.6-5.8, and 20 g glucose). After several days of growth at 30° C., the clones showing growth are picked into 1 ml synthetic complete uracil dropout liquid medium containing glucose as a carbon source (for 1 L, 6.7 g yeast nitrogen base, 0.77 g uracil dropout mix, 120 µl 10N NaOH to bring the pH to 5.6-5.8, and 20 g glucose) in a deep-well 96-well plate, and are grown on a shaker at 800 rpm at 30° C. for 2 days. The cells are then pelleted by centrifugation at 4000 rpm for 5 minutes in a benchtop centrifuge, the supernatant is poured off, and yeast plasmid DNA is purified using a commercial kit (for example the Zymoprep yeast plasmid miniprep kit from Zymo Research), following the manufacturer's instructions. The resuspended DNA is introduced into the DH10B (Life Technologies) or EC100 (Epicentre Technologies) strain of *E. coli* by electroporation by combining 2 µl DNA with 20 µl electrocompetent cells on ice, transferring into a 1 mm gap size electroporation cuvette, electroporating at 1.5 kV using a Bio-Rad MicroPulser electroporator, suspending the cells in 0.5 ml LB broth, allowing the cells to recover for 1 hour at 37° C. on a shaker and plating 0.2 ml aliquots of transformed cells onto a 10 cm plate containing LB agar medium with 50 µg/ml carbenicillin.

Bacterial colonies arising on the plate are picked, 2 colonies for each yeast clone used for DNA isolation, and are grown up and plasmid DNA prepared from them using standard methods (Sambrook 1989). The plasmid DNA is digested with restriction enzymes cutting 5' of the 5' ORF (NheI), 3' of the 3' ORF (XhoI) and in between the two ORFs (PflMI) to verify that the rescued plasmid contains a fusion protein.

The cloned plasmid DNA is re-introduced into yeast by lithium acetate—heat shock transformation as described above (Gietz 2006), individual colonies arising from the transformation are picked, suspended in deionized water and 5 µl aliquots spotted in serial 10× dilutions on synthetic complete uracil dropout medium with galactose as a carbon source, or on YPGal rich medium containing galactose as a carbon source (20 g Bacto Peptone, 10 g Bacto Yeast Extract and 20 g galactose per liter), and incubated at 40° C. to verify heat tolerance, or spotted in serial 10× dilutions on the same media with galactose as a carbon source and containing 1M NaCl and incubated at 30° C. to verify salt tolerance. Yeast clones transformed with candidate fusion gene constructs are compared to transformants with the p416-GAL1 empty vector for growth under selective conditions to establish the activity of the fusion gene constructs.

Figure 10:
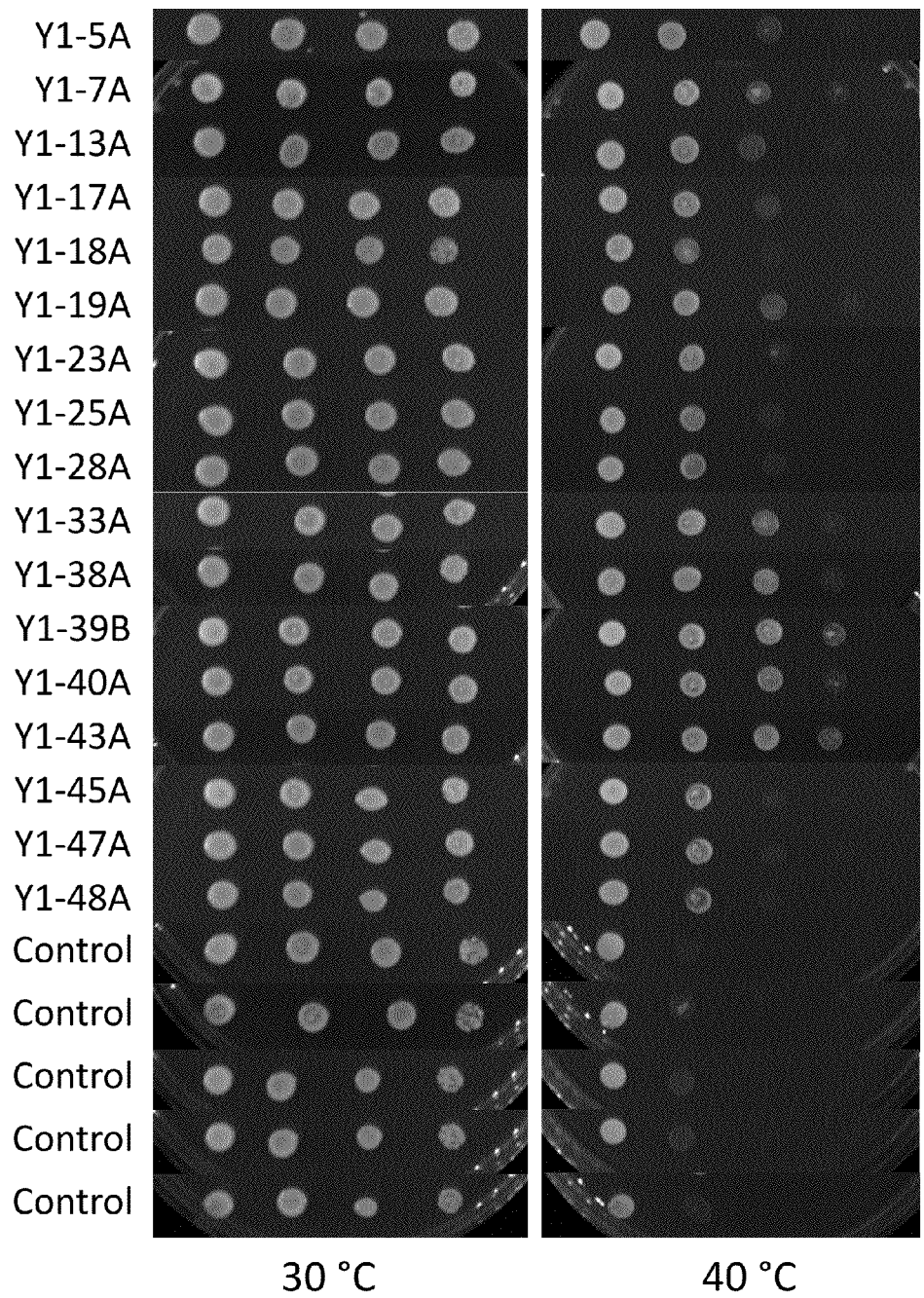
FIG. 10: Composite images of spot assays demonstrating heat tolerance of the fusion genes listed in FIG. 9. Each fusion gene was re-transformed into yeast strain BY4741 and selected for presence of the plasmid. Transformed cells were suspended in deionized water, adjusted for uniform cell density, and spotted in 4 serial 10× dilutions, on duplicate plates with synthetic complete uracil dropout medium containing galactose as a carbon source. The plates were incubated at 30° C. and 40° C. as indicated in the figure. The fusion gene names are indicated to the left of each row of spots. Heat tolerance is visible by enhanced growth at 40° C. compared to the control (strain BY4741 transformed with plasmid p416-GAL1). Multiple controls are shown, from multiple plates from which the composite image originated.

Examples of fusion genes isolated from a screen for heat tolerance (ability to grow at 40° C.) are listed in FIG. 9, and the ability of yeast cells transformed with these clones to grow at elevated temperature is demonstrated in FIG. 10. The cells spotted on the plates shown in FIG. 10 represent re-transformants of strain BY4741 with the fusion gene clones listed in FIG. 9, and confirm their ability to confer heat tolerance.

Screening for Fusion Genes Conferring Butanol Tolerance Phenotypes:

The pooled libraries containing randomized in-frame fusion polynucleotide are transformed into laboratory strains of yeast and then grown under conditions that select for the presence of the plasmids and expression of the randomized in-frame fusion polypeptides encoded by the randomized in-frame fusion polynucleotide is induced. Four different approaches are used to select or screen for butanol-tolerant transformants. Two of these involve survival selections, using lethal concentrations of butanol to isolate cells with the ability to survive the alcohol. The other two approaches aim to isolate cells with improved growth properties in the presence of sub-lethal concentrations of butanol. On selection each of the two survival selections and the two growth tolerance selections involve growth and selection on solid medium while the other uses growth in liquid medium followed by selection or screens on solid medium. The three selection and screening approaches are summarized in Table 5, with the concentration ranges of butanol based on published information (Knoshaug 2008).

TABLE 5

Media and growth conditions for isolating butanol-tolerant *S. cerevisiae* transformants

| Selection type | Solid or liquid medium | Butanol concentration | Incubation time | Selection based on: |
|---|---|---|---|---|
| Survival | solid | Lethal: 2.5-3.0% butanol | 5-10 days | Colonies growing on plates |
| Growth tolerance | solid | Sub-lethal: 1.5-2.5% butanol | 5-10 days | Colony size |
| Survival | liquid | Lethal: 2.5-3.0% butanol | 12-24 hours | Surviving cells |
| Growth tolerance | liquid | Sub-lethal: 1.5-2.5% butanol | 24-72 hours | Colony size |

The four selection schemes are preceded by careful titration, under the exact plating or culturing conditions and cell densities used later with bulk yeast transformants to arrive at the optimal butanol concentration for each selection. Mock transformations, containing yeast cells combined with carrier DNA and otherwise treated as in a real transformation, are used for these titration experiments. All cultures are grown at 30° C. under carefully controlled, constant conditions to maintain uniformity in the selections.

For survival selection on solid medium, yeast cultures at specific, optimal growth densities re harvested and transformed with randomized in-frame fusion polynucleotide library DNA. The transformed cultures are grown in uracil dropout medium in liquid culture containing galactose for 2 hours following transformation to allow the cells to recover from transformation shock and begin inducing expression of the encoded randomized in-frame fusion polypeptides. The cell density is then determined and the cells are plated at a constant cell density and an expected colony density of roughly 50,000 transformants per 15 cm selective plate containing solid minimal medium lacking the specific nutrients used to select for presence of the centromeric plasmid, and containing galactose and butanol. Small aliquots of the transformation are plated on the plates with the same medium, but lacking butanol as controls. The plates are sealed and incubated at 30° C. until surviving colonies become visible.

Alternatively, yeast cells are transformed with fusion gene library DNA in the same manner as described above. Cells are plated on synthetic complete uracil dropout medium containing glucose as a carbon source (for 1 L, 6.7 g yeast nitrogen base, 0.77 g uracil dropout mix, 20 g Bacto agar, 120 µl 10N NaOH to bring the pH to 5.6-5.8, and 20 g glucose), and are incubated at 30° C. until transformed colonies become visible. The cells are then removed from the plates by scraping or by using glass beads to suspend the colonies in liquid added to the top of the plates. The cells are diluted to an OD600 of 0.1 and grown for 4 h in liquid synthetic complete uracil dropout medium containing raffinose as a carbon source (for 1 L, 6.7 g yeast nitrogen base, 0.77 g uracil dropout mix, 120 µl 10N NaOH to bring the pH to 5.6-5.8, and 20 g raffinose) to allow the cells to metabolize the remaining glucose, and to remove the catabolic repression of the GAL1 promoter. The cells are then diluted again to a density of OD600=0.1 into YPGal rich medium containing galactose as a carbon source and grown for 2 hours on a shaker at 30° C. to induce the expression of the fusion genes through the GAL1 promoter. The cell density of the resulting suspension is determined by counting with a hemocytometer, and cells are plated at a density of $2.5 \times 10^7$ cells per 15 cm plate (roughly 150,000 cells per sq cm) on YPGal agar medium containing 2-3% butanol, 2% being sub-lethal and 3% being lethal. The plates are incubated at 30° C. for 4-10 days and are then examined for colonies (when using lethal concentrations of butanol in the plates) or for colonies larger than the background (when using sub-lethal concentrations of butanol in the plates).

Because screens on solid media allow visualization of individual clones or transformants, they are particularly useful for identifying transformants expressing genes contributing to rapid growth which are clearly visible as larger colonies. A difference as little as a few percent in doubling time can lead to a measurable difference in colony size. For example, a 48 hour growth period for a strain with an average doubling time of 2 hours allows 24 doublings, while a strain with a 5% faster average doubling time of 114 minutes doubles 25.3 times, leading to a 2.5-fold difference in cell number which is clearly reflected in colony size. Thus, plating on solid media containing sub-lethal concentrations of butanol allows identification of transformants that have a growth advantage in the presence of butanol, indicative of butanol tolerance. Such screens have been used by others for isolation of genes contributing to ethanol tolerance (Hong 2010).

For resistance selection in liquid medium, yeast cultures are transformed with fusion gene library DNA in the same manner as described above. Cells are plated on synthetic complete uracil dropout medium containing glucose as a carbon source (for 1 L, 6.7 g yeast nitrogen base, 0.77 g uracil dropout mix, 20 g Bacto agar, 120 µl 10N NaOH to bring the pH to 5.6-5.8, and 20 g glucose), and are incubated at 30° C. until transformed colonies become visible. The cells are removed from the plates by scraping or by using glass beads to suspend the colonies in liquid added to the top of the plates, and are then diluted to an OD600 of 0.1 and grown for 4 h in liquid synthetic complete uracil dropout medium containing raffinose as a carbon source (for 1 L, 6.7 g yeast nitrogen base, 0.77 g uracil dropout mix, 120 µl 10N NaOH to bring the pH to 5.6-5.8, and 20 g raffinose) to allow the cells to metabolize the remaining glucose, and to remove the catabolic repression of the GAL1 promoter. The cells are then diluted again to a density of OD600=0.1 into YPGal rich medium containing galactose as a carbon source and grown for 2 hours on a shaker at 30° C. to induce the expression of the fusion genes through the GAL1 promoter. Butanol is then added to the cultures to 3%, the culture is capped to prevent evaporation and grown at 30° C. with gentle shaking for an additional 2-7 days. The cells remaining at the end of the selection period are then spun down and their plasmid DNA isolated for cloning into *E. coli* and re-transformation into yeast and another cycle of selection, or cells are plated on synthetic complete uracil dropout medium containing glucose as a carbon source to isolate surviving cells.

Colonies arising on selective plates are picked, or pools of yeast cells surviving selection in liquid medium are collected by centrifugation, expanded in selective medium if necessary, and used for plasmid extractions and plasmid propagation in *E. coli*. Two *E. coli* colonies are picked for each yeast transformant and 20 *E. coli* colonies are picked for each pool of surviving yeast cells from liquid selections, the DNA isolated and checked by restriction digestion. The plasmid DNA is then re-introduced into yeast for phenotype confirmation.

For simplicity, all plasmids are checked using two standard butanol-tolerance assays conducted in 96-well formats. The two assays use lethal and sublethal concentrations of butanol, respectively, in liquid culture. After a period of culture under lethal conditions, or several passages of growth under sublethal conditions, the cultures are serially diluted and replica-plated onto solid media to assess the density of surviving cells. These assays allow rapid and uniform testing of all isolated plasmids with the necessary controls, and allow rapid validation of randomized in-frame fusion polynucleotide conferring survival or growth advantages in the presence of butanol.

Characterization of Positive Clones

Randomized in-frame fusion polynucleotide expression constructs conferring the most dramatic or broad phenotypes are sequenced to identify the active genes. The results are tabulated and the best randomized in-frame fusion polynucleotide chosen for future work. Sequences identified repeatedly within distinct randomized in-frame fusion polynucleotide are used in future screens or as part of ORF collections. ORF collections containing randomized in-frame fusion polynucleotide already known to confer a desirable phenotype may be smaller than the whole-genome ORF collections described above for *E. coli*, which has many advantages including smaller library size, less expensive and faster screens, and amenability in organisms with lower transformation efficiencies, including algae and plants.

Example 3

Isolation of Randomized in-Frame Fusion Polynucleotides Capable of Conferring Higher Biomass, Accelerated Growth Rate or Alcohol Resistance to Cyanobacteria i.e. *Synechococcus Elongatus* Introduction Cyanobacteria have been engineered to produce a variety of chemicals, including ethanol (Deng 1999, Dexter 2009, Gao 2012), isobutyraldehyde (Atsumi 2009), isobutanol (Atsumi 2009), n-butanol (Lan 2011, Lan 2012), 1,3-butanediol (Oliver 2013), acetone (Zhou 2012), ethylene (Takahama 2003), isoprene (Lindberg 2010), fatty acids and fatty alcohols (Liu 2011, Tan 2011) and sugars (Ducat 2011, Ducat 2012), in some cases with promising results (i.e. Ducat 2011, Oliver 2013). Because of their relative genetic simplicity compared to plants and eukaryotic algae, low input requirements for their cultivation, ability to resist stresses, and amenability to genetic manipulation, cyanobacteria are among the photosynthetic organisms that will play a major role in this global shift towards biological production (Ducat 2011, Robertson 2011, Ruffing 2011).

Cyanobacteria are also of interest because of their high inherent rates of growth and carbon fixation; as a result, these organisms hold much promise as sources of biomass that can serve as feedstocks for fuel and chemical production. Nevertheless, biomass productivity is genetically complex and poorly understood, and therefore difficult to engineer. Increasing the rates of biomass accumulation in industrially promising cyanobacterial species is one of the obstacles faced by the nascent cyanobacterial biotechnology industry in its attempts to develop cyanobacteria into economical production organisms.

This example describes engineering of higher biomass, accelerated growth rate or alcohol resistance in the cyanobacterium *Synechococcus elongatus* using randomized in-frame polynucleotide fusions. *S. elongatus* is an important experimental cyanobacterium that is fast-growing and easily cultured, easily and efficiently transformable (Golden 1987, Tsinoremas 1994, Elhai 1994, Vioque 2007, Clerico 2007, Flores 2008, Heidorn 2011).

Sequence Identification and PCR Primer Design:

A complete collection of *Synechococcus elongatus* gene sequences are generated based on the reference sequence of *S. elongatus* strain PCC7942 available from the J. Craig Venter Institute (JCVI) Comprehensive Microbial Resource genome data collection (available on the CMR-JCVI web site on the internet). The sequence annotation of this genome is used for identifying the start and stop codons of each gene.

Figure 6:
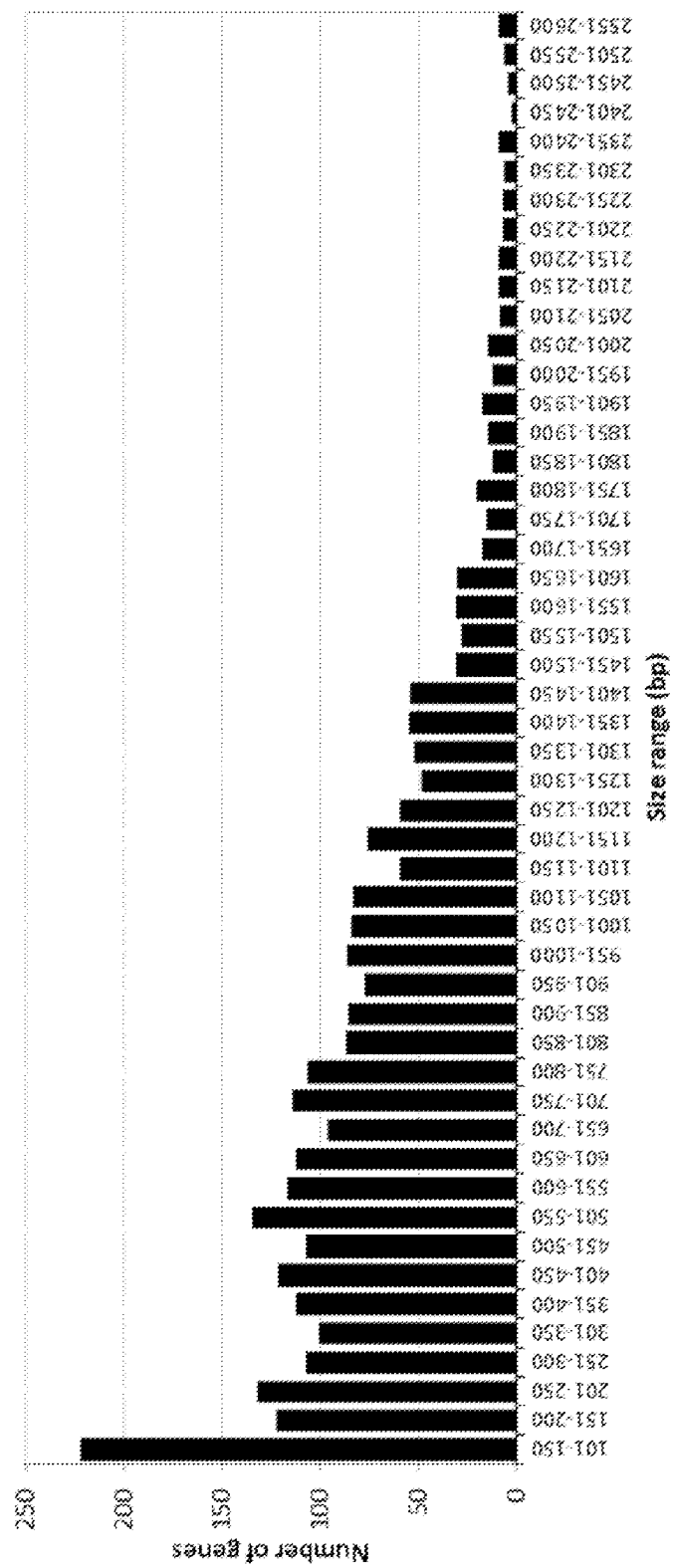
FIG. 6: Size distribution of selected *Synechococcus elongatus* genes, 101-2598 bp in length, used as a starting collection of sequences for a randomized in-frame polynucleotide fusion library.

The JCVI annotation lists 2991 total protein coding genes, ranging in length between 21 bp, encoding a protein of 7 amino acids, and 4,785 bp, encoding a protein of 1595 amino acids. Of these ORFs, 2958 are between 100 bp and 3,000 bp in length. The length of genes used as input sequences is capped at 3000 bp, preferentially 2604 bp, which increases the likelihood of successful PCR amplification and correct folding of the resultant in-frame fusion polypeptides or proteins. The result is a final collection of 2,925 ORFs for PCR amplification, that are between 100 and 2604 bp in length. The average length of this sequence collection is 785 bp and the median length is 693 bp. The size distribution of these *S. elongatus* ORFs is shown in FIG. 6.

PCR primers are designed based on the known start and stop codons of each ORF, including 24 bp of coding sequence from each end. Two different sets of primers are designed for each ORF, so that two different PCR products are generated, one for cloning the ORF into the 5' position of the fusion gene and the other for placing it 3'. The two amplicons for each ORF only differ in the presence of a stop codon (occurring only in the ORFs destined for the 3' position of the randomized in-frame fusion polynucleotide library) and in their conserved flanking sequences.

Each primer contains 16 bases of conserved sequence at the 5' end that serves two purposes. First, the extra sequence allows efficient PCR amplification of pools of ORFs using conserved PCR primer sequences that are able to amplify all the ORFs in a collection without biasing the representation of different ORFs with respect to one another (Dahl 2005, Myllykangas 2011, Natsoulis 2011). Second, they contain homology to the expression vector (see details below) and to the conserved sequences at the ends of the randomized in-frame fusion polynucleotide partner, enabling rapid and efficient, homology-dependent assembly of the randomized in-frame fusion polynucleotides in the vector (see FIG. 3).

The 5'-terminal 16 nucleotides in the 3' PCR primer of ORFs destined for the 5' position in a fusion gene, and the 5'-terminal 16 nucleotides in the 5' PCR primer of ORFs destined for the 3' position in a fusion gene, form part of a linker sequence that separates the two ORFs. This 60 bp linker sequence encodes a 20 amino acid peptide (SEQ ID NO: 25104) rich in glycine, serine and alanine, which is loosely based on sequences used by others when connecting two ORFs in a fusion gene (Arai 2001, Eldridge 2009, Wang 2010). This linker sequence is fully encoded in the second or conserved stage of PCR amplification (see below), resulting in the addition of conserved coding sequences to the 3' ends of the ORFs destined for the 5' position of the randomized in-frame fusion polynucleotides and the 5' end of the ORFs destined for the 3' position in the randomized in-frame fusion polynucleotides.

Because two entire sets of cyanobacterial ORFs need to be generated, one for the 5' position in the fusion genes and the other for the 3' position, all procedures described below are performed in duplicate for the two ORF positions.

Cyanobacterial Strains And Genomic DNA Preparation:

The chosen *Synechococcus elongatus* genes are PCR amplified from strain PCC7942. This strain is available from the Institut Pasteur Culture Collection of Cyanobacteria, and can be used as a source of high-purity genomic DNA from which genes of interest can be amplified.

The cyanobacterial strain that serves as the source of ORFs is grown in liquid culture using standard growth conditions (Bustos 1992, Kulkarni 1997, Mutsuda 2003, Clerico 2007) in BG11 medium or modified BG11 medium. Modified BG-11 liquid medium (BG11M, Clerico 2007) is made up as follows: 1.5 g/L NaNO3, 0.039 g/L K2HPO4, 0.075 g/L MgSO4.7H2O, 0.02 g/L Na2CO3, 0.027 g/L CaCl2, 0.001 g/L EDTA, 0.012 g/L FeNH4 citrate, and 1 mL of the following microelement solution: 2.86 g/L H3BO3, 1.81 g/L MnCl2.4H2O, 0.222 g/L ZnSO4.7H2O, 0.391 g/L Na2MoO4, 0.079 g/L CuSO4.5H2O, and 0.0494 g/L Co(NO3)2.6H2O. Solid medium is made by combining equal volumes of twice concentrated BG-11M liquid medium and Difco agar solution (3% in sterile water) autoclaved separately and mixed together; filter-sterilized Na2SO3 is added to 1 mM final concentration.

Cells are pelleted by centrifugation and then resuspended in ¹⁄₁₀ of the original culture volume using 20 mM Tris pH 8.0, 10 mM EDTA and 100 mM glucose. The cells are lysed by adding ¹⁄₁₀₀ volume 10 mg/ml hen egg lysozyme dissolved in 10 mM Tris pH 8.0, 10 mM EDTA and adding ¹⁄₂₀ volume 10 mg/ml DNA-se free RNAse A, mixing well and incubating at room temperature for 15 minutes. Cell lysis and release of genomic DNA is completed by treatment with proteinase K. To the lysed cells is added ¹⁄₁₀ volume of 1M Tris, 0.5M EDTA, pH 9.5 and ¹⁄₁₀₀ volume of a 20 mg/ml solution of proteinase K. The lysed cells are mixed gently by capping the tube and inverting it, and the mixture is incubated at 50° C. for 2 hours with occasional gentle mixing. The DNA is then extracted twice with an equal volume of phenol-chloroform (pH 7.0) followed by one additional extraction with an equal volume of chloroform. The DNA is precipitated by the addition of ¹⁄₁₀ volume 3M sodium acetate pH 5.5 and 2.5 volumes ethanol (or 1 volume isopropanol). The tube is immediately inverted after addition of the alcohol, and the DNA is visible as a stringy white precipitate. To avoid co-precipitating other impurities from the cell (residual protein or carbohydrates), the precipitated DNA is removed from the alcohol solution using a clean pipet tip or a pasteur pipet and is transferred to a clean tube containing 70% ethanol. The tube is capped and inverted multiple times to remove salts from the DNA precipitate. The pellet is collected by centrifugation, the ethanol removed by aspiration and the pellet is dried in an air flow hood to remove excess ethanol. The pellet is dissolved in 1×TE (10 mM Tris pH 8.0, 0.1 mM EDTA). Further purification of the DNA can be performed using column chromatography or cesium chloride density centrifugation (Sambrook 1989).

Other DNA preparation methods, yielding equivalent results to the one described here, have been described in the literature (Clerico 2007, Heidorn 2011).

Expression Vectors

A simple and standard expression vector is used to express all fusion proteins. The *S. elongatus* $P_{trc}$ promoter inducible by isopropyl-β-D-thiogalactopyranoside (IPTG, Geerts 1995, Kutsuna 1998) is frequently used and effective for the expression of genes in *S. elongatus*. In addition, the expression vector contains the NS1 or NS2 neutral site elements that direct site-specific integration into the *S. elongatus* chromosome (Mutsuda 2003), a suitable terminator (Wang 2012), antibiotic resistance marker gene(s) and the high-copy pMB1 plasmid replicon from pUC 19 (Yanish-Perron 1985). The pUC 19 vector is a convenient source of a plasmid backbone (pMB 1 replicon), an antibiotic-resistance polynucleotide (e.g. β-lactamase from Tn3 conferring ampicillin resistance) and the *E. coli* lac promoter/operator and terminator sequences. These sequences are PCR amplified from pUC19 and used as a source of the plasmid backbone for cloning and expression of randomized in-frame fusion polynucleotides as illustrated in FIG. 3. For example, the PCR primers 5'-agct-gtttcctgtgtgaaattgtt-3' and 5'-ttaagccagccccgacacccgcca-3' can be used to PCR amplify such a fragment from pUC19. The regions of homology to this expression vector fragment that are included in the 5' end of the 5' ORF and in the 3' end of the 3' ORF (see FIG. 3) correspond to the same DNA sequences specified by these two PCR primers.

As an alternative to the $P_{trc}$ promoter system for expression of randomized in-frame fusion polynucleotides, other cyanobacterial promoters can be used as described in the literature (Ruffing 2011, Wang 2012). Alternatively, synthetic promoters can be developed from partially randomized sequences containing the consensus elements for bacterial expression (Jensen 1998a, Jensen 1998b, Hammer 2006, De May 2007).

To test a candidate promoter for suitability for the expression of randomized in-frame fusion polynucleotides, the selected promoters and their associated 5'UTRs are synthesized as 250 bp DNA fragments and cloned upstream of the *E. coli* lacZ beta-galactosidase gene in a vector containing a selectable marker (Heidorn 2011, Ruffing 2011). Terminators are placed upstream of the promoter fragments to prevent read-through transcription from promoters present elsewhere on the plasmid. The resulting constructs are transformed into *S. elongatus* and the transformants assayed for beta-galactosidase activity (Bustos 1991). Firefly luciferase is also suitable as an assayable marker gene and can be used for promoter testing instead of lacZ (Kondo 1993, Andersson 2000).

The plasmids described here for expression of randomized in-frame fusion polynucleotides are based on high-copy number plasmids such as those containing the pMB 1 origin of replication. However, other plasmid systems are also suitable for this work. For example an F'-based plasmid such as pBeloBAC11 (Shizuya 1992) or broad-host-range plasmid systems (Heidorn 2011) can be used to clone randomized in-frame fusion polynucleotides using the same promoters as described above, or using a different set of promoters. Any plasmid backbone that allows cloning and propagation of sequences of interest in any suitable host cell can be used for transformation of *S. elongatus* after cloning and plasmid purification (Heidorn 2011).

Fusion Gene Design:

For example, a hypothetical polynucleotide sequence A, coding for a peptide or protein, can be part of a starting collection of polynucleotides intended to be used for the construction of a collection of randomized in-frame fusion polynucleotides. The goal of generating the collection of randomized in-frame fusion polynucleotides is to have each polynucleotide in the starting collection, including polynucleotide A, present at the 5' position of a series of randomized in-frame fusion polynucleotides, and to have the same sequence present in the 3' position of a different series of randomized in-frame fusion polynucleotides. In each of these two series of randomized in-frame fusion polynucleotides, the polynucleotide A is fused with as many other members of the starting collection as feasible with the available methods for generating such fusions. In order to enable these separate series of fusions, with polynucleotide A in a 5' or in a 3' position with respect to the other polynucleotides present in the starting collection, two different versions of the polynucleotide sequence A are generated. The version of polynucleotide sequence A intended for use in the 5' position does not contain a stop codon and has 5' homology (or other sequence compatibility for cloning purposes) to the promoter region of the expression vector. The version of polynucleotide sequence A intended for use in the 3' position does contain a stop codon and has 3' homology (or other sequence compatibility for cloning purposes) to the terminator region of the expression vector.

The sequence separating the two ORFs in a randomized in-frame fusion polynucleotide (labeled as 'linker sequence' in FIG. 3) encodes a short peptide that is rich in glycine and serine residues. Such a peptide is expected to be unstructured and will provide a flexible protein spacer separating the two members of a randomized fusion protein while being relatively resistant to proteolysis. Examples of suitable linker peptide sequences are GGGGSGGSGGSGGGS (SEQ ID NO: 25117) or SGGSSAAGSGSG (SEQ ID NO: 25118) or SAGSSAAGSGSG (SEQ ID NO: 25119, Wang 2010). Alternatively, alpha-helical linker sequences can be used, for example the sequence $A(EAAAAK)_nA$, n=2-5 (SEQ ID NOS: 25120 to 25123, Arai 2001).

Sequence Amplification:

Each ORF is PCR amplified with polynucleotide-specific primers containing 24 polynucleotide-specific bases at the 3' end and 16 bp of conserved sequences at the 5' ends. The amplification is performed for each polynucleotide individually, or for pools of polynucleotides simultaneously.

For individual amplification, the two primers, each at a final concentration of 0.5-5 µM, are combined with 10-1000 ng of *E. coli* genomic DNA, PCR buffer and thermostable polymerase in a total reaction volume of 1-50 µl. A high-fidelity thermostable polymerase such as Phusion® polymerase can be used. For Phusion® polymerase, the PCR amplicons are generated by 2 minutes denaturation at 95° C. followed by 10-35 cycles of 20 seconds at 95° C., 20 seconds at 60° C. and 1 min/kb at 72° C. (minimally 30 seconds at 72° C.). The efficiency of formation of the PCR product is measured by agarose electrophoresis or by fluorescent spectroscopy using a fluorometer such as a Qubit® fluorometer (Life Technologies). Successful PCR reactions can be purified using silica resins suitable for DNA purification. Unsuccessful reactions are repeated by varying the $Mg^{+2}$ concentrations in the PCR reaction and/or other reaction conditions. Following successful amplification of each ORF, the concentration of each PCR product is normalized, and products corresponding to specific size ranges are pooled for cloning.

Individual amplification has the advantage that the amplification of each ORF is performed and monitored separately, allowing approximately equivalent representation of each ORF in the final pool of ORFs. It has the disadvantage that a large number of PCR reactions need to be performed and assayed in parallel, requiring robotics and optimization of a large number of amplifications.

For pooled amplification, ORFs are pooled by size, because the efficiency of PCR amplification is strongly size dependent, and because the PCR conditions (extension time at 72° C., see above) depend on the size of the amplicon. The ORFs are separated into any number of size pools. A smaller number of size pools has the advantage that the amplification can be done in a smaller number of samples, saving time and reagents. A large number of size pools has the advantage that the complexity of each pool is lower, implying higher concentrations of each primer pair and thus a higher likelihood of successful amplification of each polynucleotide.

A plausible and convenient number of pools to use for gene amplification is 96 pools of 30-31 genes each, filling one 96-well plate (96 pools×30.81 genes on average=2958 genes total). To arrive at the assignment of each gene to a pool, the genes and their corresponding primer pairs are sorted based on gene size and primers assigned to each pool from contiguous sets of primers from the sorted list. When subdividing the total number of amplifications into 96 pools, 31 genes of identical or similar size=62 primers are assigned to each of 78 pools, and the remaining 18 pools each contain 60 primers corresponding to 30 genes.

Each ORF is PCR amplified with polynucleotide-specific primers containing 20-30 polynucleotide-specific bases at the 3' end and the conserved sequences at the 5' ends. The amplification is performed for each polynucleotide individually, or for pools of polynucleotides simultaneously.

For individual amplification, the two primers, each at a final concentration of 0.5-5 µM, are combined with 10-1000 ng of *E. coli* genomic DNA, PCR buffer and thermostable polymerase in a total reaction volume of 1-50 µl. A high-fidelity thermostable polymerase such as Phusion® polymerase can be used. For Phusion® polymerase, the PCR amplicons are generated by 2 minutes denaturation at 95° C. followed by 10-35 cycles of 20 seconds at 95° C., 20 seconds at 60° C. and 1 min/kb at 72° C. (minimally 30 seconds at 72° C.). The efficiency of formation of the PCR product is measured by agarose electrophoresis or by fluorescent spectroscopy using a fluorometer such as a Qubit® fluorometer (Life Technologies). Successful PCR reactions can be purified using silica resins suitable for DNA purification. Unsuccessful reactions are repeated by varying the $Mg^{+2}$ concentrations in the PCR reaction and/or other reaction conditions. Following successful amplification of each ORF, the concentration of each PCR product is normalized, and products corresponding to specific size ranges are pooled for cloning.

Individual amplification has the advantage that the amplification of each ORF is performed and monitored separately, allowing approximately equivalent representation of each ORF in the final pool of ORFs. It has the disadvantage that a large number of PCR reactions need to be performed and assayed in parallel, requiring robotics and optimization of a large number of amplifications.

For pooled amplification, ORFs are pooled by size, because the efficiency of PCR amplification is strongly size dependent, and because the PCR conditions (extension time at 72° C., see above) depend on the size of the amplicon. The ORFs are separated into any number of size pools. A smaller number of size pools has the advantage that the amplification can be done in a smaller number of samples, saving time and reagents. A large number of size pools has the advantage that the complexity of each pool is lower, implying higher concentrations of each primer pair and thus a higher likelihood of successful amplification of each polynucleotide. A convenient number of size pools corresponds to the number of wells in one or two 96-well plates. For example, 192 pools of 15-16 ORFs each (192 pools×15.23 ORFs on average=2925 ORFs total; this corresponds to 45 pools containing 16 primer pairs each, and 147 pools containing 15 primer pairs each).

Pooled PCR amplification is performed in three steps: 1) an initial amplification using gene-specific primers followed by 2) bulk-up of each ORF pool using conserved primers, followed by further pooling, size selection on gels and 3) a third amplification step resulting in the final length PCR products. The three amplification steps are referred to as $1^{st}$ stage, $2^{nd}$ stage and $3^{rd}$ stage amplifications, respectively.

All PCR amplifications are performed using Phusion™ Hot Start II thermostable high-fidelity polymerase (Thermo Scientific™). The enzyme is supplied with a 5×HF amplification buffer which is used for all reactions. Amplifications are performed in 20 µL or 50 µL reaction volumes, as noted below. All amplifications are performed on T100 thermal cyclers (Bio-Rad Laboratories) containing 96-well blocks. The deoxynucleotide triphosphates (dNTPs) used in all amplifications are a stock containing 10 mM of each dNTP, also obtained from Thermo Scientific®. Deionized water is used in all reactions and to make all solutions not supplied with the polymerase.

All PCR amplifications follow the same general procedure:
1. A PCR mix as described below is prepared for each stage of the PCR reaction, and is kept cold until inserted into the thermal cycler.
2. The samples are mixed thoroughly and then centrifuged at 4000 rpm for 1 minute to bring the reaction contents to the bottom of the tube or well in a plate.
3. The plates or tubes are inserted into a thermal cycler.

$1^{st}$ Stage Amplification:

First stage amplifications are conducted using pools of sequence-specific PCR primers as noted above. Each amplification is performed in 20 µL total volume, using 2 µL of 10 ng/µL *Synechococcus elongatus* strain PCC7942 genomic template DNA per reaction. To each reaction are added 2.5 µL primer pools from 10004 stocks to provide a total final primer concentration of 12.5 µM. Each primer pool contains either 15 or 16 primer pairs; and final individual primer concentrations are approximately 0.39-0.42 µM.

The 1st stage PCR reaction mix is set up in 20 µl total volume and is mixed from the following components: 4 µl 5× Phusion® HF Buffer, 0.4 µl 10 mM dNTPs, 10.7 µl deionized $H_2O$, 2 µl 10 ng/µl genomic template DNA, 2.5 µL primer pools (10004), 0.4 µl Phusion™ Hot Start II thermostable polymerase (2 units/µl). The PCR cycling conditions are as follows: initial denaturation at 98° C. for 45 sec, 10 cycles consisting of three steps each (98° C. for 10 seconds, 60° C. for 30 seconds and 72° C. for 3 minutes), a final extension step at 72° C. for 3 minutes and a soak at 4° C. until removal of the samples from the thermal cycler. After the PCR amplification is complete, the samples are removed from the thermal cycler, mixed thoroughly, and centrifuged at 4000 rpm for 1 minute to provide the $1^{st}$ Stage amplification product.

$2^{nd}$ Stage Amplification:

The primers used in $2^{nd}$ stage amplifications are single primers with homology to the conserved portions of the $1^{st}$ stage amplification primers. The $2^{nd}$ stage primers are prepared as pairwise mixes, each containing equimolar amounts of the two primers and containing a total primer concentration of 20 µM.

The $2^{nd}$ stage PCR reaction mix is set up in 50 µl total volume and is mixed from the following components: 10 µl 5× Phusion® HF Buffer, 1 µl 10 mM dNTPs, 22 µl deionized $H_2O$, 10 µl $1^{st}$ stage reaction product, 6 µl $2^{nd}$ stage primer mix (20 µM) and 1 µl Phusion™ Hot Start II thermostable polymerase (2 units/µl). The PCR cycling conditions are as follows: initial denaturation at 98° C. for 45 sec, 25 cycles consisting of two steps each (98° C. for 20 seconds and 72° C. for 3 minutes), a final extension step at 72° C. for 3 minutes and a soak at 4° C. until removal from the thermal cycler.

After the PCR amplification is complete, the samples are removed from the thermal cycler, mixed thoroughly, and centrifuged at 4000 rpm for 1 minute.

To allow more efficient downstream processing of the samples, the 192 multiplex PCR samples are consolidated into 24 larger pools by pooling 8 samples into one. The amount of product in each multiplex PCR reaction is first quantitated to allow equimolar pooling of the different sized fragment collections. This is done either by conducting gel electrophoresis on each multiplex reaction and quantitating the fluorescence in each band of expected size, or by capillary electrophoresis, such as an Applied Biosystems® 3730 DNA analyzer or a QIAGEN® QJAxcel® instrument. The concentration of desirable product in each multiplex reaction is used to calculate the relative amounts of each multiplex PCR reaction that are to be pooled together to result in equimolar amounts of each product added to the pool, taking the average size of each multiplex pool into consideration. Products are grouped and pooled by size to minimize amplification biases in downstream PCR amplifications.

The 192 multiplex reactions are combined into 24 larger pools as follows. Large Pool 1: multiplex pools 1-8; Large Pool 2: multiplex pools 9-16; Large Pool 3: multiplex pools 17-24; Large Pool 4: multiplex pools 25-32; Large Pool 5: multiplex pools 33-40; Large Pool 6: multiplex pools 41-48; Large Pool 7: multiplex pools 49-56; Large Pool 8: multiplex pools 57-64; Large Pool 9: multiplex pools 65-72; Large Pool 10: multiplex pools 73-80; Large Pool 11: multiplex pools 81-88; Large Pool 12: multiplex pools 89-96; Large Pool 13: multiplex pools 97-104; Large Pool 14: multiplex pools 105-112; Large Pool 15: multiplex pools 113-120; Large Pool 16: multiplex pools 121-128; Large Pool 17: multiplex pools 129-136; Large Pool 18: multiplex pools 137-144; Large Pool 19: multiplex pools 145-152; Large Pool 20: multiplex pools 153-160; Large Pool 21: multiplex pools 161-168; Large Pool 22: multiplex pools 169-176; Large Pool 23: multiplex pools 177-184; and Large Pool 24: multiplex pools 185-192. The resulting average ORF sizes (with and without added primer sequences) of each Large Pool is calculated based on the sizes of its component ORFs.

Once pooling has been completed, an amount of each ORF Large Pool corresponding to 10 µg of total desirable product are purified using a silica resin column or plate such as the Macherey Nagel NucleoSpin® 96 PCR cleanup kit, following the manufacturer's recommendationsAfter elution of the purified PCR product, each sample is mixed thoroughly and its concentration determined spectrophotometrically.

To eliminate unwanted size products and primer dimers from the 48 Large Pools, 2 µg of each pool is electrophoresed on a 1% agarose gel and stained with ethidium bromide, the bands visualized under UV or blue light, and gel fragments corresponding to the correct size of each larger pool are excised from the gel. The gel fragments are weighed and DNA is purified from them using silica resin gel purification methods such as the Macherey Nagel Nucleo Spin® Gel and PCR clean-up kit, following the manufacturer's recommendations. When the purification is complete, the concentrations of all samples are determined spectrophotometrically, and the concentration of each purified $2^{nd}$ stage Large Pool amplification product is adjusted to 10 ng/µL for $3^{rd}$ Stage Amplification.

$3^{rd}$ Stage Amplification:

The $3^{rd}$ stage amplification adds the final sequences to each PCR product to allow efficient assembly by end homology and to increase the amount of each Large Pool. The primers used in $3^{rd}$ stage amplifications are single primers with homology to the conserved portions of the $1^{st}$ and $2^{nd}$ stage amplification primers. The $3^{rd}$ stage primers are prepared as pairwise mixes, each containing equimolar amounts of the two primers and containing a total primer concentration of 20 µM.

The $3^{rd}$ stage PCR reaction mix is set up in 50 µl total volume and is mixed from the following components: 10 µl 5× Phusion® HF Buffer, 1 µl 10 mM dNTPs, 22 µl deionized $H_2O$, 10 µl gel-purified, pooled $2^{nd}$ stage reaction product (10 ng/µl), 6 µl $3^{rd}$ stage primer mix (20 µM) and 1 µl Phusion® Hot Start II thermostable polymerase (2 units/µl). The PCR cycling conditions are as follows: initial denaturation at 98° C. for 45 sec, 25 cycles consisting of two steps each (98° C. for 20 seconds and 72° C. for 3 minutes), a final extension step at 72° C. for 3 minutes and a soak at 4° C. until removal from the thermal cycler.

After the $3r^d$ stage amplification is complete, the samples are mixed thoroughly, centrifuged, and purified using a silica resin purification, such as the Macherey Nagel NucleoSpin® 96 PCR clean-up kit, following the manufacturer's recommendations. After elution, each sample is mixed thoroughly and its concentration is determined spectrophotometrically.

For more efficient downstream processing, the 24 Large Pools are then consolidated into 5 "Superpools", by combining the 4 smallest Large Pools into one Superpool and combining successive sets of 5 Large Pools to form additional Superpools. The relative amounts of each Large Pool added to each Superpool is calculated, by considering the final concentrations of each large pool after $3r^d$ stage amplification and purification, and the final average size of each Large Pool (including sequences added by primers), with the goal of adding equimolar amounts of each Large Pool to each Superpool.

As in previous steps in this example, Superpools are prepared based on ORF size, with similarly sized ORF Larger Pools grouped into the same Superpool. To minimize cloning biases based on insert size, size fractions are cloned separately into the expression vectors, by combining each size pool of the 5' ORFs with each size pool of the 3' ORFs pairwise, in each case together with the cloning vector.

Randomized in Frame Fusion Polynucleotide Library Construction

After amplification, the relative concentrations of the ORFs are normalized for molar concentrations of DNA molecules (as opposed to mass concentrations). Specific ORFs, including ORFs from cloned polynucleotides or ORFs from other organisms that are added to an ORF collection generated by individual or pooled PCR amplification as described above, can be added to the ORF collection in varying amounts. For example, specific ORFs are added in molar amounts corresponding to the concentrations of other ORFs, or in lower or higher amounts that change their representation within the final randomized in-frame fusion polynucleotide library. For example, if a polynucleotide encoding a specific protein that confers stress tolerance is suspected to have a particularly high chance of conferring stress tolerance in *S. elongatus*, it is possible to over-represent this sequence in the ORF collection to ensure that most or all randomized in-frame fusion polynucleotide combinations are tested along with this prioritized sequence.

Randomized in Frame Fusion Polynucleotide Library Construction

After amplification and pooling into Superpools, the relative concentrations of the ORFs are normalized for molar concentrations of DNA molecules (as opposed to mass concentrations). Specific ORFs, including ORFs from cloned polynucleotides or ORFs from other organisms that are added to an ORF collection generated by individual or pooled PCR amplification as described above, can be added to the ORF collection in varying amounts. For example, specific ORFs are added in molar amounts corresponding to the concentrations of other ORFs, or in lower or higher amounts that change their representation within the final randomized in-frame fusion polynucleotide library. For example, if a polynucleotide encoding a specific protein that confers stress tolerance is suspected to have a particularly high chance of conferring stress tolerance in *E. coli*, it is possible to over-represent this sequence in the ORF collection to ensure that most or all randomized in-frame fusion polynucleotide combinations are tested along with this prioritized sequence.

One-step assembly of two ORFs into a pUC19 expression vector molecule is directed by conserved/homologous sequences that are located at the 5' and 3' ends of each fragment and that specify the structure of the circular, assembled product, shown in FIG. 3. Any one of a large number of methods can be used to accomplish this homology-dependent assembly, all of which are derived from cloning methods that are based on the annealing of homologous, single-stranded DNA ends, such as linker tailing methods (Lathe 1984) or methods dependent on complementary homopolymeric single-stranded tails at the ends of DNA molecules (Lobban 1973). In addition, modern homology-dependent cloning techniques are conceptually related to the ligation-independent cloning methods described in the early 1990s (Aslanidis 1990, Aslanidis 1994). Such homology-dependent cloning methods include but are not limited to: In-Fusion cloning (Zhu 2007, Irwin 2012), Sequence and Ligation-Independent Cloning (SLIC, Li 2007, Li 2012), FastCloning (Li 2011), Circular Polymerase Extension Cloning (Quan 2009, Quan 2011), the Gibson assembly method (Gibson 2009, Gibson 2010), Quick and Clean Cloning (Thieme 2011), and others (Vroom 2008).

Library assembly is performed in vitro with each combination of the five 5' and the five 3' ORF superpools, for a total of 25 assembly reactions. In each reaction, 150 fmol of the 5'ORF superpool DNA and 150 fmol of the 3'ORF superpool DNA (molar concentrations based on average size) are combined with 75 fmol of the PCR-amplified single fragment pUC19 vector DNA (SEQ ID 25126). The volume of the DNA mixture is adjusted to 10 µl, to which is added 10 µl of assembly mix (200 mM Tris pH 8.0, 20 mM $MgCl_2$, 0.4 mM each of dATP, dCTP, dGTP and dTTP, 20 mM dithiothreitol, 2 mM nicotinamide adenine dinucleotide, 0.02 units/µl T5 exonuclease, 0.05 units/µl Phusion® thermostable DNA polymerase, 0.4 units/µl Taq ligase). The reaction is mixed gently and incubated at 50° C. for 1-2 hours. The reaction is then kept on ice or frozen before use for E. coli transformations.

This in vitro assembly procedure can be performed as described, or with other enzymes with exonuclease activity that may be suitable for this procedure, such as T4 DNA polymerase, Exonuclease III, lambda exonuclease, T5 exonuclease or T7 exonuclease. Exonucleases with 5' to 3' directionality of their activity (i.e. T4 polymerase, lambda exonuclease, T5 exonuclease or T7 exonuclease) are preferred as they result in higher numbers of base pairs of annealed sequence between the two nicks at each cloning junction, thus stabilizing the desired product. The procedure can be performed without the addition of Taq DNA ligase, with satisfactory results. The reaction may also be supplemented with polyethylene glycol (molecular weight 4000-10000) at a final concentration of 5-10% to promote annealing of single-stranded DNA ends. However, given sufficiently high DNA concentrations as noted above, PEG is not necessary.

The assembly reactions are transformed into E. coli by electroporation by mixing 1 µl of the assembly reaction with 25 µl electrocompetent DH10B cells (Life Technologies Corporation) or EC100 cells (Epicentre Technologies) on ice. The cell/DNA mixture is then transferred into a 1 mm gap width electroporation cuvette and electroporated at 1.5 kV using a Bio-Rad Micropulser electroporator. The cells are suspended in 1 ml LB broth, cultured in a 10 ml culture tube for 1 hour at ° C. shaking at 250 rpm, and plated on LB agar containing 50-100 µg/µl carbenicillin. Transformation efficiencies can be improved by desalting the assembly reaction, either by DNA precipitation with ethanol, or by microdialysis, or by centrifugation through a Bio-Rad Micro Bio-Spin P6 gel column following the manufacturer's recommendation.

Library Transformation and Screening

The S. elongatus strains PCC7942 or PCC7002, which are used industrially as well as for research purposes (Ruffing 2011) are used for all transformations and screens.

Following assembly, the different libraries are either be used directly to generate S. elongatus transformants or are first amplified by transformation into E. coli.

The total possible number of sequence combinations resulting from random pairwise assembly of 2925 ORFs equals the square of this number=8.6 million. Typically, the goal of a screening project is to screen through 3× as many clones as the library complexity to have a >90% chance that each combination is represented. In this example, this would correspond to roughly 26 million transformants, which is possible in S. elongatus due to high transformation efficiencies that have been achieved in various laboratory strains. Generating 10 million S. elongatus transformants corresponds to performing roughly 1000 transformations using cells grown in 10 liters of culture medium.

Because plasmid assembly reactions using homology-dependent cloning methods can be highly efficient (Li 2007, Quan 2009, Gibson 2010, Li 2011, Quan 2011, Thieme 2011, Li 2012), resulting in a high percentage of the input DNA assembled into the correct product, S. elongatus can be transformed directly with the FG pool DNA. Assuming a S. elongatus transformation rate of 1E6 transformants per µg of DNA, this requires >10 µg of assembled FG pool DNA, which is an attainable number, considering that each assembly reaction contains a total of about 0.5 µg of DNA. Pilot S. elongatus transformation experiments are used to measure the number of transformants that can be generated from FG pool DNA, and whether these transformants contain integrated sequences of the correct structure.

If the observed S. elongatus transformation efficiency is limiting for generating a sufficient number of transformants directly from FG pool DNA, the FG pools can first be amplified in E. coli. A single 20 µl homology-mediated assembly reaction can yield roughly 2 million E. coli transformants, which can be amplified either in liquid gel medium (Elsaesser 2004) or by a combination of liquid growth and amplification with phi29 polymerase (Fullwood 2008). The plasmid amplification is performed separately for each of the 25 assembly pools, maintaining proportionality of the sequence combinations represented in each pool.

Transformation is achieved using the following procedure (Clerico 2007). S. elongatus cells are grown in 100 mL of liquid BG-11M to an OD750 of 0.7. 15 mL of the cyanobacterial cell suspension is harvested by centrifugation for 10 min at 6000 g. The cell pellet is resuspended in 10 mL of 10 mM NaCl and pelleted again by centrifugation for 10 min at 6000 g. The cell pellet is resuspended in 0.3 mL of BG-11M and transfer to a microcentrifuge tube. To each aliquot of 0.3 mL of cells, between 50 ng and 2 µg of DNA are added in a volume of 1-20 µL. The tubes are wrapped in aluminum foil to shield the cells from light and incubated overnight at 30° C. with gentle agitation. The entire 0.3-mL cell suspension is plated on a BG-11M plate containing the appropriate antibiotic or selective agent. The plates are incubated at 30° C. in constant light for approximately 5 days until single colonies appear.

Bacterial conjugation between *E. coli* and *S. elongatus* can also be used as an efficient way to deliver the library of fusion protein genes into *S. elongatus* (Tsinoremas 1994, Elhai 1994).

Isolated colonies can be re-streaked or grown in liquid culture in the presence of the antibiotic to continue selecting for the insertion. The transformed cells can be grown in the presence of inducer to activate expression of the fusion proteins (i.e. in the presence of IPTG when using the $P_{trc}$ promoter).

Screening for Rapid Growth/High-Biomass Phenotypes:

The pooled libraries containing fused genes are transformed into the PCC7942 laboratory strains of *S. elongatus* (Ruffing 2011) and then grown under conditions that select for presence of the plasmids and induce expression of the fusion proteins. All cultures are grown under carefully controlled, constant conditions in lighted racks and lighted orbital platform shakers to maintain uniformity in the selections.

Two different approaches are used to select or screen for transformants with higher growth rates and/or higher rates or biomass accumulation. One of these involves screening transformation plates for larger-sized colonies, while the other uses FACS sorting to isolate cyanobacterial microcolonies encapsulated and grown in alginate beads.

Larger colonies: Because screens on solid media allow visualization of individual clones or transformants, they are particularly useful for identifying transformants expressing genes contributing to rapid growth which are clearly visible as larger colonies, which can easily be picked out of large numbers of colonies, even at high plating densities. A difference as little as a few percent in doubling time can lead to a measurable difference in colony size. For example, a 6 day=144 hour growth period for a strain with an average doubling time of 6 hours=360 minutes would allow 24 doublings, while a strain with a 5% faster average doubling time of 342 minutes would double 25.3 times, leading to a 2.5-fold difference in cell number which is clearly reflected in colony size. Such screens have been used by others for isolation of genes contributing to ethanol tolerance in yeast (Hong 2010).

When screening for larger colonies, it is possible for false positives will arise in which the colony size is altered for reasons other than an increased rate of cell division or an increase in average cell size. Examples of such false positive are altered colony morphologies that result in flatter colonies, or colonies containing cells with higher mobility that tend to spread out from the edges of the colony. To rapidly eliminate these false positives, each candidate colony is lifted or scraped from the screening plate with a wire or plastic loop and suspended in a small amount of liquid medium. Half of the cell suspension is counted with a flow cytometer to determine the cell number and light scattering properties of the cell that are indicative of cell size. Only colonies with cell numbers that are 2 standard deviations above the average cell number found in 10 control colonies, or colonies containing cells with a proportionally similar increase in cell size, are retained for further characterization and validations.*

Encapsulation in gel microbeads: Encapsulation in alginate or agarose gel microbeads or microdrops has been successfully used for isolation of microbes capable of growth in a variety of environmental conditions, for culturing microbes that are unable to grow in high nutrient concentrations, or for performing growth assays of microbial strains or mixtures of microbes. Individual microbes encapsulated within a gel microbead form microcolonies within the bead as they grow and can be separated by fluorescent activated cell sorting based on the side scattering properties of the microbeads which reflect the size of the microcolonies within them.

Cyanobacterial transformants are removed from plates by wetting the plate with liquid medium and using the spreading action of 4-5 mm glass beads to separate colonies from the agar matrix. The suspended transformed cells are pooled corresponding to the sub-library that was used to produce them, and parts of each pool will be cryopreserved. Individual cyanobacterial cells are encapsulated in gel microdrops using published protocols and encapsulation materials and equipment sold by One Cell Systems Inc. The microdrop composition is adjusted to allow uniform growth of *S. elongatus* cells within them at normal rates of cell division.

The cells are grown at a density of $10^7$ microdrops per 50 ml in lighted bioreactors or growth flasks with constant shaking. To reduce the probability of multiple cells encapsulated within the same microdrop, the cell density is adjusted so that approximately 10% of microdrops contain a cell, requiring approximately $3 \times 10^8$ microdrops (in 1.5 L total volume of medium) to represent the entire library of $10^7$ transformants at >90% confidence of representation.

After several days' growth, the gel microbeads are collected by centrifugation and sorted by fluorescence activated cell sorting. Gel microdroplets containing microcolonies that are 2 standard deviations above the mean in side scattering are isolated, returned to liquid culture and grown for an additional several days to allow the cyanobacterial cells to overgrow the microdroplets and burst out of them. DNA is isolated from such cultures and used for plasmid rescue in *E. coli* (Dolganov 1993). Rescued plasmid are purified as populations of molecules and re-introduced into *S. elongatus* and the encapsulation, growth and sorting process will be repeated.

Characterization and Validation of Active Fusion Genes for Biomass and Growth Rate Colonies or populations of cells with phenotypes of interest arising on plates or in microdrop cultures are picked, expanded and used for plasmid rescue in *E. coli* (Dolganov 1993). Four *E. coli* colonies will be picked for each *S. elongatus* transformant, or 200 *E. coli* colonies are picked from each population of microdroplets. The DNA is isolated and checked by restriction digestion. The plasmid DNA is then be re-introduced into *S. elongatus* for phenotype confirmation.

For simplicity, all plasmids isolated in this fashion are validated using a standard growth rate and biomass assay conducted in 96-well format. Cells from each *S. elongatus* transformant to be verified are counted using an automated flow cytometer, and diluted to the same, standard cell density. 100 µl aliquots of each cell culture are added to a well in a 96-well plate which is covered and incubated with mild shaking under lights under conditions minimizing evaporation. After several days of growth, a small aliquot of each culture is analyzed by flow cytometry to determine the cell density and average cell size. The remainder of each culture is washed with water to remove salts, the cell pellet is dried and weighed to determine dry weight. The results are tabulated to allow selection of the most promising fusion gene constructs with the greatest effect on cell number, cell size of dry weight of the resulting culture.

Screening for Alcohol-Resistance

Four different approaches are used to select or screen for butanol- or ethanol-tolerant transformants. Two of these involve survival selections, using lethal concentrations of butanol to isolate cells with the ability to survive the alcohol. The other two approaches aim to isolate cells with improved growth properties in the presence of sub-lethal concentrations of butanol or ethanol. The selections/screens either involve growth and selection on solid medium or combine growth in liquid medium with screens on solid medium. The selection and screening approaches are summarized for butanol as an example in Table 6, with the concentration ranges of butanol estimated based on published information for isobutanol and n-butanol (Atsumi 2009, Kämäräinen 2012). The column 'incubation time' refers to the amount of time the transformants are cultured time in the presence of butanol. The same methods used to isolate alcohol-resistant or alcohol-tolerant cells can also be used to select and screen for tolerance to other toxic compounds such as butyraldehyde, or to other conditions of abiotic stress such as high salt and high temperature.

Alternatively, transformants are cultured in bulk in liquid culture under conditions selecting for various types of growth and resistance properties of the cells. The four selection schemes are preceded by careful titration, under the exact plating or culturing conditions and cell densities to be used later with bulk *S. elongatus* transformants, to arrive at the optimal butanol concentration for each selection. All cultures are grown under carefully controlled, constant conditions to maintain uniformity in the selections.

TABLE 6

Selections and screens for butanol-tolerant *S. elongatus* transformants

| Selection type | Solid or liquid medium | Butanol concentration | Incubation time | Selection based on: |
|---|---|---|---|---|
| Survival | solid | Lethal: 1.5-2.5% butanol | 10-20 days | Colonies growing on plates |
| Growth tolerance | solid | Sub-lethal: 1-2% butanol | 10-20 days | Colony size |
| Survival | liquid | Lethal: 1.5-2.5% butanol | 24-48 hours | Surviving cells |
| Growth tolerance | Liquid/ solid | Sub-lethal: 1-2% butanol | 48-96 hours (liquid) 10-20 days (solid) | Colony size |

For selections and screens on solid media, following transformation of the randomized fusion polypeptide library, transformants are pre-cultured in liquid media lacking antibiotics for 6 hours at 30° C. under light. Antibiotics and IPTG are then added to the liquid culture to select for presence of the plasmid and induce expression of the randomized in-frame fusion polynucleotides, and the transformants are cultured for an additional hour. The culture is then diluted appropriately to allow for manageable numbers of transformants per plate (approximately 2000-20000 colonies per 10 cm plate depending on the trait selected or screened for). The culture is plated on solid medium whose composition depending on the trait being selected for, for example BG11M agar containing butanol see Table 6. The plates are incubated at 30° C. for several days and colonies are selected at that time for colony picking, plasmid isolations, phenotype validation and characterization of active randomized in-frame fusion polynucleotides (see below). Colony selections are either made based on colony size (reflective of growth rate and growth yield, used to identify polynucleotides affecting growth rate, low temperature growth and growth yield traits) or on positive selection i.e. in the cases where the majority of transformants fail to grow on the plate and only those that grow contain a randomized in-frame fusion polynucleotide of interest (used to identify randomized fusion polynucleotides affecting tolerance of high temperatures, salt or organic solvents).

Because screens on solid media allow visualization of individual clones or transformants, they are particularly useful for identifying transformants expressing randomized in-frame fusion polynucleotides contributing to rapid growth which are clearly visible as larger colonies. A difference as little as a few percent in doubling time can lead to a measurable difference in colony size. For example, a 6 day=144 hour growth period for a strain with an average doubling time of 6 hours=360 minutes would allow 24 doublings, while a strain with a 5% faster average doubling time of 342 minutes would double 25.3 times, leading to a 2.5-fold difference in cell number which is clearly reflected in colony size. Such screens can be performed with any media conditions, for example it is possible to screen for growth rate in the presence of sub-lethal amounts of inhibiting agents such as salt, ethanol or butanol, or in sub-lethal high or low temperatures. Similar screens have been used by others for isolation of genes contributing to ethanol tolerance (Hong 2010).

Selections and screens in liquid media are generally performed as bulk selections. Following transformation of the randomized in-frame fusion polynucleotide library into competent cells, transformants are pre-cultured in liquid media lacking antibiotics for 6 hours at 30° C. under light. Antibiotics and IPTG are then added to the liquid culture to select for presence of the plasmid and induce expression of the randomized in-frame fusion polynucleotides, and the transformants are cultured for an additional hour. The culture is then diluted 2-10× in fresh medium containing antibiotics and IPTG and containing selective agents such as butanol as listed in Table 6. The culture is allowed to grow at 30° C. or for an additional 24 hours to several days, depending on the type of selection imposed on the cells. At that time, the cells are harvested by centrifugation, DNA containing the randomized in-frame fusion polynucleotide is extracted using chromosomal DNA isolation procedures (Clerico 2007), the plasmids are cloned in *E. coli*, prepped in bulk, and the transformation and selection of *S. elongatus* is repeated. Two or more cycles of batch selection can be performed in this manner before a transformation is plated on solid media allowing selection of individual transformants, followed by colony picking, plasmid isolations, phenotype validation and characterization of active fusion polynucleotides (see below).

Selections in liquid can be done either as survival selections or as selections for rapidly-dividing cells. Survival selections are performed in the presence of a lethal concentration of a selective agent (i.e. salt, ethanol or butanol, in this example) or at a lethal high or low temperatures, and for a specific period of time (generally 12 hours or longer). Following the selective period, the selective culture is diluted in fresh, non-selective medium, or the temperature is returned to 37° C. to allow any surviving cells to resume normal growth. This culture containing surviving cells is grown up, chromosomal DNA is extracted, the plasmids cloned in *E. coli* and the batch selection repeated if necessary, as described above.

Alternatively, a selection in liquid culture is performed to select for rapid growth in the presence of a sub-lethal concentration of a selective agent (i.e. salt, ethanol or butanol, in this example) or at a sub-lethal high or low temperatures. In this case, a liquid culture of transformants maintained under selective conditions is allowed to grow to mid-log phase only (generally 2-5 days of growth, depending on the severity of selective conditions). At that point, the majority of cells in the culture are expected to be alive, but the culture is enriched for cells capable of normal, rapid growth under the selective conditions. The cells are pelleted by centrifugation, chromosomal DNA is extracted, the plasmids cloned in *E. coli* and the batch selection repeated if necessary. Alternatively, the cells harvested from the sublethal growth conditions can be plated on solid medium containing lethal or sub-lethal concentrations of butanol or another selective agent to allow visual selection of colonies capable of growth or with accelerated of growth in the presence of selective agent.

Characterization of Active Fusion Genes for Alcohol Tolerance

Colonies with butanol-resistant phenotypes arising on selective plates are picked, expanded and used for plasmid rescue in *E. coli* (Dolganov 1993). Four *E. coli* colonies are picked for each *S. elongatus* transformant, the DNA isolated and checked by restriction digestion. The plasmid DNA is then re-introduced into *S. elongatus* for phenotype confirmation.

For simplicity, all plasmids are checked using two standard butanol-tolerance assays that are conducted in 96-well formats. The two assays use lethal and sublethal concentrations of butanol, respectively, in liquid culture. After a period of culture under lethal conditions, or several passages of growth under sublethal conditions, the cultures are serially diluted and spotted onto solid media to assess the density of surviving cells. These assays allow rapid and uniform testing of all isolated plasmids with the necessary controls, and allow rapid validation of fusion genes conferring survival or growth advantages in the presence of butanol.

Re-transformations of active plasmids are also tested more broadly for growth or tolerance phenotypes. For growth rate and growth yield traits, this involves plating the transformants at low cell density and observing the sizes of the resulting colonies compared to a control transformant, or alternatively comparing doubling times or cell pellet size in liquid culture, with or without selective conditions, to the rate of growth of a control strain. For resistance phenotypes (temperature, ethanol and butanol), the re-screen involves replica plating of transformants (i.e. replicated from a 96-well plate onto a plate using a 96-pin tool) on to solid media and growth under selective conditions to compare the extent of growth of each transformation to controls. Alternatively, the transformations are exposed to selective conditions in liquid culture, followed by replicating by pin-tool on to non-selective solid media to assess the degree of cell survival in each culture, reflected in the number of surviving colonies.

A specific candidate randomized in-frame fusion polynucleotide can be tested either for conferral of the phenotype that it was originally selected for, or for another phenotype. Various phenotypes related to cell growth and stress tolerance can cross-react. For example, a randomized in-frame fusion polynucleotide selected for conferral of butanol tolerance can also confer ethanol tolerance, temperature tolerance, salt tolerance, etc. By extensively cross-testing randomized in-frame fusion polynucleotides under various conditions it is possible to find randomized in-frame fusion polynucleotides with a broad ability to advance cell growth under various conditions of abiotic stress.

Fusion gene expression constructs conferring the most dramatic or broad phenotypes are sequenced to identify the active genes. The results are tabulated and the best fusion genes chosen for future work. Sequences identified repeatedly within distinct fusion genes can be used in future screens as part of ORF collections. ORF collections containing genes already known to confer a desirable phenotype may be smaller than the whole-genome ORF collections described in this proposal, with many resulting advantages including smaller library size, less expensive and more rapid screens, and applicability to organisms with more complex genomes and lower transformation efficiencies, including eukaryotic algae and plants.

There are many advantages to limiting the size of an ORF collection, the most important of which is the smaller number of pairwise combinations that are represented in the resulting library of randomized in-frame fusion polynucleotides. Lower-complexity libraries can be screened faster and less expensively than more complex libraries, and are amenable to screening for more complex phenotypes than those listed above that involve visual screens and positive selections. Lower-complexity libraries are also amenable to testing in organisms with lower transformation efficiencies where it may not be realistic or reasonably possible to screen libraries containing tens of millions of sequence combinations (resulting from ORF collections numbering in the thousands), but which may be suitable for screening libraries containing hundreds of thousands of sequence combinations (resulting from ORF collections numbering in the hundreds).

Evaluation of Results and Conclusions

When implementing this approach to constructing and testing randomized in-frame fusion polynucleotides, it is possible to compare the results to those obtained from simple overexpression of the same gene collection used to construct the randomized in-frame fusion polynucleotides libraries. The data generated in the course of such experiments allows comparison of the number of active genes isolated with each approach, the frequency of an active gene (i.e. per 1000 genes screened) and the quality of the phenotypes produced. These three metrics are critical in determining whether the randomized in-frame fusion polynucleotides technology holds promise for engineering useful phenotypes in cyanobacteria.

REFERENCES

Alper H, Moxley J, Nevoigt E, Fink G R, Stephanopoulos G (2006). Engineering yeast transcription machinery for improved ethanol tolerance and production. Science 314: 1565-1568.

Andersson C R, Tsinoremas N F, Shelton J, Lebedeva N V, Yarrow J, Min H, Golden S S (2000). Application of bioluminescence to the study of circadian rhythms in cyanobacteria. Methods Enzymol. 305:527-542.

Arai R, Ueda H, Kitayama A, Kamiya N, Nagamune T (2001). Design of the linkers which effectively separate domains of a bifunctional fusion protein. Protein Engineering 14 (8): 529-532

Ashby M K, Houmard J (2006). Cyanobacterial two-component proteins: structure, diversity, distribution, and evolution. Microbiol. Mol Biol Rev. 70(2):472-509.

Aslanidis C, DeJong P J (1990). Ligation-independent cloning of PCR products (LI-PCR). Nucl Acids Res 18 (20): 6069-6074

Aslanidis C, de Jong P J, Schmitz G. (1994). Minimal length requirement of the single-stranded tails for ligation-independent cloning (LIC) of PCR products. PCR Methods Appl. 4(3): 172-177.

Atsumi S, Wu T-Y, Machado IMP, Huang W-C, Chen P-Y, Pellegrini M, Liao J C (2010). Evolution, genomic analysis, and reconstruction of isobutanol tolerance in *Escherichia coli*. Mol Syst Biol 6:449.

Atsumi S, Higashide W, Liao JC. (2009). Direct photosynthetic recycling of carbon dioxide to isobutyraldehyde. Nat. Biotechnol. 27(12):1177-1180.

Babushok D V, Ostertag E M, Kazazian H H Jr (2007). Current topics in genome evolution: molecular mechanisms of new gene formation. Cell Mol Life Sci. 64(5):542-54.

Baer S, Blaschek H, Smith T (1987). Effect of butanol challenge and temperature on lipid composition and membrane fluidity of butanol tolerant *Clostridium acetobutylicum*. Appl Environ Microbiol 53:2854-2861.

Beekwilder J, Rakonjac J, Jongsma M, Bosch D (1999). A phagemid vector using the *E. coli* phage shock promoter facilitates phage display of toxic proteins. Gene 228(1-2): 23-31.

Belyaeva T, Griffiths L, Minchin S, Cole J, Busby S (1993). The *Escherichia coli* cysG promoter belongs to the 'extended-10' class of bacterial promoters. Biochem. J. (1993) 296 (Pt 3): 851-857

Brachmann C B, Davies A, Cost G J, Caputo E, Li J, Hieter P, Boeke J D (1998). Designer deletion strains derived from *Saccharomyces cerevisiae* S288C: a useful set of strains and plasmids for PCR-mediated gene disruption and other applications. Yeast 14(2):115-132.

Brissette J L, Russel M, Weiner L, Model P (1990). Phage shock protein, a stress protein of *Escherichia coli*. Proc Natl Acad Sci USA. 87(3): 862-866.

Brissette J L, Weiner L, Ripmaster T L, Model P (1991). Characterization and sequence of the *Escherichia coli* stress-induced psp operon. J Mol. Biol. 220(1): 35-48.

Bustos S A, Golden S S (1991). Expression of the psbDII gene in *Synechococcus* sp. strain PCC 7942 requires sequences downstream of the transcription start site. J. Bacteriol. 173(23):7525-7533.

Bustos S A, Golden S S (1992). Light-regulated expression of the psbD gene family in *Synechococcus* sp. strain PCC 7942: evidence for the role of duplicated psbD genes in cyanobacteria. Mol Gen Genet. 232(2):221-230.

Chema R, Sugawara H, Koike T, Lopez R, Gibson T J, Higgins D G, Thompson J D (2003). Multiple sequence alignment with the Clustal series of programs. Nucleic Acids Res. 31(13):3497-3500.

Clerico E M, Ditty J L, Golden S S (2007). Specialized techniques for site-directed mutagenesis in cyanobacteria. Methods Mol. Biol. 362:155-171.

Dahl F, Gullberg M, Stenberg J, Landegren U, Nilsson M (2005). Multiplex amplification enabled by selective circularization of large sets of genomic DNA fragments. Nucleic Acids Res. 33(8): e71.

De Mey M, Maertens J, Lequeux G J, Soetaert W K, Vandamme E J (2007). Construction and model-based analysis of a promoter library for E-coli: an indispensable tool for metabolic engineering BMC Biotechnol. 7: 34

Degryse E, Dumas B, Dietrich M, Laruelle L, Achstetter T (1995). In vivo cloning by homologous recombination in yeast using a two-plasmid-based system. Yeast 11(7):629-640.

Deng M D, Coleman J R (1999). Ethanol synthesis by genetic engineering in cyanobacteria. Appl Environ Microbiol. 65(2):523-528.

Dexter J, Fu P (2009). Metabolic engineering of cyanobacteria for ethanol production. Energy Environ. Sci. 2(8):857-864.

Ding J, Huang X, Zhang L, Zhao N, Yang D, Zhang K (2009). Tolerance and stress response to ethanol in the yeast *Saccharomyces cerevisiae*. Appl Microbiol Biotechnol. 85(2): 253-263.

Dismukes G C, Carrieri D, Bennette N, Ananyev G M, Posewitz M C (2008). Aquatic phototrophs: efficient alternatives to land-based crops for biofuels. Curr Opin Biotechnol. 19(3):235-240.

Dolganov N, Grossman A R (1993). Insertional inactivation of genes to isolate mutants of *Synechococcus* sp. strain PCC 7942: isolation of filamentous strains. J. Bacteriol. 175(23):7644-7651.

Ducat D C, Way J C, Silver P A (2011). Engineering cyanobacteria to generate high-value products. Trends Biotechnol. 29(2):95-103.

Ducat D C, Avelar-Rivas J A, Way J C, Silver P A (2012). Rerouting carbon flux to enhance photosynthetic productivity. Appl Environ Microbiol. 78(8):2660-2668.

Dunlop M J (2011). Engineering microbes for tolerance to next-generation biofuels. Biotechnol Biofuels 4:32

Dunlop M J, Dossani Z Y, Szmidt H L, Chu H C, Lee T S, Keasling J D, Hadi M, Mukhopadhyay A (2011a). Engineering microbial biofuel tolerance and export using efflux pumps. Mol Syst Biol 7:487.

Eisenbeis S, Hocker B (2010). Evolutionary mechanism as a template for protein engineering. J Pept Sci. 16(10):538-544.

Eldridge B, Cooley R N, Odegrip R, McGregor D P, Fitzgerald K J, Ullman CG (2009). An in vitro selection strategy for conferring protease resistance to ligand binding peptides. Protein Eng Des Sel. 22(11):691-8.

Elhai J (1994). Genetic techniques appropriate for the biotechnological exploitation of cyanobacteria. J. Appl. Phycol. 6(2):177-186.

Elsaesser R, Paysan J. (2004). Liquid gel amplification of complex plasmid libraries. Biotechniques 37(2):200-202.

Elsharawy A, Warner J, Olson J, Forster M, Schilhabel M B, Link D, Rose-John S, Schreiber S, Rosenstiel P, Brayer J, Franke A (2012). Accurate variant detection across non-amplified and whole genome amplified DNA using targeted next generation sequencing. BMC Genomics 13(1): 500.

Flores E, Muro-Pastor A M, Meeks J C (2008). Gene transfer to cyanobacteria in the laboratory and in nature. In: Herrero A, Flores E, eds. The cyanobacteria: molecular biology, genomics and evolution. Norfolk, UK: Caister Academic Press. pp 45-57.

Fullwood M J, Tan J J, Ng P W, Chiu K P, Liu J, Wei C L, Ruan Y (2008). The use of multiple displacement amplification to amplify complex DNA libraries. Nucleic Acids Res. 36(5):e32.

Funk M, Niedenthal R, Mumberg D, Brinkmann K, Ronicke V, Henkel T (2002). Vector systems for heterologous expression of proteins in *Saccharomyces cerevisiae*. Methods Enzymol. 350:248-57.

Gao Z, Zhao H, Li Z, Tan X, Lu X (2012). Photosynthetic production of ethanol from carbon dioxide in genetically engineered cyanobacteria. Energy Environ. Sci. 5(12): 9857-9865.

Geerts D, Bovy A, de Vrieze G, Borrias M, Weisbeek P (1995). Inducible expression of heterologous genes targeted to a chromosomal platform in the cyanobacterium *Synechococcus* sp. PCC 7942. Microbiology 141(4):831-841.

Gibson D G, Young L, Chuang R Y, Venter J C, Hutchison C A 3rd, Smith H O (2009). Enzymatic assembly of DNA molecules up to several hundred kilobases. Nat. Methods. 6(5):343-345

Gibson D G, Smith H O, Hutchison C A 3rd, Venter J C, Merryman C. (2010). Chemical synthesis of the mouse mitochondrial genome. Nat. Methods. 7(11):901-903.

Gietz R D, Woods R A (2002). Transformation of yeast by lithium acetate/single-stranded carrier DNA/polyethylene glycol method. Methods Enzymol. 350:87-96.

Gietz R D, Woods R A (2006). Yeast transformation by the LiAc/SS Carrier DNA/PEG method. Methods Mol. Biol. 313:107-120.

Gietz R D, Schiestl R H (2007). High-efficiency yeast transformation using the LiAc/SS carrier DNA/PEG method. Nat Protocols 2(1):31-34.

Gilbert W (1978). Why genes in pieces? Nature 271(5645): 501.

Golden S S, Brusslan J, Haselkorn R (1987). Genetic engineering of the cyanobacterial chromosome. Methods Enzymol. 153:215-231.

Hammer K, Mijakovic I, Jensen P R (2006). Synthetic promoter libraries—tuning of gene expression. Trends Biotechnol. 24 (2): 53-55

Haun R S, Serventi I M, Moss J (1992). Rapid, reliable ligation-independent cloning of PCR products using modified plasmid vectors. Biotechniques, 13(4): 515-518.

Heidorn T, Camsund D, Huang H H, Lindberg P, Oliveira P, Stensjo K, Lindblad P (2011). Synthetic biology in cyanobacteria engineering and analyzing novel functions. Methods Enzymol. 497:539-579.

Hong M E, Lee K S, Yu B J, Sung Y J, Park S M, Koo H M, Kweon D H, Park J C, Jin Y S (2010). Identification of gene targets eliciting improved alcohol tolerance in Saccharomyces cerevisiae through inverse metabolic engineering. J. Biotechnol. 149(1-2):52-59.

Inaki K, Liu E T (2012). Structural mutations in cancer: mechanistic and functional insights. Trends Genet. 28(11): 550-559.

Irwin C R, Farmer A, Willer D O, Evans D H (2012). In-Fusion® cloning with vaccinia virus DNA polymerase. Methods Mol. Biol. 890:23-35.

Ishiura M, Kutsuna S, Aoki S, Iwasaki H, Andersson C R, Tanabe A, Golden S S, Johnson C H, Kondo T (2000). Expression of a gene cluster kaiABC as a circadian feedback process in cyanobacteria. Science 281(5382):1519-1523.

Jang Y S, Kim B, Shin J H, Choi Y J, Choi S, Song C W, Lee J, Park H G, Lee S Y (2012). Bio-based production of C2-C6 platform chemicals. Biotechnol Bioeng. 109(10): 2437-2459.

Jensen P R, Hammer K (1998a). Artificial promoters for metabolic optimization. Biotechnol. Bioengineering 58 (2-3): 191-195

Jensen, P R; Hammer, K (1998b). The sequence of spacers between the consensus sequences modulates the strength of prokaryotic promoters. Appl. Environ. Microbiol. 64 (1): 82-87.

Jia, Kaizhi; Zhang, Yanping; Li, Yin (2009). Systematic engineering of microorganisms to improve alcohol tolerance. Engineering in Life Sciences 10(5): 422-429

Jovanovic G, Weiner L, Model P (1996). Identification, nucleotide sequence, and characterization of PspF, the transcriptional activator of the Escherichia coli stress-induced psp operon. J. Bacteriol. 178 (7): 1936-1945

Kämäräinen J, Knoop H, Stanford N J, Guerrero F, Akhtar M K, Aro E M, Steuer R, Jones P R (2012). Physiological tolerance and stoichiometric potential of cyanobacteria for hydrocarbon fuel production. J. Biotechnol. 162(1):67-74.

Knoshaug E P, Zhang M (2008). Butanol tolerance in a selection of microorganisms. Appl Biochem Biotechnol. 153(1-3):13-20.

Kuijpers N G, Solis-Escalante D, Bosman L, van den Broek M, Pronk J T, Daran J M, Daran-Lapujade P (2013). A versatile, efficient strategy for assembly of multi-fragment expression vectors in Saccharomyces cerevisiae using 60 bp synthetic recombination sequences. Microb Cell Fact. 12:47.

Kondo T, Strayer C A, Kulkarni R D, Taylor W, Ishiura M, Golden S S, Johnson C H (1993). Circadian rhythms in prokaryotes: luciferase as a reporter of circadian gene expression in cyanobacteria. Proc Natl Acad Sci USA 90(12):5672-5676.

Kulkarni R D, Golden S S (1997). mRNA stability is regulated by a coding-region element and the unique 5' untranslated leader sequences of the three Synechococcus psbA transcripts. Mol. Microbiol. 24(6):1131-1142.

Kutsuna S, Kondo T, Aoki S, Ishiura M (1998). A period-extender gene, pex, that extends the period of the circadian clock in the cyanobacterium Synechococcus sp. strain PCC 7942. J. Bacteriol. 180(8):2167-2174.

Lan E I, Liao J C (2011). Metabolic engineering of cyanobacteria for 1-butanol production from carbon dioxide. Metab Eng. 13(4):353-63.

Lan E I, Liao J C (2012). ATP drives direct photosynthetic production of 1-butanol in cyanobacteria. Proc Natl Acad Sci USA. 109(16):6018-6023.

Lee J W, Na D, Park J M, Lee J, Choi S, Lee S Y (2012). Systems metabolic engineering of microorganisms for natural and non-natural chemicals. Nat Chem. Biol. 8(6): 536-546.

Li M Z, Elledge S J. (2007). Harnessing homologous recombination in vitro to generate recombinant DNA via SLIC. Nat. Methods. 4(3): 251-256.

Li C, Wen A, Shen B, Lu J, Huang Y, Chang Y. (2011). FastCloning: a highly simplified, purification-free, sequence- and ligation-independent PCR cloning method. BMC Biotechnol. 11:92.

Li M Z, Elledge S J. (2012). SLIC: a method for sequence- and ligation-independent cloning. Methods Mol. Biol. 852:51-59.

Liang S T, Bipatnath M; Xu Y C, Chen S L, Dennis P, Ehrenberg M, Brehmer H (1999). Activities of constitutive promoters in Escherichia coli. J. Mol. Biol. 292 (1): 19-37

Lindberg P, Park S, Melis A (2010). Engineering a platform for photosynthetic isoprene production in cyanobacteria, using Synechocystis as the model organism. Metab Eng. 12(1):70-79.

Liu S, Qureshi N (2009). How microbes tolerate ethanol and butanol. New Biotechnol. 26(3-4):117-121.

Liu X, Sheng J, Curtiss R III (2011). Fatty acid production in genetically modified cyanobacteria. Proc Natl Acad Sci USA. 108(17):6899-6904.

Liu J, Chen L, Wang J, Qiao J, Zhang W (2012). Proteomic analysis reveals resistance mechanism against biofuel hexane in Synechocystis sp. PCC 6803. Biotechnol Biofuels. 5(1):68.

Lobban P E, Kaiser A D (1973). Enzymatic end-to end joining of DNA molecules. J Mol. Biol. 78(3): 453-471.

Ma H, Kunes S, Schatz P J, Botstein D (1987). Plasmid construction by homologous recombination in yeast. Gene 58(2-3):201-216.

Machado I M, Atsumi S (2012). Cyanobacterial biofuel production. J. Biotechnol. 162(1):50-56.

Marschalek R (2011). Mechanisms of leukemogenesis by MLL fusion proteins. Br J. Haematol. 152(2):141-154.

Mascal M (2012). Chemicals from biobutanol: technologies and markets. Biofuels, Bioprod. Bioref. 6(4):483-493.

Melo J V (1996). *The diversity of BCR-ABL fusion proteins and their relationship to leukemia phenotype*. Blood 88(7): 2375-2384.

Menart V, Jevgevar S., Vilar M, Trobiš A, Pavko A (2003). Constitutive versus thermoinducible expression of heterologous proteins in Escherichia coli based on strong $P_R, P_L$ promoters from phage lambda. Biotechnology and Bioengineering 83 (2): 181-190.

Mitelman F, Johansson B, Mertens F (2004). Fusion genes and rearranged genes as a linear function of chromosome aberrations in cancer. Nat. Genet. 36(4):331-334.

Mitelman F, Johansson B, Mertens F (2007). The impact of translocations and gene fusions on cancer causation. Nat Rev Cancer 7(4):233-245.

Model P, Jovanovic G, Dworkin J (1997). The *Escherichia coli* phage-shock-protein (psp) operon. Mol. Microbiol. 24(2):255-61.

Mutsuda M, Michel K P, Zhang X, Montgomery B L, Golden S S (2003). Biochemical properties of CikA, an unusual phytochrome-like histidine protein kinase that resets the circadian clock in *Synechococcus elongatus* PCC 7942. J Biol Chem 278(21): 19102-19110

Myllykangas S, Natsoulis G, Bell J M, Ji HP (2011). Targeted sequencing library preparation by genomic DNA circularization. BMC Biotechnol. 11:122.

Natsoulis G, Bell J M, Xu H, Buenrostro J D, Ordonez H, Grimes S, Newburger D, Jensen M, Zahn J M, Zhang N, Ji H P (2011). A flexible approach for highly multiplexed candidate gene targeted resequencing. PLoS One 6(6): e21088.

Newburger D E, Natsoulis G, Grimes S, Bell J M, Davis R W, Batzoglou S, Ji H P (2012). The Human OligoGenome Resource: a database of oligonucleotide capture probes for resequencing target regions across the human genome. Nucleic Acids Res. 40(Database issue):D1137-1143.

Oliver J W, Machado I M, Yoneda H, Atsumi S (2013). Cyanobacterial conversion of carbon dioxide to 2,3-butanediol. Proc Natl Acad Sci USA. 110(4):1249-1254.

Quan J, Tian J (2009). Circular polymerase extension cloning of complex gene libraries and pathways. PLoS One. 4(7): e6441.

Quan J, Tian J (2011). Circular polymerase extension cloning for high-throughput cloning of complex and combinatorial DNA libraries. Nat. Protoc. 6(2):242-251

Rabbitts T H (2009). Commonality but diversity in cancer gene fusions. Cell 137(3):391-395.

Raymond C K, Pownder T A, Sexson S L (1999). General method for plasmid construction using homologous recombination. Biotechniques 26(1):134-8, 140-1.

Raymond C K, Sims E H, Olson M V (2002). Linker-mediated recombinational subcloning of large DNA fragments using yeast. Genome Res. 12(1):190-197.

Robertson D E, Jacobson S A, Morgan F, Berry D, Church G M, Afeyan N B (2011). A new dawn for industrial photosynthesis. Photosynth Res. 107(3):269-277.

Ruffing A M. (2011). Engineered cyanobacteria: teaching an old bug new tricks. Bioeng Bugs. 2(3):136-149.

Sambrook, J., Fritsch, E. F., and Maniatis, T. (1989) Molecular Cloning: A Laboratory Manual, Second Ed., Cold Spring Harbor Laboratory Press, Plainview, N.Y.

Sawyers C L (1992). The bcr-abl gene in chronic myelogenous leukaemia. Cancer Surv. 15:37-51.

Shao Z, Zhao H, Zhao H (2009). DNA assembler, an in vivo genetic method for rapid construction of biochemical pathways. Nucleic Acids Res. 37(2):e16.

Shizuya H, Birren B, Kim U J, Mancino V, Slepak T, Tachiiri Y, Simon M (1992). Cloning and stable maintenance of 300-kilobase-pair fragments of human DNA in *Escherichia coli* using an F-factor-based vector. Proc Natl Acad Sci USA 89(18): 8794-8797.

Steen E J, Chan R, Prasad N, Myers S, Petzold C J, Redding A, Ouellet M, Keasling J D (2008). Metabolic engineering of *Saccharomyces cerevisiae* for the production of n-butanol. Microb Cell Fact. 2008 7:36.

Stemmer W P (1994). Rapid evolution of a protein in vitro by DNA shuffling. Nature 370(6488):389-391.

Stemmer W P (1994a). DNA shuffling by random fragmentation and reassembly: in vitro recombination for molecular evolution. Proc Natl Acad Sci USA 91(22):10747-10751.

Takahama K, Matsuoka M, Nagahama K, Ogawa T (2003). Construction and analysis of a recombinant cyanobacterium expressing a chromosomally inserted gene for an ethylene-forming enzyme at the psbAI locus. J Biosci Bioeng. 95(3):302-305.

Tan X, Yao L, Gao Q, Wang W, Qi F, Lu X. (2011). Photosynthesis driven conversion of carbon dioxide to fatty alcohols and hydrocarbons in cyanobacteria. Metab Eng. 13(2):169-176.

Tewhey R, Warner J B, Nakano M, Libby B, Medkova M, David P H, Kotsopoulos S K, Samuels M L, Hutchison J B, Larson J W, Topol E J, Weiner M P, Harismendy O, Olson J, Link D R, Frazer K A (2009). Microdroplet-based PCR enrichment for large-scale targeted sequencing. Nat. Biotechnol. 27(11):1025-1031.

Thieme F, Engler C, Kandzia R, Marillonnet S (2011). Quick and clean cloning: a ligation-independent cloning strategy for selective cloning of specific PCR products from nonspecific mixes. PLoS One 6(6): e20556

Tian X, Chen L, Wang J, Qiao J, Zhang W. (2013). Quantitative proteomics reveals dynamic responses of *Synechocystis* sp. PCC 6803 to next-generation biofuel butanol. J Proteomics 78:326-345.

Tomas C, Welker N, Papoutsakis E (2003). Overexpression of groESL in *Clostridium acetobutylicum* results in increased solvent production and tolerance, prolonged metabolism, and changes in the cell's transcriptional program. Appl Environ Microbiol 69:4951-4965.

Tsinoremas N F, Kutach A K, Strayer C A, Golden S S (1994). Efficient gene transfer in *Synechococcus* sp. strains PCC 7942 and PCC 6301 bp interspecies conjugation and chromosomal recombination. J. Bacteriol. 176(21):6764-6768.

Vieira J, Messing J (1982). The pUC plasmids, an M13 mp 7-derived system for insertion mutagenesis and sequencing with synthetic universal primers. Gene 19(3):259-268.

Vioque A. (2007). Transformation of cyanobacteria. Adv Exp Med. Biol. 616:12-22.

Vroom J A, Wang C L (2008). Modular construction of plasmids through ligation-free assembly of vector components with oligonucleotide linkers. Biotechniques 44(7): 924-926.

Wang R, Xue Y, Wu X, Song X, Peng J (2010). Enhancement of engineered trifunctional enzyme by optimizing linker peptides for degradation of agricultural by-products. Enzyme and Microb. Technol. 47 (5): 194-199

Wang B, Wang J, Zhang W, Meldrum DR (2012). Application of synthetic biology in cyanobacteria and algae. Front Microbiol. 3:344.

Ward A C (1990). Single-step purification of shuttle vectors from yeast for high frequency back-transformation into *E. coli*. Nucleic Acids Res. 8(17):5319.

Weiner L, Brissette J L, Model P (1991). Stress-induced expression of the *Escherichia coli* phage shock protein operon is dependent on σ-54 and modulated by positive and negative feedback mechanisms Genes Dev. 5(10): 1912-1923

Weiner L, Brissette J L, Ramani N, Model P. (1995). Analysis of the proteins and cis-acting elements regulating the stress-induced phage shock protein operon. Nucleic Acids Res. 23(11): 2030-2036.

Whitworth D E, Cock P J (2009). Evolution of prokaryotic two-component systems: insights from comparative genomics. Amino Acids 37(3):459-66.

Wingler L M, Cornish V W (2011). Reiterative Recombination for the in vivo assembly of libraries of multigene pathways. Proc Natl Acad Sci USA. 108(37):15135-15140.

Zhang W, Fisher J F, Mobashery S. (2009). The bifunctional enzymes of antibiotic resistance. Curr Opin Microbiol. 12(5):505-511.

Zhao Y, Hindorff L, Chuang A, Monroe-Augustus M, Lyristis M, Harrison M, Rudolph F, Bennett G (2003). Expression of a cloned cyclopropane fatty acid synthase gene reduces solvent formation in *Clostridium acetobutylicum* ATCC 824. Appl Environ Microbiol, 69:2831-2841.

Zhou J, Zhang H, Zhang Y, Li Y, Ma Y (2012). Designing and creating a modularized synthetic pathway in cyanobacterium *Synechocystis* enables production of acetone from carbon dioxide. Metab Eng. 14(4):394-400.

Zhou J, Li Y (2012a). Engineering cyanobacteria for fuels and chemicals production. Protein Cell. 1(3):207-210. Lathe R, Kieny M P, Skory S, Lecocq J P (1984). Linker tailing: unphosphorylated linker oligonucleotides for joining DNA termini. DNA 3(2): 173-182

Zhu B, Cai G, Hall E O, Freeman G J (2007). In-fusion assembly: seamless engineering of multidomain fusion proteins, modular vectors, and mutations. BioTechniques 43:354-359.

All publications, databases, GenBank sequences, patents and patent applications cited in this Specification are herein incorporated by reference as if each was specifically and individually indicated to be incorporated by reference.

SEQUENCE LISTING (25152 sequences)

SEQ ID NO: 1 - DNA, 102 bp, Saccharomyces cerevisiae
atggcaacgttggattttaccactaaaccacttgcgcttgttatttacatgagtgtggtacttctattgatggtaggtgttccattacttttttcgtcttaa

SEQ ID NO: 2 - DNA, 105 bp, Saccharomyces cerevisiae
atgataataatatttatagaattgtgtagaattgcagattcccttttatggattcctaaatcctcgaggagaacttctagtatatctacatacctaatattataa

SEQ ID NO: 3 - DNA, 105 bp, Saccharomyces cerevisiae
atgtgggtagtactttcaaaagaaaaaatattactgaagaaggcatactacgccaagactattttattctcagcacttgtcctacgtggggttagaggcgagtaa

SEQ ID NO: 4 - DNA, 105 bp, Saccharomyces cerevisiae
atgttctcccacttcgaagtctcggaaaacagaccccggaaacagccgcgacgaaaaagaatcagcttaggcatgataaatactgtggtttcattagatagataa

SEQ ID NO: 5 - DNA, 108 bp, Saccharomyces cerevisiae
atgaccgaaagaaagctattgcagctgctacggcgtcctttcatctccctttctttattcacggccttaagagcttgtccgcttcgccccaaaagcctaattgcttag

SEQ ID NO: 6 - DNA, 108 bp, Saccharomyces cerevisiae
atgagaagtttggtgtttgtccaactttccctgttgtcctgggaaatattctgtggggaacgtagctttgtgagcatgaaagctatcttttcgtgtatgtacgtgtga

SEQ ID NO: 7 - DNA, 111 bp, Saccharomyces cerevisiae
atgatctctgatgaacagctgaactccttggccatcaccttcggtattgtgatgatgactttaattgtcatttaccatgctgttgactccaccatgtctcctaagaactaa

SEQ ID NO: 8 - DNA, 111 bp, Saccharomyces cerevisiae
atgcaaccatctaccgctaccgccgctccaaaagaaaagaccagcagtgaaaagaaggacaactatattatcaaaggtgtcttctgggacccagcatgtgttattgcttag

SEQ ID NO: 9 - DNA, 111 bp, Saccharomyces cerevisiae
atgctaatcttcataattcattatcatcgccacttggcattgcatttaatgggcgccttccaaaaacattcaaatagtatcagcccccccccaaggaaaggctttatttga

SEQ ID NO: 10 - DNA, 111 bp, Saccharomyces cerevisiae
atggtacacttcatttttatcgccttacgaagcatgcgttttatgcgaagattggtgagaaacctccaatacttgctgttgccgataacttcttcattgctttttatatag

SEQ ID NO: 11 - DNA, 114 bp, Saccharomyces cerevisiae
atgcaagatttagagatttttttgagtattttcgctttcattttcgttttctactttggtgctcatagaacagtcatgaacagaaacaagagcgatgttccttacttgcagtga

SEQ ID NO: 12 - DNA, 114 bp, Saccharomyces cerevisiae
atgcaatggaacgctttttcctttgtgtcttatgtatatcttcgttattttatttcgttccgcccaaatattgtgctagccagtgttcgcttgtcttggtatagtatcatttag

SEQ ID NO: 13 - DNA, 117 bp, Saccharomyces cerevisiae
atgtccctacggccttgtctaacaccatccagcatgcaatacagtgacatatatatacccacacactctctcacatctacctctactctcgctgtcataccttacccggctttctga

SEQ ID NO: 14 - DNA, 117 bp, Saccharomyces cerevisiae
atgaatgtaatatttaaattgtatttaacgatagatgcaccaaaaaaaaagaaagttacagtaagagacttcttgtcgattcgttattccatgccatacaggttagcctcaaattaa

SEQ ID NO: 15 - DNA, 117 bp, Saccharomyces cerevisiae
atgcaaccgatcaccactgcttccacacaagccactcagaaggataaatcctctgaaaagaaagacaactatataatcaagggcctcttctgggatcccgcctgtgttatcgcttaa

SEQ ID NO: 16 - DNA, 120 bp, Saccharomyces cerevisiae
atgaaagtgctagatgattggttttcaaggaagttctcaaaagctgtacacggaaacaatcacggcaccatttccttgtcaactctgtcttatatcagagtccataaactagtaaaatga

SEQ ID NO: 17 - DNA, 120 bp, Saccharomyces cerevisiae
atgagtcgttctattttttttttctcgtccctttttttgtcccctcttaacaaaattagaaatataggcgggaaagtggagaacccttggaagagtcagatcagagattggaaaaattaa

SEQ ID NO: 18 - DNA, 120 bp, Saccharomyces cerevisiae
atgcacctaagaagcagatggtggcttgccttactgtattgtaaagatccagtctccagatctgcgaccactccgaaggttgaaacccgagcttcctgtttgctgtctcgcgccttttaa

SEQ ID NO: 19 - DNA, 120 bp, Saccharomyces cerevisiae
atgccatttccgtcgatattacatctgacaataggaagatatgcgagctatgactccaacaatcacatgagacggcgtgcaaaactcatggaagccatcttccgcatccgaacaatatga

SEQ ID NO: 20 - DNA, 123 bp, Saccharomyces cerevisiae
atgacagcaaagacgaaacaaagctggaataaggggatctgggaaaacgggaaacaaggttcacatcagcaaacatttctaccgaaaatctgggtaaacatttatagtaccccaacatcttaa

SEQ ID NO: 21 - DNA, 123 bp, Saccharomyces cerevisiae
atgacttgcggtatagaaaatagttataagagtgctgaaaaaaaaaagaagtacagaagttttcgtttctttgaaagtcgcgattattccgagttgtgtattatagtaggaacatactattga

SEQ ID NO: 22 - DNA, 123 bp, Saccharomyces cerevisiae
atgactttaccaggtggtgttattttagttttcattttggtcggtttggcttgtattgccattattgctaccattatctacagaaaatggcaagctagacaaagaggattgcaaagattctaa

SEQ ID NO: 23 - DNA, 129 bp, Saccharomyces cerevisiae
atgttgactggtattgccccagaccaagtgaccagaatgatcaccggtgttccatggtactccagcagattaaagccagccatctccagtgctctatccaaggacggtatctacactatcgcaaactag

SEQ ID NO: 24 - DNA, 132 bp, Saccharomyces cerevisiae
atgtattcgtgcgcgaaaaaaaaaacaactgcagcacctgagtttcgcgtatggtcacccactacactactcggtcaggctcttaccagcttaactacagttgatcggacgggaaacggtgctttctggtag

SEQ ID NO: 25 - DNA, 132 bp, Saccharomyces cerevisiae
atgtacaatcagataataaacacttttattgatgattgtcttttcttgcaaaccccaatgttacaatcgcccattagttctaagattgtgttgtcctttttcttacgaaatttttttccctcccttttttga

SEQ ID NO: 26 - DNA, 132 bp, Saccharomyces cerevisiae
atgttgatgagcacgttaccaggtggtgttatcttagtttttattctagtcggtttggcttgtatcgccatcatttctaccattatctacagaaaatggcaagctagacaaagaggtttacaaagattctaa

SEQ ID NO: 27 - DNA, 135 bp, Saccharomyces cerevisiae
atgaagataaaaatttccatcgaaattagtctttcgctcctatctgaacattacaaaagaaacgaaaactgtattagtaatatgcttgtaattggagaagggccgaggggcgagaccattgtggagcgattttaa

SEQ ID NO: 28 - DNA, 135 bp, Saccharomyces cerevisiae
atgcatgacatctgggtaatcaccacttctcccgcttgctttgagattctgtataaatattgcaaacaaaagggtagagcacggatgggaggccttatagtaaaaattattcgttttaatcatgcgtcagtgtga

SEQ ID NO: 29 - DNA, 135 bp, Saccharomyces cerevisiae
atgttttatggaagcttcaataaatgcgtgactggctatagttgtcggatggcaatccattattatgtataccgtattattaagagtgcaactaggcccgactataaatctaacactcagatccttgtactgtaa

SEQ ID NO: 30 - DNA, 138 bp, Saccharomyces cerevisiae
atgaaaatgaactatcatctatcaactagtagttacactaccagtatgttatcatgtacggtgttagatgatgacataaggtatgagaaactgtcatggaagttagacgaagctgaaatgcaaggattgataatgtaa

SEQ ID NO: 31 - DNA, 138 bp, Saccharomyces cerevisiae
atgcctagtgattatacttcccattacccagtaatacttatcaaaaaaaaaaaaaaaaaaattgcaggaatgtataggcatagtaagcggtaccttgagataatgtccaccgcttcagctcaattcgtcggaaactaa

SEQ ID NO: 32 - DNA, 141 bp, Saccharomyces cerevisiae
atgtgtaaactcatgtggtgcactggtgttgtttccaagactgcactattaactgggaatttttttttttcttctagtgaatttttttttaaagcgacgcacaggaaaagtgaaaattatttaaacggacggcaaacatga

SEQ ID NO: 33 - DNA, 141 bp, Saccharomyces cerevisiae
atgttaacgacacaaaagtgtgaaagtagagaagggaagaacgatgagatctttgaattgggagaaagtaatagtgacaagatattattaaaacatggcaaatgtaacttgttttctgaaaggaaaccagttaatcactag

SEQ ID NO: 34 - DNA, 144 bp, Saccharomyces cerevisiae
atggcacacaaatgtgcaagtgccaagctattgagtggaataatggccttgttatttaatggtaagagccttctgaggccaatctgccttcacgtacacaaccaccttgttagtaacagtgataccaacatagtttggccgtga

SEQ ID NO: 35 - DNA, 147 bp, Saccharomyces cerevisiae
atgcaagttggttttgtttctcagaccaactgccgttcctttcctgcgtgtattgtttttctgtttcaaatgagtcaacggcaacgatcgttcaatgcaaatcttcgagtatttaaaagcaaatgtaagaaaatttatataggttaa

SEQ ID NO: 36 - DNA, 147 bp, Saccharomyces cerevisiae
atgccacaattagttccattttattttatgaatcaattaacatatggtttcttattaatgattctattattaattttattctcacaattctttttacctatgatcttaagattatatgtatctagattatttatttctaaattataa

SEQ ID NO: 37 - DNA, 147 bp, Saccharomyces cerevisiae
atgtcttacacacgagtagatcatcccactggaaaaatggcttgtcacctgaggcagattttggcaagcccactgtttttcgcaaattatgtactacatgcagccattcactacccttcgagcgacatacgcggcgacatcctgtag

SEQ ID NO: 38 - DNA, 150 bp, Saccharomyces cerevisiae
atgaaattactatttctgaatattatagtcgtgcgccgccatttgcattgtaaaagctacagactatcaccatggtatatatatatatatggtgattatctgctatatacgacagaaataccatacaaaccgtttactcggcaaccttga

SEQ ID NO: 39 - DNA, 150 bp, Saccharomyces cerevisiae
atgaagttatttattcttgattatgagaagaaaagaacaaagataggaaaagggatggcaagaagagaattgaaaatgatgaacaagaagcctgatttatatacgattattgtatcttatttttcaattttttcgttgttttttttttag

SEQ ID NO: 40 - DNA, 150 bp, Saccharomyces cerevisiae
atgataaactacgttaacattacatgtataatatttagcactcgtacgttactagtctttgacacaagtttatatatccccccctttatgttatcgtttattggctacagcctcagtaatcaaaatagtccactatttctatatcattaa

SEQ ID NO: 41 - DNA, 150 bp, Saccharomyces cerevisiae
atgatacaaaaaccgattttattatcctcgtttctgtttctctacatccgtgcattattacatagtatacatccgtacatccgtacatccgtacatctgtacacaaaaaaaatcacctcatacaattttttaggagtgccgtttaaatga

SEQ ID NO: 42 - DNA, 150 bp, Saccharomyces cerevisiae
atgatgagaatgtctctaaaacaaatgcagtcacagagattttctgcgacttctcgagtgagaatgttgcttattggtgctagtggcttgagatcttcgtcaagcaaattggaatgccccagattctcaaacaagcacggcagaaactga

SEQ ID NO: 43 - DNA, 150 bp, Saccharomyces cerevisiae
atgtcccgtgtctatatatatccattgacggtattctatttttttgctattgaaatgagcgttttttgttactacaattggttttacagacggaattttccctatttgtttcgtcccatttttccttttctcattgttctcatatcttaa

SEQ ID NO: 44 - DNA, 150 bp, Saccharomyces cerevisiae
atgtggagacgtcggcgcgagccctgggaggagttatcttttcttcttaacagcttatcaccccggaattggtttatccggagatggggtcttatggctggaagaggccagcacctttgctggctccggtgcgcttgtgacggcccgtga

SEQ ID NO: 45 - DNA, 153 bp, Saccharomyces cerevisiae
atgaaacagatgatgattgaagcatccataagtaaagacactttgaggttgctaatttgcttttttgaaataaaacagtgccatatatcactccagcctacttgttattatcagaattgggtacggtattcatctatatattaccagttgtaa

SEQ ID NO: 46 - DNA, 153 bp, Saccharomyces cerevisiae
atgtctaacacctttgttgcagtcgaattctcgtggctgtacgcaatttctcttatcctaccgtgtgaaacaattcgcgtcgcgtgggcgccgaaaagggcttatcacggcacatctgaagaaaagagacggctggctccagctgatatttag

SEQ ID NO: 47 - DNA, 153 bp, Saccharomyces cerevisiae
atgtttggtctacctcaacaggaagtctccgaagaggagaaaagagctcatcaagaacaaactgagaaaaccttgaaacaggccgcttatgtggctgcgtttctttgggtttccccaatgatctggcatttggtgaaaaagcaatggaaataa

SEQ ID NO: 48 - DNA, 156 bp, Saccharomyces cerevisiae
atgacattccatcttgggtggacaattttatggtataatcaagcgtatttagaagtttgggcgacagtatttcaagacgagatgcataagtattctcttcatcctcaatcccgcgatgctaaaacaaagttttgttgttgcattccatttaagtag

SEQ ID NO: 49 - DNA, 156 bp, Saccharomyces cerevisiae
atgaggcatcatcaaaatatgcattatgccccacaacaacaaccagtctatgtccaacagcctcctcctcggagagaatccggtggttgctgtagaacctgttgtcacttcctatgttgtctatgtttaattaacctatgttgtgacgttttttaa

SEQ ID NO: 50 - DNA, 156 bp, Saccharomyces cerevisiae
atgcacggcgcttgcctcagcggtctataccctttgccatttacccataaattccatgattatctacattttaatatctatatctcatttggcggcccaaaatattgtataactgcccttaatacatacgttatactattttacaccgtatactaa

SEQ ID NO: 51 - DNA, 159 bp, Saccharomyces cerevisiae
atgacagttctaatcaagttgggtctaaggatattgcatgtatacaaaggattctttcggaaagtaatcctgaaatatttttttttttcgtctgaacatacgaaagtaaataaaaaaagttcaatgcatgccttcctatgcaagatttataaaaggtga

SEQ ID NO: 52 - DNA, 159 bp, Saccharomyces cerevisiae
atgattccctttcctgcacaacacgagatctttcacgcatacatcggaaggatcaccccccactcaagtcgttgcattgctaacatgtggcattctgcccatttttttcacgaaaattctctctctataatgaagacccttgtgccctggactctgtaa

SEQ ID NO: 53 - DNA, 159 bp, Saccharomyces cerevisiae
atgattttctttttcaaccagatccgttcaatatttacagctttgcatacgccaactcaacagatccaattatcaagaagggcctttttccaattcttaggctatttgggtagttgtgttgtgatttcattagcagctcaatcgaaatacgtgcagtaa

SEQ ID NO: 54 - DNA, 162 bp, Saccharomyces cerevisiae
atgattctcgctttgggcgacttcctgactaacaggaagacaaagcatgcgagaggccctgggttcaattcccagctcgccccttttatttttgattatttatttcctattggtcgggtaacagattttttttatttttttcaaggcccttttgttttgtaa

SEQ ID NO: 55 - DNA, 162 bp, Saccharomyces cerevisiae
atgcatatattaacgcgatcgagtaaaaatgcctttcccagaagtagaagtaggcaagacatccatatttcaagccacatccatagagatacctccaacagcgcgttgttgaagattttggtaattacaagaacgaggttagattccttcgttaaaacttag

SEQ ID NO: 56 - DNA, 162 bp, Saccharomyces cerevisiae
atgcgtttgtctctctattcatgttgtctctgtataggggcacggcgaattcctactccgtgtctcttctcctatatctttacaccaaatttggcccattttcattcccctttacgtagtagcggttttcggcctgccggtgctacgcgtttctatagctag

SEQ ID NO: 57 - DNA, 162 bp, Saccharomyces cerevisiae
atggggttcctccctgagtgtaatttaacgtgtgctttcttattgcattcgtttacattccctattgctcattgcccttctttcagttgggcatctttttttttcacaattaggccgcccttttttcccaaattggcacttgtttgtacgatctttagctag

SEQ ID NO: 58 - DNA, 165 bp, Saccharomyces cerevisiae
atgagactacataaaacatttatctgttttagtcaaaacaaacgtggttgtagaaatattctgcaagaaaattcgcggatgatatttgagaataaaatactcataatgatattgaggcagggtatattttttaatattagcgtgagcaccaagatcagtttctaa

SEQ ID NO: 59 - DNA, 165 bp, Saccharomyces cerevisiae
atgatagttgatttctattccaacactttgagacattgtgagaccctccgttcgcaaccgtgctctctgttttcatcactatatgcacgctctttccaaagctcctgcactttgcacgtggcggagccatcgcccggcttccatatgtacggctgccacacctaa

SEQ ID NO: 60 - DNA, 165 bp, Saccharomyces cerevisiae
atgatgtgcgtctgtatcccaaaaaaaaaactaatggattggcgcgtgtactatatatattcatatgtcgtgtgtttgtatatgtgtgggagtgattgtgcgtgtatatgtgtgttggcgtgtgtggtacaatgtgtgtgttttaatgtagaaatgaggttgtag

SEQ ID NO: 61 - DNA, 165 bp, Saccharomyces cerevisiae
atgcttttgtgcttccatatgtgtcaaaggataatgtggctccctttcgatttaatgaagtggcgtagatttcattgtggcgctgttcttgttggaacactgagcttacgtaaccgcagcccaaagatactttctctttattttattagcgataggacaggctaa

SEQ ID NO: 62 - DNA, 165 bp, Saccharomyces cerevisiae
atggtgcggctttcgtatctgcgtctcatccttcccccttgccgcttgtcagaactctctagcttggcgattctctatcaacctgttattccaattcttatatctaccattaccttccagcattttttcaaatgtgttcacacgccctgtaacgtttatatataa

SEQ ID NO: 63 - DNA, 168 bp, Saccharomyces cerevisiae
atggtcaaattaacttcaatcgctgccggtgtcgccgccattgctgctggtgcctccgccgcagcaaccactacattatctcaatctgacgaaagagttaatttggttgaattaggtgtttatgtttccgatatcagagctcatttggctgaatactactctttctaa

SEQ ID NO: 64 - DNA, 168 bp, Saccharomyces cerevisiae
atgatcgtaaataatacacatatacttaccctaccaccacatgccgtatccaccctcacttgtatactgatatggcataggcacacggatgctacagtatatatcatctcaagttaccctactctcacattccactccatggcccatctctcacttcatcagtactaa

SEQ ID NO: 65 - DNA, 168 bp, Saccharomyces cerevisiae
atggattctgccaagatcattaacattatattatcccttttcttaccaccagtcgccgtttttctagcccgtgggtggggtactgactgtatagtggatatcattttgaccattttggcttggttcccaggtatgctatatgccttgtacattgtcctacaagattaa

SEQ ID NO: 66 - DNA, 168 bp, Saccharomyces cerevisiae
atgttcaatgtagcattaccatcacaagacaaaaaatcagaattttacaagcaaaagcgcttatctttaaggaccaacatattagatgaattcttaagggttgccaaaacgcaagacaacaggcaaaataatttcgtttctcagtaccgaaatgacgaaatatactga

SEQ ID NO: 67 - DNA, 171 bp, Saccharomyces cerevisiae
atgtccctacggccttgtctaacaccatccagcatgcaatacagtgacatatatatacaccacacccacacaccacacccacaccacacccacacccacacacaccacacacccacacactctcttacatctacctttactctcgctgtcacaccttacccggctttctga

SEQ ID NO: 68 - DNA, 171 bp, Saccharomyces cerevisiae
atgaaaagggacctaattggtccggtcaaagcattaataaagatcaacaattgctcttgcttatcaaggtgccagatctcaaggttacctcatttctttacatttcatccacattttagcacacttatttattattacaatttgaaaaattgtatcacttctgagacttag

SEQ ID NO: 69 - DNA, 171 bp, Saccharomyces cerevisiae
atggctcacgaaaacgtctggttctctcacccaagaagatacggtaaaggctcccgtcaatgtcgtgtttgttcttcccacaccggtttgatcagaaagtacggcttaaacatctgtcgtcaatgtttcagagaaaaagctaacgacattggtttcaacaaattcagataa

SEQ ID NO: 70 - DNA, 171 bp, Saccharomyces cerevisiae
atggctcacgaaaacgtttggttctcccacccaagaagattcggtaaaggttcccgtcaatgtcgtgtctgctcctcccacactggtttggtcagaaagtacgacttaaacatctgtcgtcaatgtttcagagaaaaggctaacgacattggtttccacaagtacagataa

SEQ ID NO: 71 - DNA, 171 bp, Saccharomyces cerevisiae
atgtttttacgtttttataatcgactactttatatctataacgaattatttaattttcttcgatttactgtgtttctaccattttgcgaattcgtgccccatcatgacttattttatttaattgttacatatcaaaggacactggtttacaaacataaaaatgattgttga

SEQ ID NO: 72 - DNA, 174 bp, Saccharomyces cerevisiae
atgaatgtgtttatgccaataagggtttttttgtacagttatgtgattataaacagtcttttgtctagtttttttcaccagtatcggcctctatttataaaaaacggagcagctttcggtgtcagtaattctgaaaaaatttgtgtcactctgattgtaaatgaattaatttag

SEQ ID NO: 73 - DNA, 174 bp, Saccharomyces cerevisiae
atgtataaatgtgtcccgagttattattctaaagcgggcaccattgtagtaacttattgcgaaatttctgctcttctcgtctcgctcaaaaatcgcgttcagggtaaaaggggcgaaacagagggccagatagaaatttcgagaaaagcgggtcaccccgcccctgcattttga

SEQ ID NO: 74 - DNA, 177 bp, Saccharomyces cerevisiae
atgacacaattgagtcaatccaacgtggaacgggttgcccttgtatacatttcagtttacttcttttcatgtatttccttaatagtttattttttcactttctgcctatccgtttcaattccgaagaaccgtcaacatccaataaagatcatctacaacaataagtgcccctcataa

SEQ ID NO: 75 - DNA, 177 bp, Saccharomyces cerevisiae
atgcatttgatgtacactttgggcccagacggcaagagaatctatacattgaaaaaggtcaccgaaagtggtgaaatcacgaagtctgctcacccagctagattttctccagacgacaaatattcaagacaaagagtaactttgaagaagagatttggtttggtaccaggccaatag

SEQ ID NO: 76 - DNA, 177 bp, Saccharomyces cerevisiae
atggaatctatatttctacatgctaatattacgatcattcctcattcagttttatatgtttcattatcctattacattatcaatccttgcgtttcagtttccactaatttagatgactatttctcatcatttgtgtcatcttctaacaccgtatatgataatatactagtaacataa

SEQ ID NO: 77 - DNA, 180 bp, Saccharomyces cerevisiae
atgaagttatctcaagttgttgtttccgccgtcgccttcactggtttagtaagtgctgctaacagttctaacagctcaagctcaaagaatgctgcccaaccaattgccggtttaaacaacggtaaggttgcaggcgccgctggtgttgctctagctggtgctttggcctttttgatttaa

SEQ ID NO: 78 - DNA, 180 bp, Saccharomyces cerevisiae
atgactattgctccaattactggtacgatcaagagaagagtcatcatggacatcgtcctcgggttctccctcgggggtgtcatggcctcttactggtggtggggattccacatggataagattaacaagagagagaagttctacgcagagctagctgagaggaaaaagcaagagaactga

SEQ ID NO: 79 - DNA, 180 bp, Saccharomyces cerevisiae
atggctaagtctaagaaccataccgctcacaaccaaaccagaaaggctcacagaaacggtatcaagaagccaaagacctacaagtacccttctttgaaaggtgttgatccaaagtttagaagaaaccacaagcatgccctacacggcactgctaaggctttggctgctgccaagaaataa

SEQ ID NO: 80 - DNA, 180 bp, Saccharomyces cerevisiae
atgggcttttttaacaataatccggtaattgaattcttccacagaataacgagaaaacccagtaccattgcgatgtgggtgtttgctggtctgatttgttcaagtacattttatttaatgttcatgtcatcacctacaatcgacttcaactcgaagagtaagaaaaaaaatgataaataa

SEQ ID NO: 81 - DNA, 180 bp, Saccharomyces cerevisiae
atgttgaaaagattccctacccctatccttaaagtatactggcctttctttgtggctggcgccgcagtgtattatggtatgagtaaagctgctgacctttcttctaacacgaaggaatttatcaatgatccaagaaatcccagattcgcaaaaggtggaaagtttgtggaagttgattga

SEQ ID NO: 82 - DNA, 183 bp, Saccharomyces cerevisiae
atgagtttcctaccatcttttatcttaagcgatgaatctaaagaacgtatttccaaaattttaactttgactcataatgtagcacattatggctggatcccatttgttttgtatttgggctgggcacacacttctaatagaccaaactttttgaacttactgtctccgttaccaagtgtttaa

SEQ ID NO: 83 - DNA, 183 bp, Saccharomyces cerevisiae
atggctaataaagttattcaactacagaaaatcttccaatcttccactaaacctctatggtggagacatccaaggtcagctttatacctgtatccattttatgctatttttgcggtagccgtcgttacaccacttctatacattccaaatgctattagaggtatcaaagccaagaaggcatag

SEQ ID NO: 84 - DNA, 183 bp, Saccharomyces cerevisiae
atgttcgatagttctatcgaacgagtgactctggaactatgcttccatataactcttagcattatgtgtggctgtagtatctactttctgcttcttgtgtttattctaactttttattcgtcggttttgttacatcttaaattgtatttctttagttctgaccgagccatatttaatgcatag

SEQ ID NO: 85 - DNA, 183 bp, Saccharomyces cerevisiae
atgtttgctaagctttatcgcggtcttacttacgttaccaacaaaattctatctacattgctatcacatcattccatacattattgcataaattcctttaagccgactacattggcaattataattcttctacacccctgttgccgttgtaatgtttacattattagatgcatccaccattaa

SEQ ID NO: 86 - DNA, 186 bp, Saccharomyces cerevisiae
atgttcagcgaattaattaacttccaaaatgaaggtcatgagtgccaatgccaatgtggtagctgcaaaaataatgaacaatgccaaaaatcatgtagctgcccaacggggtgtaacagcgacgacaaatgcccctgcggtaacaagtctgaagaaaccaagaagtcatgctgctctgggaaatga

SEQ ID NO: 87 - DNA, 186 bp, Saccharomyces cerevisiae
atgaaagtatcacaagttttcatttctgccatctctgtcttcggcctcgctactagcgtaaatgctcaaaacgcatccaacaccacgagtaacgctgctcctgctttgcacgctcaaaatggtcaactactaaacgccggagtcgtcggtgctgctgttggtggtgctttggcctttttgatttag

SEQ ID NO: 88 - DNA, 186 bp, Saccharomyces cerevisiae
atgcagtccatgatctgctcatctgagcacgaaaacctaacctgcaagtactggcctgttagcttcctcgcttcttggtgtgagaatgggtctggcacactgatgcagaaagatggtagtcttttatatgccgtgaaaaatttttcccatatatttgaaaaaaaaatttttcataccaatctatag

SEQ ID NO: 89 - DNA, 186 bp, Saccharomyces cerevisiae
atggacggtatgtttgctatgccaggcgcagctgcaggtgcggcctccccacaacaaccaaaatcaagattccaagctttcaaggaatctccactatacacaattgcactaaacggtgccttcttcgttgcaggtgttgcgtttattcaatctccactcatggacatgttggccccacaattataa

SEQ ID NO: 90 - DNA, 189 bp, Saccharomyces cerevisiae
atgacacttgcctattatggacagccagtaaagatgtgccatatattgccccctttacgctctctgccagtattagtgggaaaaaaaaaactgaaaaaaaaaaaatcgcagactactaataatcacgtgatatttcttttcactctcttcataaagttgctaaaaacacacaatcgaatgagcctctga

SEQ ID NO: 91 - DNA, 189 bp, Saccharomyces cerevisiae
atggacactgaagagaaaaaaaagactacagcgtcagtagagcatgcccggatgttgcaaaatgaaatacaacagttatttgctcagttgcgggatacgaattctcaaattcgctgcgatcttaacgagtttgaacaaataaaggaatcatctacaacagcggattcaaccacgaacagtgcgaactga

SEQ ID NO: 92 - DNA, 189 bp, Saccharomyces cerevisiae
atggtttgtattcacactgaaaatcaaaatcaaggggacttttacccttttgttctactggagatttctgttctccatgagtcccccttaggacatctgcgttatcgtttaacagatgtgccgccccagccaaactctcctggcgaaatttattgtttttacataaactgtattatgaacagaaggtag

SEQ ID NO: 93 - DNA, 189 bp, Saccharomyces cerevisiae
atgtctgcctggaggaaagctggtatatcatatgctgcatatttgaatgtggccgctcaggctatccgttcttcattgaaaactgaattacaaaccgctagtgttcttaacagatcgcaaacagatgctttttatacccaatataaaaatggcactgcagcttctgaacccactccaataacaaaatag

SEQ ID NO: 94 - DNA, 189 bp, Saccharomyces cerevisiae
atgtgtattattgtaaaatactcacaatgtaatctattttttcaggatgtgttacgatgcagacatgttttgtgcatgctctttagcattgttgtgcattttagattgtcgtcgtttgtttctgtatgtggtgtacggattatgtgtaactgtattaattgttcaagattcattcataatattaactaa

SEQ ID NO: 95 - DNA, 192 bp, Saccharomyces cerevisiae
atgaaaatgtggggaccctcccaacgagattccttcagagagattacatataaagtgaaattcaagtatgacgatggtgactactccttggccattgatttgatgtctagggattgtattaatgtctatgagttgattaccgataggctactggttgatttcctttcaaaaaagctgctcaagctaagatag

SEQ ID NO: 96 - DNA, 192 bp, Saccharomyces cerevisiae
atgatgtgtattataaattctgagtcttttcatggttctcagaaaagatcgggcgtgtggtctagtggtatgattctcgctttgggcgacttcctgattaacagggggacaaagcatgcgagaggccctgggttcaattcccagctcgcccccttttttactattgaaaagtattcggtcagacgtagctga

SEQ ID NO: 97 - DNA, 192 bp, Saccharomyces cerevisiae
atgccatactcaccttcacttatattgatggggcatacgcacacggatgctacagtatataccactctcaagttaccctactctcacactccaatccatggcccattctcactaaatcagtaccaaatgcacccacatcattatgcacggcacttgcctcagcggtctataccctgtgccatttacccataa

SEQ ID NO: 98 - DNA, 192 bp, Saccharomyces cerevisiae
atggtttgtcgttttgttcatcattcaagggtcatttttatttccatttatgatttcttgagtacaaaaggcaaaaaaaacatgtataattatacacaagaaaaaaaaacaaaacaaaagaacactttcacacaagcaagtatatattatgagaattttttcgagtcttacagaaccatatcttgcctctaa

SEQ ID NO: 99 - DNA, 195 bp, Saccharomyces cerevisiae
atgaagattttcacgctgtataccatgattcagcaatacttttttgataatggcggtgtttatagtataaagaatttttattctgcagttccgaaggagaaaatgaacataattcttgtttcacttgattgtgagctccaaaagcttgctcttaagctgtcaaagaaaactagtggcactcacactacgcactag

SEQ ID NO: 100 - DNA, 195 bp, Saccharomyces cerevisiae
atgaattgtttatgtttatgttctttatactcaaaatcaataagtgcttattttagcgaattttcttctacgaatatatataagtcatatctaagacttccatccgtgctttattacgtttgtatgatgcatacaatgatgccaaatcagcttgatgctgttggtattcagtcgtccgaaagcctgttgatgtga

SEQ ID NO: 101 - DNA, 195 bp, Saccharomyces cerevisiae
atgatctcagtttgtttcgtttttcctcattctctggctttagacttcaaatcgcggtgtaaaaaaaataggacaaaactatgtagcgcatactatgtcagtcaggtattgagaatatgtaaagaaatgccataccgtgatttgattttgttttcaactgtaaggaagggagtttatatgagattatattattaa

SEQ ID NO: 102 - DNA, 195 bp, Saccharomyces cerevisiae
atgattttagtacatacagggaacgtcctctacccacgttttattgttgttgcatttacttttgaacagcgacaggggggaaggtgtaaaggaggaaaagcaacctgcatggctagtgttcaaagttacaaggtaacaatgcaaatcagtagtatgacaattatttacccgctatttatttttttttctctttaa

SEQ ID NO: 103 - DNA, 195 bp, Saccharomyces cerevisiae
atgtctagtcgccaaggtggtaagatgaagcctctaaagcaaaagaagaagcaacaacaggacttagatcctgaagacattgccttcaaagagaagcaaaaggccgatgctgctgctaagaaagctttgatggctaatatgaaaagtggtaaacctttagtgggtggtggtatcaaaaaatctggtaagaaataa

SEQ ID NO: 104 - DNA, 198 bp, Saccharomyces cerevisiae
atggccgtacagacaccaagacaaagactggctaatgccaagtttaacaagaataacgaaaagtatagaaaatacggtaagaagaaggagggcaaaactgagaaaaccgcacctgtgatatccaaaacttggttgggtattcttctgtttcttctcgtaggtggtggtgttttgcaactaatcagctatatcctatga

SEQ ID NO: 105 - DNA, 201 bp, Saccharomyces cerevisiae
atgagaaacgaattataccagttatggtgtgtggcgagtgcagcaagaggggtagccaagagctcattcgtaagggccaattcggccatgtgtgagtacgtgcgcacgtccaacgtcttgagtcgctggactcgggacaggcaatgggaagcagctaaggccctatcacaacgggtcaagaaagagtatgccgccaattag

SEQ ID NO: 106 - DNA, 201 bp, Saccharomyces cerevisiae
atgatactatccaaacatgtaaattttacgtaccatacatataacctcatctataatttttaccctgatctaactaactttggcatgcctggttcaatctacgggttacagtcatcgttgaaaacgatggaaaaacatgtcgagattcctcaatccatacaccattatagtccgttttatcagcttccactaattttttaa

SEQ ID NO: 107 - DNA, 201 bp, Saccharomyces cerevisiae
atgcaattcaagaccatcgtcgctgccttcgctactgttgccgctgtccaagctgctaacgtttctaccaatggttccaaccgtaccaacggttccaacaccaccagcaccaagatctccactggtgctgctgcttccaacgctttgggtgctggtgtcttcggtgctgccgtcgctgccggtgtcgctttcttattctaa

SEQ ID NO: 108 - DNA, 201 bp, Saccharomyces cerevisiae
atgcgccgcctatatcgtcatcttgcttcctttttcttactcccttcctgccctggaaacaccatacaatccatcacatcatatcctgccaatgcactattacgcagctttcggcacgtgagtacggaaacaccagttcggaaccgggtacacaatagggatagtcaaagctgtccattttttccgctgatggatgactga

SEQ ID NO: 109 - DNA, 201 bp, Saccharomyces cerevisiae
atgcggcgtgcattgttcatagcggggcaaacatacttgtggcttaatttgacacatctacttttaatcttttcttggtctagtacaatggctttttcccaaagtagaaggcttcttactccaaccgtaccctgtcctactttactgggcattgattttttaattcttgtcttgaggcatttcgacgagattttcatttga

SEQ ID NO: 110 - DNA, 201 bp, Saccharomyces cerevisiae
atgttcttcagccaagttttgagatcttccgctcgtgctgccccaatcaagaggtatacaggcggtagaataggtgaatcgtgggtaattacggaaggtagaaggctcattccagaaatctttcaatggagtgcagtattgagcgtttgtttaggttggcctggtgctgtatacttctttagtaaggcaagaaaagcatga

SEQ ID NO: 111 - DNA, 204 bp, Saccharomyces cerevisiae
atgaacaagagatataaattataccgggtgtggtattactatgctcaccaaacagtttgcataacctctactggatttgcattatgttttgtggtccaagctaaaactgcaggactgggcgtaacaccaattacttcactatacggggacaaaaaagaacacctaggtaagttgttggttcctttagttttatatcaaatttag

SEQ ID NO: 112 - DNA, 204 bp, Saccharomyces cerevisiae
atgccttatcactatttatttttggcactcttcacctacctggccacgtccaatgttgtttcaggaagtacacaagcatgcctgccagtgggcccgaggaaaaatgggatgaatgtcaacttttataaatactcattactggattcaacaacgtattcctacccgcaatatatgacttctggatatgcctcgaattggaattag

SEQ ID NO: 113 - DNA, 204 bp, Saccharomyces cerevisiae
atgctggccatgaaatcattttcacaagtttctaaatcatacaaggcaagtgctcccagtaaaaagctgacgacgttgttttatgttgcttacatcactctgggactaacaacacctttccttctaccggcccgaatggcttctaaagacacacactactacaaggacgaattttgttctcaacgatcatacaccaggttttag

SEQ ID NO: 114 - DNA, 204 bp, Saccharomyces cerevisiae
atggataacaaaaccccagtcactttagccaaggtcatcaaagttttaggaagaaccggttctcgtggtggtgtcacccaagtccgtgtcgaattcttggaagacacttccagaactattgtcagaaacgtgaagggcccagttagagaaaacgacattttggttctaatggaatctgaacgtgaagctcgtcgtttgcgttag

SEQ ID NO: 115 - DNA, 204 bp, Saccharomyces cerevisiae
atggattctaagaccccagtcaccttagctaaagtcatcaaagttttaggccgtaccggttctcgtggtggtgttacccaagttcgtgttgagttcttggaagacacttcccgtaccattgtcagaaatgtcaagggtccagttagagaaaacgacattttggtcttgatggaatctgaacgtgaagctcgtcgtttgcgttaa

SEQ ID NO: 116 - DNA, 204 bp, Saccharomyces cerevisiae
atggtcgcctttttagaactaacttctgacgtttctcaaccttttgtcatcccatctctttcgccagtctctcagccaagctcaagaaagaactctgacgcaaacgtcgatgacctgaatctggctattgccaatgccgctcttttggatgcctctgcttcaagccgctcacactccagaaaaaactctttgtctctgttgtaa

SEQ ID NO: 117 - DNA, 204 bp, Saccharomyces cerevisiae
atggttgttggcagcgaatttaacaacactgcagatgtagatgtcgtagctatccttctcacgttgttgaatgctgactattttgttattaagcaacgccttgttagtgcttgttttacaaagcgtattaaatggtattttatttatgctatcgctttattatctttattttcatcacgtaacacggtgtgtgcgccatattaa

SEQ ID NO: 118 - DNA, 207 bp, Saccharomyces cerevisiae
atgaatacagaccaacaaaaagtgagcgaaatatttcagagctcaaaggaaaaattgcagggcgatgcaaaggtagtgagtgacgcttttaagaaaatggctagtcaagacaaggacggcaagactaccgatgctgatgaaagtgaaaaacacaactatcaagagcaatacaacaagctcaaaggggcggggcataagaaggagtag

SEQ ID NO: 119 - DNA, 207 bp, Saccharomyces cerevisiae
atgaccatggaccaaggccttaacccaaagcaattcttccttgacgatgtcgtcctacaagacactttgtgctcaatgagcaaccgtgtcaacaagagtgtcaagaccggctacttattccccaaggatcacgttccttctgccaacatcattgccgtcgaacgtcgcggcggtctttctgacattggtaagaatacttccaactaa

SEQ ID NO: 120 - DNA, 207 bp, Saccharomyces cerevisiae
atgagaccacgtgaccaaggctttttggttttagggtttacttactcggtactcctaattagtcttgctacattttactggttacgcaacaatgactctttcctgcactactggtgtgtattactgctatgccctgcgactctctggctgtgggccctcatagcctggtgtgacagtgaaatgttcgcaagtagtaaagatgaataa

SEQ ID NO: 121 - DNA, 207 bp, Saccharomyces cerevisiae
atgagagcagtcactagaaacaaaatagtcaataacctatacttttctacatttctcattgcattcgcatcagtggccatcggttctgtgctgccatgtccagcacattcagtggattctgattcaccagctgtacagcaacacaagcttcagcttgctcatgagcaggagttaaagaggaaggatgctttaagtaaaaagatttaa

SEQ ID NO: 122 - DNA, 207 bp, Saccharomyces cerevisiae
atgcatttgtgccagaatggacactattacaaaccccaccgtgcctcagctgagaaggtcccttacctaaagaaaaagaaaaagaattctcgaaacgaaggcaaggcaaaaaaaaagaatgaaaagaaaaaaataggaactgttgaattttttcaacaaaaaaaaaaagaaaaaaaacgggtcctaaatgcggtgtgtgggttataa

SEQ ID NO: 123 - DNA, 207 bp, Saccharomyces cerevisiae
atggcaaaatcggttttcaatttctttcattttgaaatattggagtatttaaaccgttttgtgtatcattcacaatactttcttccatactactgctctcttgaagttcttgggaagagccgaaaaaattggacatttcaatattggtgcttatacattactactgacaagaagataataaaaaagaaagatttctatcaccgatag

SEQ ID NO: 124 - DNA, 207 bp, Saccharomyces cerevisiae
atggctagaggtaatcaaagagacttggcaagacaaaaaaacttgaaaaaacaaaaggacatggctaagaaccagaaaaagagtggtgatcctaagaaaagaatggagtcagacgccgaaatcttgagacaaaagcaggccgccgcagatgctagaagagaggctgaaaagcttgagaagttaaaagccgaaaagacgagaagataa

SEQ ID NO: 125 - DNA, 207 bp, Saccharomyces cerevisiae
atgggtgctgcttatcatttcatggggaaagctatccctccacaccaactagccattgggacattaggactgctaggtttattggttgttccaaatccttttaaaagcgcaaagccaaaaacagtcgacatcaaaacagacaacaaagacgaggaaaaattcattgaaaactacttaaagaaacattcggaaaagcaagatgcgtaa

SEQ ID NO: 126 - DNA, 210 bp, Saccharomyces cerevisiae
atgaacgctaacaaacaaaggcagtataatcagcttgcacacgaacttagagagcttcaaacgaatttacaggaaacgacaaaacaactagatatcatgtcgaaacaatgtaacgaaaacttggtaggccaattgggtaaggtacatggaagttggttgataggtagttacatttattatatggagcagatgcttggaaaaacgcaataa

SEQ ID NO: 127 - DNA, 210 bp, Saccharomyces cerevisiae
atgactcgtgatacacccgaagatgtcagtactgcaggcgcaaaggatattttagatgttttgaacctactaaaaggaggagaagagaaaatctcggaagtcgaacttaagttggatgaaatggaaaagaaaatggactctctgttagttcagttagaagatctacacagggacaacaatgatttggcaaaaagttccagccaaaaatag

SEQ ID NO: 128 - DNA, 210 bp, Saccharomyces cerevisiae
atgactgaaactgacaagaaacaagaacaagaaaaccacgcggagtgcgaggacaaacctaagccatgttgcgtttgtaagccagaaaaggaggagcgggatacatgcatcttattcaatggacaagactctgaaaaatgcaaggaattcattgaaaagtacaaagagtgcatgaagggttatggcttcgaagttccaagtgcaaattag

SEQ ID NO: 129 - DNA, 210 bp, Saccharomyces cerevisiae
atgactgtaaaaatatgtgactgttaaggcgaatgttgtaaggactcttgtcattgtgggagcacctgccttccaagctgttctggcggtgaaaagtgcaaatgtgatcacagcaccggaagccctcaatgtaagagttgtggtgaaaaatgcaaatgcgaaaccacgtgcacttgtgaaaagagtaaatgcaattgtgaaaaatgttag

SEQ ID NO: 130 - DNA, 210 bp, Saccharomyces cerevisiae
atgctggttcccatgcataactcacccacggccgccaacggccgcttatcacttactgtcgccagctccggtcttagaaagggtaaaaaaaaccgggtgtatactatacactcatacatccgctcacccgtttccagtagtgaattttcattttctgtacgaaggcaatataagctgacgatccgcataaagcagaagactcatttgtaa

SEQ ID NO: 131 - DNA, 210 bp, Saccharomyces cerevisiae
atgtgttgtttcgataccctccatatattctataatattagatccataaatcccactctcttgaatttcattaattatttcctccttatcgttccacagttcataaaatcttatcgtttcatcgttagtggcaacgcaaattgccatggaacttggagagattactgcgctcagtacacgcaaagggttgggcgacctaacttcgagtag

SEQ ID NO: 132 - DNA, 213 bp, Saccharomyces cerevisiae
atgaagttccaatatgcgttggccaaggaacagctaggcagcaactcgcgcagtggcgtcaaaaaactaataagtaaacaccactggcttccggaatactatttctctgatctctcattttctgttgtacagcagtgggacagtagagccattgaaaaaactacaatcatatcttgtatgcggcccgcaaaccaagagatttatcctttgtga

SEQ ID NO: 133 - DNA, 213 bp, Saccharomyces cerevisiae
atgaaatcactccatgatagtttaagtgttacagacattaagagaagtcggctgcaaatttccatgcagacactttgtcccttcttggaggataccctacagtgtaaaagcctccttagcttagtggtagagcgttgcacttgtaatgcaaaggtcgttagttcaattctgacaggtggcaaaattttttccctaaagttaacacttatttag

SEQ ID NO: 134 - DNA, 213 bp, Saccharomyces cerevisiae
atgattgtcccagtcagatgtttctcatgcggtaaagttgttggtgacaagtgggaaagctacttaaacttgttgcaagaagatgagttggatgaaggtactgcattgtcaagattaggtctaaaaagatactgctgtagaagaatgattctaacccacgtcgatcttattgaaaagtttttaagatacaacccattagaaaaaagagattaa

SEQ ID NO: 135 - DNA, 213 bp, Saccharomyces cerevisiae
atggtaaaagtgaaatctaagaatagtgttataaagctattgtctacagcggcaagtggatactctcgttacatctcgattaagaaaggtgcacctttggttactcaggtcagatacgatcctgtggtgaaacggcatgtgcttttcaaagaagcaaagaaaaggaaagtggcagaaagaaagccattggatttcttgcgtacagccaagtga

SEQ ID NO: 136 - DNA, 213 bp, Saccharomyces cerevisiae
atgtattcaaagatcttgctataccgtagtaacgttctgttcatgaactttttctctgtttttgtatgtacaattggtactttatttttggttttcgcagatgtctatgttcttgcgtcggcatttttccaaagtaaaaaggaaaaagagacaaagtttaagcatttacactaccaaaaaagatcttgtttctttctagcaaatatacactaa

SEQ ID NO: 137 - DNA, 213 bp, Saccharomyces cerevisiae
atgtcattctctgtcagctgcaagactcccaagaccacgaagctgctggtatcttctatttcagagagcgctgttgctcttattattattaccatacgtatacttttttccattggcaaaagcgatttcaaaaaaataatctccaaggaaataaatggtgcagaaacaatatactacagaaatataccggaaagtaaaccccaagggagttag

SEQ ID NO: 138 - DNA, 213 bp, Saccharomyces cerevisiae
atgtccaaatacgcttggtataccagagttacagatacattacatcgtctaacggtactgacgttggttggtggtacgttatacatgtcgggtggcttagcttacactttatacatgaacggtaagaagtacgaacaacaagtgacccaacaaaaggcacttgaagaagacaatcaacaactgcaaagtcctactgcacctcctaccgagtaa

SEQ ID NO: 139 - DNA, 213 bp, Saccharomyces cerevisiae
atgtctcgcgaagggttccagattccaacaaatttagacgccgcagctgcaggtacttctcaagctagaacggcaactttgaagtatatttgtgctgaatgttctagtaaattatctttatccagaactgatgcagtccgttgtaaggactgtggtcatagaatcctgttgaaggctaggactaagagattggttcaatttgaagctagatga

SEQ ID NO: 140 - DNA, 216 bp, Saccharomyces cerevisiae
atgcatcgtaaaaaaagaaaaaaagaaaagaaaagaaccgaaaaagacaatacaaccaaccttcctccactttttctttttccttgttctctctcgcttcctacgttactcgcgcctgtgcactacattcccaccagattaactcaccaccaggcagagaaccaattgttcttgttattgttccaaccgataattgtaaagccattaaggtcgtaa

SEQ ID NO: 141 - DNA, 216 bp, Saccharomyces cerevisiae
atgtcaagacacaagtacaagttatggatgtgcatcgcaaagggaaaaaggggagtgggggaaagaaatacgtttgtccctaagtgctcttatgctcccttttgtgcttcagaggttcttgatcaattattaagaggggataactctatcgtatataacttttatcttaaaaatggttcaggtagtgtttatataggctcagtctttcttatctga

SEQ ID NO: 142 - DNA, 219 bp, Saccharomyces cerevisiae
atgagcaagcataagcatgaatggacggaatcagtggccaactctgggccggcttcaatcttatcttactgcgcgtcctcgattttgatgacagtaacgaacaaattcgtggttaacctggacaactttaacatgaactttgtgatgttgtttgtacaatcactggtgtgcactgtgacgctatgtatcctacgaattgtaggcgttgctaatttttga

SEQ ID NO: 143 - DNA, 219 bp, Saccharomyces cerevisiae
atggagaaccctcatgaacaagtgcaggctaacatactttcgcgaataattggtaatgtcaaaaggctcaatgagagcgtggcaattcttaaccaggagcttgtgaccattaataatcggaacaaaaatctagaaatcatgggcgcaatttgtgataactaccatagtagcgtccaattcaacctggaagcgaccaataacaagaagccacctctttaa

SEQ ID NO: 144 - DNA, 219 bp, Saccharomyces cerevisiae
atggctagagcaagaaagggtgcactggttcaatgtgatccatccatcaaggcgctcatattacaaattgacgccaagatgagtgatatagtactagaggagttggatgacacccatcttttagtaaatccctcgaaagtcgaatttgttaagcatgagctaaataggctattatctaagaatatatataatcctatggatgaagaagaaaatcagtaa

SEQ ID NO: 145 - DNA, 219 bp, Saccharomyces cerevisiae
atgtctgataagcccgactcccaagtattttgtccaaattgcaatgaaagacttcaaaagtgtttagtacagcaaaattatgccattataatatgtcccagcttagtctgcggctacccattcaatcaaagagaagtactcgaaaatctaacgtatgtagacgataatgacgtcttaaaagttgcaaaaaaaagattatcttcacgaagcaaaccataa

SEQ ID NO: 146 - DNA, 219 bp, Saccharomyces cerevisiae
atgtctgcattatttaattttcgttctcttctgcaagtgatattgttactgatttgttcatgttcttatgttcatgggcagtggccgtctctcctagatcgttacaaaaatcatgaggttttgggggccttctggaaaatggcacgtgttggtgaaagggccagtccatatgttagtttagcatgtattttgatggccatcagtcaatttaacagctga

SEQ ID NO: 147 - DNA, 222 bp, Saccharomyces cerevisiae
atgagatctaatattttgaaattattacaacggacaagtaggagatatgtatcctcaaaggattttgagcctgtgatagggtctaatcctaagaaacaaacatctagactaatggtcggttctgtgggtgttatgattccagttctactttatttgttttataagaacgatagcaaacatagtgaaattaaaaagatataccaaaatgagaaaaaaatttaa

SEQ ID NO: 148 - DNA, 222 bp, Saccharomyces cerevisiae
atgattgaggtagttgtgaatgaccgattaggcaaaaaagtcagagtgaagtgccttgctgaagatagtgtaggtgatttcaaaaaagtattgtccttgcaaattggcacccaaccaaacaaaattgtgttgcagaagggtggaagtgttttaaaagaccatatctctctggaagattatgaggtacatgatcagacaaatttggagctgtattacctgtag

SEQ ID NO: 149 - DNA, 222 bp, Saccharomyces cerevisiae
atggaactttttataccttgcccagagcgcctcaagaaaatgatgctgaaagaagaattgaggaaggaactactcatcttacgttgtttgtatcatcccacgatccaaatcatgttacctacgttaggtacgctaggaactgaaaaaagaaaagaaaagtatgcgttatcactcttcgagccaattcttaattgtgtggggtccgcgaaaacttccggataa

SEQ ID NO: 150 - DNA, 222 bp, Saccharomyces cerevisiae
atggcagagataaaacattatcaattcaatgtcgtcatgacctgctcgggatgttctggtgcagtcaataaagttttgacgaaattagaaccagacgtttccaaaatagatatatcccttgaaaagcaattagtagatgtatatactacacttccttacgattttattttagaaaagattaagaaaaccggaaaggaagttagatctggcaaacaattgtga

SEQ ID NO: 151 - DNA, 222 bp, Saccharomyces cerevisiae
atgttgctatatttatatattttatatattgccctcaaaactgtatctcatctttttttctgcaatccttgctttcgtaatctaagtgtgggtgacatgctaaatccgcggctttccttaagctttttcacaaaccatctattatgtccagaagctccgctgattatccgtggaaaagggtcttattctgccgtaggaaacttcttctcgagaaaaaagtga

SEQ ID NO: 152 - DNA, 225 bp, Saccharomyces cerevisiae
atgaataaatatctatttgaccataaaatatggagtactccttactacttttattgcgaagaagattgccaccgtctttttctaagttttattgagggaagaactttcgagaagccaacaagcaacgctgaggaaaatgtacaggagactgaagctggcgaatctttcacattaaatcccggagaagattttcaaaattgctttccaagacagcggatattgtag

SEQ ID NO: 153 - DNA, 225 bp, Saccharomyces cerevisiae
atgatcgcccaaagtaccagattagccgccgccgtctcttcttcagccgcctccgcgggtgtctcaaggatagccgctagcgccatggccagcactattttcaagagatctccgggcaactcgttcaactcttttaaggaatatagagaaaatgccaagacatatggtcccttgagtgcctcactagctaccagaagacacttggctcacgcgccaaagttgtag

SEQ ID NO: 154 - DNA, 225 bp, Saccharomyces cerevisiae
atggcgcctccaaccaccatccgcactagggaccaagcgctcgcaccgttagcaacgcttgactcacaaaccaactgccggctgaaagagcttgtgcaatgggagtgccaattcaaaggagccgaatacgtctgctcgccttttaagaggctttttgaacactgcattgcacccgacaaatcagccactaactacgaggtcacggacacatataccaatagttaa

SEQ ID NO: 155 - DNA, 225 bp, Saccharomyces cerevisiae
atgtggagatcttatcttgtttttctcttctttatgacaccaaggatacaaacatattgtcctgtaccggtactaaggtcaatggcagtattaaatattatctctccgcttataatttttgtcagtcctattaaaaagcaagacagtttacacagcagcgcttgttacgcaaatttgacgttagtggaaaagctgcaactttggcattctatgtcaaacgattag

SEQ ID NO: 156 - DNA, 228 bp, Saccharomyces cerevisiae
atgaaccgttttgtaattatttgccttctttttacttattatgtcatatggtcgctcctgcctatcttcgagatcgagaactccaatccagttgtgagtttactcttccccatttctagcaatgttgcaattttcctgcccatcttcttactgttgatcgggtttactttaactggttctgttttaggtgtattgcttatacgcagcgataaaaagaaaaaagtttaa

SEQ ID NO: 157 - DNA, 228 bp, Saccharomyces cerevisiae
atgaatccacgctacaggtttatactgagattttattcttcgaaaaaaccaactttccacaatacagcaccttcgaagaccaacgtaaacgtaccacgcgctaacaaaagtcaaagcaagggtaaacacaaaggcaaattgttggtactcgtaggaactttagcactcgtgacatcagttatttcggtaaactatcaaaagaacgaaccagttgaatttcttgaataa

SEQ ID NO: 158 - DNA, 228 bp, Saccharomyces cerevisiae
atgacaaagaatttcatcgtcactttgaaaaagaacactccagatgtggaagctaagaagttcttggattcagttcatcacgcaggtggctctattgtacacgaattcgacatcattaaagggtacaccatcaaggtaccagatgttctccacttgaacaagttgaaggaaaagcacaatgatgtcatcgagaacgtcgaagaagacaaagaagttcatacaaattga

SEQ ID NO: 159 - DNA, 228 bp, Saccharomyces cerevisiae
atgagccaacaacaaggttactaccaacaaggacccccacagcaaggttattatcaacaaggtccaccacaacaaggttattatcaacaaggtccaccgcaacagggttatcctcagcagcaaccagtctatgtccaacaaggtcaaccaaaggaggaaagctgcttggacagttgtttaaaatgtttgtgttgttgtttcttattagaattggtatgcgataactga

SEQ ID NO: 160 - DNA, 228 bp, Saccharomyces cerevisiae
atgccaattataggggtgccgaggtgccttataaaacccttttctgtgcctgtgacatttcctttttcggtcaaaaagaatatccgaattttagatttggaccctcgtacagaagcttattgtctaagcctgaattcagtctgctttaaacggcttccgcggaggaaatatttccatctcttgaattcgtacaacattaaacgtgtgttgggagtcgtatactgttag

SEQ ID NO: 161 - DNA, 228 bp, Saccharomyces cerevisiae
atggaagcggaaaaacaatctgatattaagggaaccattgctttcgatactcacggtaacgttatagagtctaccggcgtgggcagtcaaaggatcgaagatatcggtgatttatcgaaagttacgctggatgcagaaggttttgctcaagttcaaggagattcgctactcgtacacctgtacaaacgcaatgatatcactttagctgtatataccagcgctcaataa

SEQ ID NO: 162 - DNA, 231 bp, Saccharomyces cerevisiae
atgagtactgaaaaactggaagcttcggaggaaccacaggctcccttggccaatacatctgagactaactcaataaagggagatacagaaaatattgtaaccgtgtttgacctggcaaatgaaatagaaaaatcactaaaggatgttcagaggcaaatgaaggaaaatgatgatgagttttcacgcagtatacaagcaattgaagacaagcttaacaaaatgagtcggtga

SEQ ID NO: 163 - DNA, 231 bp, Saccharomyces cerevisiae
atgatctttgaatgtacatcctttgaaacaaggcatatcttgaacagttactcttgtgctactcaactttcgtacaatacatatagaatcactgagaaagtaaatccaattcaagcggcagtttcaaagaacaataagccttttgtgtcaaattctgattctgctttttttcctattttttcatccttcaattttgtggcatatactacattaactttcaagaaaacttaa

SEQ ID NO: 164 - DNA, 231 bp, Saccharomyces cerevisiae
atgcaattagtattagcagctaaatatattggagcaggtatctcaacaattggtttattaggagcaggtattggtattgctatcgtattcgcagctttaattaatggtgtatcaagaaacccatcaattaaagacctagtattccctatggctattttaggtttcgccttatcagaagctacaggtttattctgtttaatggtttcattcttattattattcggtgtataa

SEQ ID NO: 165 - DNA, 231 bp, Saccharomyces cerevisiae
atggagatgctcttgtttctgaacgaatcatacatctttcatagacttcgtatgtggagtattgtattatggcactcatgtgtattcgtatgcgcagaatgtgggaatgccaattatagggtgccgaggtgccttataaaacccttttctgtgcctgtgacatttcctttttcggtcaaaaagaatatccgaattttagatttggaccctcgtacagaagcttattgttaa

SEQ ID NO: 166 - DNA, 234 bp, Saccharomyces cerevisiae
atgctggcgaaaacgggcgatgtagtggtacagaaggtgccggttatccgtttgtccgtttttcttcattttttttttgtttttcccttttgtcttttgcaccgcttatatatgggtatgaaacaagttcaagaatttataatggaacccaaaggttcagtctttgtagttcgagcgacattgcgcgtttccttagaaaacgctggaaagatattctttaacgagacggagtaa

SEQ ID NO: 167 - DNA, 234 bp, Saccharomyces cerevisiae
atggcatttgaaagacaaggaaagatcgaaaagaagatatcgtattccttatttttgaatggacctaatgtacactttgggagcatcttattcggtgcagtcgataaaagtaagtacgcagaagagctctgcacacatcctatgcgtcaagcttataatacccttgattcaaactcaagaataattatcacagtacagagtgttgcaattttggacggcaaacttgtatggtaa

SEQ ID NO: 168 - DNA, 234 bp, Saccharomyces cerevisiae
atggctgtagatgttcctcgtgcggtgattaataaacttatgctgtttactgcagcgatggtggtactgcccgtactcacttttttcattattcagcaatttacgccaaataccttaattagtggaggtttagctgctgcaatggccaatgttgttctaatcgtttacattgttgtagcgttccgcgaggatactgaagatcacaaagttgatggtaataaaaaggaagactga

SEQ ID NO: 169 - DNA, 234 bp, Saccharomyces cerevisiae
atggtttctacccctgaactgaagaaatatatggacaagaagatattgctgaatataaatggatctaggaaagtggcaggaattttgcgaggctacgatattttcttaaacgtcgttcttgatgatgcaatggagataaatggtgaagaccctgccaataaccaccagctaggcttgcagaccgtcattaggggcaactccataatatccctagaggctctagatgccatataa

SEQ ID NO: 170 - DNA, 237 bp, Saccharomyces cerevisiae
atgatgataataatatttatagaattgtgtagaattgcagattccctttcatggattcctaaatccttgaggagaacttctagtacattctacatacctaatattattgccttattaaaaatggaatcccaacaattatctcaaaattcacccacttttcaaaaacacacgccgattggtcatattaatcatgaccaatataatagtgattccggtagttactatacattgatgtga

SEQ ID NO: 171 - DNA, 237 bp, Saccharomyces cerevisiae
atgagcactgccttcagaaaaataaaactaatatttaagaaaagtgatagtcaatatccgcaaaactatcgagcggaaattaaatcaagaaataagaatacagtaataacaaggcacgatctactaattgcacacgaaatgaaacaaagggcgtcgctagagaggagcaattcgattaggaatcttcagtcacaaggtaaaaggagatcagattcaaaagaatctcgaaaattgtaa

SEQ ID NO: 172 - DNA, 237 bp, Saccharomyces cerevisiae
atgcaggcaaaccattccgtcagttacctttacgaatcaagtacttcaaagaggtcaaatgggctcttttctcaaacacaaaagcaaggaagttttcaaaaagctttaagtcaaactcaggaagaaatagaagatgaagacctgatggtagacctcaacacaggatctttaactcccgttaagttaaaatattggactcaaatgagtgctatgacggaaaaatttggtaaactgtga

SEQ ID NO: 173 - DNA, 237 bp, Saccharomyces cerevisiae
atggctagagaaatcaccgacatcaaacaatttttggaattgaccagaagagctgacgttaagaccgccactgttaagattaacaaaaaattgaacaaggccggtaagccattcagacaaaccaagttcaaggttagaggctcttcttctttgtacactttggttatcaacgatgctggtaaggctaagaaattgatccaatctttgccaccaactttgaaggttaacagattataa

SEQ ID NO: 174 - DNA, 237 bp, Saccharomyces cerevisiae
atgtcacagaacaacacaatcagctcaatgaatcctgaaagagcttacaacaatgtaacgctgaaaaatttaacagcatttcagttattatctcaaagagaaaacatatgcgagttattgaacttggtagaaagtacggaaagacacaatagtattatcaatcctgaaaggcaaaggatgagtttggaagaaatgaaaaaaatgctcgatgctttgaaaaatgaaaggaaaaagtag

SEQ ID NO: 175 - DNA, 237 bp, Saccharomyces cerevisiae
atgttgtgccaacagatgattagaacgacagctaagagaagtagcaatatcatgaccagacctattatcatgaagaggtcagtacacttcaaagacggtgtgtatgaaaatatcccattcaaagtcaaaggaagaaagacaccttacgccttatctcatttcgggttcttcgctattggatttgctgttccatttgttgcctgctatgttcaattgaaaaagtcaggtgctttttaa

SEQ ID NO: 176 - DNA, 240 bp, Saccharomyces cerevisiae
atgaaaatgaacccttgtactgttatcctctgtaagtcgttatttttcttttgcctttttcaggttgactgctactgtaatcgtaagaatattcaaaatcaatcatctcgcatcgcaacaaaaataaaacgaagttactggtttaggtggcagaaacatataatattggcgaacattcataaaataattaaggcttaccaacgaagcataataaaattgccagtaaccaaaggtctctga

SEQ ID NO: 177 - DNA, 240 bp, Saccharomyces cerevisiae
atgcaaatcaaaaacattgtcgctgttctagctacagtcactgctatcaacgcccaagttggcattgaacctaacgccactactccaaatgctacgcagccaaatgctacgcagccaaatactactcttcctaccgcttcggtgactacgacagtttcgattggcgaagccgtagttaataccatggcggcgggtgcctttggagcagcaatcgctgccggtgttgccttcttattctag

SEQ ID NO: 178 - DNA, 240 bp, Saccharomyces cerevisiae
atgcacgcccgcgactggtttttagtttttattgcaattttcattcctcccttagcagtctggctaaaaagaggtttttttaccaaggatctgctcattaactttctgttatttttactagggtttttccctggtctgatccatgctttgtacgtgatcagctgtcatccatatgaggagaacgaggcccggtactcacacctctcctcctcggatgataactatggtagtttagcatga

SEQ ID NO: 179 - DNA, 240 bp, Saccharomyces cerevisiae
atgcctaagagattaagtgggttacaaaaagaagtcttacacctgtatagggcttccatacgaacggctcatacaaaaccaaaggaaaaccaagttaattttgtgaattatattcatgaagaatttgggaagtatagaaatttgccaagaaaagacttcaccaccattgaacacttgttacgggtcggaaacaaaaaaattgccaccttttcacaccctgaactgacgaatatacattga

SEQ ID NO: 180 - DNA, 240 bp, Saccharomyces cerevisiae
atgtctaacatgatgaataagttcgctgaaaaattacaaggtaacgatgattcccatcagaagggaaagaacgccaaatcctccaacaaggaaagggatgatatgaacatggacatgggtatgggtcatgatcagtccgaagggggaatgaagatgggccatgatcaatctggaacaaagatgaacgctggcagaggaattgcgaacgattggaagacttacgaaaacatgaaaaaataa

SEQ ID NO: 181 - DNA, 243 bp, Saccharomyces cerevisiae
atgaacacacaagaactatgtaagattttcgtagccagagaatatcctctggtagtggtgccctttatatattttgttctatttttacaccagaagtatcacactactctaaattatgtctggtaccctacgtgttctaaaagaatctgggtgagagaaaaaggaagaaagtgctcctttttttttttttcaaaggtgcctcggtccgatggcttcgcaaacaatagatgccaaaggaaatga

SEQ ID NO: 182 - DNA, 243 bp, Saccharomyces cerevisiae
atgacacaacataaaagctcgatggtgtacatacccaccactaaggaagctaaaagacgtaatgggaaatcagaaggcatactaaatactattgaagaagtggtggaaaagctttattggacctactacatacatttacccttttatttaatggcctcttttgattcattcttcctccatgttttttttctcacaattttcagtttgagtttcttcggtatactaaagtattgcttcctttga

SEQ ID NO: 183 - DNA, 243 bp, Saccharomyces cerevisiae
atggatagcggaaagagtgatataaataagcatgcatacaaggagacagcgaccccgctgcccgtagatccgccctcttacgaagaaacaatgaagcaagataaggaggaggtcgaagccgatgaaacgacatcttccgcacacagagacagctttatgaggcctgtttacactcaccatccgcatccaagatcccacaagggatatccgggtgcgaagacccttacatatacttcacggtag

SEQ ID NO: 184 - DNA, 243 bp, Saccharomyces cerevisiae
atggctagagctagtgaaaaaggtgaagagaaaaagcagagcaacaaccaggttgaaaagctggttgaagcacctgtagaatttgtcagagaaggtactcaattcttggccaagtgtaagaaacctgatttgaaggaatacaccaagattgtcaaggctgttggtattggttttattgcagtcggtatcattggttacgccatcaagttgattcatattccaatcagatacgttattgtttaa

SEQ ID NO: 185 - DNA, 243 bp, Saccharomyces cerevisiae
atgtctaataaagagataacttgtatcaaaccgtttaaaattattgctctaattttattgatagttctaataataaacctctcttataagttatttctgagacgctatttaaagtcgacagttatttggtgtttaggaatcgccaatacagatcgtaacgatatgatgtggtggcaagtctcgccactattagagcgctgggtttggcagttagttgacaattatgaatccgggtacgaataa

SEQ ID NO: 186 - DNA, 243 bp, Saccharomyces cerevisiae
atgttatctaaagaagcgttaataaaaatcctcagccaaaatgaaggtggtaatgatatgaaaattgccgatgaagtagtaccaatgatacagaaatatttggatatattcattgatgaggcggtgctgcggtccttgcaatctcacaaggacattaacggagaacgtggcgataaaagtcccttagagttatcgcatcaagatttagagcgtatcgtagggcttcttctgatggatatgtaa

SEQ ID NO: 187 - DNA, 249 bp, Saccharomyces cerevisiae
atgtcaacatatgacgaaatcgaaatcgaagatatgacgtttgagcctgaaaatcaaatgttcacctatccttgtccctgtggagataggtttcaaatatatctggatgacatgtttgagggcgaaaaagttgctgtttgtcccagctgctcactgatgatcgatgtagttttcgataaagaagacttggctgagtactacgaagaggcaggcatccacccccctgagcctattgccgctgctgcctaa

SEQ ID NO: 188 - DNA, 249 bp, Saccharomyces cerevisiae
atgtcaagcccaactcctccaggtggtcaacgtactttgcaaaagagaaaacagggaagttcacaaaaagttgcggcatccgctccaaagaaaaacacgaacagcaataattcgattttgaagatttattctgatgaggctacgggactaagagtagatcccttagttgtgttgtttctagcggtcggtttcatcttttctgttgttgcattacatgttatttctaaagttgccggtaagttattttaa

SEQ ID NO: 189 - DNA, 252 bp, Saccharomyces cerevisiae
atggctgatcaagaaaactctccactacatacagttggtttcgatgctagatttccccaacaaaaccaaacaaagcattgttggcaatcttatgtggattatcacaagtgtgttaatatgaagggcgaagattttgctccgtgcaaggtcttttggaagacctataacgccttatgtcccctagactggatcgaaaaatgggatgatcaaagagaaaaaggtattttcgcaggtgatatcaactcagactaa

SEQ ID NO: 190 - DNA, 255 bp, Saccharomyces cerevisiae
atgacgagaacaaacaagtggaccgaacgtgaaggaaaggctgatccaaagtacttttcgcacactggtaactacggtgaatctccaaatcacatcaagaagcaaggttccggcaagggtaattggggtaagccaggcgatgagattgatgacttaattgataatggtgaaatacccccagtgttcaagaaagatagaagaggctcaaatttgcaatcgcatgaacaaaagtttgaaaacgtccaaaaggaatga

SEQ ID NO: 191 - DNA, 255 bp, Saccharomyces cerevisiae
atgcacggcacttgcctcagcggtctataccctgagccatttacccataactcccacgattatccacattttaatatctatatctcattcggcggccccaaatattgtataactgctcttaatacatacgttataccacttttgcaccatatactaaccactcaatttatacacacttatttcaatatacccacaaaatcaccaccaaaatcacctaaacataaaaattatttatctttcaactttacgaaataa

SEQ ID NO: 192 - DNA, 255 bp, Saccharomyces cerevisiae
atggacgatttccttgaacatttgagcaaagacgataacaaagcatggtatggcgcggaagaaaccgagagagctgcaaaattagatgcaatagaaacactacttattacagatagtgtactaaaaaggaacgacgtgaaaaaacgtgaaaaatacctagacctaatagagaatagtggaaacaacaatggcaaaatattcgtactcagtacttcaaaaatcacagtgagcaacttgacaaaccaacagatatag

SEQ ID NO: 193 - DNA, 255 bp, Saccharomyces cerevisiae
atggccagcagtacttccacttccgcttccgcttcctcctccatcaaaactaacagtgccttagtttccaacaatgtcgttgccgcctcttccgtctctgctacttctactgctagttccagtgccgctaagaacactacttccagttcaaagaacgctgctccaggcatggttgcaaaccctgtttcctcgaagtacggtatcatcatggccgcatttgctgctgtttctttcgtcctaggcaccggtatttaa

SEQ ID NO: 194 - DNA, 258 bp, Saccharomyces cerevisiae
atgattctcgctttgggcgacttcctgcctaaacaggaagacaaagcatgcgagaggccctgggttcaattcccagctcgccccgttatcttttttcaccatcagggcggaatttttttgtttagcatcaatcaacctaacctctcatgcttctccaagctgaaagaagtaaactcactctatgtacgtgttgcaacatatatctgccaaaagaatgaaagtaggttcagaacaaacagattgaaaggagaccagtaa

SEQ ID NO: 195 - DNA, 258 bp, Saccharomyces cerevisiae
atgcctcaaaaaccacttaaagttactaagaaagccaaggacccccgtagggtcacaaagaaacaaaaaaatttgagaaaagctgccccattgcaattgaaatcaaaaaagaaatctttgcaacatctgaagaaattgaaaaagagctcttcccttaccgaaaccactgaaagattagttgcgagtaaagtcgggcatttggagttgttgagaggtactagaaaggagttggaaaaaggtaagaagaactctaaatga

SEQ ID NO: 196 - DNA, 258 bp, Saccharomyces cerevisiae
atggttttgaatccgtccaagtaccaagacacccgcacgtggaagatgacgcctgccatgatcagggcccgtaaaccctttttcaaaggcaatatgctcggtctcacgctgctgctgggtgtcacgggctctgtttactactacacatatcattttctgcacaaggacaacgactttgcagacgtgcccattccacccatcgatccgcaggagctcgaggctctcaaaaaggagtacgaagccaagaagaaggcatga

SEQ ID NO: 197 - DNA, 258 bp, Saccharomyces cerevisiae
atgtcagcggagaacattagtactggctcgccgacgggcaagcagccatcctctgaagttaatcttggcgaaagagaagctggaacaaaaaatgagaggatgatgcgccaaaccaaacttctgaaggatacattagacttgttgtggaataaaaccttagagcagcaagaggtgtgtgagcaactaaagcaagaaaatgattatctagaagattacattggcaatttgatgagatccagtaatgtgttggaaaaataa

SEQ ID NO: 198 - DNA, 258 bp, Saccharomyces cerevisiae
atgtcatctgctctatacaaacaaagcacaaattttactcattctaccggttctttcttgcaaagcgcacctgttgaactgacgacagtcagtgggtaccaggagtttttgaagaagcaagagaaaaagaactatgaaattcaaacagttttaagcgaggataaatcacatggttatgtgctaaaggacggcgaagtcatcgctaatatcattggtgaggccaaagattatcttttggatttggccggccaggcttga

SEQ ID NO: 199 - DNA, 258 bp, Saccharomyces cerevisiae
atgttaccacgttcagcattagcacgctcattgcaattacagcgcggtgtggccgcaaggttctactctgaaggttctaccggcaccccaagagggtcaggctcagaggattcgtttgttaaaagggaaagggccacggaagacttcttcgttaggcagcgtgagaaggagcaactacgccatttgaaagaacaactggaaaaacaacgaaagaagattgattctttggaaaataaaattgactcgatgaccaaataa

SEQ ID NO: 200 - DNA, 258 bp, Saccharomyces cerevisiae
atgttccttcctataatttttcacaccatcctaaccctcctgaactttggtaaatattactgtttacctattcaagaagacgatgataaatcaggaaaagaaattgaacaaattttagacaataacatcgagtcattaggactactactaaattcgatgtccttatcctcgaactttacgacaggcgatcctgaactagattcgctcttccaagatgatttaatccccgagttatatagtgtattagatggcttctaa

SEQ ID NO: 201 - DNA, 261 bp, Saccharomyces cerevisiae
atgaccagaactagcaaatggacagtccacgaagcaaagtctaacccaaagtatttcacccataacggcaactttggggagtctcccaaccacgtcaagagaggaggctatgggaaaggcaattggggcaagcctggcgatgagattaatgacttaatcgattctggcgaaattaagacagtcttcaacaagaccagaaggggctctaactcccaaaacaatgaaagaaggctttctgatttgcaacaataccacatctaa

SEQ ID NO: 202 - DNA, 261 bp, Saccharomyces cerevisiae
atgagcgagagcagtgatatcagcgcgatgcagccggtgaacccgaagccgttcctcaaaggcctggtcaaccatcgtgtaggcgtcaagcttaagttcaacagcaccgaatatagaggtacgctcgtgtccacggacaactactttaacctgcagctgaacgaagcagaagagtttgttgcgggtgtctcgcacggcaccctgggcgagatattcatccgctgcaataacgtgctgtacatcagggagctgccgaactaa

SEQ ID NO: 203 - DNA, 261 bp, Saccharomyces cerevisiae
atgcctccaagaagtatagaagaatggttttactacaagttactgagtagtccaggtttccatagatttgtacgcaaggtatataggaaagtaaatggtattaaagaagatcctttcactgaccaatcaactgcttttcaatatctttataagccaactccacgacagaaatttaaggctttaaggcttttattttgggatgaaatgagatctacttttgggttcagaaggagactaggagaccgctttaaaaaagattaa

SEQ ID NO: 204 - DNA, 261 bp, Saccharomyces cerevisiae
atggggaatataatgtcagctagttttgcgcctgaatgcactgacctgaagacgaaatacgatagttgttttaatgaatggtatagcgaaaaattcctgaagggaaaatccgttgagaacgagtgctcaaaacaatggtacgcttatactacatgtgtcaacgcagctctcgtcaaacaaggtattaagcctgctctagacgaagctagggaggaggcgccgtttgaaaatggcggcaaactaaaagaagttgacaaatga

SEQ ID NO: 205 - DNA, 261 bp, Saccharomyces cerevisiae
atggtgttttacaaagtcacgttgagtaggtcgcttatcggtgtgccacacacaacgaagagcattgtcaaaagtttgggtttaggtaaaagagggtccatagtctacaaaaaagtaaacccggccatagctggctccctagctaaagtaaaagagttagtcaaagtagaagtaacagaacatgaattaacaccatcgcagcaacgagagttgagaaagtcaaaccctgggtttatagtggagaagagaaccatcgactga

SEQ ID NO: 206 - DNA, 261 bp, Saccharomyces cerevisiae
atgtccggaaaagcttctacagagggtagcgttactacggagtttctctctgatatcattggtaagacagtgaacgtcaaacttgcctcgggtttactctacagcggaagattggaatccattgatggttttatgaatgttgcactatcgagtgccactgaacactacgagagtaataacaataagcttctaaataagttcaatagtgatgtctttttgaggggcacgcaggtcatgtatatcagtgaacaaaaaatatag

SEQ ID NO: 207 - DNA, 261 bp, Saccharomyces cerevisiae
atgttaaaccgttgcatttcccgtaataccaggctgccagtaaacctaagaattgcctctcgcttttattcagatggtcctctcggtggtgccggacctggtaatcctcaagatatctttatcaagagagaacgtgccaaagaggattattatgccagacaacaagagagggaacaattagcacatgtgaaggaacaactaaaagaacacaagaaaaaattagagaatttagaaaacaaaattaataacctttcaaagtga

SEQ ID NO: 208 - DNA, 264 bp, Saccharomyces cerevisiae
atgcagttacttcgctgtttttcaatattttctgttattgcttcagttttagcacaggaactgacaactatatgcgagcaaatcccctcaccaactttagaatcgacgccgtactctttgtcaacgactactattttggccaacgggaaggcaatgcaaggagtttttgaatattacaaatcagtaacgtttgtcagtaattgcggttctcacccctcaacaactagcaaaggcagccccataaacacacagtatgttttttga

SEQ ID NO: 209 - DNA, 264 bp, Saccharomyces cerevisiae
atgcatccattagtcgatgaattgactctttcacgctacttgacccacggtacttcagttttatcaagttccctttattctgttgctttctttctctttttttttcccaatttcctttttttttgctcttgtcccaatcataaatgggtgagtttaccgtttattggaatggatattttggaagccctttgtttttatagagagggaaaaatacggaatatttttgaaataggtggtctattacttcagagtttttataattaa

SEQ ID NO: 210 - DNA, 264 bp, Saccharomyces cerevisiae
atggacgcattgaactccaaagaacaacaagagttccaaaaagtagtggaacaaaagcaaatgaaggatttcatgcgtttgtactctaatctggtagaaagatgtttcacagactgtgtcaatgacttcacaacatcaaagctaaccaataaggaacaaacatgcatcatgaagtgctcagaaaagttcttgaagcatagcgaacgtgtagggcagcgtttccaagaacaaaacgctgccttgggacaaggcttgggccgataa

SEQ ID NO: 211 - DNA, 264 bp, Saccharomyces cerevisiae
atggcagatagcgaggatacctctgtgatcctgcagggcatcgacacaatcaacagcgtggagggcctggaagaagatggttacctcagcgacgaggacacgtcactcagcaacgagctcgcagatgcacagcgtcaatgggaagagtcgctgcaacagttgaacaagctgctcaactgggtcctgctgcccctgctgggcaagtatataggtaggagaatggccaagactctatggagtaggttcattgaacactttgtataa

SEQ ID NO: 212 - DNA, 264 bp, Saccharomyces cerevisiae
atggtcgctagccgcgctcgggaaaaccagcgatattctcaatgtaggaagtctaccattttccctttaggctttgccataatctctggatacatacaatttcagaatatttcaatactgcatatttcaagattcaacccattattttataacatttttcattcaatattcaagaaccccggaacaacaatacagttagaaagtacgttatattatcatgaagtccccatttcgcccattggaaatgcaggtagccaaatctga

SEQ ID NO: 213 - DNA, 264 bp, Saccharomyces cerevisiae
atggtttcccaattattcgaagaaaaagctaaagccgtcaacgagctaccaacgaagccctccactgatgaattattagaattgtatgctctgtacaagcaagccactgtaggtgacaacgacaaggaaaagcctggtattttcaacatgaaggaccgctacaagtgggaagcctgggaaaacttaaaaggtaaatcccaggaagatgccgaaaaggaatacattgcccttgttgatcaactgattgccaagtactcctcttag

SEQ ID NO: 214 - DNA, 264 bp, Saccharomyces cerevisiae
atgtcactaagaaacatatcaatgatcacaaaaaatttgcaaacaactgccaagtgttatgtcccaaaaagttcacctacatcaacaactattccggttataagggatgctagtactactcaatgtcgcagaataactaccgtcatcaatattacgagtctgaaaggatattctccatctccaagaacagttcatgataagccaattgttatttgcactgacaacgaagaggtagagactgtatcggagcacgtaaaagtataa

SEQ ID NO: 215 - DNA, 264 bp, Saccharomyces cerevisiae
atgtcttctctatcaacgtctgatttggcctcccttgatgacacttccaaaaaggaaattgctactttcttggagggagagaactccaaacaaaaagtccagatgtcaatccatcaattcactaatatatgcttcaaaaaatgtgttgagtctgtcaatgattctaatttaagttcgcaagaagagcaatgtttgtctaactgtgtgaatcggtttttggatactaatatcaggattgtgaacgggttgcaaaacacccgttaa

SEQ ID NO: 216 - DNA, 267 bp, Saccharomyces cerevisiae
atggacatcttgaaactgtcagattttattggaaatactttaatagtttcccttacagaagatcgtattttagttggaagcttggttgctgtagatgcccaaatgaatttgctattagatcatgttgaggaacgtatgggctccagtagtagaatgatgggcctagtcagcgtccctaggcgttccgttaagaccataatgattgataagcctgttctgcaggagcttactgcgaataaagttgaattgatggctaatattgtttag

SEQ ID NO: 217 - DNA, 267 bp, Saccharomyces cerevisiae
atggcagcttcagttccaccaggaggtcagcgtatcttgcagaagagaagacaggcacaatccattaaggaaaagcaagcaaaacaaacgcccacttccaccagacaggctggttacggtgggtcttcaagctcaattttgaagttatatacggacgaagccaatggattcagagtcgactcccttgtcgtattgttcctatctgtcggtttcatcttctccgtgattgctttgcatctattgacgaaatttacacacattatataa

SEQ ID NO: 218 - DNA, 267 bp, Saccharomyces cerevisiae
atgtgtgtgtgtgcgatacccttttttgaattctttctaccttttatccctcactatgcctttcttttatttgtttcgtccgttcgctttactgtaaatgaacgttgttactacttagtgtgcgtgctcaagttgaattgtgcttttttttttatggttatgatatttgaactaaaacgagtgtgtgtttcgtatttagacagatcccgtaaaatccaaattgttagcttttttccttttatcactattatttttttccactcttaa

SEQ ID NO: 219 - DNA, 270 bp, Saccharomyces cerevisiae
atgagtacggacgttgctgctgcacaagcccaaagtaaaatagatttaacaaaaaaaaaaaatgaggaaataaataagaagtctctagaggaagacgatgaatttgaagatttccccattgacacatgggccaatggtgaaacaataaaaagcaatgctgtaacgcaaacaaacatatgggaagaaaactgggatgatgttgaagttgacgacgatttcaccaatgaattgaaggccgaattggatagatacaaacgggaaaatcagtga

SEQ ID NO: 220 - DNA, 270 bp, Saccharomyces cerevisiae
atggagacacctttggatttattgaaactcaatctcgatgagagggtgtacatcaagctgcgcggggccaggacgctggtgggcacactgcaagcgttcgactcacactgcaacatcgtgctgagtgatgcagtagagaccatataccaattaaacaacgaggagttgagtgagtccgaaagacgatgtgaaatggtgttcatcagaggagacacagtgactctaatcagcacgccctctgaagatgacgatggcgcagtggagatataa

SEQ ID NO: 221 - DNA, 270 bp, Saccharomyces cerevisiae
atggatacggaagcattggccaattatttgctacggcagcttagtttagatgcggaggagaataagctagaagatcttctccaacggcaaaatgaagatcaagagtctagtcaagaatataacaagaaattattattggcatgtggatttcaggccattttaagaaaaattctgctggatgctagaacaagggcaactgcagaaggtttgagggaagtatatccttatcatattgaagctgcaacgcaggcttttctggatagtcaatga

SEQ ID NO: 222 - DNA, 273 bp, Saccharomyces cerevisiae
atgaatgacgatgaagatagagcccaactgaaggctaggctgtggatccgtgtggaagaacgattacaacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataa

SEQ ID NO: 223 - DNA, 273 bp, Saccharomyces cerevisiae
atgcaatactgtgaactcgatttatcagggcagtggctggatacagtatattgtgaagagaatttctccgactttgtctttataaagtttctaaatccttcacagtttgaagagaagatatattgttatactttacatatcaccaaaaggacactagaaaataagagattacttttgtattatgaagatgaattcaaaaaacatggtcacgatattaatgagcttgttggcgacggtataatcttgcgttcatgctggaaccctcgacagtaa

SEQ ID NO: 224 - DNA, 273 bp, Saccharomyces cerevisiae
atgggtgctgcatacaaagtatttgggaagacggttcaacctcacgtattggctatatctacgtttatcgctactgctgcagtggcatcttactttaccacgaaaccaaaaaccaaaaatgaaggcaagaatagttctgccttgagccaacaaaaaagcggtgaaagttcaaactcagatgctatgggaaaggacgatgatgtcgtaaagagtattgaaggatttttaaatgatttagagaaagatacgaggcaggatacgaaagccaactga

SEQ ID NO: 225 - DNA, 276 bp, Saccharomyces cerevisiae
atgcaaccggcagctagacttttatcgcggtccgtatggaagggccccaacatcgtgccattacccataagggaggccatgactaagggcactccaataagaacaaacgcaagggccgccaccatccttcctcagttcgtgggactgaaatttcaaatacacaatggtaaggagtacgtacctattgaaatatcagaagatatggtgggccacaaactgggcgagttcgcacctaccaggaagcgtttcagctatactcaaaccaagaacaaatga

SEQ ID NO: 226 - DNA, 279 bp, Saccharomyces cerevisiae
atgcaattctctactgtcgcttccgttgctttcgtcgctttggctaactttgttgccgctgaatccgctgccgccatttctcaaatcactgacggtcaaatccaagctactaccactgctaccaccgaagctaccaccactgctgccccatcttccaccgttgaaactgtttctccatccagcaccgaaactatctctcaacaaactgaaaatggtgctgctaaggccgctgtcggtatgggtgccggtgctctagctgctgctgctatgttgttataa

SEQ ID NO: 227 - DNA, 279 bp, Saccharomyces cerevisiae
atgggtaaaagattttcagaatccgccgcaaagaaagcagctggcttagcaagaaaaagagatcaggcacatgctaaacaaagagcacaaatggagcagctagaagcggaggaagcttctaaatgggaacaaggttcgaggaaagagaatgccaaaaaattagaggaagagcaaaaaagacaagaaaaagcaagagctaaaaaggagcgcgatgcgttgctaaccgcagaggaggagcaactgggcaagggtggcaagggtaaaagaaaaatgaaataa

SEQ ID NO: 228 - DNA, 279 bp, Saccharomyces cerevisiae
atgtctggatacttcaaccatctttcttcgaatgcacatttcgcaaatattcaagccgatcagggcttcataggtgatgctactggcacaagcagcgatcatggcagtagtggcatggttgattttgccctacaactcggagaactgagcctagaagagaaaatacttaaagagttcaccttattccagagcaagaacatggacttattgcaagagacggcgacggcgtgtccgagtactaatccttccttgagacagagccgaattcaaggctggtga

SEQ ID NO: 229 - DNA, 282 bp, Saccharomyces cerevisiae
atgagtctaccggagattttgcctttggaagtcatagataaaacaattaaccagaaagtgttgattgtgctgcagtcgaaccgcgagttcgagggcacgttagttggtttcgacgacttcgtcaacgttatactggaagacgctgtcgagtggcttatcgatcctgaggacgagagcagaaatgagaaagttatgcagcaccatggcagaatgcttttaagcggcaacaatattgccatccttgtgccaggcggcaaaaagacccctacggaggcgttgtaa

SEQ ID NO: 230 - DNA, 282 bp, Saccharomyces cerevisiae
atgcataatactggcaagagatactcagaaactgccaaaaaagtggcagcaggaagagcaagaaaacgtaggcaagcttacgaaaaggaccaactagagaaacaacaactagaagctcaagaagctcagaggtgggaagaaggtgcgagaacccctaaccagaagaagctgattatggaacaaaaaaagacagagaagctaagagccaaaaaggaaagagaccaattactagccgccgaagaggaagctttaggtaagggaggcaggggaaaaagatactga

SEQ ID NO: 231 - DNA, 282 bp, Saccharomyces cerevisiae
atggtcaccccaagagaacctaagaagagaaccactagaaagaagaaggacccaaatgcccctaagagggctttgtccgcctacatgtttttcgctaacgaaaacagagatattgttcgttctgaaaatccagatatcacatttggacaagtcggcaagaagttgggtgagaagtggaaggctctaacgccagaggaaaagcagccttacgaggccaaggcccaggccgataagaagagatatgaatccgaaaaggagttatataacgccactttggcttag

SEQ ID NO: 232 - DNA, 282 bp, Saccharomyces cerevisiae
atgtctttcttaggtttcggtggtggtcagcctcaattatcatctcaacaaaagattcaagctgcggaagctgaactagatttggtcacagacatgttcaataaattggttaataactgttataaaaaatgtatcaatacttcttattccgagggtgagctgaataagaatgaatcttcgtgcctagacagatgtgtggccaaatattttgagaccaatgttcaagtcggtgaaaacatgcagaaaatgggccaatcatttaacgcagccggtaagttttag

SEQ ID NO: 233 - DNA, 282 bp, Saccharomyces cerevisiae
atgttgagaaccacttttttgcgcactccaagacaattgatgcgtaaatcgccaagggcgtctttctcaatcgtcactagggccgcctttcctcacctaaagaacaatcaagatgaagctgagaaaaaagaacagggtttgtttgatagcaacaagaagaggttggacactttggaacacggcaagaatccagattataagcaacctggaatggaagatttgaaaaaaaagggagatgacgctagaatcgaacaaaacaggccagatgacggtgtttattaa

SEQ ID NO: 234 - DNA, 282 bp, Saccharomyces cerevisiae
atgtttttacagactctccgcctaactatgccaaggatgtttttgcacatgaaaccgtcccccataacgataacaagggcctgcacagtgcccagcctcctatctgttgcagctccgcaaccagctcttgttgcagctaacagacctttggtttttaacagaggtttcaaggtcagaacatctgtcaaaaagttctgcagtgattgctacttggtaagaagaaagggaagagtatacatttattgcaagtcgaataaaaaacacaaacagcgtcaaggctga

SEQ ID NO: 235 - DNA, 284 bp, Saccharomyces cerevisiae
atgacattagtaagtacccaaatgagctactaacaacgcatccggtaatactaacaagagaaattggttaggtagggaaactagtacacatatccatagatttggtcttggtatcaacgtgcctcgcggggattaaacgcaatacaggtttgacgcctaaactggagactctggacaatcagactatgagaaactacatgaagcggtacttgaacttgggagagtctgtatacgactattctgttgccacttgtggctcctcgacgtatttcgctaggaaatag

SEQ ID NO: 236 - DNA, 285 bp, Saccharomyces cerevisiae
atgaatccttttgcatcgctagaaggacaagataatatttcttctgttttttttttacatatgcaacaatttgaaagtcaggtcaaagacagattccggttccccatattcagattggagagaaaaacttttggcaactcatgttaccaagtcgagacgcttaaagttaagtgtcggccaagacacgcaaaatcttgtaatcttttaacgctgctcttcaaatcacggacgcaatcagtacttgtacctaattttggttttctaatattgaatagcgaaccatag

SEQ ID NO: 237 - DNA, 285 bp, Saccharomyces cerevisiae
atgatggctagtacatccaatgatgaagaaaagttgatatcaaccactgacaaatacttcatcgagcagaggaatatagtattgcaggagatcaatgagactatgaattcaatcttgaatggtctgaatggtctcaatatatcattggagagctcgatagctgtgggaagagaattccagtcagtttctgatttgtggaaaacactttatgatgggttggaaagtttatcagacgaagcgcccatcgacgagcaacctactttatctcaatcgaaaacgaagtaa

SEQ ID NO: 238 - DNA, 285 bp, Saccharomyces cerevisiae
atgcctggatttacagctccaacaagaaggcaggtgttgtctttatacaaggaattcatcaagaatgctaatcaattcaataattacaacttcagggaatactttttaagtaaaacaaggactactttcagaaagaacatgaatcagcaagacccaaaagtgttaatgaacctatttaaggaagctaagaacgacttaggtgtcttgaaaagacagtctgttatttctcagatgtacacatttgacaggctggtcgtagaaccattgcaaggaagaaaacactaa

SEQ ID NO: 239 - DNA, 285 bp, Saccharomyces cerevisiae
atggaacacaatctttcacctttacagcaagaagtattggacaaatacaaacagctttctttagatctaaaagctctggatgaaactataaaagaactaaactattcgcaacacaggcaacagcattcacagcaagaaactgtatcgccagatgagatactacaggagatgagggacatagaggtcaaaattggtttagttgggacactgctaaaaggtagcgtgtactcgcttatcttgcaaagaaagcaagaacaggagtctttgggtagcaattctaaataa

SEQ ID NO: 240 - DNA, 285 bp, Saccharomyces cerevisiae
atggaccgatctttgcaagtatatatctgtatgtatccatatttagatggcagcaagcaatatagatttgatgagcttatatcattttatcgtccttgtccaaaaagtcttgataacattaaaagtcactaccgtcaaatccatcatcaaatccgccgtcgaacccaccagcatcatcaaatccgccgtcggacccaccagcatcatcaccgtagtaattgttctcgacaacgacagtgtctggtccgtcatagttgtggtcgtcaaatgcgtgttctagcatag

SEQ ID NO: 241 - DNA, 285 bp, Saccharomyces cerevisiae
atgggtcctccaagcggtaaaacttacatgggatggtggggtcacatgggtggtccaaagcaaaaaggtataacctcatatgctgtgtctccatatgctcaaaagccattacaaggtattttccataacgctgtattcaatagttttagaagatttaagtctcaatttctatatgtattaatacctgcgggaatttattggtactggtggaagaacggtaacgagtataatgaatttctgtacagcaaagctggtagagaagagctggaaagagttaatgtttaa

SEQ ID NO: 242 - DNA, 285 bp, Saccharomyces cerevisiae
atgtcattcatacctattgtatgtggtatgaagagtttcgactcttcatacgataccgttcccggacatcaaaacctgtattgcccgaattgtcacaattatagtgtcggccccataaaaagaaaggaatttttcactatttggtttataccgttggttccggtcttctggggaaaacagttgcactgccccatatgcaattggcgacaagattttaagaatgacgaacagcttaataaagtcattcaagaacaacaaaacttacgacaaaagcagcccaactga

SEQ ID NO: 243 - DNA, 285 bp, Saccharomyces cerevisiae
atgtcgaacaaagttaaaaccaaggccatggtgccaccaataaattgcatatttaacttcttacaacagcaaacaccagtaacgatatggttattcgagcaaatcggcataagaatcaagggtaaaatagttggatttgatgagttcatgaatgttgtcatcgatgaagccgtggaaattcctgtgaatagtgccgatggtaaagaagatgtggagaagggcacgcccttggggaagatcctgttgaaaggcgataatatcacattgataacatcagcggactga

SEQ ID NO: 244 - DNA, 285 bp, Saccharomyces cerevisiae
atgtctgagatattacaagatgtacaaaggaaactggtttttccaatagattttcccagccaacggaaaacagaaaaatttcaacagctatcgctcatgatcggagctttggtagcgtgtatattgggatttgcacaacagtccctgaaagttttactgactgcgtatggcattagttgtgtgattactttaatatgtgttttgccagcttacccatggtataataaacaaaaattgaggtgggcacagccaaaaattgaaattaatgtcgaccagtatgactag

SEQ ID NO: 245 - DNA, 288 bp, Saccharomyces cerevisiae
atgaagttagattcaggaatatactcagaggcacaaagagttgtgagaactccaaagtttagatatattatgttagggctggtgggcgctgctgtggtaccgaccgcatacatgaggagaggctatacggttcctgcacatagcttagacaacatcaacggcgtagacacaactaaggcgtctgttatgggtacagaacagagagcagctatgacgaagggtaagagtttacaagagatgatggatgatgatgaagtaacgtatttgatgttctcttcaatcatgtaa

SEQ ID NO: 246 - DNA, 288 bp, Saccharomyces cerevisiae
atgtccggaaaaccaccagtttatagattaccccctcttcccagactaaaagtgaagaaacctatcattaggcaagaagcgaacaaatgtcttgttttaatgtcaaacttattacaatgctggtcttcatatggtcatatgagccctaaatgtgctggcttagtaacggaattgaaaagttgcactagtgaaagtgccctcggcaaaagaaacaacgttcaaaagagcaatattaactatcacgccgctaggctgtatgataggatcaacggtaaaccccatgattaa

SEQ ID NO: 247 - DNA, 289 bp, Saccharomyces cerevisiae
atgataccggctctcactcccgaagaacggcagaagttgcgcagcgcaatactacatcgaatgcagctggaacgtatgtcacctcaccgcaacactctacccccaaccttcacccgcactaattactaacacaacctcagtggaaacaacagaaaaactgatcgaaaatattaaagaggagacgttaaagaaactaaatctgctccagcagcctgatgcaacatcagcgcctcaatcaaaggaactaatcagagaggtgcttgaacaggaaggacgccgtatagaatga

SEQ ID NO: 248 - DNA, 291 bp, Saccharomyces cerevisiae
atgtatatcaattttactagttttctgataaaagaaaaaaagtataatgtcagatttttgttaagtagaaatagaaagatatacgctgccgtgggagaaggacacctctccggatttgtaactaaaaatcataaaatatcacgtctttccttcatattttcaaaaaaaaaaaaagttttctttaccatttttgacacaataatcacgataattgttaggtcaggcattccctttccacttttatgttcatttggacgcaataagatatacatattatttaatgtgctctaa

SEQ ID NO: 249 - DNA, 291 bp, Saccharomyces cerevisiae
atgtcgacagttaatgttttgagatactctgcgttgggtttggggctattttttggttttagaaatgatatgattttgaagtgtaatgctaagaagaaagaggagcaggcacagtacgaggagaaattgaagctggtagaggaggcaaagaaggaatacgccaagctacaccctgtagtaactcctaaagatgtgcctgcgaacgcctcatttaatttggaagatcctaatatagattttgaaagagttattcttaacgccgttgaatccctgaaggaagcttcaacataa

SEQ ID NO: 250 - DNA, 291 bp, Saccharomyces cerevisiae
atgtgccctcgcacagttttgctcatcataaacattaatcattggttttatgataagaatatcgtaagaattattttaactttcagattagattccggccatatttctgacatttgttttattaataaaaatttggcgaatgctttgataactgctgatatttcattgttgaaaaggcatgatataagatgcacaaagtatattataacttattatcagagatataggaacaaagaaaaagggaaattcatatctctatgtaaaaataccattatttcctcttctgtttaa

SEQ ID NO: 251 - DNA, 294 bp, Saccharomyces cerevisiae
atggaggaccacacccttgtggccatcgttgttttctttgggaatggtgaacctttccatgtgtcgttgtctgtagaaatggtgttcgtgctgcttctttcatccactagaattcatgaggtagtagttcttatatgttataaacttcaacacgccacctggtcttggggtaatatgagcaagaatttctctcttaaaccggatataagtctgagctttctgttggatataatttctataaatgatatatgcatctacggttgcattgcccttacagttgtgtttattttataa

SEQ ID NO: 252 - DNA, 294 bp, Saccharomyces cerevisiae
atgtccgaacaagcacaaacacaacaaccagcgaaaagcactccctccaaggattctaacaagaatggcagctccgtgtccacgatcctcgacactaagtgggatattgtcctgtccaacatgctggtcaagactgccatgggttttggcgtgggtgtgttcacctcagtattattcttcaagcgccgtgcatttcctgtatggctaggcattggatttggtgttggaagaggctacgccgagggcgacgccatctttagatccagcgctggcctcagatcctcgaaggtttag

SEQ ID NO: 253 - DNA, 294 bp, Saccharomyces cerevisiae
atgtctaatccatgccagaaggaggcctgcgccatccaaggtttgtaatattaacttcaaaagattcgatcgtttttttcttttcactaacgttttttcacattaattttagattgccttctatcacatcagtacgatgatgctaaatgcgctaaagttatagatcagctgtacatctgctgctcaaaattttacaatgacaatggaaaagattcacggtcaccctgctgtccgctaccttcgcttcttgagttgaagatgaaacagcgaaagcttacaccaggggacagttga

SEQ ID NO: 254 - DNA, 297 bp, Saccharomyces cerevisiae
atgaagtcaagtattccaatcaccgaagtattgccaagagcagtgggttcgctaacattcgatgaaaattacaatttactggatacatcaggtgtcgcaaaagtcatcgaaaagtcaccaatcgcagaaataatcaggaaatcaaatgccgagttaggtaggctgggctactccgtctacgaagatgctcaatatataggtcatgccttcaagaaagctggccattttattgtgtacttcactccaaagaacaagaacagagagggcgttgttcctcctgtaggaataaccaattag

SEQ ID NO: 255 - DNA, 297 bp, Saccharomyces cerevisiae
atggcagttagtaataataataataataataatagtaaagaacgcacccaaaatataaaagaagtggaggaaaagttgggcgagaatccaaagattactttaaaagggggagggaaaactaaaatcatggattttgaacagttacgcaagccccattgcgtaagacccagtgcaagatttccagttgaagatactgccggtggtttattgagaacgggtggccacaggcctcagataagtgatgaagaagtctctaaaaggcaccatgaacagtctcatggacaagaagatcattaa

SEQ ID NO: 256 - DNA, 297 bp, Saccharomyces cerevisiae
atggcggtaagtatcctatcatattatgtgagctagaaccgaattagtatactaacatttataatacagtacacttctcatctgtcttcaaaaactggtctacatttcggtagactttctttaagaagtttaacagcttatgctccgaatttaatgttatggggtggtgctagcatgcttgggctatttgtattcacagaaggatggcctaagtttcaagatacgctatacaaaaagattccgttgttaggacctacattggaagatcatactccaccagaagataaacctaattga

SEQ ID NO: 257 - DNA, 297 bp, Saccharomyces cerevisiae
atgtcagggaacccaggaagctcgctgagcgcattgagacctactccacccgagagaggttcgttcccgctagaccacgacggcgaatgcaccaagtacatgcaagagtatctcaaatgtatgcagcttgtgcagaacgaaaatgcaatgaattgtagactactggcaaaggactacctgcggtgcaggatggaccaccaattgatggactacgatgaatggtcacatttaggtcttcctgaggatgctccaggcaacaacggtaaaaccataaaagacgccaccgataataaatag

SEQ ID NO: 258 - DNA, 300 bp, Saccharomyces cerevisiae
atgttgattgatttttgctgtagttatatagcagggacccacggaagagagcgagcgccttctttcacagggacttttgtcagccacgtctccgcggaaaacaattgccgtccgcgtcgcagtgagattacgcagccgtgcgcttcagggacagaaaagaagcatttcgcggctacggagaaacagtgcactaactctctcgagggtagccgcaaagatttcttgtctcttccattaggacatagctatctttttcttttctgtttttggcgtatgatctgttctgagccaaagttatag

SEQ ID NO: 259 - DNA, 300 bp, Saccharomyces cerevisiae
atgaagactgtctattacaaagaaatcacctaccagcagtatcttcaactgcaacctgaacaacaggaaaaatacctggctttatgtcaaaaagattttgaacaagagactgaaagaattgcatttgatcgtcaaggaggtgtgcctggtattgctaggaaatttgcacaagaagaagttgcttggttcgatcgcgttacaacatggtcatatatgaatgcttatattccgagctacagaagaagaagaaaccttttaaagattgatatgttaaagatgtctaatgctgaagaatactga

SEQ ID NO: 260 - DNA, 300 bp, Saccharomyces cerevisiae
atgaccgaagaaactattactatagattctatttcaaatgggatactgaataacctgttaaccacattgatccaggacattgtagctcgggaaaccactcaacaacaattgctgaagacaagatatccggatcttcgcagttattatttcgacccgaacggatctctcgatattaatggactacagaagcaacaagagtcctctcagtatattcactgtgagaattgtggcagggatgtgtccgcaaacagactagcagctcatttacagagatgtttgagtaggggtgctagacgttga

SEQ ID NO: 261 - DNA, 300 bp, Saccharomyces cerevisiae
atggcccatctctcactaaatcagtacaaatgcactcacatcattatgcacggcacttgcctcagcggtttataccctgtgccatttacccataaagcccacgattatccacattttaatatctatatctcattcggcggccccaaatattgtataactgcccttaatacatacgttataccactttttcaccatctactatccactcaatttatatacacttatgtcaatattacaaaaaaatcaccactaaaatcacctaaacataaaaatattctatccttcaacgataatacataa

SEQ ID NO: 262 - DNA, 300 bp, Saccharomyces cerevisiae
atggccgcaactaaagaagcaaagcaaccaaaggaaccaaagaagaggaccaccaggagaaagaaggatcctaacgcccctaagaggggcttgtcagcttatatgttctttgctaatgaaaacagagacattgtccgttccgagaatcctgacgtaacttttggccaagtaggcagaatattgggtgagaggtggaaggccttaactgctgaagaaaagcaaccctatgaatctaaggctcaagcagacaagaagagatacgaatctgaaaaggaattgtacaatgctacacgtgcttga

SEQ ID NO: 263 - DNA, 300 bp, Saccharomyces cerevisiae
atggtaaacgtgaaagtggagtttctaggtggacttgatgctatttttggaaaacaaagagtacataaaattaagatggacaaagaagatcctgtcacagtgggcgatttgattgaccacattgtatctactatgatcaataaccctaatgacgttagtatcttcatcgaagatgattctataagacccggtatcatcacattaatcaacgacaccgattgggagctcgaaggcgaaaaagactacatattggaagacggtgacatcatctcttttacttcaacattacatggtggttaa

SEQ ID NO: 264 - DNA, 300 bp, Saccharomyces cerevisiae
atgtataaaataactactatatatttgtggctgaaatcatacctttcatttttcatcggcttagataatcttgattttctcaccttaatacgcttttttcaatgtcgtttacaaaacaagctaggtttgcaagatatcctggactttttttgtaatctatgtggccacagtatggttcgcacttgcaacatggtagaggctgcccaaaaacaaaaccgcatcacctttggcagcatttacgtgaaactccatcctcttgtcaaactttgcacaggaatcgtgtgggccccacgagtgtga

SEQ ID NO: 265 - DNA, 300 bp, Saccharomyces cerevisiae
atgtctcaagatttcgttacgttagtatcaaaagatgataaggaatatgagatatcacgatctgctgcgatgatttcaccgacgttaaaagctatgattgagggacccttcagggaaagcaaaggccgaatagagctcaagcagtttgactcgcatattctagaaaaggctgtggaatatttaaattataatttgaagtacagcggcgttagcgaggacgatgatgagattccagagtttgaaataccgacagaaatgtcgttagagctgctacttgcggcggactatttgagtatatag

SEQ ID NO: 266 - DNA, 300 bp, Saccharomyces cerevisiae
atgttgggaatgataaggtgggtagtagaggggacgttggtagctatgctcctatcggcaataagaagggagacgggaatgatattcttttacaaccagtatcagttgggcggctggatacatagatatctgtcatggggagagatgtgctacacaaggacgctgaagatggttaaacgttctaaatttttcagaaagcagttgaacgaggacgggtttggacgcatcaatgatagcggtccaaaacgaaggggaagagatcaatctcaatacagcagtaggtttgtagaactagattaa

SEQ ID NO: 267 - DNA, 303 bp, Saccharomyces cerevisiae
atgaaaacattcttcttgattgaggctggcagagccttgcaaatagtggcattccgtcctgcgattactactgttctattccaacgtttctcagtgagtttctcctgtagttatttcacttgttgtacctcacagcttctacgggaaaattggcttttcaaattccttacagctttcgatcacgtgatccgagcttcaaatgacctttcgacgatgcgtttcatgattatgtatatatatgtatatatatatatctatacagtcttaaggaagcgcttaagttgttacatgttaatactttag

SEQ ID NO: 268 - DNA, 303 bp, Saccharomyces cerevisiae
atgacagataacacaacttccagcgacttaataaagaatgtcgaaacggctcgctccactatcgatggtttaattgaatctctagggtggattgaactaaattaccgttgtgagaggcaatgcaattgggatgaagtttgttacactccttcctggggcccatctccaatgggtatgactgaaccaggttcccacaatgagggatttggaacccactttgatgaatctcgacaaaggttggttattaacagtaaactacagtgtatcaatataaatgatttgatggttaatcgtaatcattag

SEQ ID NO: 269 - DNA, 303 bp, Saccharomyces cerevisiae
atgagaggcgaaacaggcgtaagcattaaaaacccaaggccatctcgtcctttttcttgtttttggcgtaaaggagatgttgaaaatattaggaaaagtgatatagggaacgaaaagaaaatagacgctaagttcaacaggcttcagtataatctatattacaagcctctctcgcaccacaaggccggtttattgtacaaagaactcttcttcagaagctgcttctcttatactacctgctcattagactttcagggtaaaaggcaccaagtggaaagaaaggcagtagatatagtactttga

SEQ ID NO: 270 - DNA, 303 bp, Saccharomyces cerevisiae
atgagcaatactaagcataccacttctcatcacatggaactcaaaaggatcattatccttacacttttattcatactcataatgttgatatttcgaaactcagtgtccttcaaaatgacatttcaagaactactgccacgattttacaaaaagaattcaaactcagttagtaataataacaggccctcatctattttctcggaaaacttggtggattttgatgatgttaacatggtcgataagaccagactgtttatttttttatttttcagtttcatcattactataccgtttatggtataa

SEQ ID NO: 271 - DNA, 305 bp, Saccharomyces cerevisiae
atggttcagtacgctccctttctattaggaaagtatgttcattcttcatacgctattctatttttttttttttcacacttattcttttactaacgcatagttaaccatttgctgtttcgaagaggcaacatcaaacaagtcgatgtgctctttcccaagctggtctctattgcagattttctgatccgttattggcaattatggtaggctgtctcagctactatgtgtacgaaaggaaaatggggcgtccacaaggtcatcatttacacgagctcataaagaagcgatgggacgatcgcaaataa

SEQ ID NO: 272 - DNA, 306 bp, Saccharomyces cerevisiae
atgaacaataatgttgaagaactcctacggcgtattcccctctacaacaaatatggtaaggattttccacaagaaacagtgactaggtttcagatgcctgaatttaagttaccagcgctacaaccaacaagggacttattatgcccttggtacgaagaatgtgacaatatcaccaaagtctgtcagttacatgattcttctaataagaaattcgatcagtggtacaaggagcaatatctgagtaaaaaaccaccgggaattgttggaaacacactattatctccatcaagaaaggataattcctag

SEQ ID NO: 273 - DNA, 306 bp, Saccharomyces cerevisiae
atgaagaacgcagcattgtgtgaggctcttcctctgctcgccacgtgctcccacgaaatcccacccacaccacacacggtctgtttcgtcttcccccccgcattattactatccccgagcaaactcacacttttgaattcgcgtcgcgtcgcgtcgcgctgcgtcattatcattgacccacgcttgctgcgtctcttctcttgctcccggccacaacaactcccccgggataaaaaccaatcttttgctaagccatctttttctttttttttctttcttcttacctcgttattatcgcctttctaa

SEQ ID NO: 274 - DNA, 306 bp, Saccharomyces cerevisiae
atgactatgaatggaataccagtgaaattattaaatgaggcacagggacatatcgtttctctggagctaacaacgggagcgacttatcgtggtaaacttgttgaaagcgaagatagcatgaacgtacagctaagagatgtaatagctacagagccccagggggctgtaacacacatggatcaaatattcgtacgtgggtcacagatcaaatttatcgttgttccagatctcttaaagaatgcaccattattcaaaaaaaactcatcaagacctatgccaccaataagaggacctaagagaaggtga

SEQ ID NO: 275 - DNA, 306 bp, Saccharomyces cerevisiae
atgatttttaaacgtgcagtatctacattgattcctccaaaagttgtgtcttccaagaatataggttcggcaccaaatgccaagcgcattgctaatgttgttcacttttataagtctttgcctcaaggaccagcaccagccatcaaggctaacactagattggccagatacaaagccaagtactttgatggggataatgctagtggtaaaccattgtggcattttgctctaggtataattgcctttggctattccatggaatattattttcatttgagacatcataaaggtgcggaagagcattga

SEQ ID NO: 276 - DNA, 306 bp, Saccharomyces cerevisiae
atgcaatcgatcagtaattgtcccatcgggttagtttcaaaaaacacaatcaattcagcttccactattgcagagtgggtagcatgtccatggaaatatatcaacgttgttggttcaggcagatatgtgagcaataaacctgataaaattaccagatatgatttactcaaggctgcccaggaagcggaaatgcaggagttgcttacaagaaatgatatgaaaggtagacataaacgtaataagaaaagtaagatagcattggagactatagcggaagaaaactcttcaactgaaagccttttttaa

SEQ ID NO: 277 - DNA, 306 bp, Saccharomyces cerevisiae
atgctaaaggtggaaaagttcaaaaaattgaagcgattcgaggtctattattgtttaaaaaattcttttctggaagaagtagatatcgagatgaaatattcctgcagtataacaactataatgagcaatggttcagcaagcttgttgatgaactgggaagaattaacacctggtcactgttttacctcttacacaactaaccctatcgcaggtgactatggtttgaatgcatcagcaatagacggccacacggaagagttagtggcgacccacccagcgggaaccttggagaatgcaacgcagtag

SEQ ID NO: 278 - DNA, 306 bp, Saccharomyces cerevisiae
atgtcggactcagaagtcaatcaagaagctaagccagaggtcaagccagaagtcaagcctgagactcacatcaatttaaaggtgtccgatggatcttcagagatcttcttcaagatcaaaaagaccactcctttaagaaggctgatggaagcgttcgctaaaagacagggtaaggaaatggactccttaagattcttgtacgacggtattagaattcaagctgatcagacccctgaagatttggacatggaggataacgatattattgaggctcacagagaacagattggtggtgctacgtattag

SEQ ID NO: 279 - DNA, 307 bp, Saccharomyces cerevisiae
atgattgttaaagtgaagacactgactgggaaggagatctctgttgagctgaaggaatcagatctcgtatatcacatcaaggaacttttggaggaaaaagaagggattccaccatctcaacaaagacttatattccagggaaaacaaatgtatgttcattcagtggttaattatcttttaagtttatttacgtttttgagaccttactaacgaccaggatagtgatgataaattaacagtaacggatgcacatctagtagagggaatgcaactccacttggtattaacactaagaggtggtaactag

SEQ ID NO: 280 - DNA, 309 bp, Saccharomyces cerevisiae
atgcgtactttcactgactttgtttctggcgcacctattgtaaggagtcttcagaaaagcaccataaggaaatatgggtacaatttggcaccccacatgtttttgttactacacgtagatgagctatcgattttttctgcataccaagcaagtttacctggcgaaaagaaagtcgacacagagcggctgaagcgtgatctatgcccacgtaaacccattgagataaagtacttttcacagatatgtaacgatatgatgaacaaaaaggaccgattgggtgatgttttgcatgtgtgctgcccaagttga

SEQ ID NO: 281 - DNA, 309 bp, Saccharomyces cerevisiae
atgcgtactttcactgactttgtttctggcgcacctattgtaaggagtcttcagaaaagcaccataaggaaatatgggtacaatttggcaccccacatgtttttgttactacacgtagatgagctatcgattttttctgcataccaagcaagtttacctggcgaaaagaaagtcgacacagagcggctgaagcgtgatctatgcccacgtaaacccattgagataaagtacttttcacagatatgtaacgatatgatgaacaaaaaggaccgattgggtgatgttttgcgtgtgtgctgcccaagttga

SEQ ID NO: 282 - DNA, 309 bp, Saccharomyces cerevisiae
atgaaattctctactctctccaccgttgctgccattgccgcatttgcttccgcagattccacctctgatggtgtcacttacgtagatgttaccaccaccccacaaagtactacatctatggtctccaccgtgaaaactacttccactccatacactacaagtaccattgccactctatccactaaatctatcagtagccaagctaacaccaccacccatgagatcagcacatacgtcggcgctgccgttaaaggctccgttgcgggtatgggtgccatcatgggtgctgctgcctttgctttgttataa

SEQ ID NO: 283 - DNA, 309 bp, Saccharomyces cerevisiae
atggcaggggatagtataagcgctgacggcactggcgtccatccagttgaactgtcggtgtattcagtattgtccaccgatttagacggactgtatcaatcgatcaatgaattacgcgagtcgcaagcactactcatccttatgcttcggaaggttcgcgataaacttcgaagagaaggtcaagtcctttatgacccagaaccattcaaaccaaccatggataaactggctgacttatctgcccgtgtgcgcattctctcacaaagatacgaggagcttcaggggaatgctagagccctcaacaactaa

SEQ ID NO: 284 - DNA, 309 bp, Saccharomyces cerevisiae
atggtggcagttcataaggtcaggtacaacgtcataatgatactgggccctgaacagacaccaaacgaaaagacaacgttggacaactgcggtcttgcccgtagaaacttggtgttgctcaaagcagtccacacaaactgcgacagttggaacatgaacagatatcctctaacccttctgaaaatggcgaacatggccatttcgtggaacacggcactcaagaaaaaagtaaataatgtagcttggctcttgctcaaatgcaatgcgcccatggagctgtggtacacgtgtcttagtaaaaatttgtga

SEQ ID NO: 285 - DNA, 309 bp, Saccharomyces cerevisiae
atgtctagtgaaagagcctgtatgctgtgtggcatagtgcagaccacaaatgagtttaatagagatggttgtcccaactgtcagggtatttttgaagaggcaggtgtttctacaatggaatgtacgtcgccttctttcgagggcctcgtaggaatgtgtaagcctactaagtcgtgggtagcaaagtggctgagcgtagatcatagtatagctggtatgtacgccatcaaggtcgatggtagactaccagctgaggttgtggagctgttgcctcactacaaaccgagggatggcagtcaagttgagtaa

SEQ ID NO: 286 - DNA, 312 bp, Saccharomyces cerevisiae
atgtccggtagaggtaaaggtggtaaaggtctaggaaaaggtggtgccaagcgtcacagaaagattctaagagataacattcaaggtatcactaagccagctatcagaagattagctagaagaggtggtgtcaagcgtatttctggtttgatctacgaagaagtcagagccgtcttgaaatccttcttggaatccgtcatcagggactctgttacttacactgaacacgccaagagaaagactgttacttctttggatgttgtttatgctttgaagagacaaggtagaaccttatatggtttcggtggttaa

SEQ ID NO: 287 - DNA, 312 bp, Saccharomyces cerevisiae
atgtccggtagaggtaaaggtggtaaaggtctaggtaaaggtggtgccaagcgtcacagaaagattctaagagataacatccaaggtattactaagccagctatcagaagattagctagaagaggtggtgtcaagcgtatttctggtttgatctacgaagaagtcagagctgtcttgaaatccttcttggaatccgtcatcagagactctgttacctacaccgaacacgccaagagaaagactgttacttctttggatgttgtttatgctttgaagagacaaggtagaaccttatacggtttcggtggttaa

SEQ ID NO: 288 - DNA, 312 bp, Saccharomyces cerevisiae
atgaattcaagtctgaatgccaattcttatttttttcgaaaacccccaatgctaacttatatggtccgttttctttactgttatccatctccctttcctatagctccagcggttaccgatcttccagaatgccggggagatctttctctttctttgtttataacaagtttcacaagcacgaaagaaagaacaatactgtacgccaaaagccgcctaaagacgcatattcccgtcaatttatgtgaccggtaccactatatacctaaggcacctctataccaatgtagaatgccctgtttatactctatatag

SEQ ID NO: 289 - DNA, 312 bp, Saccharomyces cerevisiae
atggttactcaattcaaaactgccagcgaattcgactctgcaattgctcaagacaagctagttgtcgtagatttctacgccacttggtgcggtccatgtaaaatgattgctccaatgattgaaaaattctctgaacaatacccacaagctgatttctataaattggatgtcgatgaattgggtgatgttgcacaaaagaatgaagtttccgctatgccaactttgcttctattcaagaacggtaaggaagttgcaaaggttgttggtgccaacccagcggctattaagcaagccattgctgctaatgcttaa

SEQ ID NO: 290 - DNA, 315 bp, Saccharomyces cerevisiae
atgcaaaattcccaagactacttttacgctcaaaatcgctgccaacaacaacaagccccttccacattgcgtaccgtgaccatggcggaatttagaagggtgcctttgccacctatggctgaggttcctatgttgtctactcaaaactccatgggcagctccgcttctgcctccgcttcttcattagaaatgtgggaaaaggatttggaggagagactcaactctatcgatcatgacatgaacaacaacaaatttggttctggcgaactaaaatctatgttcaaccagggtaaggtcgaggaaatggacttctaa

SEQ ID NO: 291 - DNA, 315 bp, Saccharomyces cerevisiae
atgcccaagatcttttgtttagcggacgtgtgtatggtccctattggcaccgactctgctagtatttctgattttgttgcactcattgaaaaaaaaatcagagaaagcccattaaagagcactttacacagtgcaggaacaacaattgaagggccttgggatgatgtgatgggtttgattggcgaaatccatgaatacggtcatgagaaaggatatgttagagtacacactgatattcgtgttgggactagaactgataagcaccaaactgctcaagataagatcgatgttgttttaaaaaaaatttctcaatga

SEQ ID NO: 292 - DNA, 315 bp, Saccharomyces cerevisiae
atggaagatacctcgaggtgcatcgatgatgtactgaaaataggacaacaggagaaggaaataagacaggcagagttttctgacgcacaaggggagagagaggaggttaagtgtattgattacacagtagatttggaagcaggtcttccgcgccacgagagtagtggaaaaagtaataccctcaaacagtgttataacgccgttctagggtttctcgaggaactcatcatcgtcattattattgtgttgctgttgtacagtttgacaatggtaggtcttttttatgtgatgacgatgacgaagtttttgttttaa

SEQ ID NO: 293 - DNA, 315 bp, Saccharomyces cerevisiae
atggacattgacatgaactatcccagtataactactttgatgagtaatgaatcagcaaacttattgattatttgggggaatgccacgcctgatattagctatctatcttatacaactaacccaatgttaggtgactatgttttaaatgtgtccgctataaatggctgcacggaggaattaatagcaactcatctagtgccaactttggagaatgcaacccagtgggtttatgatgcgggggagtactgggacaattattcctttactgatgaaagtacccctctgccaggactttcctggccatttaatgaataa

SEQ ID NO: 294 - DNA, 315 bp, Saccharomyces cerevisiae
atgggcttattttcatttgatggtggcaaaaaggaatcacaaccccctaatacccgttcacagagaaagttgtgctgggagtccagggacgcattcttccagtgtttggacaaggcagacatcttggacgcaatggaccccaagaatagcaagagtataaagtcgcactgcaaggtggaaaatgaaaaatttgaggagaattgcgcccatagctggatcaagtacttcaaggagaagagggtcatcgactttaagagagagcagaccatcaagagaatcgagcaggaagctaaacagagggaacgaaatcagtga

SEQ ID NO: 295 - DNA, 315 bp, Saccharomyces cerevisiae
atggtcactcaattaaaatccgcttctgaatacgacagtgctttagcatctggcgacaagttagtcgttgttgacttttttgccacatggtgtgggccatgtaaaatgattgcaccaatgattgaaaagtttgcagaacaatattctgacgctgctttttacaagttggatgttgatgaagtctcagatgttgctcaaaaagctgaagtttcttccatgcctaccctaatcttctacaagggcggtaaggaggttaccagagtcgtcggtgccaacccagctgctatcaagcaagctattgcttccaacgtatag

SEQ ID NO: 296 - DNA, 315 bp, Saccharomyces cerevisiae
atgttaaggagggaaacttcaacaatatacaggacacacaaaaaaagcaacagtagtatactcaggagccagcgggaccagactagagtggattccttggtagaggagtctcccatgggcgatttcgggatcaataaccagcctacacagcctggcgtgatatactactttgtagagctgactaatttaggcatacaggaaaacacaagcagtaataataacaacaacaataatcatggtgacgatgaaaacggcagtcgatacggccacggcagcagtctgggtggagacgttcactctcgccgttgttcatga

SEQ ID NO: 297 - DNA, 318 bp, Saccharomyces cerevisiae
atgatggacttgggcgacaaaataaatcctaacctctcgttcttaggaatcaactgcgtcagcttcaaccaatcacccgacattcttgagtctctacatcaagcactgccaaatatggccttgcttgcttatccaaacagtggtgaagtttatgatactgaaaagaagatatggttgccaaatagcgataagctgaacagttgggatacggttgttaaacagtacattagcagcggtgcccgtatcattggtggttgttgcagaacaagtccaaaagacatccaagagatttctgcagccgtcaagaaatacacgtaa

SEQ ID NO: 298 - DNA, 318 bp, Saccharomyces cerevisiae
atgcaagttctcatcggaacgaaattagtgactgaaggaattgacattaagcaattgatgatggtgatcatgcttgataatagacttaatattattgagctcattcaaggcgtagggagactaagagatgggggcctctgttatctattatctagaaaaaacagttgggcggcaaggaatcgtaagggtgaattaccaccgattaaggaaggctgtataaccgaacaggtacgcgagttctatggacttgaatcaaagaaaggaaaaaaagggccagcatgttggatgctgtggctccaggacagacctgtctgctga

SEQ ID NO: 299 - DNA, 318 bp, Saccharomyces cerevisiae
atgccactatttgcaaggctctgccagcctcaatcaagaagaatgttttcatctatatcttctttctctgctctatctgtgttacgcccacaaaccggtatgctcttaaacagttcaccattgaagactccgtccttcacaccgttgggatttggcttaataggtcaaagaagatggaaatcaaggggtaacacctatcaacctagtacattgaaacggaagagaacttttggtttcttggctagggccaagagcaaacagggctctaagatattgaaaaggaggaagctcaaaggtaggtggtttttgtctcattga

SEQ ID NO: 300 - DNA, 318 bp, Saccharomyces cerevisiae
atggaacatccagcatatacattgagtcttttgactacagccggtggccttatgggatactaccgtaagggctccattccatctctagtatctggcttagtattcggtagtgtatatgggattgccggttacttgctacatatgaatagagatggtgggctcgaaatggcattgggtgcatcgaccttactacttggtgctggtgtcataagaggcatgccttccaggttcactaaacctgtccctgtcgttttgacagctttgggtgggctcggcagttactactattataacaaatacaaggaattttacccttag

SEQ ID NO: 301 - DNA, 318 bp, Saccharomyces cerevisiae
atgggtctatcatctatctttggcggcggtgcaccatcacaacaaaaggaagcagccactactgcaaagacaaccccaaaccctatagccaaggagctgaaaaaccaaattgctcaagaactggctgtggctaatgcgactgaattagtgaacaaaatttctgagaactgctttgaaaaatgcttaacttcgccatacgctaccagaaacgatgcgtgcattgaccagtgtttggctaaatatatgagaagttggaatgtcatatcaaaggcttacatctccagaatccagaacgcctccgcttctggcgaaatctaa

SEQ ID NO: 302 - DNA, 318 bp, Saccharomyces cerevisiae
atgtccaagagtaatacttataggatgctcgtcttactagaagacgacaccaagataaataaagaagatgaaaaatttttgaaaggtaagccgggaaaaatgcatgaatttgttgacgagttgatacttccatttaatgttgacgaactggacgaattaaatacctggtttgataagttcgatgccgaaatatgtataccgaacgaaggtcatatcaaatacgaaattagtagcgatggtttaattgtacttatgctagataaggaaattgaagaggttgtcgaaaaagtaaagaaatttgtcgaagagaataactga

SEQ ID NO: 303 - DNA, 318 bp, Saccharomyces cerevisiae
atgttggcgcgcagtttgggttacaggttgatatcgaccagtcgtatcttatataataaacccacggttaagtcagtggtgtcgtcgtgtcctgcgggaacatcgcttaacttaaacatatggaagagcggtaaagacgcagtggcactcgaggacaaggagtatccaaattggttatggagcgtattggatagtgatcacgttgtcgaacatgcggctgaggacccagagggacaggctctcttaaagagaagaaagaacataaggaaggcgaacaggcagcgaatcaagcaaaacaatttcttgagccaactttaa

SEQ ID NO: 304 - DNA, 321 bp, Saccharomyces cerevisiae
atgaagtacttagctgcttacctattattgaacgctgctggtaacaccccagatgccaccaagattaaggctattttggaatccgtcggtatcgaaatcgaagacgaaaaggtttcctccgttttgtccgctttggaaggtaagtctgttgacgaattaattactgaaggtaacgaaaagttggctgctgttccagctgctggtccagcttctgctggcggtgctgctgctgcctctggtgatgctgctgctgaagaagaaaaggaagaagaagccgctgaagaatctgacgacgacatgggtttcggtttattcgactaa

SEQ ID NO: 305 - DNA, 321 bp, Saccharomyces cerevisiae
atggcacccacacaattggatataaaagtcaaggccttgaagaggctgactaaggaggaagggtactaccaacaagaactgaaagatcaggaagcacatgtggcaaaacttaaagaagacaagtcagttgacccatatgacttgaagaaacaggaggaggtccttgatgacacaaaaagattattacctactttatatgagaagattagagaatttaaagaggatttagaacaatttctaaaaacttaccagggtaccgaagatgtcagtgatgcaagatccgctattacgtctgcacaggaattactcgattctaaataa

SEQ ID NO: 306 - DNA, 321 bp, Saccharomyces cerevisiae
atggccaaatcattacgtgctagcagtcatctaaatgctaaatctgtcaaaagacgtggcgttttccaaaaagcagtagatgcacgtgaacaaagaatatccgataaactaaaggaagacttactaaagcaaaaattagaagatctaaaaaagaaagaagagcaaggaattgacatggatgtcgacgagaaaaaatccaatgaagaagctcccagaaaaaaaatcagcacctctggttggagagacggtagacatcacacttataaaaaggctaagctgatgaaacaatctaagaaaaaaacttctttcaccagattctga

SEQ ID NO: 307 - DNA, 321 bp, Saccharomyces cerevisiae
atgtccacccttttgaagtctgctaaatctatcgttccattgatggaccgtgtccttgtccaaagaatcaaggcacaagcaaagacagcatccgggttgtatttacctgaaaagaacgtggagaagttaaaccaagctgaagttgttgccgtaggcccgggctttactgatgctaatggtaataaggttgttcctcaagttaaagttggtgaccaagttttgattccacagtttggtggttctaccattaaattgggtaacgacgatgaagttattcttttcagggacgctgaaatcctggctaagattgccaaggactaa

SEQ ID NO: 308 - DNA, 321 bp, Saccharomyces cerevisiae
atgtcgaaattgggtccgttagcaagatctgtgaagtggactctctctgtgggagtaatcggttctgttttttacctgtaccgatacagtaacaatggctacttctacgatcacgatgctacatggttgaaacaagatcatcaggtacaggacctggtggatagaaaagaagtggtacctggggagaccaggaaccgcaagctagttgtgacggatgatggcactgcatggagcaggaccatgggggagagcataaaagatatttggaatgaacagataagaaactctgtcgattggatctactcctggggtaagaattag

SEQ ID NO: 309 - DNA, 321 bp, Saccharomyces cerevisiae
atgtctactgaatccgctttgtcttacgccgccttgattttggctgactctgaaatcgaaatctcttctgaaaagttgttgactttgactaacgctgccaatgtcccagttgaaaatatctgggctgatatttttgctaaggctttggacggccaaaacttgaaggacttattggtcaacttcagcgctggtgctgctgccccagctggtgtcgctggtggtgtcgctggtggtgaagccggtgaagccgaagctgaaaaggaagaagaagaagctaaagaagaatccgatgacgacatgggtttcggtttatttgattag

SEQ ID NO: 310 - DNA, 324 bp, Saccharomyces cerevisiae
atgagtagggctagcaagataacgtttgcagcttcctgtctgataacggcagcgacggtagtgggcgtgcattatgtgcaagaaatggaaagggaaactttgcatcagggtccgataaaagatgctaaacgagtcgaagaaaagaggttgagaaagacaaacggagttgcatcattagatcccacaaaagaaaggaaaaggtacttcaatatgagtgaacacgaggaacaaaaagagttgcgaaagaagtatgagaccatgcaaccgcttagtggagaagttgtgaccaaagatggagaggtggttaaagaatctaagaaataa

SEQ ID NO: 311 - DNA, 324 bp, Saccharomyces cerevisiae
atggtaaacttagctaacgttttaaccaacgcgactgcagctacgctgagcgcatggtctaatacagttccgttagagacatattttcattttgatgaggcatcaggatttggcgactactatttgaatgtatccgtaatctggatgaatgaaaccctttatgaaaccagaattgtcccagctattatcaatgtccgcgaatggcttgaccatatggaggcaaacgatccttcacctagtgtaactaacccatacgaaacttcaggttattatgccttttcaacagtagtacctgttttaatggggaatatgaaagtagcataa

SEQ ID NO: 312 - DNA, 324 bp, Saccharomyces cerevisiae
atgtcccgccatcagtttgatctaataatgtgcctaaagcagcctggtgtacagacaggtcttctttgtgaaaaatgtgatggcaaatgtcctatctgcgactcttatgtaaggcccaaaaggaaagttagagtatgtgaaaactgttcgtttggtaaacaagctaaaaattgtataatttgtaatctaaatgttggagtcaatgacgcattctattgttgggagtgctgccgcttaggtaaagataaagatggctgtcctaggatcttaaaccttggcagcaatagactggatagacatttcgagaaaaagaaaaaggtataa

SEQ ID NO: 313 - DNA, 327 bp, Saccharomyces cerevisiae
atgcctccaaagcaacaattatctaaagctgccaaagccgctgctgcccttgctggtggtaagaagtctaagaagaagtggtccaaaaagtccatgaaagacagagctcaacacgctgtcattttagaccaagagaagtacgacagaatcttgaaggaagttccaacttacagatacgtttctgtctctgttttggtcgacagattaaagattggtggttctttagctagaattgctttgagacacttggaaaaggaaggtatcatcaagccaatctccaagcactccaagcaagctatctacaccagagctactgcttctgaataa

SEQ ID NO: 314 - DNA, 327 bp, Saccharomyces cerevisiae
atgcctccaaagcaacaattgtctaaagctgccaaagccgctgccgctcttgctggtggtaagaagtccaagaagaagtggtccaaaaagtccatgaaggacagagctcaacacgctgttattttggatcaagaaaaatacgacagaatcttgaaggaggttccaacttacagatacgtctctgtttccgttttggttgatagattaaagattggtggttctcttgccagaattgctttgaggcacttggaaaaggaaggtatcatcaagccaatctcgaagcattccaagcaagctatctataccagagctgctgcttccgaataa

SEQ ID NO: 315 - DNA, 327 bp, Saccharomyces cerevisiae
atgaatactaataagatagcacaagacgaagtccaagataaggttttgcaaagagcagaactagcacattctgtatggaacttaaggttcaacctcagtaaagttgccaaacggattcgcatggaaacaaaggtatttccagagataaagataaatgacgcgcaatcacagttagagcgatctaggtgtagaatatttagccctgacctggaggaagaacatgtgcccttgattcaaggctttaaatgtttggattcaccccctcccgttccaccaagctcatcgcagggggaggatgaagagaacacggtagattcgcaatactag

SEQ ID NO: 316 - DNA, 327 bp, Saccharomyces cerevisiae
atgagctcaaatgaagaggtatttactcagataaacgcaactgcgaatgtggttgataataagaagcgtttacttttcgtgcaagatagctcagcacttgttctagggcttgttgcaggatttttgcaaatcgagtcagtccatgggtttatttggttcctgattctgtacaacttgattaatgtcatttacattgtttggatctgtcaacttcaaccaggaaagttctaccaaagcccacttcatgacatttttttcgaatcgttttttagagagataactggttttgtcatggcatggacatttggatacgccctaatcggatga

SEQ ID NO: 317 - DNA, 327 bp, Saccharomyces cerevisiae
atggatatgcttcataataaatgtagtgatgctatcaaaagcacctccaatagcaatttgagtaatgaggtagacaaacaaaaattgcaatacgatgacctcgggaacaccggattttctgaactatttgagatggaatctcaagataataatgatagcatagaggatttcttgttctttaatataaatttaacccaggaggttgagttcgagaaccaaagacaatatgagcacacgaaaaagacaaagaagcataacccattctatgtaccgtcagaggtagtgcgagagatggtcaagaaacacgcattgaatggcagaatatag

SEQ ID NO: 318 - DNA, 327 bp, Saccharomyces cerevisiae
atggtagctagttgtaaagatcagaagaaggctgtcgctatatgtttgcagagatcgccctgtgtcatgatagagagacataaccctcaagaatgtcttgacaatccagagctgaataaggatctgcccgaactttgtattgctcagatgaaagcatttttggattgtaagcgaggaatcgtcgacatgactaagcggttcacaggtaacgcacctctgtcgactggcaagtacgatcaacagtacgaaaacttgtgcaaaggaaagtttgatccgagggaggagatggaaaagctaaaacttctgaacagccagcagaaggactga

SEQ ID NO: 319 - DNA, 327 bp, Saccharomyces cerevisiae
atgtccattgagaatctgaaatcatttgatcctttcgccgacacaggagacgacgaaaccgccacttcaaactatattcatattcgtatccaacagagaaatggtagaaaaactttaactacggtgcaaggtgtcccagaggaatatgatttaaagagaattcttaaggtcctaaagaaggactttgcatgtaatggtaacattgtcaaggatccagaaatgggggagattattcagttgcagggtgaccaaagagcaaaggtttgcgaatttatgatctcccaactgggattgcaaaagaagaacattaaaattcatgggttttaa

SEQ ID NO: 320 - DNA, 330 bp, Saccharomyces cerevisiae
atgactgaattcaaggccggttctgctaagaaaggtgctacacttttcaagactagatgtctacaatgccacaccgtggaaaagggtggcccacataaggttggtccaaacttgcatggtatctttggcagacactctggtcaagctgaagggtattcgtacacagatgccaatatcaagaaaaacgtgttgtgggacgaaaataacatgtcagagtacttgactaacccaaagaaatatattcctggtaccaagatggcctttggtgggttgaagaaggaaaaagacagaaacgacttaattacctacttgaaaaaagcctgtgagtaa

SEQ ID NO: 321 - DNA, 330 bp, Saccharomyces cerevisiae
atgtcacagatagcacaagaaatgacagtgagcttaagaaacgccaggacacaattggatatggtcaatcagcagctagcatatttggacagacaagaaaagcttgctgaattgacaaagaaagaactagagtcttatccaacggacaaagtatggagatcttgcggtaaatcgtttatcttacaggataaatccaaatacgttaatgatttatcacatgacgaaactgttcttctggatcaaagaaaaacattaaagataaagaagaactatttagaaactactgttgaaaaaacaatagacaatctaaaggcattgatgaagaattaa

SEQ ID NO: 322 - DNA, 330 bp, Saccharomyces cerevisiae
atgtcagccaccttgaaagactacttaaataaaagagttgttataatcaaagttgacggcgaatgcctcatagcaagcctaaacggcttcgacaaaaatactaatctattcataaccaatgttttcaaccgcataagcaaggaattcatctgcaaggcacagttacttcgaggcagcgagattgctcttgttggcctcatagatgcagaaaatgatgacagtctagctcctatagacgaaaagaaggtcccaatgctaaaggacaccaagaataaaatcgaaaatgagcatgtaatatgggaaaaagtgtacgaatcaaagacaaaataa

SEQ ID NO: 323 - DNA, 330 bp, Saccharomyces cerevisiae
atgtcgttctttttaaatagtctaaggggcaaccaggaggtctcgcaagagaagctagacgttgcaggagtgcaattcgatgcgatgtgctcgactttcaacaatattctcagtacgtgtcttgagaaatgtattccgcatgagggctttggtgagcctgatctaacgaaaggtgagcaatgctgcatagacagatgtgtggcaaagatgcattacagcaatcgcctcattggaggatttgtacaaacacgaggtttcgggccagagaatcagctacgacattattcgcgatttgtggccaaagaaatagctgatgattccaaaaaatag

SEQ ID NO: 324 - DNA, 330 bp, Saccharomyces cerevisiae
atgtctgacgcaggtagaaaaggattcggtgaaaaagcttctgaagctttgaagccagactctcaaaagtcatacgctgaacaaggtaaggaatacatcactgacaaggccgacaaggtcgctggtaaggttcaaccagaagacaacaagggtgtcttccaaggtgtccacgactctgccgaaaaaggcaaggataacgctgaaggtcaaggtgaatctttggcagaccaagctagagattacatgggagccgccaagtccaagttgaacgatgccgtcgaatatgtttccggtcgtgtccacggtgaagaagacccaaccaagaagtaa

SEQ ID NO: 325 - DNA, 330 bp, Saccharomyces cerevisiae
atgtctgcctttgttactaaagctgaagagatgatcaaatctcatccatatttccagttatccgccagctggtgccccgactgcgtctatgctaattccatttggaataagttgaatgtacaggacaaagttttcgtttttgatattggttcacttccaagaaacgaacaggaaaaatggagaattgcgttccaaaaagttgttggtagcagaaacttaccaacgatagttgtcaatggtaaattctggggtactgagagtcaattgcatagatttgaagcaaaaggcactcttgaggaggaattgactaaaatcgggcttctgccttga

SEQ ID NO: 326 - DNA, 333 bp, Saccharomyces cerevisiae
atgaaatacttagctgcttacttattattggttcaaggtggtaacgctgccccatccgccgctgacatcaaggccgtcgtcgaatctgtcggtgctgaagtcgatgaagccagaatcaacgaattgttgtcctctttggaaggtaagggctctttggaagaaatcatcgctgaaggtcaaaagaagttcgctactgttccaactggtggtgcttcttctgctgctgccggtgctgccggtgctgctgccggtggtgatgctgctgaagaagaaaaggaagaagaagctaaggaagaatctgatgatgacatgggttttggtttattcgattaa

SEQ ID NO: 327 - DNA, 333 bp, Saccharomyces cerevisiae
atgaacgtaccaaaggcgagactcctaaaagtagcagagttatctgcgaagatatttgatcaaaatttcaacccatcaggtataagaaccggttctaagattctaaatgagcgattaaagggcccttctgtggcaagctactacggcaatccggatatcctgaagttcagacatttgaaaacattatatcctgatattgaatttgtagaccttgaggagcaatatcgattatctatggtagaagcaaagaaacgtcgtggtaaaggtgctcctaagaagatgaagaaggatgcagctgcaactgcaaaggggaaggggaagaaaaaaaaatga

SEQ ID NO: 328 - DNA, 333 bp, Saccharomyces cerevisiae
atgacatcagttcaaaactctccacgcttacaacaacctcaggaacagcaacagcaacagcaacagctttccttaaagataaaacaattgaagttaaaaagaatcaacgaacttaacaataaactgaggaaagaactcagccgtgaaagaattactgcttcaaatgcatgtcttacaataataaactatacctcgaatacaaaagattatacattaccagaactatggggctaccccgtagcaggatcaaatcattttatagagggtttgaaaaatgctcaaaaaaatagccaaatgtcaaactcaaatagtgtttgttgtacgcttatgtaa

SEQ ID NO: 329 - DNA, 333 bp, Saccharomyces cerevisiae
atgaccaaagatgccgtgaatctagatgcttacaccgtgagcttcatgcctttctataccgagtatcaaggaccaaccgaagagtttaaggattacaaattcgaagatactatttactttcgtggcaaggaactgaagagggaaaagtctgcgacgccttccagtagcgataacacaactagtaataccttcagtaatggcgccatcctctcgggaaacacaataactggcaagatagtttcagtgaataattacgaaagagagggcactgatcgcaacgaattggcgcgattgcaagaattgatctccctcatcgatgtcataaatcagtaa

SEQ ID NO: 330 - DNA, 333 bp, Saccharomyces cerevisiae
atgctttcgttttgtccttcgtgtaacaatatgctactgataacgagtggcgatagtggtgtatatacattagcatgccgttcatgtccatatgagtttcctatagagggtatagaaatctatgataggaagaaacttccaagaaaggaagttgatgatgttcttggtggtggttgggacaatgtggatcaaaccaaaacccaatgtcccaattatgatacttgtggtggtgagagtgcttactttttccaactacaaattaggtcagctgatgagccgatgactaccttttataagtgtgtaaactgtggtcatagatggaaggaaaattaa

SEQ ID NO: 331 - DNA, 333 bp, Saccharomyces cerevisiae
atggtatctcaagaaactatcaagcacgtcaaggaccttattgcagaaaacgagatcttcgtcgcatccaaaacgtactgtccatactgccatgcagccctaaacacgctttttgaaaagttaaaggttcccaggtccaaagttctggttttgcaattgaatgacatgaaggaaggcgcagacattcaggctgcgttatatgagattaatggccaaagaaccgtgccaaacatctatattaatggtaaacatattggaggcaacgacgacttgcaggaattgagggagactggtgaattggaggaattgttagaacctattcttgcaaattaa

SEQ ID NO: 332 - DNA, 333 bp, Saccharomyces cerevisiae
atgttcaagagagcaatgagcacagatggtcccgtggcacgtaccatcctgaagagactggaatgcggctttccagattacaagaactttgcgtttggcctctacaacgattctcacaagcataagggccatgctggtgtacagggaaatgtctctgctgagacacatttccggattgagatggtcagtaaaaagttcgaaggcctgaaacttccacaacgccatcgtatggtttattccctcttgcaagacgagatggctcaggcgaacggtatccatgctttacaattgtcactaaagaccccacaggagtatgaatccaaagcgaaatag

SEQ ID NO: 333 - DNA, 333 bp, Saccharomyces cerevisiae
atgtttatcttagtatccgttgtaaatatatgtacatatatacatctacatatgttcccattaattagtacatttacctcaatagggttgggcgtcctcatgaaagataaagggaaggaaggaaaaacgataaaagcacaaaatgtgacatatcaaacatttgagaaatacgttgagtcttcttcattctttttcctcgtccacaattttctcaattcatcaacgatgaaaacgctactgctgatgagcaataacaatagtatatcagagataccaagtttctcagttttaaagatactttggaaaaatggtatatatatagcgcacatttga

SEQ ID NO: 334 - DNA, 336 bp, Saccharomyces cerevisiae
atgagccaatttgaaaagcagaaggaacagggcaattctttgttcaaacagggcctgtatcgcgaggctgtgcactgttatgaccaactaattactgctcaaccgcagaacccggtcgggtacagcaacaaagccatggcgctgatcaaactgggtgaatatacacaggctattcaaatgtgccagcaaggactgcggtacacctcaacggcagagcatgtagctatcagatccaaattgcaatatcgtctagagctggcacagggagcggtaggttcagtacagatccctgttgtagaggttgatgaactaccggagggatacgaccggtcctga

SEQ ID NO: 335 - DNA, 336 bp, Saccharomyces cerevisiae
atgctaggaagggcattgcgacctgggtggctgggcattactaggacggtggttaagaaaccaagttgcgggtcctactttaacagaacctttcaaacagcaattaacactacaatgcctcccatgcaagagggcatgctgagtacaatgatgatgatgacggctacggcaacaaggatcactggcacagtcagtgagccattaaacggttcaaatatagtgatgcaactcgattcagtgatgagaaagaggaaaaaaaagatgaagaaacacaaactgcggaaaagaagaaagagggagaaggcagaaagaagaaagctatctcagggtagataa

SEQ ID NO: 336 - DNA, 336 bp, Saccharomyces cerevisiae
atggagcaaaacaaagatccgcagatgatctcgaaacatagttctaggctacctatatgggtgctaagtcctcgcgaagaacaacaggctcgcaagaacttgaagacggaaacatacaaaaaatgtgcaaattttgttcaagcaatggcagattgtgctaaggcaaatggaatgaaagtttttcccacttgtgataagcaacgagatgaaatgaaatcgtgcctcctgttttatcaaacagatgagaaatatttagatggtgaaagggataaaattgttttagaaaaaatcaacaagcttgaaaagttatgtcaaaaacaaagctctacaaaataa

SEQ ID NO: 337 - DNA, 336 bp, Saccharomyces cerevisiae
atggccctgtggggtagaagtgcctacagacaaaaaaccgttacgtcccgcctcaccaagcatcgacacacaagccctctcaacctccttaatttctttatctttttttcccttcacctctgtgctctttttttagccacagctgtgcattacgcttgctttgcttgttttgttctctttcgccatgccatattactacttttctacttactggcacgaggccgcgcaagccagatccaagcacgccagaaagtgcggtgtactggtgcaaccttttatcgatttctcatcatatcgctatcgcaacgggcatgggcgacgaaaaagccaatctaa

SEQ ID NO: 338 - DNA, 336 bp, Saccharomyces cerevisiae
atgggtctatttaataacttcaagtttaaatatacaagggcgcaactggagatctttagattttcattttgtttgctagcacctgttgctgtaatgtactatattggtacagatactgataaaaaattaaatgttccagggttttggccagatcctgcaacgttgaaccaaataccaaaagagccttatgagattaaagctgaactggcaaggatgaaaaaagaacgtttagagaaaaggcttaggttggagaaaaagatacaagaggagtttggtttagaccttgaggaggaaaaagaaaaaattaaacgggatttggctctcaaaaaaggatga

SEQ ID NO: 339 - DNA, 336 bp, Saccharomyces cerevisiae
atggttgaaccagcaaggaaaaagcagaggattgatcgcgatactcatcacactgtggctgaaccagtaacggaagctaaaaatacgctgtacgtgagccagcttaatgaaaaaattaatatgcaacgactgcgagtaaacctttttttgctctttgctacgtttggagaggtactgaaggttagcatgaatttcaagaaacagcggggccaagcctttatcaccatgagaaccatcgaccaggccagtctggcccagatttcattaaacggcgagcgattctttggtaagcctttgaaagttgagttcagcaagagtgaaactaaaacactatga

SEQ ID NO: 340 - DNA, 336 bp, Saccharomyces cerevisiae
atgtctactgtaaccaaatacttttacaagggtgaaaatacagatttgattgtcttcgctgcatccgaagagcttgtagacgaatatttgaaaaatccatcaattggtaagctatctgaagttgtcgaactcttcgaagttttcactcctcaggacggtaggggtgccgagggtgagttgggcgctgcctccaaggcccaagtggaaaatgagttcggtaagggcaagaagatcgaagaagttatcgatttgatattgagaaatggtaagccaaactctaccacctctagtctcaaaaccaaagggggtaacgccggaaccaaagcctacaattga

SEQ ID NO: 341 - DNA, 339 bp, Saccharomyces cerevisiae
atggattggctgaaaaatacaacaattgtagtgttattcagtcattcaactgacaaaagtaacaaacacaagaaacgtcaagtccagtgcaatatgcgaaagaacactttagatatggtcactataggtatcgcatgccttgtgggagtctacacgggcacgagatttttcgagcccattgttatcgatagattgcgtaaggatggaaacttgagaacggacattcccatcccagaatacgacgaggacggaaatctgttaaaggtcacgccgtctttatcatccacaccagctgcaccacctacaccacctacacctcctactccaccacaacagtaa

SEQ ID NO: 342 - DNA, 339 bp, Saccharomyces cerevisiae
atgtatctcagtgcccagcttatgagaactgtcacagcctcccacttgaccctcagagccctctccactccccccctctttcaacatcgccagatagccgccgttgaatggtgcgggacaacccggcctggcctggccaggcaaaaaaggacgcagcacgcctcgagcgttatttccaaatcgggcgtactatcagccaagcccagctcggtatttttagcgcttctcgcaggaaaattggctgagaagtatatatacgcgagaatgttgctcttccatgtctcagtagtcaatgagtgtccagtggtgtttcattctggaccagttgtttggaagtag

SEQ ID NO: 343 - DNA, 342 bp, Saccharomyces cerevisiae
atgacaagcaaacgggaaaagtcactggatcacacattgtaagtagaagcagtttttcaatgggaagaccgcactgcatagtttactaactatttaaactttccaaacattagagaactaaagataccgtttgaaacggagcgacaagcgaccatagcaaccaaagtcctatctccggacccgattttgaagccacaagattttcaagtagactacagttccgagaaaaatgtcatgctagtccagttcagaagcattgatgatagggtgcttcgagtgggagttagcagtatcatagacagtatcaaaaccattgtggaagccatggacgttctatcataa

SEQ ID NO: 344 - DNA, 342 bp, Saccharomyces cerevisiae
atgacagaggttgtgggattctgggagagcgtgtcagatgacgaatcagaagacaaagactgtatggaggtgcagaacacagtgagtgccgacgagagcccacttgtgcagagccttgtatcctttgtaggctcgtgctccatcaacctacttttgcccttcctcaacggcatgatgctcggcttcggcgagctatttgctcacgagctctgctggagattcaattggtttaaccatagaaacaaggggtataaggtgtacccagagtcgcgcaaaatagcagcattgaaagagatttcaagccctggcacccgtgggagggttgcgtccaagttcctttaa

SEQ ID NO: 345 - DNA, 342 bp, Saccharomyces cerevisiae
atgactgatgagctgaaaagttatgaagcattgaaagcggaactaaaaaagtccctccaagatagaagagagcaagaagatacctttgacaacttacaacaagagatatatgataaagagaccgagtatttctcacacaatagtaataacaaccattcaggtcatgggggagcccatgggtcaaaatcacactattctggtaacatcataaaagggtttgataccttctccaagtcacaccacagccatgcagattctgcattcaataacaatgatcgtattttttcattaagtagtgctacgtacgtgaagcagcagcatggccaatcacaaaacgactaa

SEQ ID NO: 346 - DNA, 342 bp, Saccharomyces cerevisiae
atgcctcctcttccacaaaattatgcgcaacagcagccttcgaattgggacaaattcaaaatggggttgatgatgggtactaccgtcggtgtctgcacaggcatcctatttggtggatttgccatcgcaactcaaggcccaggtcctgatggtgtagttagaacactagggaaatacattgctggttcagcgggtacctttgggctatttatgtccatcgggtctataatcagaagtgatagtgaaagtagtccaatgtcccatcctaacctgaacctacagcaacaggcaagactggaaatgtggaagcttcgtgccaaatacggtatacgtaaggactga

SEQ ID NO: 347 - DNA, 342 bp, Saccharomyces cerevisiae
atggctaaagaaagtacgggattcaaaccaggctctgcaaaaaagggtgctacattgtttaaaacgaggtgtcagcagtgtcatacaatagaagagggtggtcctaacaaagttggacctaatttacatggtatttttggtagacattcaggtcaggtaaagggttattcttacacagatgcaaacatcaacaagaacgtcaaatgggatgaggatagtatgtccgagtacttgacgaacccaaagaaatatattcctggtaccaagatggcgtttgccgggttgaagaaggaaaaggacagaaacgatttaattacttatatgacaaaggctgccaaatag

SEQ ID NO: 348 - DNA, 342 bp, Saccharomyces cerevisiae
atgggagaacaaaacaaattgtactatgatgtcgagaaattggtgaattctttgcaggaaagttttgacctggattgcgcgcaaagtgtatcacttttcaccagtaaatcaaggagcaatgaggcttggttggaagagctagagaataaattcaagttaaaagatgatgttgaacttgatgatgtggaaaatttaagagccgaaattgacatgaagttaaatatgttggaggataaagtaagctactatgaaagactttacaaagaactcgaagagttccagaatgaaataaaaattaaaacagttgtgaataacagaagacaatcgcgaactccaaaatga

SEQ ID NO: 349 - DNA, 342 bp, Saccharomyces cerevisiae
atgggcaagtgtagcatgaaaaagaaaggtgtgggcaagaatgttggtgttggcaagaaagtacaaaaaaagaggtcgatcagcaccgctgaaaggaagagaacaaagttacaagtggaaaagttaaacaaaagtagtgaaacaatgataccgacgctgctgcgggaggcaagtacacaagagccagctaaactgaaagctgagactactttgaaagccgaggagctgatcaaggaccaggaaaaggactccaaggtacgagagcaaattcggacagaaaaatcaaaaacaaacgacagcatgctgaagcagatcgaaatgatatccggcttttccttatag

SEQ ID NO: 350 - DNA, 342 bp, Saccharomyces cerevisiae
atgtctgaaattcaaaacaaagctgaaactgccgcccaagatgtccaacaaaagttggaagaaaccaaagaatctttgcaaaacaagggccaagaagtaaaggaacaagctgaagcttctatcgacaacctaaaaaatgaagctactccagaagctgaacaggtgaagaaggaagaacaaaacattgctgatggtgtcgaacaaaagaagaccgaagctgccaacaaagttgaagaaactaagaagcaagcttccgccgccgtcagtgagaagaaggaaaccaagaaggaaggcggtttcttgaagaaattgaaccgtaaaattgcttccattttcaactaa

SEQ ID NO: 351 - DNA, 345 bp, Saccharomyces cerevisiae
atgaagttccaatatgcgttggccaaggaacagctaggcagcaactcgcgcagtggcgtcaaaaaactaataagtaaacaccactggcttccggaatactatttctctgatctctcattttctgttgtacagcagtgggacagtagagccattgaaaaaactacaatcatatcttgtatgcggcccgcaaaccaagagatttatcctttgagacattgtgagaccctccgttcgcaaccgtgctctctgttttcatcactatatgcacgctctttccaaagctcctgcactttgcacgtggcggagccatcgcccggcttccatatgtacggctgccacacctaa

SEQ ID NO: 352 - DNA, 345 bp, Saccharomyces cerevisiae
atgaaggccagttacttagttttgattttcattagcatattctccatggcacaggcatcttccttatcatcatacatcgtaactttccccaagacggataatatggctacggaccagaatagcattattgaagatgtcaaaaaatatgtggtggacatagggggtaaaataacacacgaatatagcttgataaagggctttacagtggacttacctgatagcgaccaaattttggacggtctgaaagaacgtttgagctatattgaaagcgagtacggtgctaaatgcaatttggaaaaggattcagaagttcatgctctaaaccgtgaccatttagttgcttag

SEQ ID NO: 353 - DNA, 345 bp, Saccharomyces cerevisiae
atgagcgcgagtgacaaaacaaagctctgcaataagggcatgagcaggacatcgcgaaccacaactttcgtaatcacacccgccttccgtgagagagacgatgagggtgccaattccctgtgtaaagctttcttgaacactttctcgaacctcaaatcaggtatgttcaaatgtttgttgggagttggcgccgtaggtacgttcatttctacgttcccacagtttttcttgctgccttgccttctttgcgtacggtgtgtatgtgtatgtctgtgtgcaagtatttcctatgctgcaagtgcgattttctcgttttctatttttttttttttttgcctcgcctaa

SEQ ID NO: 354 - DNA, 345 bp, Saccharomyces cerevisiae
atgctttttgaagtatttggtgaagtgttagcatcgtatatcgtatcgtcaaaaactaagggagagttggcgtttccagtgaacaatgcgccaccggattctcttgttgcaataaattgtgtagtgctattcttgagatcagcaatcggatcctgttcaggggctaaagaattaataagatcgtcagctttggaattgtcatgctcctctagttgcggattaccagccaccgacaaaccagggtctttccattctggcgcactatccaagtctatcttgtccgcaaatgaagctgtggtctctaaaagctcattgtcttttctttcttcatttgtagatatttga

SEQ ID NO: 355 - DNA, 345 bp, Saccharomyces cerevisiae
atgggcttatcgcgctggcacgacaagaattcaaggccagcagaggaaaagagcgaagaaatgcaacaggatgcgcactactacgcccttgcggcaagtgatagtttaaatgcaagtgtttctaacgaatatggtaatcaagtaatgaactcgttttggaaagtgggtatagactctccctatgtggacgatgaagcaattagaaacagagatgtcgaaaataacttaccttctttaaagcaaagtgtttataatgctaatgaaccaaatgctacctcgtctgcattttcaaccgcttcatacgcacatgaaactttcgattttagaaaccttaaactaagataa

SEQ ID NO: 356 - DNA, 345 bp, Saccharomyces cerevisiae
atgtctgaagtaattgaaggtaacgtcaaaattgacagaatttccccaggtgatggtgccaccttcccaaagacaggtgacttggttaccattcattacaccggtaccttggagaacggccaaaaattcgattcctccgttgacaggggctctccattccaatgtaacatcggtgtcggccaagtcatcaagggttgggatgttggtattccaaagttgtctgttggtgaaaaagctaggttaaccatccctggcccatatgcttatggcccacgtggtttcccaggtttgattccaccaaacagtactttggttttcgacgtcgaattgttgaaggtcaactaa

SEQ ID NO: 357 - DNA, 345 bp, Saccharomyces cerevisiae
atgtctgaattaggtgccaaatatcaacagttgcaaaatgagttagaagagtttattgtggccagacaaaaattagagacacaattacaagaaaacaagattgtaaatgaagagtttgaccaattagaagaagatacacctgtgtacaaattgacaggcaatgtccttttaccagttgaacaaagtgaggcacgtaccaacgtggacaaaagattagagttcatcgaaacagaaattacaagatgcgaaaagaacataagggacaagcaggaagaactagaaaagatgagaagcgagctaattaaactgaacaatacagcagcttccactggcccaggaaggtaa

SEQ ID NO: 358 - DNA, 345 bp, Saccharomyces cerevisiae
atgttgagagcgttccgctgttctatacatacttcgagggtattgttacatgatgctggagtgaaattaactttcttctcaaagcctaattgtgggttatgcgatcaagcaaaggaagtgatagatgatgtatttgaaagaaaggaatttcataataaagcagtttcactagagatagtcaacataactgaccgaagaaacgcaaaatggtggaaggaatattgcttcgacataccagtacttcatattgagaaagttggtgatcctaagtcgtgcaccaagatcctgcactttcttgaagaagacgatatcagtgataaaataaggagaatgcaatctagatga

SEQ ID NO: 359 - DNA, 348 bp, Saccharomyces cerevisiae
atgaaaattagcttgcataacaaacggcaacgaggagaccaaaaccaaaacatgtctgttttcaatgtactcaaaccactacttaaaggttcaaatagtttcaaagtgaagctcaacggctttctattcaataacgtttctacaataacaataagaactttaatgaaaactcataaaggtacagcaaagaggtggaggcgtaccggtaatacttttaaaagaggcatagctggaagaaaacatggcaatataggctggtcccatagatcattaaaagccttaaccggaaggaaaattgcccatccagcttattcaaagcatctaaagcggttattaccctatcattga

SEQ ID NO: 360 - DNA, 348 bp, Saccharomyces cerevisiae
atgctaagcaggatccaaaattataccagtgggttggtttctaaagcaaatcttttgtcatcaaaggctttatactatggtaaagtcggtgccgagatttcaaaacagatttatttaaaagagggtcttcaaccaccaactgttgcccagttcaaatcagtgtattcgaacctttataagcagagcctaaactttgctctaaagcctacagaagttttatcgtgtttaaaaaacatccaaaagaatgaactattaaaatatggcgcatatggtattcagttgatagggttttattctgtcggtgaaataattggaagaagaaaattagtgggatataaacatcactaa

SEQ ID NO: 361 - DNA, 348 bp, Saccharomyces cerevisiae
atgggtaatttcagatttcctataaaaaccaagctaccaccagggtttatcaatgctcgcatacttagggataacttcaaaagacaacaatttaaagagaatgaaatccttgttaaatctttgaaattcatcgctagaaatatgaaccttccaacaaaactgaggttggaggctcagttaaaactaaatgcattgccaaactacatgagatctacgcagatcaaaaataggtgcgtggactctggacatgcaagatttgttctaagtgattttaggttgtgtaggtatcaatttagagaaaacgctctgaagggtaatttgccaggtgttaagaagggtatttggtaa

SEQ ID NO: 362 - DNA, 348 bp, Saccharomyces cerevisiae
atgggtagtttttgggacgcattcgcagtatacgacaagaaaaagcacgcagatccaagtgtatatggaggaaaccataacaacacaggagacagtaaaacgcaggttatgttttcgaaagagtaccgtcaacctaggacacatcagcaagagaacttgcagagcatgagaagatcttccataggatcacaggacagttccgatgttgaggacgttaaggaagggagattacccgcagaagtagaaataccaaagaatgttgacatctctaacatgtcgcaaggtgagtttttaagactttacgaaagtttgaggaggggggaacccgacaataaagtaaatagataa

SEQ ID NO: 363 - DNA, 348 bp, Saccharomyces cerevisiae
atgtcgtcatcagtgccatacgatccatatgtgcctccagaggagagtaactcaggcgcaaacccaaattcccaaaacaagactgctgctttgagacaagagattgatgacacggtgggaataatgagagataatatcaacaaggttgctgaacgtggtgaaaggctaacatccattgaggacaaagctgataacttggctatctccgcacaaggattcaagagaggcgccaacagggtcagaaagcaaatgtggtggaaagatctaaaaatgagaatgtgtttattcttagttgttattattttactagtggtaattatcgttcctatcgtcgtccatttcagctaa

SEQ ID NO: 364 - DNA, 351 bp, Saccharomyces cerevisiae
atgatcgaaactgccatttatggtaagacagtggatgaccaatctcgatgtgtccactggcatcttccaaaggatgtaattgccatcaggtttaaatgttgtgataagtactatgcgtgctttgaatgccaccaagagttaagttctcacccgctagaaaaatatgatctccttgacgatgcaaataaacacttgattatttgcggagtttgccgtcatgaaatgacgtttgcagagtattacgactacaattcaaaccttatttgtcccaattgcagatccccctttaatccaggctgtaaattgcactaccatttgtatttccagaaccctccccccgctatgtgttga

SEQ ID NO: 365 - DNA, 351 bp, Saccharomyces cerevisiae
atgcgctgggatgttatcatcttatacgcaattagccgcccatatgccacccggcgcaccgggtcgcacacacacccccgtgattcgcgatatatagcggccaatcaacggcgacctccaagcgcgtgccgggtgggcccctcgccggccaagcagcgcaaggatattcccatcttcgagctcttagatacaacgcttataaagaacgcactttttgcattaacctcttttttgtattacagaacaaacattttaacttgcccttttttaaactttctttatctctccaggacaggccaattggataaattttgcaaagatcaaacagtaacacaaattttagcaacctaa

SEQ ID NO: 366 - DNA, 351 bp, Saccharomyces cerevisiae
atgtcccaagaaagtagtgttttatcagaatcgcaagaacaactagccaataaccctaaaatagaggatacaagccctccctctgccaattcgagagataatagcaaacctgtacttccgtgggattacaagaataaagccatagagatcaagagcttcagtggttataaggtaaatttcaccggctggataagaagagacgtaagagaagaacgtcaaaggggaagcgagtttactgcatctgacgttaaaggatcagatgacaaagctacaaggaaaaaagaaccagcagatgaggatcctgaagtaaaacaacttgaaaaagaaggagaggatggactggactcataa

SEQ ID NO: 367 - DNA, 351 bp, Saccharomyces cerevisiae
atgttactcacaccagccaagactacaagaacggaagactcagcaaactcaacagatgacagcagtaaaagcagtaattcattcatgcgtgccatagtttcttcccttatggttaagcccataacatctctgactaatacagtcacatgcagacaaagttcccatcacaatagctctccaagtaaaatcacaagatatgatttaatcaaagctgctgctgaaaatgacttgaaaaggagtaagtctcagggacgagaaaaatccagaagaaactctaatcgtagaaataatgaagaaatttttgtggccaatactgcttcagaaatccaacggactaaaagtagcatatag

SEQ ID NO: 368 - DNA, 354 bp, Saccharomyces cerevisiae
atgaagtctacatttaagtctgaatatccatttgaaaaaaggaaggcggagtcggagaggattgctgacaggttcaagaataggatacctgtgatttgcgaaaaagctgaaaagtcagatattccagagattgataagcgtaaatatctagttcctgctgaccttaccgtagggcaatttgtttatgttataagaaagagaattatgctaccccctgagaaggccatcttcatttttgtcaatgatactttgccacctactgcggcgttgatgtctgccatatatcaagaacacaaggataaggacgggtttttgtatgtcacttactcaggagaaaatacatttggcaggtag

SEQ ID NO: 369 - DNA, 354 bp, Saccharomyces cerevisiae
atggatggatcgactatagtgtttatactgacgatggtgtgcttgtttgtttacaccgtgaaacacaggggcgccaagcaagtaccctcgcgaaccgtacaggatgccaaaccggcgccctcggtcgccaccaacgacccttctccggagccagtaccatcggctccggaggaacgcgttgctcggttaaacagacatggtagtgatcgaaagagagccgttaatagtgacatggttgaaatcgtgatgacgatggcgccacatgtgcctcaggaaaaagtcgtgcaagatctcaggaacacagggtccattgagcacacaatggaaaatatcttcgctggcaaactagattag

SEQ ID NO: 370 - DNA, 357 bp, Saccharomyces cerevisiae
atgaagctcccacagaccatgctacgttctatatctgtgaagcatgtccggtggccaaggattctgacgggctcaaagctttggtactcaacgcagatggcaatgactccggaggagaagatgatcaccgataaactacaacaggaactggaacctgaagtgtgtaaagtgcaagacgtttccggtggctgcggatccatgtttgctatcaacataacaagcaagaagttcaacggactgagtctcatcaagcagcaccagctggtgaacagaattttgagggacgatatttccagatggcatggcctacaattgaccactaagaagtcaactgggaagggtccggcatcatcatga

SEQ ID NO: 371 - DNA, 357 bp, Saccharomyces cerevisiae
atgagacccgttgtatccactggtaaggcatggtgttgtaccgtcctatcggcatttggtgtagtaattctttccgtcattgctcatctcttcaacacaaaccatgaatcctttgtaggatcaataaacgatcctgaagatggacctgcgtatgttatattttcttatttatttcgccgttacccatttaccatctcttatatctctcctccttactaacaattatattttaaccctattgtttatagtgttgcacatactgtttatttggctgccttggtatacctcgtgtttttcgtattctgtgggttccaagtttacctagccagaagaaaaccttcgatcgagttgcgttag

SEQ ID NO: 372 - DNA, 357 bp, Saccharomyces cerevisiae
atgagtaatattttggcagtgttcaaccctccaccacaaagggagctggaaaaagaagagactatggattgcgttccttgtcaagtcatgagcactatgttttctgttggatttggctcatacttggcatctgggaaaccattcaagtatggtaaaaaagaagccaaaagaggcatttctctgactgaatttgaaaaaagaaacccacaatggtggaaagtaactttacgtagcttcggtgggttattaatcgccttcggtttcgttagaggaaccgaaggttggttgtggcataaaaataaagaatataagaactataagaaattaagtaacgatggtgaaacacaggctaactag

SEQ ID NO: 373 - DNA, 357 bp, Saccharomyces cerevisiae
atgcagacaatgggcggggagcaccttcttctttcacagctaaaggggtctttctttctcctacttttggcatactttttcaggggcagaagtccttattacgcacgttgctaccgccggcttgctgttacacctggtgccatcactattgccattgccattgctacagattcaattccggcgcttgcaaagtccaaagttctggtgtcggtttgttctcacacagatccctgtacagcgtcttgtaacctgatccccttcccccgccccttctcgaacagcctgacgcgcttcctcttttgtttgggctcggcccgtttttgcatttcctttccctgttttggattgagtatataa

SEQ ID NO: 374 - DNA, 357 bp, Saccharomyces cerevisiae
atgcagcacacgcttacccggaccgcctctctgccagaacgctcgagcagcgcccacagcgccgctactgcgttacccgcacttcgccgcccgccagacagctgcgagactctcgtcccgctactgtgtatcttttggttcgtcttcgttagtatgagcccgctcccgccggctcgtgccaacaaatcagacaacaaaggcttaatctcagcagatcgtaacaacaaggctactctactgcttacaataccccgttgtacatccaagtcgtatacaaatgatttatccccactcaaaatgacattgctatccgccggcaagcacccaaggcctttccgccaagagcaccgttgctag

SEQ ID NO: 375 - DNA, 357 bp, Saccharomyces cerevisiae
atggctgagaaacgtactcttatagctgtgatagctgacgaagatactacaactggtttattgttagccgggattggacaaatcactcctgaaacccaagaaaagaacttttttgtttaccaagaaggtaagactactaaggaggaaatcactgacaagtttaatcactttactgaagagagagacgatattgccatccttctaatcaaccaacatatcgcggaaaacataagagctagagtggactccttcaccaatgcgttccctgctattttagaaattccatctaaagatcatccctacgaccctgaaaaggactctgtattgaagagagtcagaaagttgttcggtgagtaa

SEQ ID NO: 376 - DNA, 357 bp, Saccharomyces cerevisiae
atgtcgttcagcggaaaaaaatttaggtctagaagacagcagctagtatatgaagcatctttagcggggcgatacaaaaaagcattgagtaagcacccctttcttttttttggtttaccattttgtgcaacaatagtattgggttcgttttggttgtcaagctttacagcgatcaagtacgagcaaggcgatcgtaaagttcaggaaattaatgaagaggatatcttgaaaataaggaagaatcaaagggaatttgatattaaagaagaatattatcgtttacaaggtctttctgaagaggattgggagcctgtgcgcgtcgctaggttaaaggatgaatctgagaatgtctggtaa

SEQ ID NO: 377 - DNA, 360 bp, Saccharomyces cerevisiae
atgaaaaatattgcatacgaaggtcgtctattcttgattagtgcagtgcagttcatgccagatgcgacagcaatgggctttggggagattattgaccaagctacaggtaagagaaaattacctggatggccatctgctgacgacaactgtattaatggaggtagtgttattattgatccttatggagagattattgcagggccattgctagggcaggagggccttttaaccgccgaaattaacactgacttgattgctgaagctcgctttgatcttgaccctgtcggacattatgctaggggagatgtcttccagttgactgtcaatgaaaggtcacacgatgtcaagtttacgaaatga

SEQ ID NO: 378 - DNA, 360 bp, Saccharomyces cerevisiae
atgccaaaaaagagagcttccaacggtagaaacaagaagggtagaggtcacgtcaagccagtgagatgtgttaactgttccaagtccattccaaaggataaggctatcaagagaatggctattagaaacattgttgaagctgctgccgtcagagatttgtccgaagcttctgtctacccagaatacgccttgccaaagacttacaacaagttgcactactgtgtctcctgtgctattcacgccagaattgttagagttagatccagagaagacagaaagaacagagctcctccacaaagaccaagatttaacagggataacaaagtttctccagcagctgccgcaaagaaagctttgtaa

SEQ ID NO: 379 - DNA, 360 bp, Saccharomyces cerevisiae
atgccaaagaagagagcttccaacggtagaaacaagaaaggtagaggtcacgtcaaaccagtcagatgtgtcaactgttccaagtctattccaaaggataaggctatcaagagaatggctatcagaaacattgttgaagccgctgccgtcagagatttgtccgaagcttctgtctaccctgaatacgctttgccaaagacttacaacaagttacactactgtgtttcttgtgctattcacgccagaattgtcagagtcagatccagagaagacagaaagaacagagctccacctcaaagaccaagattcaacagagaaaacaaggtttcccctgctgatgccgccaagaaggctttataa

SEQ ID NO: 380 - DNA, 360 bp, Saccharomyces cerevisiae
atgcgcagcatagaaaacgatagaagtaattatcaacttacacagaaaaataaatcggcggatgggttggtatttaatgtggtaactcaagatatgataaacaaaagtactaaaccttacagaggacaccggtttacaaaagaaaatgtccgaatactagaaagttggtttgcaaagaacatcgagaacccatatctagataccaagggcctagagaatctaatgaagaataccagtttatctcgcattcaaatcaaaaactgggtttcgaatagaagaagaaaagaaaaaacaataacaatcgctccagaattagcggacctcttgagcggtgagcctctggcaaagaagaaagaatga

SEQ ID NO: 381 - DNA, 360 bp, Saccharomyces cerevisiae
atggaaaaaaaaaaaattttagacgcggcgcttgcaccccgcattataagtggtgtgccgacggacggtcaacccctttcagggggccccctatcttgggcgtggtgtcacaccacgctcaaacggtgggcactaatgaaaacgcgcccatataaatatccgctatcaacagaacccccaacccccccatcagtgcccaactcagcttccgtaaaccacaacaccaccactaatacaactctatcatacacaagatgtcattcgacgacttacacaaagccactgagagagcggtcatccaggccgtggaccagatctgcgacgatttcgaggttacccccgagaagctggacgaattaa

SEQ ID NO: 382 - DNA, 362 bp, Saccharomyces cerevisiae
atgaactatttggaaacacagttaaataaaaagcaaaaacagatacaggaatacgaaagtatgaatggcaacctgataaagatgtttgagcaattgtctaaagaaaagaaaaagtatgtagctattttttccagtcggcaaaaatcggtataacaaacaaaaaatatttagtttctgttattaacagaacttgtcaaagtgatgagacaccaaaaaaaatttcctcgacgtacattaaagagttaaaggagtacaacgaattgagagatgccggtttaaggttggcccaaataattgctgatgaaaagcaatgcaaaattaaggatgtttttgaagagatcggttattcaatgaaggactaa

SEQ ID NO: 383 - DNA, 362 bp, Saccharomyces cerevisiae
atgagaccagcacagttactgttgaatacagctgtatgttaagggatattttctttttattgtgacaaacggataatcatgcgttcattctgacttgatgctttctaagaaaacaattatgttgattatgaatgctaactacaagattatagagtattatactaacaaaaaactagaaaaaaacatctggtggctacaaaatacccgtcgaattaacaccgttatttctcgctgttggtgtagctttatgctctgggacatacttcacatataagaaattaagaactgacgagactttgagattgacaggtaacccagaattatctagtttagatgaagtccttgccaaagataaggattaa

SEQ ID NO: 384 - DNA, 363 bp, Saccharomyces cerevisiae
atggtcaaactaacttcaatcgccgctggtgtcgctgccatcgctgctactgcttccgcaaccaccactctagctcaatctgacgaaagagtcaacttggttgaattgggtgtctacgtctctgatatcagagctcacttggcccaatactacatgttccaagccgcccacccaactgaaacctacccggttgaagttgctgaagccgttttcaactacggtgacttcaccaccatgttgactggtattgccccagaccaagtgaccagaatgatcaccggtgttccatggtactccagcagattaaagccagccatctccagtgctctatccaaggacggtatctacactatcacaaactag

SEQ ID NO: 385 - DNA, 363 bp, Saccharomyces cerevisiae
atggtcaaactaacttcaatcgctgctggtgttgccgccatcgctgctactgcttccgcaaccaccactctagctcaatctgacgaaagagtcaacttggttgaattgggtgtctacgtctctgatatcagagctcacttggcccaatactactctttccaagccgctcatccaactgaaacctacccagttgaaatcgctgaagccgttttcaactacggtgacttcaccaccatgttgactggtattgccccagaccaagtgaccagaatgatcaccggtgttccatggtactccagcagattaaagccagccatctccagtgctctatccaaggacggtatctacactatcgcaaactag

SEQ ID NO: 386 - DNA, 363 bp, Saccharomyces cerevisiae
atggtcaaattaacttcaatcgccgctggtgtcgctgccatcgctgctactgcttccgcaaccaccactatagctcaatctgacgaaagagtcaacttggttgaattgggtgtctacgtctctgatatcagagctcacttggcccaatactacatgttccaagccgcccacccaactgaaacctacccagttgaagttgctgaagccgttttcaactacggtgacttcaccaccatgttgactggtattgccccagaccaagtgaccagaatgatcaccggtgttccatggtactccagcagattaaagccagctatctccaaggctctatccaaagatggtatctacactatcgcaaactag

SEQ ID NO: 387 - DNA, 363 bp, Saccharomyces cerevisiae
atggtcaaattaacttcaatcgctgctggtgtcgccgccatcgctgctggtgcttccgcaaccaccactctagctcaatctgacgaaagagtcaacttggtggaattgggtgtctacgtctctgatatcagagctcacttggcccaatactacatgttccaagccgcccacccaactgaaacctacccagtcgaagttgctgaagccgttttcaactacggtgacttcaccaccatgttgactggtatttccccagaccaagtcaccagaatgatcaccggtgtcccatggtactccaccagattaaagccagctatctccaaggctctatccaaagatggtatctacactatcgcaaactag

SEQ ID NO: 388 - DNA, 363 bp, Saccharomyces cerevisiae
atggtcaaattaacttcaatcgctgctggtgtcgctgccatcgctgctactgcttccgcaaccaccactctagctcaatctgacgaaagagtcaacttggttgaattgggtgtctacgtctctgatatcagagctcacttggcccaatactacatgttccaagccgcacacccaactgaaacctacccagtcgaagttgctgaagccgttttcaactacggtgacttcaccaccatgttgactggtatttctccagaccaagtgaccagaatgatcaccggtgtcccatggtactccagcagattaaagccagccatctccagtgctctatccaaggacggtatctacactatcgcaaactag

SEQ ID NO: 389 - DNA, 363 bp, Saccharomyces cerevisiae
atggtcaaattaacttcaatcgctgctggtgttgccgccatcgctgctactgcttccgcaaccaccactctagctcaatctgacgaaagagtcaacttggttgaattgggtgtctacgtctctgatatcagagctcacttggcccaatactacatgttccaagccgcccacccaactgaaacctacccagtcgaagttgctgaagccgttttcaactacggtgacttcaccaccatgttgactggtattgccccagaccaagtgaccagaatgataaccggtgtcccatggtactccaccagattaaagccagctatctccaaggctctatccaaggacggtatctacactatcgcaaactag

SEQ ID NO: 390 - DNA, 363 bp, Saccharomyces cerevisiae
atggtcaaattaacttcaattgccgctggtgttgccgccatcgctgctactgcttccgcaaccaccactctagctcaatctgacgaaagagtcaacttggttgaattgggtgtctacgtatctgatatcagagctcatttggctcaatactactctttccaagctgctcacccaactgaaacctacccaattgaagttgctgaggccgttttcaactacggtgacttcaccaccatgttgactggtattgccccagaccaagtgaccagaatgatcaccggtgttccatggtactccagcagattaaagccagccatttccagtgctctatccaaggacggtatctacactatcgcaaactag

SEQ ID NO: 391 - DNA, 363 bp, Saccharomyces cerevisiae
atgaaattcatttctacctttctcacttttattttagcggccgtttctgtcactgctagttccgatgaagatatcgctcaggtgccagccgaggccattattggatacttggatttcggaggtgatcatgacatagcttttttaccattcagtaacgctaccgccagtgggctattgtttatcaacaccactattgctgaggcggctgaaaaagagcaaaacaccactttggcgaaaagagaggctgttgccgacgcttggcactggttaaatttgagaccaggccaaccaatgtacaagagagaggccaacgctgatgcttggcactggttgcaactcaagccaggccaaccaatgtactga

SEQ ID NO: 392 - DNA, 363 bp, Saccharomyces cerevisiae
atgaatgctccagacagattcgaactgttccttctgggtgaaggggaatccaagctaaagattgaccccgacaccaaagcccccaacgcagtagtgataacgtttgagaaggaggaccacacgttgggaaacctgattcgtgcagaacttctgaacgacagaaaagtgctgtttgccgcttacaaggttgagcatcccttcttcgctcgtttcaagctgagaatacagaccaccgagggctacgacccgaaggatgccttgaaaaacgcctgtaacagcatcattaacaagcttggcgccctgaagacaaatttcgaaaccgagtggaacctgcaaactctagccgccgacgacgcattttga

SEQ ID NO: 393 - DNA, 363 bp, Saccharomyces cerevisiae
atgacaggtgaaagaattgaaaaggtgaaaataaatgacgaatttgcaaaatcacatttcctaacaactcagtggagagaaacaaagcgccaacgacactataagatgcccgttactgaacagggactccgcgagaggatagaatcagccataccgcaagtttaccatatcattgtgacggatctttcgtacggttgtggtcagtcgtttgatattgtggtggtcagcgacttctttcaaggtaaaagcaaactaatgaggagtcgtgcagtgaacaaggctgtgaaagaagagctgcaggagattcatgcctttagctgcaagtgctacactgaggaggaatggtctaagattgtggtatga

SEQ ID NO: 394 - DNA, 363 bp, Saccharomyces cerevisiae
atgcacaacaagattgttagaatcgcgtccagtgcactcacagggggcaaactactcgagaagctaaaacccttgacccgttgggaagttcaatgggaccctaataagaccaaatgtttgggaataacaagagaggtaacattcaaggactacgaaaccacatgggcctttttgactcgtgtatcgatgagatctcatctatggggccaccatcccctgattcacacaagttacacctgggtcaagctggaacttcatacgcatgacatagacccgaaagacggggctcacagccagcttagcgatatagacgtccggatggccaagagaatagattcctacatcgatgagatgacaacttga

SEQ ID NO: 395 - DNA, 363 bp, Saccharomyces cerevisiae
atgcctaaagtttacagttaccaagaagttgccgaacacaatggcccagaaaatttctggattatcatcgatgacaaagtttacgatgtttctcaattcaaagatgaacatccaggtggtgatgaaattataatggatttgggtggacaagatgctacagaaagctttgtcgatatcggtcattctgacgaagcattgagactactgaaaggtttatacattggtgacgttgacaagaccagtgagcgcgtttctgtggaaaaggtatctacctctgaaaaccaaagtaaaggtagtggtacattggttgtcatattggccattttaatgctaggtgttgcttattatttgttgaacgaataa

SEQ ID NO: 396 - DNA, 363 bp, Saccharomyces cerevisiae
atggtgaatgaaacaggagaaagtcaaaaagcggcaaaaggcactccagttagtgggaaggtatggaaggcagaaaagacaccgctgagggccaaaagcagagtcgttaagaacaagaagttaacatcatgggagttgaaaaaacaaaaaagactcgaagataaacagttcaaagaaagattgaaggctttgaaggatgagaaggaagaagctcgtcaagctaaaataaccatgttaaaggaaagaagagagaagaaggaagagaatgaaagatacgaacgtttggctgctaagatgcatgctaagaaggttgaaagaatgagaagaagagagaaaaggaacaaggctttaaaagaacgttag

SEQ ID NO: 397 - DNA, 366 bp, Saccharomyces cerevisiae
atgacctgtggtctagtacgaataaggttagctagatttggaagaaaaaatagtccggtctataatatcgtagtggctaattcccgtaaggcgagggatgctaaaccgatcgaggtactaggaacctacgtgccggtacccagcccagtgaccaagagagaattgaagaggggcgttgtacctattaaagacgtgaagcttgattttgatagaacaaaatattggattggtgtgggagcacaacctagcgaaacagttactaaactattacgaaaggctggtatattaaatgatgcatgggccactagtaagaacagcaatgtgaataggaaagttgtatttgaaagaatggaaacattggagtga

SEQ ID NO: 398 - DNA, 366 bp, Saccharomyces cerevisiae
atgagcaaccaggcactatatgagaaactcgaacaaaccaggacgattctgtccgtgaagctggcggaattgataaatatgactacgatagccgatagaaatgatgatgacgagggttcattcgcacaagaaaattctgagctcgctgtggccacgaccagtgtgatgatggtgaataaccagaccatgcaattgattaaaaatgttcaagacttgttgatcctgaccagatcgataaaagagaaatggctactgaaccaaattcctgtaacggaacactcaaaagtgactcgttttgacgagaagcagatagaggaattactggataactgtatagaaacgttcgtggcggaaaaaactacgtaa

SEQ ID NO: 399 - DNA, 366 bp, Saccharomyces cerevisiae
atgagcaacgaagttgacaggatggatgttgatgaagatgaatcgcaaaatattgcgcaaagctcaaaccaaagtgcgccagtggaaaccaaaaagaagagatttgaaattaagaaatggaccgcagtggcgttttggtcatgggatatagctgttgacaactgtgctatttgcaggaaccatataatggaaccatgcattgaatgccagccaaaggccatgacggacactgataatgaatgtgtagcagcctggggtgtctgtaatcacgctttccatttgcactgtattaataaatggatcaagacaagagacgcatgcccattagataaccaaccttggcagttagcaagatgcggtaggtga

SEQ ID NO: 400 - DNA, 366 bp, Saccharomyces cerevisiae
atgtccactaagttgcctattgtgatttcaaacggaacagccttcaaaaaagtccccgttcaattgctgttgaatagcggatcagaggcacaacatggcctccctaggaacgctgactctcagcctgctcgaccaagaacgggcattactaggacatgtgggcaatgtggagagattaagacttcattacaatggagggagggccctaacggtgctgcttgcctgtgtaatgcttgtgggttgttttttagaaaattgattctgcgcttcggtagagcagctgctaaaagatacatggagcaaattaaaggtaccgggactaagagaaggatccccaaagaacttaccggaactgtcagattctga

SEQ ID NO: 401 - DNA, 366 bp, Saccharomyces cerevisiae
atgtctgactttcaaaaggaaaaggttgaagaacaagaacaacaacaacaacaaatcatcaagattagaatcactttgacctccaccaaggttaagcaattggaaaacgtctcttccaacattgtcaagaacgctgaacaacacaacttggtcaagaagggtccagtcagactaccaaccaaggttttgaagatctccaccagaaagactccaaatggtgaaggttctaagacttgggaaacctacgaaatgagaatccacaagagatacatcgacttggaagctcctgttcaaatcgttaagagaatcactcaaatcaccattgaacctggtgtggatgtcgaagttgttgttgcttccaactaa

SEQ ID NO: 402 - DNA, 366 bp, Saccharomyces cerevisiae
atgtctgatattttggatgagattgtcatagaagatgttgtggcaaattgcccccaggagtttctgcaatatcataaatgcataagagataatgaggaaaatcctgggaagtgtaaagatggaagaatgatattatctacatgcattagagaaaaagtgcccagtgtgaaaagtatcatgagcgaatgtagtgagccaatgaagaaatatgaccaatgcattcgtgataatatgggtacaagaactattaacgaaaactgtctaggattcttacaggacttaaggaaatgtgcggaattgcaggttaaaaataaaaatattaagccttcaattaatggagtaaacttggaattaatcaaggactga

SEQ ID NO: 403 - DNA, 369 bp, Saccharomyces cerevisiae
atgaaagtttccgataggcgtaagtttgaaaaagcaaactttgacgagtttgagtcggctctaaataacaaaaacgacttggtacattgtccctcaataactttatttgaatcgatccccacggaagtgcggtcattctacgaagacgaaaagtctggcctaatcaaagtggtaaaattcagaactggtgcaatggataggaaaaggtcttttgaaaaaattgtcatttccgtcatggtcgggaaaaatgtacaaaagttcctgacgtttgttgaagacgaaccagatttccagggcggaccaatcccttcaaacaaaccacgtgatggtctacacgttgtttcaagtgcatactttgaaattcaatag

SEQ ID NO: 404 - DNA, 369 bp, Saccharomyces cerevisiae
atgaaagtttccgataggcgtaagtttgaaaaagcaaactttgacgagtttgagtcggctctaaataacaaaaacgacttggtacattgtccctcaataactttatttgaatcgatccccacggaagtgcggtcattctacgaagacgaaaagtctggcctaatcaaagtggtaaaattcagaactggtgcaatggataggaaaaggtcttttgaaaaagttgtcatttccgtcatggtcgggaaaaatgtaaaaaagttcctgacgtttgttgaagacgaaccagatttccagggcggaccaatcccttcaaacaaaccacgtgatggtctacacgttgtttcaagtgcatactttgaaattcaatag

SEQ ID NO: 405 - DNA, 369 bp, Saccharomyces cerevisiae
atggtcaaattaacttcaatcgccgctggtgtcgccgccattgccgctggtgcctccgctgcagcaaccactacactatctcaatctgacgaaagagttaatttggttgaattaggtgtctatgtttccgatatcagagctcatttggctgaatactactccttccaagctgcccacccaactgaaacttatccagttgaaattgcagaagctgttttcaactacggtgatttcaccaccatgttgactggtattcccgccgaccaagttaccagagttatcactggtgttccatggtactctagcagattaaagccagctatctctagcgctctatccgcagacggtatctacactattgcaaattag

SEQ ID NO: 406 - DNA, 369 bp, Saccharomyces cerevisiae
atgactacgtttagattttgtcgtgactgcaacaatatgttgtaccctcgtgaggataaagaaaataaccggttgttatttgaatgcagaacatgctcgtatgtagaagaagcgggcagtccattggtctacaggcatgaattgattaccaacattggtgaaactgcgggagtggtgcaagatattggttccgatcccactcttccgagatctgatagagaatgtcccaaatgtcactctcgggaaaatgtgttttttcaatcacaacaaagaagaaaggatacttcgatggttttattctttgtgtgcttatcttgctcacacatatttacttcagatcaaaaaaacaaaaggacgcagttttcatga

SEQ ID NO: 407 - DNA, 369 bp, Saccharomyces cerevisiae
atgcaagacaactcaagtcattccagagagtcggcttcggctggtgacgatcctcttggaattgataaattgacagtcgactacgattacttactttataaaatgagagactatgtacagagtatacaattggatactacggagctatgtaaaaaacaaaatgaagtgatggtgaatggtattattgaaaacaccatagataaaaatattgcgaagttcaaagaactccttgaaaaatgcgatacgttggaaaatcactatgaaatgttaaaccaactggcgataataacagatactttcaaggaaagaatcgcagaggccgtaaataattacaatagcttaaaaaagggcgccagtaaatctaagtaa

SEQ ID NO: 408 - DNA, 369 bp, Saccharomyces cerevisiae
atggcagtacccgggtattacgaattatatcgtagaagtactatagggaatagtttggtggatgctcttgatactttaattagtgatgggagaatagaagcgtcgttagctatgcgtgttttagagacatttgacaaagtggtggctgagactttaaaagacaatacccaatctaaattgactgtgaaaggaaacctggacacatatggattttgcgatgatgtttggacttttatcgtaaaaaattgtcaggttactgttgaggacagccaccgcgacgcctcccagaacgggtctggagatagccaaagtgtaatttcggtggataagttgaggattgtggcatgtaactcaaaaaagagcgagtaa

SEQ ID NO: 409 - DNA, 369 bp, Saccharomyces cerevisiae
atggccaatttttttgttagactgtgggaaagtgtatttgaaccagggacctccccccagctgatcatcgccacacacgtatcttttgttgcactactactgaccctcatctggctcatctatgccacaaacgggaatatccacttctatgctcttttctgtatatcacttttactatggattaccgttatctggtttataaacgaattatcacacgtcaaattgaaggataatgatgagctggataaagatgccaataaaaaggacgacagtgccatcaaggaagacagcgaagacaagcaagaaagcgggaaatccactagtactgccagacggactcaagcacaatctaggtcaagaaaagcatag

SEQ ID NO: 410 - DNA, 369 bp, Saccharomyces cerevisiae
atggccagcgaaacaccaagagttgaccccacagaaatctccaacgtcaatgctcctgtgtttaggataatagcgcaaatcaaatcacaacccactgaatctcagttgattttacaatcgccaaccatatcatcgaaaaacggcagcgaggttgaaatgattacgttgaacaatattcgtgtatctatgaataaaacatttgagatcgactcgtggtatgagtttgtttgcaggaacaatgatgacggcgagctaggatttttgattctagacgctgtactatgcaaattcaaggagaacgaagatttaagcttaaacggtgtggttgctttacagagactatgtaagaaatacccagaaatatactag

SEQ ID NO: 411 - DNA, 369 bp, Saccharomyces cerevisiae
atgggtgaaatgctagagaggcaaaaaaaaaggttgccaagtaaagcgaagtatttgaagtatactgcaagcatcaccgaaacaggaaatcacgaagctgactcatctgtgattttccgtccccaccatagtgatgtaacatgcagtaacgcacggcgggccgaaagtcggactttaccccagatttgtagttgtatcctattggatcacgggcgacggacaagacccgaagtgcggaccggcatggtcagcttgcacggaagctttaagggtttcccttgtttcggcattagaagaggcatttcgcacgttttaccgggtcagaaacttcgaggaagctgtgacaattggaaaaaaaggcaaaactaa

SEQ ID NO: 412 - DNA, 369 bp, Saccharomyces cerevisiae
atgttccttacattctcaatgtgtgtgaactggataatcgtaaaaatgccaaacaggtctgaagaacttgaccgattactcgacaaaataatcaactctccgcatagaacagaagcctcgaagactttgcaagaaattgaaaataatcaatcatatattttaaatgtacagttgaagaagttattgcgacttcatgacgactcatttaaaaataagtgtgtttctcctattaactatatgttggaaaagtacactccgtatatggggcataccgaagcattacaaaaggaagcagagcttgtggatagggatctccgaatccttgaaatgacgtaccaactgatagaaaagaatcgcaactcgaaataa

SEQ ID NO: 413 - DNA, 372 bp, Saccharomyces cerevisiae
atggtcaaattaacttcaatcgctgctggtgtcgccgccatcgctgctggtgttgccgctgccccagccactaccactctatctccatctgacgaaagagttaacttggtcgaattgggtgtttacgtctccgatatcagagctcatttggcccaatactacttgtttcaagcagctcatccaagtgagacctacccagttgaaattgctgaagctgttttcaactatggtgacttcaccaccatgttgactggtattccagctgaacaagtcaccagagttatcactggtgtcccatggtactctaccagattgagaccagctatctccagtgctctatccaaggacggtatctacactatcgcaaattag

SEQ ID NO: 414 - DNA, 372 bp, Saccharomyces cerevisiae
atgaaactaccggtagcacagtacagtgcaccagatggtgtggaaaaaagttttgcaccaatacgcgatgaccctcgatacatgaccacagagggaaggacaactgggcccagtgaccatgtgctaaacgctggccaaatcgatagagacaaaccttcagaaccggaacgcacgaaagatggctcacaactgacatacttaggccagctgcgcacgcagctgacggggctacaggacgatattaacgagtttttgacaggaagaatggaattggcaaaaaataagaagaaagccggcgcagacgagaagcggatccaggaagagattaaccagctattagatggtggtgacggtgacgaagatgctgtttag

SEQ ID NO: 415 - DNA, 372 bp, Saccharomyces cerevisiae
atgaacgtaactgaaaatgctctattgtttaagtgcggtagcaagggctatattaatcaaacctatacgccgacagaaatttataattgtggggtagctgaaggaaagaaaactgctaaagaaaagaacccaacttattcaattttttatgatacatttctcactgggcagcctgctgaaagtcctgaaacgtttacgtgtggttcgcatggcttcacaaatgcgagttatgtggcaagcgacttttatgcatgtggttttctgcaagggaaaggtacagaaaccaatgcgggaatacataatacaaggccttctcattctctcgccaaatttaccatactgttcatgctagtgttgtatacaattgtctaa

SEQ ID NO: 416 - DNA, 372 bp, Saccharomyces cerevisiae
atgagcacgagaacaaaggccctgaatgcatacaggcatggcttaagagcaacccgaatagctttccggaatgatgctgaagtattactagccgcgagagctaaaatgcgttcaggaatgttatgtcccccagatcctaaactcaccacagaggatcagattcaacatttagaggatgtggctgtttttttgagacgaaacctggttcagggcaaaaaggttgatggctcaagtactaaggagcctaggtaccatttgaacattcacaaagacaccgaattgggtgacaatgagacgattgcagaccctacggcaagagtgaaaacaaacttaaaggcaagaccatttaaatgctctgataaaaagcaatga

SEQ ID NO: 417 - DNA, 372 bp, Saccharomyces cerevisiae
atgatgggacgaaacggtattcggctagcactgaaaagatctttcagcacttatcagccaccggtagtagagattacgaatataacgaagttatggcccactctacgacctgaagttagggatgaaatcaaggaatacttacgatggaggatgcaagaagattggagacatataccgctggaggagaccaaagcagcgtatttcttatcttatggaccctgtggtggcagatccaagggcaacgaatggaacgtagggtacacgggaatgcggatagtgttcaaccttgttttatttggcggtgcagcgactgcattttataattggaaacaagataaaaagctagaggaacaattaagggatcttgtataa

SEQ ID NO: 418 - DNA, 372 bp, Saccharomyces cerevisiae
atgattgctacacctataagattagcaaagagtgcatatgagccgatgataaaattcgtcggtacaaggcatcccttagtgaagcatgcaactgaggtcgttgttcatccttgcgctaccaacggaatgttacctggcagcaaagagtgtattccagtgagtaaattcatggaaaattataaaccattccgtgtagtgccaataaagcatagcgctaatgctggtctcagctcgtcaaagacctctgtattcgttaacaggccattgcaaaaagatgagcttgcttccattttcgagctacctgctaggtttcggtacaaacctattaacgagcatgaattggagagcataaatagcggtggtgcatggtga

SEQ ID NO: 419 - DNA, 372 bp, Saccharomyces cerevisiae
atggatcaaaagaaggacccaagtaataacttaacagaaagaagggtttccaaggtccaacgcccaaataagaaaaaggtacgaaatcaagttgaatcactttctagaaacctagagagaaataaagagggacagcttctgcagactgtatcaaaaggtcatttagaagctgattctggacactcactgggtcgtgaaaaagagaacggtgaactcggtataagaagtatattttacgataaagactggaatccaagaggcactgcaccatcacattacagaaatataccttataatcctgccactttcaaaaggcgaactgaagttcaagccagactgggaaacctcgagaatatcaaaataccaaagtga

SEQ ID NO: 420 - DNA, 372 bp, Saccharomyces cerevisiae
atgtcttggaggtactctatcttgaccgtagatggaagctttaaaattttcatcccttgggaaatattcctcacgtggaattttttgagcgctgcatggctaaattctaccgaatccaatacgtatatccactactcaacatgttggggcacaagtgattacacacttaatatctctgtcatagaagctactacagagaaattggttgacactagattattaacaacactcgagaatgcaaccgcttggattaactcaaactctattgatgaagacgaagatgatatgcctcatgccactaacgtagcagaccggcttgatgggttatcccttagcaagcgcgtatatagcatctgtcactacgaattttag

SEQ ID NO: 421 - DNA, 375 bp, Saccharomyces cerevisiae
atggtcaaactaacttcaattgttgctggtgtcgctgctattgctgctggtgtcgctgctgccccagccaccactactttatctccctctgacgaaagagttaacctggtcgaattaggtgtctacgtctcagatatcagagctcatttggctgaatactatatgttccaagctgctcatccaactgaaacttacccagttgaaattgctgaagctgttttcaactacggtgatttcaccactatgttgactggtattcccgctgatcaagtcactagagtcatcactggtgtcccatggtactccaccagattgagaccagctatctccagcgctctatccaaggacggtatctacactgctgttccaaactaa

SEQ ID NO: 422 - DNA, 375 bp, Saccharomyces cerevisiae
atggtcaaattaacttcaatcgctgccggtgttgccgccatcgctgccggtgttgccgctgctccagccactaccactctatctccatctgacgaaagagtcaacttggtcgaattgggtgtttacgtctccgatatcagagctcatttggctcaatactacttgtttcaagcagctcatccaactgagacctacccagttgagattgctgaagctgttttcaactatggtgacttcaccaccatgttgactggtattccagctgaacaagtcaccagagtcatcactggtgtcccatggtactccactagattgagaccagctatttccagtgctctatctaaggacggtatctacactgctattccaaaatag

SEQ ID NO: 423 - DNA, 375 bp, Saccharomyces cerevisiae
atggtcaaattaacttcaatcgctgctggtgtcgccgccatcgctgctggtgttgccgctgccccagccactaccactctatctccatctgacgaaagagttaacttggtcgaattgggtgtttacgtctccgatatcagagctcatttggcccaatactacttgtttcaagcagctcatccaagtgagacctacccagttgaaattgctgaagctgttttcaactatggtgacttcaccaccatgttgactggtattccagctgaacaagtcaccagagttatcactggtgttccatggtactctaccagattgagaccagctatctccagtgctctatctaaggacggtatttacactgctattccaaaatag

SEQ ID NO: 424 - DNA, 375 bp, Saccharomyces cerevisiae
atggtcaaattaacttcaatcgctgctggtgttgccgccatcgctgccggtattgccgctgccccagccactaccactctatctccatctgacgaaagggtcaacttggtcgaattgggtgtttacgtctccgatatcagagctcatttggctcaatactacttgtttcaagcagctcatccaactgagacctacccagttgagattgctgaagctgttttcaactatggtgacttcaccactatgttgactggtattccagctgaacaagtcaccagagtcatcactggtgtcccatggtactccactagattgagaccagccatctccagtgctctatctaaggacggtatctacactgctattccaaaatag

SEQ ID NO: 425 - DNA, 375 bp, Saccharomyces cerevisiae
atggtcaaattaacttcaattgctgctggtgtcgccgctattgccgctggtgtcgccgctgcaccagctaccaccactttatctccatctgacgaaagagttaacctggttgaattaggtgtctacgtctctgatatcagagctcatttggctgaatactatatgttccaagccgctcatccaactgaaacttacccagttgaaattgctgaagctgttttcaactacggtgatttcaccactatgttgaccggtatccccgctgaccaagtcactagagtcatcactggtgtcccatggtactctaccagattgagaccagccatctccagcgctctatctgcagacggtatctacactgctgtaccaaactag

SEQ ID NO: 426 - DNA, 375 bp, Saccharomyces cerevisiae
atgatcagaagggcccctaccaccttgcagctcagtcacgacgacgtaacctctctgatcgatgacctgaacgagcagaaactcaagcagcagctgaatatcgagaagacaaaatacttccaaggaaaaaatggcggatcgctgcactccaatacagactttcaggacacatcgcagaatatcgaagacaacaataacgataacgataacgatatcgatgaagatgacgacatgtcatcttacaacgacaaagcagcctcggtagcgcacaccagagtcctcaattccttgcatctgtccaccgacagcaataccgcccacgagacgtccaatgcaaacgacaaccacaaccccttctacatccgcgaggaataa

SEQ ID NO: 427 - DNA, 375 bp, Saccharomyces cerevisiae
atgcgaccacatcattttttttgtggtaacatgggagtgatgtatacggccatgtctggatacgaaacagaagacgcacaagcctactgggcatgcggtagagcatatgaatcagcttttgcaacgttgactaaaaaggttccaggaaccacattctcagctgatatgccaacatctacttggcatggtgtcctggattgcggctattcctcttcaattaacgtggcagaaaataaaagttcgcccatcgattattggaattgtggtagaacatatgccaggaattatgctctgtccgatgcgctttcactgaagccaacgaatatgttacagtactttctattagtattattttttatctgcattatactatga

SEQ ID NO: 428 - DNA, 375 bp, Saccharomyces cerevisiae
atgcgagattcccctacccacaaggagcagagggcacaaaacaccatgtctgatcaaatgcccttccctttcaacaatttcacgtactttttcactctcttttcaaagttcttttcatctttccatcactgtacttgttcgctatcggtctctcgccaatatttagctttagatggaatttaccacccacttagagctgcattcccaaacaactcgactcttcgaaggcactttacaaagaaccgcactcctcgccacacgggattctcaccctctatgacgtcctgttccaaggaacatagacaaggaacggccccaaagttgccctctccaaattacaactcgggcaccgaaggtaccagatttcaaatttga

SEQ ID NO: 429 - DNA, 375 bp, Saccharomyces cerevisiae
atgttccctatcgcttccagaagaatactgctcaatgcttcagttctgccattgagactgtgcaatagaaatttcactaccacaagaatatcctacaacgtcatacaagatttgtatttgagggaactaaaagacaccaaactggctccaagtaccttgcaagatgctgaaggtaatgttaagccttggaacccaccacaaaaaccaaatctaccagaattggaacttcaaggcccagaggctttaaaggcttacaccgagcaaaatgtagaaactgctcatgttgctaaagagtctgaagagggtgagtcagagccaattgaagaggattggctagttttggatgatgctgaggaaaccaaagaaagtcattga

SEQ ID NO: 430 - DNA, 378 bp, Saccharomyces cerevisiae
atgcctagtaaagatccagagagcgttatagacaaagaaatacggaagatatcagcaagaaatgatgagcttatcaaacaggatgggactctaaaaagggaatacactacattattgagaaaagtatcgagcgtgataacggtactgaacagtattgatgatgcagatactggttctgctgaaacggaactcccacgcttaatatctcaagcaacagtagagaaagtacccgaattgaagtggtacaatgatcagatatcactgattacagaaaagttggaggacgatgaagatattgaggttcccgaggagctaatggatgcttatactctgtacaaggaaaccccattattatataatgatacgcacacaccataa

SEQ ID NO: 431 - DNA, 378 bp, Saccharomyces cerevisiae
atggttctaaccgatgccgaagaactgcgcagtccggttataacgtctgacatgtccttttttgatttggaatccaaccactcaagtgactctgttcatttactttgcgaaaaatatacccacaaattgcccatcgaaagtgaatcgcaaaccaccttcagactggcaccgacaaagcaaagattatacagacagagtactttatacgtaccgttaagtctcaagcaaagggttttcttatttactgaacgggtaaagagtatctgggccggcttgccaagatgcaaaccgaataagtatttcaaagttgcatttgccttagccgtcctgacaccattggctatttggatattttatattgactttcgtgtacattga

SEQ ID NO: 432 - DNA, 378 bp, Saccharomyces cerevisiae
atgtctctcgactttaacactttggcccaaaacttcacccagttttactataatcaatttgataccgatagaagccaattgggtaacttgtacagaaatgaatctatgctaacattcgagactagtcaattgcaaggtgcaaaggacattgttgagaaattagtatctttgccatttcaaaaggtccaacatcgtatcactactttggatgcgcaacctgcttccccaaatggcgatgtcttagtcatgatcactggtgatctgttgattgacgaagaacaaaatccacagcgtttctctcaagtgttccatttgattcctgatggaaactcttactacgtgtttaacgatatcttccgtttgaattactctgcttaa

SEQ ID NO: 433 - DNA, 378 bp, Saccharomyces cerevisiae
atgtctgttgtaggatcgttaattttttgcttggactgtggtgatctcctggaaaatcctaatgccgtattaggctctaacgttgaatgcagccaatgtaaagccatatatcccaagtcacaattctccaatttaaaagtcgtcaccacgacggcagacgatgcgtttccatcttctcttagagccaagaaatccgtggttaaaacttctttgaagaagaacgaactgaaagacggcgctactatcaaggaaaagtgtcctcagtgtggaaatgaagagatgaactatcatactttacagttaagatctgcagatgaaggtgctactgtcttctatacatgcacttcctgtggttacaagttccgtaccaacaattga

SEQ ID NO: 434 - DNA, 378 bp, Saccharomyces cerevisiae
atgtttagatccgtttgccgcatttcttcccgcgtggcaccttctgcgtaccgcactataatgggccgttccgttatgtccaacaccatactcgcacaaagattttattctgcaaacttgagcaaagatcaggtttctcaaagggtcattgatgttatcaaggcgtttgataagaactctcccaacattgccaacaagcaaatctccagcgatacccaatttcacaaggatttggggttggactccttggacactgtcgagctgctcgtagctattgaagaagaatttgatattgaaatccctgacaaagtggctgatgagttgagaagtgttggtgaaacggtcgattatatcgcttccaatcccgacgcaaactaa

SEQ ID NO: 435 - DNA, 379 bp, Saccharomyces cerevisiae
atggtacagctgagaagaacgtatgtatatatgttcgtggtaagctcgttggtatgcacgtatcttaggcatcactaccaacaaagtgtttcaagcgatcacgtcgactaacgacaaagttgctcactttgtcgtgttcatgtgggagtcgtggctgtttgtaaagatgtttgctgaggacatcgtgactttccgcaagctacaggccaacaagtacgtgttaggggtgctgatctgttcattatgcgcaagtgtaacgagtgaattcgcccaaagcgtggtttcgcggggacaaagggtgttcgatgtgaaggatattatttgtaatttctggggcagtctgcttggtgtgggcattgccttctaccaggaccgataa

SEQ ID NO: 436 - DNA, 380 bp, Saccharomyces cerevisiae
atggtatgttacgttctattgcgctttagtttgaattgaaatcatctttaccatggtactaactacgcttgcgatgaatcgtgcaagtccgtgcggcttatacgtaatgctaatactcaaaacaggcggaaaagcagaggcagttgaagttgcagaagatatacaaacaaaagtacatcggactgggagatgagagcactacacgagaacagtggcagagaaatgtgagaaacgatacactaaatacattacaaggccactccgcatctttggagtacgtttcattgagccgaggagaccttagtatacgtgacactcgtattcacctcctgaaatccatgtcccctggctataaagcctacttacgagaagagaggtag

SEQ ID NO: 437 - DNA, 381 bp, Saccharomyces cerevisiae
atgacaggttactttttaccaccacaaacaagttcttacacgttcaggtttgctaaggtcgatgactctgcaattctatcagtcggtggcgacgttgcattcggatgctgtgcacaagagcaacctccaattacatccacaaactttacgattaatggtatcaagccatggcaaggaagattgcccgataacattgcagggactgtgtatatgtatgctggattctactgtccaatgaagattgtctactcaaacgctgtttcttggcatacactgccagttagcgtggaattgcctgatgttactactgttagcgatgattttgcagggcacgtttactcttttgacgatgacctaacagcccaattgtactatccctga

SEQ ID NO: 438 - DNA, 381 bp, Saccharomyces cerevisiae
atgagtatgcagattgaaataaaggatggaaggagtgataactctcctctgcccgaaagaaaactagttacgttaattcaagaaagttatgatagtttaaaagatgacaatgaaatcaatttatcgaccgaatcaacttccaaccttcttataaaactggtcctagaaaaacttgaaaagcactcttctttgtataaatatattgcctcggtaacgacgttgaacattgaaggactcaacgaagaaaacgctaatttctcattgaagaacgatataggcgcatcctgggaatctaaaaaagatggtatattcaactataaactagaagacaaaaataataatgagtgctatttaattacaattctttggcttcacaagtag

SEQ ID NO: 439 - DNA, 381 bp, Saccharomyces cerevisiae
atggcaggtgaagcagtttcggaacacacaccagattcgcaggaagtaacagtaactagcgtagtttgttgcctcgattctgtggtggaaataggacaccatgtcgtgtattctgtggtaacgccgttaatagtagcagtgcttatagatacaatggctggagaagcagtcttagagcatacgtcagattcacaagaagaaattgtaactactgtggtttgctctgttgtccccttggtttgctttgttgtctccgtagtttgctttgttatctctgtggtagaaatagggcaccatgtggtatactctgttgtggcaccgctaacagtaacggtggccgtggaaacaattgcagaggagatggattcagtgcacacatga

SEQ ID NO: 440 - DNA, 381 bp, Saccharomyces cerevisiae
atgtctgccccaaacccaaaggctttcccattagccgatgctgcattaacccaacaaatcttggatgtcgttcaacaggctgctaacttgagacaattgaagaaaggtgccaacgaagctaccaaaactttgaaccgtggtatctccgaattcatcattatggctgctgactgtgaacctattgaaatcctattgcatttaccattactatgtgaagacaagaatgttccatatgtctttgttccatctagagttgctttaggtagagcttgtggtgtttctagaccagttattgctgcttctattaccaccaacgatgcttctgctatcaagacccaaatctacgctgtcaaggacaagattgaaactttattaatttaa

SEQ ID NO: 441 - DNA, 381 bp, Saccharomyces cerevisiae
atgtttgaatcgtttgttaatgaaggcacagcattcctcctctttgccaaagatgagcgcataaggttcaaacatgataaatataaggcgctgcctattgatgttcgtaatgctgaaggtaatgtacctctccatagctgtagagggctgtctatctctttcaaatttttccataatgtagctttcttgtcttgctggattctcgtcttcaaaaggtctaaaggttgcaacgcaacagcagatgttagcccaccgaaaaagcccccgatcaaatgcgatgaatttcttggcttagttgcttgctcagtcatgtatgctgcttcacaaattgtgtaccttctagttgttcccgctgtgctatttgcttttcttttggtataa

SEQ ID NO: 442 - DNA, 381 bp, Saccharomyces cerevisiae
atgttttatctaagtgacatcgaggaagaagcctcggctggggctgaaccaacttataatttctgggaagttttgttattctccaatactcaagaaaacctcgtcaccgttgtcggagagttgcacacacttaccgatcgtgtggttcattacaaaattgagcctgaatcaagggaagttactgccacaacactgccatctttgttagcacttttgctagaaaaaaggaaccaggcgagacgtttatatagggatgtgctttcaatgaaaatgtcagaactggactgggacatcgacgatttgttcacacagttacaagaagagctaacaagaactgatgacactctttctatgtatcctaggagaaggttctatcactag

SEQ ID NO: 443 - DNA, 384 bp, Saccharomyces cerevisiae
atgatcccagctccacttgatgcttccttattgagagaacatgcattccaaggaactaatgatctaagcacagttttgagtccaagtacgtttaccgatgaaggtggatataaacctgtattgaaatacggactcggttatttcaattatggactggttatagacgatgaagtgtatgattattcagtgtgtgatatcataaggggtcacgtttacgatcatttttggtgttatttctgttgtttcatgattttgtttactatctggttaataagtttaaattggtgtcccagcagcaagaaaagcaagtttgattggagcaagaagaaggacgactttaagatggaaggaggtgatttagagtaccaacatgtaaagatctaa

SEQ ID NO: 444 - DNA, 384 bp, Saccharomyces cerevisiae
atgatctgttatttccttgttgtaactataaattttctaaaagaaaagacaaccatttgccattattttgttaacattttttcattgtttttgtttttgtttgtttttgtttttgtttttatttttgtctactttttttatgttattttgttttatcgtttctgttcgttgtttacctattttcctgccaattcaatttggtactatctttctattatcaatattttctttcccttatgtttttttctatatgaaaacttcacagggagaaatagaagaaaatgttcattattctgtttaactttgataaaaattacttatacgtctcccaatcatggtttcatggtcactggtaaggaaaaattcgaaaaactacgggactaa

SEQ ID NO: 445 - DNA, 384 bp, Saccharomyces cerevisiae
atgccacagtcttttacgtctattgcgagaattggtgactatattttgaagtcacccgtcctctccaagttatgtgttccagttgccaatcagttcattaacctcgcaggttacaagaagttagggctcaaatttgacgacttaattgcagaggaaaatcccatcatgcagaccgctttaagaagactccctgaagatgaatcttatgccagagcatatagaataatcagggctcatcaaaccgagttgactcatcatttactgccaagaaacgaatggatcaaagcccaagaggatgttccttacctgttgccatacatattagaagctgaagctgcagctaaggagaaggacgagttagacaacatagaggtctccaaatga

SEQ ID NO: 446 - DNA, 384 bp, Saccharomyces cerevisiae
atgtcaagcactaatggaaacgcaccagcgacaccttcctcggatcaaaatcctctccccacgaggttcgaagtggagctcgaatttatccagtcactggcaaacatccaatacgtaacgtacttactcactcaacagcagatctggaagtctcctaacttcaaaaactacttgaaatacctggagtactggtgcaaccccccttattcgcaatgcattgtgtatccaaactgtctcttcattttaaagctgttgaacgggttcatggagtcggcgatcgttaatgaagatggcctgctggaagggctagacgagctgcccaagatcattcaattacaaggcccgcaatggatgaatgaaatggtagaaagatgggccaactga

SEQ ID NO: 447 - DNA, 384 bp, Saccharomyces cerevisiae
atgtcactacaaagcaacagtgtaaaaccaacagaaattcctctctcagagatcagacgccccctagcgcctgtgttggatcctcaaaagatcgacgcaatggtggccacaatgaagggcattcccaccgctagcaagacatgctctctagaacaggctgaggcggctgcctcagccggggaactgccgcccgtggacgtgctgggcgtgcgagtcaagggacagacgctatattatgccttcggcggctgccaccgtctacaggcatacgaccgccgggctcgcgaaacgcagaacgccgccttccccgtgcgctgcagggtgctaccggccactccccgccaaatccgcatgtacctgggcagcagtctcgacatcgaataa

SEQ ID NO: 448 - DNA, 384 bp, Saccharomyces cerevisiae
atgtcttcaaactatgccactcctttagacgatgaggtgtttcccttatcttttgccaattatcaatttaccgagcatgtgtcacttggtgagcattattcactcaatacttcggaagatgccaaatataataatttgaatggtcctttcgtggtaccgagagacaccgggaagttcgatttgaacacaagttctgcctcggacgagactgtgttctcgttagataaccctcaagaaaacaactacaaacaccaagccatgaataacgtccaggattgtcgcatggccgtcgcggccaaaactacccagtcgtgtgataaattgaccgatctttatgccaatgccgcccaacaaaactacagattgtggctgtcttcattttag

SEQ ID NO: 449 - DNA, 384 bp, Saccharomyces cerevisiae
atgttgttctataagcctgtgatgaggatggcggtgagaccgctaaaaagcataagattccagtcctcatacaccagtattactaaattgacgaacctaacagaatttaggaatttgatcaagcaaaatgataaactagtcatcgatttttatgctacttggtgtggcccctgtaagatgatgcaaccacacttaacgaaattaattcaggcttatccagatgtaagatttgtcaagtgcgacgtggacgaatcaccagatattgccaaagagtgtgaagtgacggctatgcccacctttgttcttggcaaggatggccaactcatcggcaagatcattggagctaaccctactgctttagagaagggaatcaaagatctataa

SEQ ID NO: 450 - DNA, 387 bp, Saccharomyces cerevisiae
atgaacagtgctaccagtgagacaacaaccaatactggagctgctgagacaactaccagtactggagctgctgagacgaaaacagtagtcacctcttcaatttcaagattcaatcatgctgaaacacagacggcttccgcgaccgatgtgattggtcacagcagtagtgttgtttctgtatccgaaactggcaacaccaagagtctaataacttccgggttaagtactatgtcgcaacagcctcgtagcacaccagcaagtagcataataggatctagtactgcctctttagaaatctcaacctacgttggtattgccaatggtctgttgaccaataatggcataagtgtttttatttccaccgtattgctggcaatcgtatggtaa

SEQ ID NO: 451 - DNA, 387 bp, Saccharomyces cerevisiae
atgatcaccccaaagggaacgcacgatgctgtggccaagtttcaaaaaactgacctgcatcaagatctcgattacatcgtactgcaacaacgaagaacacagctagagacgcttattaacgaaagagaatcttttgtcaagaatctgtgttctcttttccacaaaattcaaaataccaagaattaccaggaatttgttgatgtattggcggagaatagggatttactgcgagaaattttcactgtagagaacggatttcaaaagcaaaaatggattagcaacgacgacattccccagatagactgggacaagtttgccctagatatcaacgcttatatagcagagaacgatcaattgttggctttgtatgaagatggcttattatga

SEQ ID NO: 452 - DNA, 387 bp, Saccharomyces cerevisiae
atggcaacgacagatatcatatctctagtaaaaaataatttactctatttccaaatgtggacggaagtggaaattttacaagacgatttatcatggaagggaaatagcctgagattactgagaggtcgtccgcctcacaagctgagcaacgatgtagacacagagcatgaaaatagcttgtcatcgccacgcccgctagagttcatattacccatcaatatgtcacagtacaaagagaattttctcactttggaatgcttgagccagacatttactcacttatgtagtccatctactgaaagaatactgctggccataattaacgatgatggtacaattgtttattacttcgtttataaaggagtacgaaaaccgaaaagaaattga

SEQ ID NO: 453 - DNA, 387 bp, Saccharomyces cerevisiae
atgtctgctaacgattactacggcggaaccgccggcgagaagagccaatattcccgtccctccaacccgccaccttcatccgctcatcagaacaaaactcaggagcgtggatacccaccccaacaacagcagcagtactaccagcagcagcagcagcatcccggatactataaccaacaaggatacaatcagcaagggtacaatcagcaagggtacaatcagcagggctacaatcagcagggatataaccagcagggatataaccaacaaggccatcaacaaccagtctacgtccaacaacaaccaccccagaggggtaacgaaggttgtctggctgcatgtctggctgcattatgtatatgctgcaccatggatatgctattctaa

SEQ ID NO: 454 - DNA, 390 bp, Saccharomyces cerevisiae
atgagattacttcaccatggtgaatacgggacaaaactaattggaggaaaatgcagcatagatgggaaactcggtcacccttgcccgctaagcagaagacgcaaaaaacatctgcgcgaaaaagaaatgggtccacaatatgtacggatgtatggtcccaaaagaaaagccataataaggacaggaaacccggatgacggcattaatttacctgacaccggccgaggcaccttaactgcagccacaatttggtcacgagcttaccattcaaattattcttaccttgtacgcccaaaagtagtgactctttctaagcatcgcgaattaatgactacttttcttttatacgttttatatgtatgtatatatataagtgccttcataaaatag

SEQ ID NO: 455 - DNA, 390 bp, Saccharomyces cerevisiae
atgatatatcccttattcaggatatgtatcctaggtgcatttctgttgggtagctatgcatgtcttgaaaatagtacgcaaaagggtattgaaggggtaactctctctcataatagtgtacaaattaataatactttggcaaaatctgcgccattttgtgagtcagacgctctttcaatgaattattcaactgaaaatatgttaagtaataatgcatgcgattatacgaaaaattcttcgtatccatatattattaccattattactaaggcctttgataatgcccttgaaaattcacttaatttacaagcaaacaggaagctttatcacagagtggggacgtgtatacagaatattttttatcaactgttgttaactgtgaattactga

SEQ ID NO: 456 - DNA, 390 bp, Saccharomyces cerevisiae
atggaactgttaccacagggacaaaggaacaacactcaggtaacgttcgaagatcagcaaaagatcaacgagttttcgaagttgattatgcgtaaggacgccattgcgcaggaattgagtttacagagggaggagaaggagtacctcgatgatgtgtctctagaaattgaattgattgacgaagatgagcccgtgcaatacaaggtgggcgacctctttatcttcatgaaacagagcaaagttaccgcacagctcgaaaaagacgcagaacgtctcgacaacaaaatagagactttagaggacaagcaaagagacattgattcccgtcttgatgctctgaaggcgatcctgtatgctaaatttggtgataatatcaaccttgaacgttag

SEQ ID NO: 457 - DNA, 390 bp, Saccharomyces cerevisiae
atggtcaccacgctaactcccgttatttgtgaatccgctccagctgctgcggcttcatactcccatgccatgaaagtgaacaatttgattttcctttctggccaaattccagtgaccccagacaacaagttagttgaaggttccattgctgataaggctgaacaggtgattcaaaacattaagaatgttctagaagcaagcaattcctcattggacagggtcgtaaaagttaacattttcttggcagatatcaatcactttgctgagtttaactccgtttacgccaagtacttcaatactcacaaacctgccagatcatgcgttgctgttgcagcattgccattaggcgttgacatggaaatggaagccattgctgccgaaagagattaa

SEQ ID NO: 458 - DNA, 390 bp, Saccharomyces cerevisiae
atggtcgaaggtgattttgtcgatgagcaatcgaacattgccttactaagctccaaatccatgtgtggtgatcatcatagcgtcaagaatagcataggggatgagatctttaaattattgacaaagattttaaattcggatgagaaagcaagcggagatgtgcacacactcgtttctgggaccccggatctctcaaattttaacctcgataatgaaccactggaaaacatactcgctgttttcataatatcttttattattgtagtggttggagttttactacttgggttgattggcatgatattcatatctctccgttcaggcagcagtaatgataagaaactacagtccaacgatgaagaaaagcaagcacttgctgaaaaagcatga

SEQ ID NO: 459 - DNA, 390 bp, Saccharomyces cerevisiae
atgtctacatcatccgtacgttttgcatttaggcggttctggcaaagtgagacaggccccaagacggtgcatttctgggctcctactttgaaatggggtctggttttcgctggattcagcgatatgaagagaccggtggaaaaaatttctggtgctcaaaatttgtcgctgctatctactgcgctgatttggactcgttggtcctttgtcatcaagccaagaaacatcttgttggcttctgtcaactcgtttctttgtctgaccgctggctatcaattgggtagaattgccaactacaggatacggaatggcgactctatatcgcaattgtgtagctatattctcagcggcgccgacgaaagcaaaaaggaaattactacgggcagataa

SEQ ID NO: 460 - DNA, 390 bp, Saccharomyces cerevisiae
atgtctgaagtagcggaaacatgggtggatacctggatggcaaaactagtcaactatgactacaagcactttataagattggtgataattgtaggtggttatttactcttaagaaatatcgcatccagggaattggcgaagaagcagttggctgcccaagtggaaaaggacaaacgagacaaagaggaaaagagatcaaaagacctgatcgacaagccagatgatgctgcaacagcagaaacaacttctttcggttggggtaagaaaactagaagaagagttaaaagacaacaggagttgtttgaaaacgctttggaagaggctaagagaagaaaccaagggttggacccagatagtgatgctgatattgaggaactactggaagaatag

SEQ ID NO: 461 - DNA, 390 bp, Saccharomyces cerevisiae
atgtcttcagcaccattattacaaagaacacctgggaaaaagatcgctttgcccacacgagttgagccaaaagtgttctttgccaatgagcgtacctttttgtcgtggttgaactttacagttatgctgggaggccttggtgtaggtttactgaattttggtgacaagataggtagggtcagtgcaggactatttacttttgttgccatgggtacaatgatatacgcgcttgtaacataccactggagagctgctgcgattagacgtagaggatcaggtccttatgatgacagattggggcccactttgttgtgctttttcttattggttgctgtcattatcaactttatattaagattgaagtacaatgacgctaacactaagttatga

SEQ ID NO: 462 - DNA, 390 bp, Saccharomyces cerevisiae
atgtttagacagtgtgctaagagatatgcatcttcattacccccaaatgctttgaaacctgcatttggcccaccagataaagtggcagctcaaaaatttaaagaatcattaatggccactgaaaagcatgcgaaggacacatctaatatgtgggttaaaatctcagtttgggtcgccctaccagcaattgctttaacagctgtgaacacatactttgttgaaaaggagcatgctgagcatcgtgaacatttgaaacatgtgccagactccgaatggccaagggattacgagtttatgaatatcaggtctaagccttttttctggggtgacggtgataagacattattctggaatcctgttgtcaacaggcacatcgagcacgacgattaa

SEQ ID NO: 463 - DNA, 393 bp, Saccharomyces cerevisiae
atgaccagatcttccgttttagctgatgctttgaatgccattaacaacgctgaaaagaccggtaagcgtcaagttttaatcagaccatcctccaaggtcattatcaagtttttgcaagttatgcaaaagcacggttacattggtgaatttgaatacatcgatgaccacagatctggtaagattgttgttcaattgaacggtagattgaacaagtgtggtgttatttccccaagattcaacgttaagattggtgacattgaaaaatggactgccaacttgttgccagccagacaattcggttacgtcatcttgaccacctctgctggtatcatggaccatgaagaagccagaagaaagcacgtttctggtaagattttgggtttcgtttactaa

SEQ ID NO: 464 - DNA, 393 bp, Saccharomyces cerevisiae
atgataccttcccggattagccacaaatttcctctattcttaaggagttcgctggccgctcctaaagctgcctatcgtttcagttcgaccatccccaaaccaagcgatcaggtacctgacgtagatgcatttctaaacaagatcggtcgaaattgcaacgaattgaaggatactttcgaaaataactggaacaaccttttccaatgggattctaagatattgaaggaaaaaggcgtgaatattcaacaaaggaaatatatactgaaacaagttcataactatcgtaacaataggccaattcatgaaattaaactgggcaagaagtcattttttggtggtgagaggaagagaaaggcatttactgctaaatggaaagctgaaaacaagcaatag

SEQ ID NO: 465 - DNA, 393 bp, Saccharomyces cerevisiae
atggaagacacgatacgtccattaaattacgcagatatcgagaccagcgggcccataaaccttcttgagacaactaataacctaaaaagctcgttaaaaaagttttcacaaaaggcaaagggatcacacatttccagagaaaggattcaccattttagaaaatggaaaaataagaccgaatcactttcagaaaaccatttgaagcctcctcctgacgtcgactctctatgtttcagtaactgctttcaacctgacgccctgtctggaaatgtatttttaccccccagaagctcaaacatgtattggaatgaaaagcaattacaattagaaatggaaattctaaaatttttatcactaaatactagcaatgaatgctgcacttctgatgattag

SEQ ID NO: 466 - DNA, 393 bp, Saccharomyces cerevisiae
atggcaaaagcaccaaaggcaaacacaccaaaagtaaccagcacgtcatctgcagtcttaacagattttcaagaaactttcaagacttctaagagggcatattttgcccaaattgaaaaatatcctaaactgaaactaattgatacattctgcttctttttggtattattaggggtgatccagtgtacattcattatcttgatccgtgataattttccattcaatgcgtttttagcgggattcattatttgtgtgggacaattcgtcctattgatgagtttgcggttacaattgtgtaatagttttccaggcatttctaaaaacagagcttttgccgagtttattgttgctagtttgattttacatttcgtttgtttacattttataaattga

SEQ ID NO: 467 - DNA, 393 bp, Saccharomyces cerevisiae
atggcctccttacctcacccaaagattgtcaagaagcacaccaagaagttcaagcgtcatcactctgaccgttaccacagagttgctgaaaactggagaaagcaaaagggtattgactctgttgttagaagaagattcagaggtaacatctctcaaccaaagatcggttacggttctaacaagaagaccaagtttttgtcaccatctggtcacaagactttcttagtcgctaacgttaaggatttggaaaccttgaccatgcacaccaagacttacgccgctgaaattgctcacaacatctccgctaagaacagagttgtcattttggctagagctaaggctttgggtatcaaggtcaccaacccaaagggtcgtttggctttggaagcttaa

SEQ ID NO: 468 - DNA, 393 bp, Saccharomyces cerevisiae
atggtaagtttcataacgtctaggcaactcaagggcctaattgaaaatcagaggaaggattttcaagttgttgatcttcgaagagaagattttgcacgtgatcatattacaaacgcttggcatgttccagtaacagcacagattacagagaagcaactgaatcaattaattaaaggtttatccgatactttctcaagttctcaattcgtcaaagtgatatttcattgtactgggtccaagaataggggaccaaaagtagctgctaaattcgaaacctacttacaagaagaagatattacaagtaagtttgagagttgcatcctcgttggaggtttttacgcttgggagacccattgtagagagagtaaccttaaattgattgttagtggttga

SEQ ID NO: 469 - DNA, 393 bp, Saccharomyces cerevisiae
atgtctcaaccggttcaacgcgctgcagcacgctcattccttcaaaaatacatcaataaagaaactttgaaatatattttcacaacacacttctggggtcccgtatcaaatttcggtatcccaattgctgctatatatgatctgaaaaaagaccctacactaatctctggcccaatgacttttgctttagttacctattcaggtgttttcatgaagtatgctctttcagtatcacccaaaaactacttactgtttggatgccaccttattaatgaaactgcgcaattagctcaaggctataggtttctcaaatacacgtatttcacaacagatgaggagaagaaagctctagataaggaatggaaagagaaagaaaaaactggtaaacagtaa

SEQ ID NO: 470 - DNA, 395 bp, Saccharomyces cerevisiae
atgagtagtttgtatgtgtcataatctcttctctccgcttcccttttcttccttcttcttctactaactctctgcgcgtccaatttagctatactgttgttggtgtattcatagtggttagtgccatgtccgtgctgttctggataatggctccaaagaacaaccaagcgtatgtgcaacattttttttacgatgtgtctccatattactagtttccctttcttttttactaacaagagtttgtttgttttgttttgtcgtacagtgtttggagaagtacagtgattttgacattggccatgatgtttttgatgtgggccattacgttcctttgccagctccatcccttggtggctccacgccgttcagatttgagacctgaatttgcagaataa

SEQ ID NO: 471 - DNA, 396 bp, Saccharomyces cerevisiae
atgagtcaaagtcgctggagtatcgttctcatctttgcattgtttatttttggcagcactggagtgaatgccttcttcaatttcggtcatcatcagcaacagcaacagcaacagcaacaatcatatgaagatcaagttttaaataacccttgtgatgggtatttgtgtccggacaccctaacgtgcgttgcacagcagaaagactgtccttgtcccttccctaaatctcagttgaaatgtgtccttcctgataataaatttgtttgcatatccaaaccagccacacacaatgaaaagtttagagcaatatatgatgaccctgtcaagggccccaaagcaaagaacaaggggtttagggattgtggatgggtatcagatgcttacaaaaaccattga

SEQ ID NO: 472 - DNA, 396 bp, Saccharomyces cerevisiae
atgcacatatcgctccctacgagaaacaaatcttattttcgaatacgtacacgtacatatcaaataggcttatatcattctgactcttcaccaatcagggacatatcagtactacatctgttaatagcaacgttatgcactattttttttccaatttttttttcgttgagtaaagttcaggtcgtacagtggcaaggaacgactatttctaaaaactgtattgccttaaccatgtctttccccttgaacgctatccctggcatgtatctgataattgctttccctcgtctacaaacagtaattcccctgcagcgaaatactcctgttcgaattacgaaatcggtgatagtgaaaggcgcagtgagcgtgccacggatctcctctccgatgcactag

SEQ ID NO: 473 - DNA, 396 bp, Saccharomyces cerevisiae
atgcaggttctcaatacgaagagtgaaacgaaacaagaaaacgaaacaatgcagccaccatatatacaagaacgtcttaagtcattaaatgatatagagacccagttatgctccatgttgcaggaggcgtctcaagtcacgttcatatttggtgaactaaaaagaggtaatgaatcagtgaaaccccaattcgaaaatcatgtcaaacagttttacgaacgactagataaatcaaccacacagctacgcaaggagatacagttgttggatgagaacgttggaacacgactactgcccatcaatgtcaacaagaaggccctaggccaagacacagaaaaaatggaagaacaattggatttattgtcggctatattagatccttcgaaatccaagtaa

SEQ ID NO: 474 - DNA, 396 bp, Saccharomyces cerevisiae
atgctttatgagctgatcggacttgttcgcataaccaactccaatgcgccaaagttggaagcaaaagaattgtcttccacaatcgggaaactgattattcaaaacagaggtgtggtgagggacattgtacccatgggcataaggtatcttcctaaaataatgaagaaagaccaggaaaaacattttcgagcatatcactttttaatgctgtttgattcatcagctgcggtacagtctgaaattctaagaactttaaagaaagatccccgtgtcataagatcatccatcgttaaagttgatttagataagcagctggatagagcctcatcgttacaccgttctttggggaagaagtctattttagaattagtgaatgaagattatcaatccatttag

SEQ ID NO: 475 - DNA, 396 bp, Saccharomyces cerevisiae
atgtcagaggatctttcacctacaagcagcagggtggatttgagcaatcctcatgggtttaccaaagagggagtggatttatcgaagctgtcaccacaagaactaaaattgtataaaatgtatgggaagcttccatccaaaaaagatctgttaagacataagatgcaggatcgtcaatattttgacagcggagattatgcattgaaaaaggccggagtcattaagtcggatgacgttatcgtgaataattctagtaataatctaccagtgaccaatcctagcggtttaagagagtctattattagaagacgtatgagtagtagtagtggtggcgattctatctcgagacaaggaagtatctcaagtggacctccaccaagatctccaaataaatga

SEQ ID NO: 476 - DNA, 396 bp, Saccharomyces cerevisiae
atgtcctctgccgccgaaaagaaaccagcttccaaagctccagctgaaaagaagccagctgccaagaaaacatcaacctccgtcgatggtaagaagagatctaaggttagaaaggagacctattcctcttatatttacaaagttttgaagcaaactcacccagacactggtatttcccagaagtctatgtctattttgaactctttcgttaacgatatctttgaaagaattgctactgaagcttctaaattggccgcttataacaagaaatccactatttctgctagagaaatccaaacagccgttagattgatcttacctggtgaattggctaaacatgccgtctccgaaggtactagggctgttaccaaatactcctcctctactcaagcctaa

SEQ ID NO: 477 - DNA, 396 bp, Saccharomyces cerevisiae
atgtctattgtgctacggaagagtaacaaaaaaaacaaaaactgcataacaagcaagttttatacaatacacattataaaaatttctactccggtgttccgagctcccattgccattggagaaagcccttatgtggagtggagctgcctacaggttgttttcaggaaagacatggttacaaaaaagacgacattcgcccaacttatcactcgcttgaaccactttttatgccaagcccttaaacgccgcgactcaaaaacatacatactgtgccgcacggcagtttttggcgctatgacacccttttccccaagaaaatcgcatattaacaacaaattacccatgcaacccaggaaaaaaaaaatagtcattatatacgtagtgcgctttcattga

SEQ ID NO: 478 - DNA, 396 bp, Saccharomyces cerevisiae
atgtctgctaaagccgaaaagaaaccagcctccaaagccccagctgaaaagaaaccagccgctaaaaagacttccacttccactgatggtaagaagagaagcaaggctagaaaggaaacatactcttcttacatttacaaagttttgaagcaaactcaccctgacactggtatttcccaaaagtccatgtctatcttgaactctttcgttaacgatatctttgaaagaatcgctactgaagcttctaaattggctgcgtataacaagaagtctactatctctgctagagaaattcaaaccgctgttagattgatcttaccaggtgaattggctaagcatgctgtctctgaaggtactagagctgttaccaagtactcttcctctactcaagcataa

SEQ ID NO: 479 - DNA, 396 bp, Saccharomyces cerevisiae
atgtttggcccattcaaattaacaagccccgtcgctggtggcctactatggaaaattccatggagaatgtccacacatcaaaaaacccgtcaaagggaaagattaagaaacgttgatcaagtcataaagcaattaactttaggtctccacgtccaaagatgtcaggataaaggtcttacttatcaagaagccatggagagcaaaaagaaatacaagccaagaagtaaatcgttaaggttgttaaacaaaccatcagtctttccaaaggagaatcaaatgtcttctaaagataaatattggacttttgataaaaaagctgttggttataggaagggtattcataaggtgcccaagtggacgaagatttccattagaaaggccccaaaattcttttga

SEQ ID NO: 480 - DNA, 399 bp, Saccharomyces cerevisiae
atgtccggtggtaaaggtggtaaagctggttcagctgctaaagcttctcaatctagatctgctaaagctggtttaacattcccagttggtagagtgcacagattgctaagaagaggtaactacgcccagagaattggttctggtgctccagtctatctaactgctgtcttagaatatttggctgctgaaattttagaattggctggtaatgctgctagagataacaaaaaaaccagaattattccaagacatttacaattggccatcagaaatgatgatgaattgaacaagctattgggtaatgttaccatcgcccaaggtggtgttttgccaaacattcaccaaaacttgttgccaaagaagtctgccaagactgccaaagcttctcaagaactgtaa

SEQ ID NO: 481 - DNA, 399 bp, Saccharomyces cerevisiae
atgtccggtggtaaaggtggtaaagctggttcagctgctaaagcttctcaatctagatctgctaaggctggtttgacattcccagtcggtagagtgcacagattgctaagaagaggtaactacgcccaaagaattggttctggtgctccagtctacttgactgctgtcttggaatatttggccgctgaaattttagaattagctggtaatgctgctagggataacaagaagaccagaattattccaagacatttgcaattggctatcagaaatgatgacgaattgaacaagctattgggtaacgttaccattgcccaaggtggtgttttgccaaacatccatcaaaacttgttgccaaagaagtctgccaaggctaccaaggcttctcaagaattataa

SEQ ID NO: 482 - DNA, 399 bp, Saccharomyces cerevisiae
atggattgcccctcaaacgttgtgttattgttgctgcaattagttttgcagcgccaacaaactctagctcatcgagataagtcggttgatttgcaaacgctgttaaaagatcccgtcattgataatgacgtactagtagagttcaagacacacaagttggtgcaattatatggccctcaatactgccgcgacatatctctgagagggctcaaaacaatggttacagatatcttcgcaaacggaatcccaaaaaatgcgcaatcttcagggaatgatcaaccagtgactgtagtggacctggccaattactactacatgcagagaatcaatgagctacagaatacagaacttcctcaattgaaagaggcattgctgacaaggctggagcacatgatctaa

SEQ ID NO: 483 - DNA, 399 bp, Saccharomyces cerevisiae
atggttacaattggtagttcctccctggtattatttcttttcttcgtagtttttgtacagatcacttatacagctttacacagattttcccgcttgttgtgcacttttttttcgaagattattgaagagggatgcgtttggtacaataaaaaacataggttcccaaacctatataaatatatatatgtatatgtatatatactacatatatgctttgagaaatatgtgaatgttgagataattgttgggattccattgttgataaaggctataatattaggtatacagaatatactagaagttctcctcaaggatttaggaatccataaaagggaatctgcaattctacacaattctataaatattattatcatcattttatatgtttatattcattga

SEQ ID NO: 484 - DNA, 399 bp, Saccharomyces cerevisiae
atggtttttgttttccccttcccatttttttcttatggtttttccagttttctagaagccggaaaaaaggcaagctacaaaatgtactacgcggagccagaattaaaaaccacgcggacgggacgggccgtggcttgtgacgccggatccccgcgtataatccgtgtcacgctaaaggacaaaatcggtttatccgagcggtttacgggaagggtcttttgctatctcgcagtagcgtgtgcctggttatcccaatactaccaccacacctgtgctttttttatcttgtacgtgcatgtatgcgtatgttttctttttttccgttggtgcttattcgctaccgtctcgttgatccatgaatcacaaacacaagccggttctgcttactatacaaaatag

SEQ ID NO: 485 - DNA, 402 bp, Saccharomyces cerevisiae
atgaacaacaagctcatatatcgttcggttagatttgcaacccataacagccagcttttacttccacctttggttctctacagaaggatactaaggcagcataagctgctacctggtccccaaagggagatgggtgaccaatacgtgcgaaacgagttcaagttgcacaaagatatcgataacccgttgcatatagtcggctttttagcttcctggcaagattatctccacatgatttccaacggtaaatggaaagatgccactttatcttcggaaaccctggagaaactatcccctgagcaaacagttcaactgtatgaattgatgaaggaaacacagaaacttcaccaagacaatgaaatagaatcaagtaaggacgtgaagcggaacaacaaggattag

SEQ ID NO: 486 - DNA, 402 bp, Saccharomyces cerevisiae
atgacagcaatgaaagaagacaacgctgcattgattacactgaagaaaaacaacgaccaagaaaaacttagagtgcataaactgacagatgcaagttcaaactctgctgatgggttcgttataaataaagccaaaaacggtggaccgcttaataaaaagtcattagttaataatgaacaacacattaagaaggctgtgtcgcctggtagagtcaggaagcacaaaacgacaacatcttccacaaaatcacgaacgaaaagtaagaaaaaagacgcttctgaaagtaaagtacagagagagaataagggttcattttaccaaggtgccattttcggttcgttccttggtgctgctgtaactactgttttaagtaacctagcagttaaagctcttcaaaattag

SEQ ID NO: 487 - DNA, 402 bp, Saccharomyces cerevisiae
atgcaattttctactgtcgcttctatcgccgctgtcgccgctgtcgcttctgccgctgctaacgttaccactgctactgtcagccaagaatctaccactttggtcaccatcacttcttgtgaagaccacgtctgttctgaaactgtctccccagctttggtttccaccgctaccgtcaccgtcgatgacgttatcactcaatacaccacctggtgcccattgaccactgaagccccaaagaacggtacttctactgctgctccagttacctctactgaagctccaaagaacaccacctctgctgctccaactcactctgtcacctcttacactggtgctgctgctaaggctttgccagctgctggtgctttgttggctggtgccgctgctttgttgttgtaa

SEQ ID NO: 488 - DNA, 402 bp, Saccharomyces cerevisiae
atgcctagtgtagatatagatgctagtcaatggcagaagttgacacagtcaagagaaaagcagaccacggtgataacaccgcttgggatgatgatgctggagattcaaggtgaactagagttgcctaaggactttgcgtcgctggcgaggagagattctccaaatgagggaaggttcagtgaacaggacggcgaaactttaatacgatttgggtcgttacagattgacggagagagggccacattgtttgtcggcaagaaacagcgtttactggggaaggtgacaaagctagacgtaccgatgggtataatgcatttcaattcgaaagataataaggtcgaattagttgatgtaatgaaatataaggttatctttaaggataggcctctacctattatgtaa

SEQ ID NO: 489 - DNA, 402 bp, Saccharomyces cerevisiae
atggacagagaccatattaatgaccatgaccatcgaatgagctattccatcaacaaggacgacttgttgttaatggttttggcggttttcattcccccagtggccgtctggaagcgtaagggtatgttcaacagggatacactattgaacttacttctcttcctactgttattcttcccagcaatcattcacgcttgctacgttgtatatgaaacgagtagtgaacgttcgtacgatctttcacgcagacatgcgactgcgcccgccgtagaccgtgacctggaagctcaccctgcagaggaatctcaagcacagcctccagcatatgatgaagacgatgaggccggtgccgatgtgcccttgatggacaacaaacaacagctctcttccggccgtacttag

SEQ ID NO: 490 - DNA, 402 bp, Saccharomyces cerevisiae
atggacgcacaactggaatgggcaagcagcctcgtcccaaagagacagcttcaacaacaacaacaacaacaggagcagcagcagcagcagcaacaggatttccacaaggaccagttgatgactgtgggtatgcgaatcagacagcgggtcgaccagggttatgcatcgaggacgccgagcacctcggacgcttcactacagccgggtgtcattagagattactcgagcgttattgttccgcaatttacaaggtcgcccttgcccactgctaactcgctaccacctatgctgataaaccagagaacaatgtcgaccgaggcgtcctcgctcgagaaatgggacgtcgcggaacctgccgcggagcacgaaacaatggttaatggatccaagagaagactttaa

SEQ ID NO: 491 - DNA, 402 bp, Saccharomyces cerevisiae
atggattcaatagatgaacaaattgctataaagcgaaaagaacttcagtcattacaaaagataaccagtttaacggatggcttaaaaattcagctaacagagttgaatgagcagatcaaagaaatgggaatgaatgcggattcagtggcccaattgatgaacaattgggattctataataaacaatatatcgcaagcaagtttgggattattgcaatatgcagagggtgattatgagataggaccgtggaaagattctaagaaaaaggaatctgaacaatcaaatgaaacaggtcttgaagcgcaagaaaatgataagaatgatgaagataatgatgaggatgaagatctggtacccttgccggaaacaatggtcagaattagggtagatggtaacgaatga

SEQ ID NO: 492 - DNA, 402 bp, Saccharomyces cerevisiae
atgtcgttttggaaaacattgcagagacagccacgtaccatctcgttgtttaccaatgacatcgcgtccaatatcaagtcgcagaaatgcctgcagttgctgaagggagacgtctctcatcgattcgacgtggaaatcgccaaccgctttcccacgtgggaccagctgcaatacatgagaacttcgtgcccgcaaggcccagtttcgttgcaaaggcagattccaaagctggattcagtgctcaaatacaagcacacagacccgacgttcgggatggacctgcagaagtgtgtccagaggggactttggaatccaaaggaggcgctttgggtcgactgggaaaacaagttggtgggaaatgagcccgcagacattgacaagtacatcattcagcgcaaataa

SEQ ID NO: 493 - DNA, 405 bp, Saccharomyces cerevisiae
atgtcaggaaaagctcatggaggtaaaggtaaatccggcgctaaagacagtggttcattgagatctcaatcttcttcagcaagggctggcttgcagtttcctgtcggtaggattaagcgttacctgaaaaggcacgctaccggccgaacaagagtaggatccaaagctgccatttatttgactgctgtgttggaatatttgactgctgaagtgctggagttggctggtaatgcagccaaggatcttaaagtcaagaggattaccccaagacatctgcaattggccattagaggtgacgatgagttagattctttgatcagggctacaattgcttcaggtggtgttttgcctcatataaataaagcattattattgaaagtggaaaaaaagggaagtaagaaataa

SEQ ID NO: 494 - DNA, 405 bp, Saccharomyces cerevisiae
atgtttggtaaagttttcgtaagctacatcagaacaagaattgggttcaaacctttaagcacgatatacacgcctgtttcttcttcttcgctcagcttcgataaggaggcatgtttcccctttaaaaaatggcacgaactgaatatgtcccagaagcaagagtttattcagcgttttgtcaaaaactacaggcaccaatacccaagttctaagaccaatgtttcgctgaaggggctgagtattggcatggacgagcacaatgactcgccatctgtgttcggcatattttataacgatatctggaaatcgtttaagaacgagcaattaggaactaacaatgataatatgaaatcgggtagtaggttcagtcaccccagctttaaacaattgttaatacagaagtga

SEQ ID NO: 495 - DNA, 408 bp, Saccharomyces cerevisiae
atgaagttcttaaccaccaacttcctaaagtgctccgttaaagcctgtgacaccagcaacgacaacttccccctacagtacgacggcagcaaatgccaattggtacaggatgaatctatcgagttcaatccagaattccttctgaacatagtcgaccgcgtagactggcctgcagtgctcacggttgctgccgaattgggaaacaacgccttacctcctaccaaaccatccttcccatcttcgatccaggagctcaccgatgacgacatggccatccttaatgacttgcatactttactgctacagacgtccattgccgaaggtgaaatgaagtgtaggaactgcggacatatctattacatcaagaacggcattccaaacttgctgttacctccacacctggtataa

SEQ ID NO: 496 - DNA, 408 bp, Saccharomyces cerevisiae
atgatgtttaatatttaccttttcgtcacttttttttccaccattcttgcaggttccctgtcagatttggaaatcggtattatcaagagaataccggtagaagattgcttaattaaggcaatgccaggtgataaagttaaggttcattatacaggatctttattagaatcgggaactgtatttgactcaagttattcaagaggctctcctatcgcttttgaacttggcgttggcagagtaattaaaggttgggatcaaggtgttgccggcatgtgcgttggcgaaaaaagaaagctgcaaattccaagttctttggcctacggagaaagaggtgtcccaggcgtcattcctccaagtgctgatttggtgtttgatgtcgaattggtagacgtgaaatcagccgcctag

SEQ ID NO: 497 - DNA, 408 bp, Saccharomyces cerevisiae
atgtcgtacaacggaatagggctcaagtcggcaaaagggtcatctacgtcgggccacgtgcagcgatcacttgctagcaacaataggcgcagaccacagggtagtcaacagcagcggcaacaacgacaaaatgcgatcaaaaaggccagccatgacaaggcaagcaggcctcttgctgtgcagaaacagatagagactcatatggagaaacgtgagattgaagtacaagttagcgagctacgggaccgactggaggaggaagaaacgctctcggaagagcagattgacaagaaatgtgaagcgttgagggcaaaactgacgaacgagtggcaagaacagcagcggatgtcctctttgtacacccctcgtaaggcgcgtctaacggaagagcagcatcgacatgaatag

SEQ ID NO: 498 - DNA, 410 bp, Saccharomyces cerevisiae
atgacttatgaacaattatacgtacgttgcctgtaacgctggttgatgctattcttttgatgtttttaacaacacacaggacaatgaatagttcccttcctgttttctaattcataattactaacaagtatagccaattcgccttctcggcatttgtgtaatcacttaagaaagagttccattcctcaaagagcttccagccatttatccacttagacactcaaccaaaatttgcaatttgtggtttaatcgttacattagctgtattatcatctgccctgttcgccgtcggttctaaatcttcatacattaagaaactcttcttctacacaattttaagtgtaattggcagcttgtttgctggcttgaccactgtttttgcttcgaattctttcggtgtctacgtctag

SEQ ID NO: 499 - DNA, 410 bp, Saccharomyces cerevisiae
atgtcagctcaagattattacggaaactctgcctccaaacaaagcgtacgttaattttacaagttttgcctttagaagatcacatcgtactaacgagcccttgtattttcattacatcactttcgattcagtattctcgtcctagcgctccaccaccaggatatgaaacggcgtctagaggttacgctccatcgcaaagccaacagaactattatccacctcaacagcagcagcagcagtatcagcaacaacctcaatactatcagcaacagcagccccaatattaccaacaacacccacagcagcccatttatgtccaacaacaaccggccagttctggaaatgaagactgtctagcgggctgtctagcgggtttatgtttatgctgtactttggatatgctgttttag

SEQ ID NO: 500 - DNA, 411 bp, Saccharomyces cerevisiae
atggccagaacaaagcaaacagcaagaaagtccactggtggtaaggccccaagaaagcaattagcttctaaggctgccagaaaatccgccccatctaccggtggtgttaagaagcctcacagatataagccaggtactgttgctttgagagaaatcagaagattccaaaaatctactgaactgttgatcagaaagttgcctttccaaagattggtcagagaaatcgctcaagatttcaagaccgacttgagatttcaatcttctgccatcggtgccttgcaagaatctgtcgaagcctacttagtctctttatttgaagataccaacttggctgccattcacgccaagcgtgtcactatccaaaagaaggatatcaagttggctagaagattaagaggtgaaagatcatag

SEQ ID NO: 501 - DNA, 411 bp, Saccharomyces cerevisiae
atggccagaactaaacaaacagctagaaaatccactggtggtaaagccccaagaaaacaattagcctccaaggctgccagaaaatccgccccatctaccggtggtgttaagaagcctcacagatataagccaggtactgttgccttgagagaaattagaagattccaaaaatctactgaactgttgatcagaaagttacctttccaaagattggtcagagaaatcgctcaagatttcaagaccgacttgagatttcaatcttctgctatcggtgctttgcaagaatccgtcgaagcatacttagtctctttgtttgaagacactaatctggctgctattcacgctaagcgtgttactatccaaaagaaggatatcaaattggccagaagactaagaggtgaaagatcatga

SEQ ID NO: 502 - DNA, 411 bp, Saccharomyces cerevisiae
atgggagaaattttagaactaactaataagaatttcatgagccacttgaaaaaggacataacttcgcaagaatccttgaaaagtagaattgaggataaaaatggtgatgtcgctagcccgaaagaggataactatcctctattgaatgaaacagcggcatggccagatggggtgattacctctgaagaaggatgttcatcttcaggtgagaaagagaattcaggcttatgttcagaagaaagttcagaagaagatccagaagaagctgaagaggaatctgcaagggcttttggagagttagttgcagtcttgcgggacaaagacataccactgaatgtattggacgaacctcagatgaaagattggcttgaaaaatacaccggtgtttatagaagctcttggcatggttga

SEQ ID NO: 503 - DNA, 411 bp, Saccharomyces cerevisiae
atgtcctctgtggaatcttcccccatctcgcgctatgaagacgaggtcttccctctttcgttttcaaacgttgctttcgagccccctatgctctcgcatagcccggacagatcgacttatgccgatgacttttctcaatcttaccagcaagaattgctaacttttccgctatcgtacccgattgtcgatgagtcagaatgcacgcacactaaagataagacggacagcaacataataacgagtactgaagacgattgcatgttcgatatggaatttaacggcaacgccgccagtgcagttgctgctgctagtaaggaatctaactctgcctctgggtttgcctttgcaagtaacgatgcctttgccaatgtcgcacaacagaactacagactgtggttgtcatcggtatga

SEQ ID NO: 504 - DNA, 414 bp, Saccharomyces cerevisiae
atgatgaaaggttctagaagaacaggtaataacactgctaccacgctaaacacgcctgtggtcattcatgccacgcagctgccccaacatgtctctactgacgaggttcttcaatttctggagagctttatcgatgagaaggagaacattattgatagtactaccatgaataccatcagcggcaacgccgctgacgcggacgctgccgctgtggctaacaccagcctcaacatcgacaccaacctttccagctccatatcgcaattaaagaggattcagagagacttcaagggtctgccacccgcccaagacttttccgccgcgcccattcaggtctccacgacggagaagaaggagacaagcataggtgttagtgccaccggcggcaagaaaactacattcgccgatgagtga

SEQ ID NO: 505 - DNA, 414 bp, Saccharomyces cerevisiae
atggtagcatcatcgatcaatgaagaatcctctttggcggtaaacttgacaagcgatgtagagaaggcttcgaaaactttgtttaaggcattcgaaaagtcatacgcaaatgactacttgatgaaaaagttcttccatatcccaatcactgaaaaagtttcaagggcaagaataaatgcaatgatacattactacacgacgtgctaccatgacttggatggtgaaattgctgaggcaaatgatttcgatgcagtcgcaatatggagccgccctgggtgccacttgcctgctacactatctgacgacgagtctttcaataagatttttttttcacgacttgactgtgaggaagcacgaagtcatgcctctgggaatggactattactacctttatgccatcggaaaagatcctag

SEQ ID NO: 506 - DNA, 414 bp, Saccharomyces cerevisiae
atggtatgttggtgtgtgtgtgtgctgcttcacatttcaggctaaaaatgttatccgtggaatcttccttagccaagtatcatgggctttggaaattagtttcccaccgatgagcgcaacgacttagcgaagcttatgaaattggtgacagcagctctatgaatatgttccatgcgtttccattcaggttactaacaatgcataaattatgagtagtctttttcatcactatataaaacctttttcaaacgaaacgctgtttttgttggtactatctttgcaggtgcctttgttttccaaactgtatttgatactgctattacttcatggtacgagaatcacaacaaaggaaaattatggaaagatgtcaaggctcgaatagctgcaggcgatggagacgacgatgatgagtaa

SEQ ID NO: 507 - DNA, 414 bp, Saccharomyces cerevisiae
atgtcatacggcggatcggcatcccaagatatagtgacaaaattgattagaaaaatccaaaatacgtctgtgtcttgcaccaggagggatgaaaatctagattcttttaatcaacacttgaaaatgagtcttaaagttgcgcataacacgaagacatttgcaaagcattgccttcatcgacaagtattcaagaatacgtatcggaaaagaaaagcagtggaagatcaaaggaaaaacttgaacacgcaacttaggcaaaaatttgcgtcgccgtcagacaatttgctttcaccatgctctagaaaactgaatgatcacaagtcaaaacttttctcagccaaatcgcaacccaaaacactggagtttgtgcggggcaaacagaatataccacgcaagccgaatgtagacatttaa

SEQ ID NO: 508 - DNA, 414 bp, Saccharomyces cerevisiae
atgtctaaggttgcacaacagttaaaatttttgaataaaattagcgccactaccagactaccgcagattctagtcgatcctaaaaaatactcaggtcttagattgacttttcaaacgaaaaaccacaatggacatatgggtgccagagttttttggcataactacctacccactttgcagttctataatccaagaatgaagtttgacgtgataaggataaagaacgaagacaagcaaaaaagcgttccatgcaaactggagattttatctcatgaaggctccgttgtagagactattgatatgcgtaataaaatgcatgaagatataatgaaagacttacttgacaaaatagagcacgttcctcttcctgaaaatgagatcataagagttggaccgcaagaaagtattatataa

SEQ ID NO: 509 - DNA, 415 bp, Saccharomyces cerevisiae
atgcatccacagttagaagctgaacgttttcattgtaagtatccagattttacttcatatatttgcctttttctgtgctccgacttactaacattgtattctccccttcttcattttagcctgtttggacttcatcaatgcactcgataaatgccatcaaaaggaatattacaagagaatatttggcctttgtaacaacgaaaaggatgctttgaacaagtgtctcaaggaggcaagtttgaataacaagaaacgtgctgtcattgaaagtagaataaagagagctgatgtagaaaagagatggaagaaaattgaggaagaagaatatggcgaggacgctatattaaagactatcttagatagacagtacgccaagaaaaagcaggaaagtgacaatgatgcgaactcgaaataa

SEQ ID NO: 510 - DNA, 416 bp, Saccharomyces cerevisiae
atgcttttcttctcctttttcaagactttagttgaccaagaagtggtcgtagaggtatgttcataatgatttacatcggaattccctttgatacaagaaaactaacgggtatcgtacatcaatttttgaaaaaagtcaagtactaacgtttgtttacccctgtttattgtgtttccactcagttaaaaaacgacattgaaataaaaggtacactacaatcagttgaccaatttttgaatctgaaactagacaacatatcatgcacagatgaaaaaaaatatccacacttgggttccgtaaggaatatttttataagaggttcaacagtcaggtacgtttacttgaataagaacatggtagatacgaatttgctacaagacgctaccagaagggaggtaatgactgaaagaaaataa

SEQ ID NO: 511 - DNA, 417 bp, Saccharomyces cerevisiae
atgatatttctaaaatctgtcatcaaggtaatcgacaattcaggtgcacaattagcagaatgtattaaagtaataaggaaagggtcccccaagagtcctgcaatggttggagacagaatagtctgtgttatacagaaagcaaagcccttgactcaaaacattacggggacagccaacaccaaccgtgtcaaaaaaggtgatatttgtcacgcaattgtcgtaaggtctaaacagcgtaacatgtgcagaaaggatggctccaccgttgcattcggagatactgcttgcgttttgattaataaaaataccggtgaacctctggggacaagaattatggctaatgatggttgtgtagatagaacactgaaagacaagggatacaataagatatgctctttggcaagtagggtcatataa

SEQ ID NO: 512 - DNA, 417 bp, Saccharomyces cerevisiae
atgatggtaacgcgcaaacactaccgctatatatacctacaaaactctcattctctcatttcctgcttcgttcatttcgagtttccaagggtatggtacggtgctatctgcccgtgcttcccctcctttgctttgctaagaaaaattttcttttgtcagcagcaacaacacgctacgctctgcgctgtgctacgaagtggtctctgtggcaacggggacattgtacccatgcccgctcgcagggaggtctgggtgtggggcgtgtgcgacctcgttgccatggcgatcgcgcgtgggtgtggtctttccccaaacggttgcccgttgctccggatttcgcatagttgtcgcgtaaacaaaaaacacgagagagggcggacggcgctgaatagtggaagatcgcgcgatgtcaagtaa

SEQ ID NO: 513 - DNA, 417 bp, Saccharomyces cerevisiae
atgcaacctatcatcaagggagcagtaagctccacatttaaacgtgctctatacaatttcggtatcaaagaaaagaagagtgtcaatattgaaatggggagaacgcaacaaacaaagaaaatcgatcagtctttgtccaaaaaacttcccaaaggtactatctacgatccatttgacttctctatgggacgaatccatttagatagaaaatatcaggcaaacaagaactcaaacaggaacgatataatgaagtccggtgcaaatccactagaattttatgcaagaccaagaatactttcaagatatgtgacctccacgggaagaatccaacatagggatatcacaggcttatcggcaaagaatcaaagaagactatcgaaagccattagacggtgccaggcaataggattaatgtga

SEQ ID NO: 514 - DNA, 417 bp, Saccharomyces cerevisiae
atggacgctactcaaccgcaatacgaactatccgtagtaacacaatgcctaaagtctgccattgacgtcatccaatggttgattcctactattactaagttcagccaatcacacccgttagttttccaactattgtttattttcttcacattttatgtcttttacaagttgttgatgaacttcattactctggtcaaaagattcctgtatttgacgttggtagtaacatgtatcggtatttatatgcgtggttcgcagcagtttttgactgtggacctgttgaatttctacaatttcgtcatgtcaaatagatactacgcatttaaaatttatactctgtttattaatgccctggaaagagaaatcaacactgtttatcatttggcgcagatgaaaatggaacagttgcttaaatag

SEQ ID NO: 515 - DNA, 417 bp, Saccharomyces cerevisiae
atgggattgcgttactccatatatattgaaaatccgttatcttccccatcatcatcgtataaatcaataaacgacccgttattccactctcagcatcgatcgcaaaaaaacgtgagcttcatcacctacggttgtagacattgcaagacacatctttccagttccttccagattatttctagagattataggggtaggaccggaactgcttatttaatgaacaaagttgttaatgtcgttgaaggaaaggtcgagcaacgaagaatgttgactggcgactacttagtctgtgatattctttgtcattggtgcaagaggaacgtaggttggaaatacttgcagagcagcaatgatgatcagcagtataaggaaggaaagtttatcttagagctgaaaaacatttgtaaatgtacttga

SEQ ID NO: 516 - DNA, 417 bp, Saccharomyces cerevisiae
atgggtgcttggttatttatccttgctgttgttgtcaactgtatcaatttgtttggccaagtgcatttcacaatactatacgctgatttagaagctgactatatcaatccaattgaattatgttctaaagttaacaagttaattacccctgaagccgccttgcatggtgctttgtcattactattcttactgaacggttactggtttgtatttttattgaacttaccagttctagcttacaatctaaacaagatctacaataaagttcaacttttggatgctaccgaaatattcagaactttaggcaaacataaaagggagagtttcctaaagttaggtttccacttattgatgttcttcttctacttgtacagaatgatcatggctttgattgctgaaagtggtgatgacttctaa

SEQ ID NO: 517 - DNA, 417 bp, Saccharomyces cerevisiae
atgttgtgcgccatcaaaagcacaggttatcggtatcctcgcacgggagccttaaatctactacgtggacgaccatttaatatggccacccgaaaaataactactgaaaggatccccggccctcccaagctgccaagagaagagcaggaagagttcgaaagacttcagaggattgccacatcgcaagaggcaatagatcagtataatgcgcaggccaccggcgatcgtacaaaggagagtttgaattcaccgcttttaaccaaaaacgatattgggtcattctcgcctgaattttccaagaccatacctgaattcgaaggtgatgttaaccccaagactggtgaagttgggggtcccaagcaggacccgttgagacacggcgattattcgtttaacggaagagtaacggatttctag

SEQ ID NO: 518 - DNA, 420 bp, Saccharomyces cerevisiae
atgaaaaaagaaaaaaaaactccgacgccccttccatcacatcatgtactcttcgctgaaccgggtttttttctttgcaatttttttttcgttctcctaaagcatacacaaataaatccttttttttattttctatttattttgttatttatcatctatatagcaataatatactttgtttttattcgtatttcacacttttctttttccttatgcaggcagtgtaattcattggggaggatgattttcatgtgcgcatatctaccggctgcaagcagccggtcggtggcaaatccggcgcttccccctcaaaaaaaaaaaaaaaaaaaaaaaaagggaactctcagaacgggggaggttgaagagcaggccaagggaaatattagttttgacctatgtgggaaacagaattttcaatga

SEQ ID NO: 519 - DNA, 420 bp, Saccharomyces cerevisiae
atgctacattgcacccaggtgtgtctgagcgctctgacaaagagaacccacagggtcaaggttcaagtcctgaaggatttcccgcgatttcaattatataaaggacaagttgcaaatgtcaaaccatctttaatgagaaactatttacataacttcaatggtgcaaaatacatactcagcgaagaacacgacataaatacggaactgttaaaacaataccaaacacttgaggcaaagctagaggaagaccatcaacagctctctaaacgccatgaaacggaagttcaaaagaacatggagttacgtaaagaatctgtttttggccacaagaaagaagagaagccaaaagaggaaaagaagggattattggattctgggattactatcgaagaggttaagatccccggtcttgacatttga

SEQ ID NO: 520 - DNA, 420 bp, Saccharomyces cerevisiae
atgtggaaggccgtgatgaatgcttggaatggaaccgagagtcaaagtaagaatgtttcaaatattcaatcttacagttttgaagacatgaaaagaatcgttggaaagcatgatcctaatgtggttttggtagatgttagagaaccatctgagtactcgattgttcatattcctgcttccatcaatgtgccatatagatcgcaccctgacgcatttgccttagatcctttagaatttgagaaacagattggcatcccaaaacctgacagtgccaaggagctaatattttattgtgcttctggcaaacgcgggggagaagctcaaaaagtcgcctcctcacatggatattcaaacacctcactatatcctggctctatgaatgattgggtttctcatgggggtgataaacttgacttatag

SEQ ID NO: 521 - DNA, 423 bp, Saccharomyces cerevisiae
atgacagatagattaacacaattgcagatatgtttagaccaaatgacggagcaattctgtgctactttaaactacatagataagaaccatggttttgaacgattgaccgtaaatgaacctcagatgtccgataagcatgccacagtagtacctcctgaggaattttctaacacgatagatgagctatccacggacattatacttaaaacaagacagataaacaagcttattgactcgttacctggtgttgacgtttcagctgaagagcaattaaggaagattgatatgttgcagaaaaagctagttgaagtggaagacgaaaaaattgaggccatcaaaaagaaggagaaacttttaaggcacgttgattctttaattgaagattttgtagatggcattgcaaactcaaaaaagagcacataa

SEQ ID NO: 522 - DNA, 423 bp, Saccharomyces cerevisiae
atgatggaattcaaagtgtcaccattgacaaagattatttctctgtcaggattcctcgcattgggattccttttggtcatactaagctgcgcattattccataattactacccactattcgatattttgatctttttgcttgccccaataccaaacacaattttcaatgcaggaaataaatatcacacatctgacttcatgtccgattcatcaaacactggccaagatctggctcacttccttacaggaatgctggtgacaagcggtatagcactccctgttgttttctatcattgccaattgattggccatttgagttgtatcatgtgcatgatcggtggtcttatcatatattctagtattgttatttttaaatggtttttcaaaaaagatttcaacgaagatgattccctttttggttaa

SEQ ID NO: 523 - DNA, 423 bp, Saccharomyces cerevisiae
atgccctctctgcgagatttatcactagaaagggaccaagaattaaatcagttacgtgcccgtatcaaccagctgggcaaaacaggcaaagaagaagccaatgattttgttggtttaaatatttcaaatgaacctgtatatgacacggtgattcaaacaggacagagctctaacgcaacgaatagttttgtacaagaaactattcagaagacgaaacaaaaagagagtggtcagccatatattatcccccaaaaaaacgaacatcagcgttacatcgataaggtttgcgaaaccagcgatctcaaagccaaattagcgcctattatggaagtgctcgagaagaaaacgaatgaaaaaattaagggaataataaggaaaagggtattacaggaacccgaccgtgacaatgatgatagcggctga

SEQ ID NO: 524 - DNA, 423 bp, Saccharomyces cerevisiae
atggcactcaaaaagaatacacacaacaaatctaccaaacgagtaacgaaacacccatctttgaaaactctaacgcataagcaaatacacacaacaattttcgttaagtctacaacaccatacgttagtgcactgaaaagaataaataagtttctcgatagcgttcataagcaaggatcatcctatgttgcggttttgggtatgggtaaagctgtagaaaagacactggcattaggttgtcattttcaagatcagaagaacaagaaaatagaggtttacactaaaactatagaagttcttgatgaagtaataactgaaggccaagctgatatcgacatggaaagtgatgttgaagatgacgataaagaaacccaactaaagaaaagggctgtaagcggtgtagaattgcgtatttatgtttaa

SEQ ID NO: 525 - DNA, 423 bp, Saccharomyces cerevisiae
atggggctttgcggaagtaaaacccaaccaatgccttcacaaactacgacggtggcaactaaagcaagaacaaaaccaattaatcgtgatacagtcaagtcaaagcaagaacttcgacataaagagaagaaagataaaaagaagaagacacaactaaagagtacaactgtcccggttgtgcaaaggaaagaaggcagcaaattaactgatacaagtgatccgagcaaaaataaagttagcccaaaggaggccgcaaggttagctgctgagaagagatttcaagagacgaatgaaaagtacaataagggcgagttaggcaaaaagctagctcaagagcgtgccaagtctcataagactcgcttaatggaagaggccgagaaaaagcatgctgagagggaaagggaaaacatgatttatgactga

SEQ ID NO: 526 - DNA, 423 bp, Saccharomyces cerevisiae
atggttgtgaaagctattgcacgaaattccataggtcgtaatggagttggagcattcgtgtttccatgcagaaagattactttgcaattctgtaactggggagggtcttcggaaggcatgaggaaatttttgacttcaaagagattagataaatggggccaggagttcccatggatacagtttgaagtgatgaggaagtctggacatcctttgttgagggcagaatacacaaatgggcgtgaaaaagttatttgtgtgagaaacttgaacattgacaatgtagaaaacaagctaaagctattgaaggattctgatggagacattttacgcagaagaacaaagaatgataacgtggaaagcttgaacagtagtgtgaggggtatatggtcgcctctgcatgctgcgaaaaggcatagaatttag

SEQ ID NO: 527 - DNA, 423 bp, Saccharomyces cerevisiae
atgtatacaaaagagtactactggttttcacaatatatgataataacaagcactttggtgctcaccataatatggtccatcttaccatcatcgctgggtgaggctgcaccaaagcagtttatcaacacgctattggacatcttcccacaaagaagatggattattaccttggagagcataatgctgatgggcatgctatgcacatacatcggccttctgatgtacaatgaagatacattaacaccgccgctagattctctatctacagtaacggatgccggtggtcaacttgtaatagaggacgacccggacgtattcgttaagaaatgggcctttaaagaaacaagtggtatttacgatctgtctctgatggatgcctgccaacttctctacctatatgataacgaccataccagcacatag

SEQ ID NO: 528 - DNA, 423 bp, Saccharomyces cerevisiae
atgtcgtatgtttgatcttaaccatttttacatcctataatttggagtgaatttttatatactaacttaaaagtaattgatttgtatctttccagttcacaaataattgatcgtccaaaacatgaactctctagagcagaattagaggaactagaagaatttgaattcaaacatggtccaatgtccctgataaatgatgctatggtgacaagaacacctgtgataatctcattaagaaacaatcataaaataatagcgagagtgaaagctttcgacaggcattgtaatatggttttagaaaatgtgaaggagctttggacagagaagaagggcaaaaatgtaattaatcgggaaagattcataagtaaactattcttaagaggtgattcagttatcgttgtgttaaaaacccctgttgagtaa

SEQ ID NO: 529 - DNA, 423 bp, Saccharomyces cerevisiae
atgtgttgctactgtgtttgttgtaccgtttctgactttatactgtatattgttgcgttttttttccccccagctgcagtccttcttcgatctgggccttgttcatctgatttcctcctgaatgtattgctaacgctactgggatttttgcccggtatgttacacgcattctactacatcacaattacaagtcctttaaggaacgctgaatacgtctattattaccagcaaggctgggtggatagcgaaagaaacgttccttcgaatcgtcctcaaaactcgcagaccccccaaaaccgcccacaacaaggaagctccgctagaaacgtatacccgagcgttgaaactcctctgttacaaggcgcagctccccatgacaacaaacagtctctggttgagtctcctcctccttatgtgccatga

SEQ ID NO: 530 - DNA, 424 bp, Saccharomyces cerevisiae
atggaacaaaggaacaacggtatgcaaaatttcgatctctgggttttaataaatgcatgtagccaattttatcttactaacaatctttgtgttttctctgtgtatagtctttcaagcaaaatataatgaatacaaacaaattttggaagaattgcaaacaaaaatcatagaattaggtcatgacaaagatgaacacactatagtcataaaaacactgaaagacgctgagccgacgagaaaatgttacaggatgataggtggcgcacttgttgaaagtgatgttcaaacgagtttgcctattcttgaaactaagaaggaaaacatagaaggtacaataagtaaaatgaaagaaaccttaatacaaactgcaaaagagtttgaaaaatggaaaaaagacaataagattcaagtcgttaaaaactaa

SEQ ID NO: 531 - DNA, 426 bp, Saccharomyces cerevisiae
atgaacattaagactttgtgtcatccagaatataaaagaatctccgttgaatcgttattgaatccggtagaggagacaatagactgcgaaaaacctcactctcaaacaaaaatcaatactgctaaacccattagtgcatctttgtatgtcacaacgaataatactgctgttgttcagcacaatgtccaaaagaggaaaggcgtcaccaggagatgtccacagtgtgcggtgataaaaacttctccgcaatggagagagggtcctgatggagaggtgacattgtgtaatgcctgtggattattttatagaaaaatatttttggtttttggcaaggatctggcaaaacggtactttaacgaaataaaaggtgtgagcgtcaaacgaaaagttccaaagagcctctatggagttacaagaacgcgttaa

SEQ ID NO: 532 - DNA, 426 bp, Saccharomyces cerevisiae
atgctcatcgatcaaatcgtggcagcggtaccaggggtacctgatataagtggcaacgcttcggccctatcgttacagagacgcagtcaagagttcgccacctcatggatatcaatgacatatagtcagagttatggtgacctggcacagaactggcagaatgacgaaggtggagcaggaaattttgattcttatgctgaagagaagttacagaatttcttttcaggtaatagggattggaaatactgctttgctgctgaggacacgaaaaacggtgagccacttgattacgatgacatacctggtgacggtgcaggcacgggttcggcattcaagtctgagatatattttaacacttacggtggtatagataattattgtaatgacgagcatatcggtgctcagaacactggagatggtcgataa

SEQ ID NO: 533 - DNA, 426 bp, Saccharomyces cerevisiae
atgtcgaatacttgggacgatgtatgggcatcagacagtgatgtcgaaactgaacgatctccagatttagtgaagttaagagagaatcatagcaagagggggtacttggacggaatagtgagttctaaagaagaaaagctgcaagagggtttcaatgatggtttcccaacgggcgctaaattagggaaacaagttggcataattatggggattttacttggcctacgaacacgttttggtgatgaagatgaggacctcagtaaggcatatattgatgctcaaaaagaattacgcattaacaaagtacttagtaagtccatatttgatccaaactttgacttgcaagaaaaacatccgctcataacaaaatggactgatattgccaatacctattgtgaaaagtaccatgtgccatctatccaataa

SEQ ID NO: 534 - DNA, 426 bp, Saccharomyces cerevisiae
atgtcgtttgtttccaagcttctctatacagtctctgcattggtgttatttcattctggtttctcaagctatgagtttcatcacttattaaaacttaactcgcttaataatgcacaaggtgcaatcagcaagttacctaaagatatcatgtatgaaacgtatgcaggattgatactctttgttcttgcagtgttcacttcgttcgagaaattacaatatttaccaattgagagtaacgatgggaagataatatcccaaggaaactatctaaaagaaatcgcattaaataaagccaccaacgtggataacttgataggaagtaaccctaatggtgagatcatatttactccaagctttgttgacgttcatatgaagagaaaaatttgcagggaatgggcctctaacactgtaaaaaaagaaaaataa

SEQ ID NO: 535 - DNA, 429 bp, Saccharomyces cerevisiae
atgaaagtaggtggcatagaagacagacaactggaagccttaaaaagggcggcactgaaggcgtgtgaactctcctatagcccctattctcacttccgtgtcggttgttccatattaacaaataacgatgttatcttcactggtgctaatgtcgagaatgcaagctacagtaattgtatatgtgcagaacgatctgctatgatacaagttctaatggcaggccatcgctcaggatggaaatgcatggtcatttgtggcgattctgaggaccagtgtgtttccccttgcggcgtttgcaggcagtttatcaatgaatttgtggtcaaggactttccaatagtcatgcttaattccacaggttctcgttctaaagtcatgacaatgggagaactgctgcccatggcttttggtccatctcatttaaactag

SEQ ID NO: 536 - DNA, 429 bp, Saccharomyces cerevisiae
atgactgaagacatcgaacaaaaaaagaccgctacagaggtaacaccacaagaaccaaagcacatccaagaagaagaagaacaggatgttgatatgactggcgatgaagaacaggaagaggaaccagacagggaaaaaattaagcttctcacacaggcaacatctgaagatggaactagtgcctcttttcaaattgtagaggaggatcacacgcttggaaatgcccttcgttacgttataatgaaaaatccagacgtagaattttgtggttactcgatacctcatccttctgaaaacctattaaatatcagaattcaaacctacggtgaaacgaccgcggtggatgctcttcaaaaagggctaaaggacttgatggatttatgtgacgttgtagaatctaagtttactgaaaaaatcaagagcatgtag

SEQ ID NO: 537 - DNA, 429 bp, Saccharomyces cerevisiae
atgcggttaattttcattgcgaaaatgcttcaatattcatttctaccattttccccgttcaatcttttgaattttgataatagtataagcgtaagctggtttataacatactcagtgatcgtttccatttgggggtttgctgtgtggattgaaggagcatataggaataagattaatctacagcttccaagatgtacgaagataaaatgctcccgctacaatacgagaataaaatcccccaagtggttcaactgtaaaaattggatgcattttttcctattatacctttttctaaccgcttctaacttaattgttcaattggcctatttttcaaaagaaatgtgtagtcagggtataaacgttcctggaacgaagaaaccaggtaatagagtttatttatcggttatcatactaatggggaacgggtga

SEQ ID NO: 538 - DNA, 429 bp, Saccharomyces cerevisiae
atggcagatcaagtaccagttacaacacaactaccaccaataaaacctgaacatgaggtaccacttgatgctggagggagtccagtaggtaacatgggtaccaactcgaataacaacaacgagctaggtgatgtattcgacagaataaagacacacttccctccggccaaggtaaagaaaataatgcagacagacgaggatataggaaaagtttcacaagccacgcccgtaatagcgggcaggtccctagagttttttatagcgttattggtgaaaaaaagcggggagatggcaagaggacaaggaaccaagagaataaccgccgaaatactaaaaaaaacaattttaaacgacgaaaaattcgatttcttaagggaaggtctatgcgtagaagaaggccaaacacaaccggaggaagagagtgcctga

SEQ ID NO: 539 - DNA, 429 bp, Saccharomyces cerevisiae
atggcgtataatcaagaagatagtaaaagactatcagacaagtataagaaggagggacattttgacaagttgaaaagagaaatattgtctaacccatggaataatacagaagagaatagtgaatcttttgaacaagcgcttcggaaaagagttgccagtactgttaaagaaatggttaacgaagatgaagaattaatatttaaaaacagagggctaaccagtgcattgattgaatcacaattggtcaaggacaactacctaaagctgggtagtaaaatggagggggataatggtgatggtgagaagaaatttgacttggatgtctatgtacggtctaagttacaggatcccaaactattggaaatgataaagggacaacttcaggaaacactgaactcttatgaagaggaagcaaatggaagtacgtaa

SEQ ID NO: 540 - DNA, 429 bp, Saccharomyces cerevisiae
atgtcaggaaccggattatcgctattcgtgacgggtcttatactgaattgtttgaattccatttgccagatatactttactatattatatggtgatcttgaagcagactatatcaactcaatcgaactgtgtaagagggtgaataggttgagtgtaccagaggcaattctacaagctttcatttctgcattgtttctttttaacgggtactggttcgtatttctcttgaatgtccctgttctagcatataacgcaagtaaagtctacaagaaaacacatctactggacgccacggatattttcagaaaattgggtagatgcaaaattgaatgctttttaaaattgggattttaccttctcatattctttttctacttctacagaatggtcacagcgttacttgaaaatgatgcaaatttgataagctaa

SEQ ID NO: 541 - DNA, 429 bp, Saccharomyces cerevisiae
atgtctcaagctgttaatgccaagaagagagtttttaagacccactcttacagaggtgtcgatttggaaaaattgttggaaatgtccactgaagatttcgtcaagttggccccagctagagttagaagaagatttgcccgtggtatgacttccaagccagccggtttcatgaagaagttgagagctgccaagttggctgccccagaaaatgaaaagccagctccagtcagaacccacatgagaaacatgatcattgttccagaaatgatcggttccgtcgtcggtatctacaacggtaaggctttcaaccaagttgaaatcagaccagaaatgttgggtcactatttgggtgaattctccattacttacaccccagtcagacatggtagagccggtgctactacttcccgtttcatcccattgaaataa

SEQ ID NO: 542 - DNA, 432 bp, Saccharomyces cerevisiae
atggctaggcatttcggtatggccctcgccccatgggatgtcatgggaggtggaagatttcagagtaaaaaagcaatggaggaacggaggaagaatggagagtgtattcgttctttcgttggcgcctccgaacaaacagatgcagaaatcaagattagtgaagcattagccaaggttgctgaggaacatggcactgagtctgttactgctattgctattgcctatgttcgctctaaggcgaaaaatgtttttccgtcggttgaaggaggaaaaattgaggatctcaaagagaacattaaggctctcagtatcgatctaacgccggacaatataaaatacttggaaaatgtagttccttttgacatcggatttcctaacacttttatcgtgttaaattccttgactcaaaaatatggtacgaataatgtttag

SEQ ID NO: 543 - DNA, 432 bp, Saccharomyces cerevisiae
atgagcaaggctacgtgttcctttgagggctgtcatagtgcagttattaccatcaacgatgataacataataaacttaccagagcaggtgcacagcgaattcaagttgctggaaaacagaactatgcgagatgctacccccagcgagagcaacttcttggtcgtccctgatgtttgggactttgataatgttggtgtatctagagaaattccttcttctatattaggggatttgagtgataagagtgattttgtctttgagtatggtaattccagctggaagattaaaaagtgcttgaaatatttgatatgcgctgattgtgataaaggtcctattggaataatatgtaaggtgcaagatcagacaaagaatgaagaaagagttttgcatctactaagcttgcgaagccttcaaattatgggaaggaattag

SEQ ID NO: 544 - DNA, 432 bp, Saccharomyces cerevisiae
atggagaccaatttttccttcgactcgaatttaattgttattatcattatcacgttgtttgccacaagaattattgctaaaagatttttatctactccaaaaatggtatcccaggaaacagttgctcacgtaaaggatctgattggccaaaaggaagtgtttgttgcagcaaagacatactgcccttactgtaaagctactttgtctaccctcttccaagaattgaacgttcccaaatccaaggcccttgtgttggaattagatgaaatgagcaatggctcagagattcaagacgctttagaagaaatctcgggccaaaaaactgtacctaacgtatacatcaatggcaagcacattggtggtaacagcgatttggaaactttgaagaaaaatggcaagttagctgaaatattgaagccggtatttcaatag

SEQ ID NO: 545 - DNA, 432 bp, Saccharomyces cerevisiae
atggctagtgttttgttgcctcaattgcgtacgggatggcatgtggatcaggctattgttaccgagactaaacgacttgttgtcattcgttttggtcgcaaaaatgatagacaatgtatgatcatggacgagttgttatcttcgattgctgaaagagtaaggaactttgcagttatttatttatgtgatatagatgaagtttcagattttgatgagatgtacgagctgacggatcccatgacagtaatgtttttctaccacaataagcacatgatgtgtgattttggtacagggaacaacaacaagttgaactttattgtagacgacaaacaagaaatgattgacatattagaaactatattcagaggtgccaggaagaacaaagggctggtggtctctccatacgattataatcataagcgtgtttcataa

SEQ ID NO: 546 - DNA, 432 bp, Saccharomyces cerevisiae
atgggcaaaaaccatttcttgaaggatttctctgctttaccggaggacgtactcatagaaaacgagagaggcataactttacttggttacccactattttctcccaagattttactgcctcacgttgacccaccacaatttcaaagactaaacactgaaaatggctcgttaattgccctgtcgaaaaatactatatcgaacttcatagaactgtatcctatcgatctgagtactgaacgcactgcaggcagtagcagttcacagatgacaaagtggttcgtactgatggattacaaggaaaagtacgatattgacgatcaaggatggtgttatagctggaatttcaataactctaggtggaaatcgaaaaatggcttggtgagaagaagggtctgggtaagactacctacgaccagtcatggattagattag

SEQ ID NO: 547 - DNA, 432 bp, Saccharomyces cerevisiae
atggtcgttcacatcttgggtaaaggtttcaaaggtaaagaggtcattaaaatcgcactggcctctaaattttacggcataggtaaaacaacagccgaaaagatatgctcgaagttagggttctacccttggatgaggatgcaccaactatcagaaccccaaatcatgagtatagctagtgaactgtcgacaatgacgattgaaggagacgctagagcaatcgtaaaagacaatatagctctaaaaagaaaaattgggagttatagcggtatgagacatacattgcatctgccagttaggggccagcatacaagaaacaacgcgaaaactgcaaggaagcttaataaaatcgatagacgtggaattcacacattttctcaagcaaaagtacaacataatccgtccctttggtcttgtatctttggcaagtga

SEQ ID NO: 548 - DNA, 432 bp, Saccharomyces cerevisiae
atgtcagttattcctccaaaattcttcaagattgcaaatatatcaattggctgcatagacattattgctgccctttcacaattgacgtatattttcaccaatttaaacgtcttcctcttggcagtttacggactggcactctccgtacctatcgtctatctggagttcaaggttccgtcaaatctttacaggtatgcttccttttactttagttttcttggaaggggtttatcttatattttactaagtctgataatcagcttcggcggtatctacaacatattggcgggaatgtttacttttattttaggggttgcctttattgtttttcatttttcccagtttgtggaagaacctgctaacttcagagcacccggctcatctttgtcaattggtgatgatgacatcgacgatgacgatgacatgatttaa

SEQ ID NO: 549 - DNA, 432 bp, Saccharomyces cerevisiae
atgtctgacgttgaagaagtcgttgaagttcaagaagaaactgttgttgaacaaactgccgaagttactatcgaagatgctttgaaggttgttttgagaaccgctttggttcacgatggtctagctagaggtttgagagaatctaccaaggctttaaccagaggtgaagctttattggttgttttggtcagctctgttactgaagctaacattatcaagttggttgaaggtttggctaacgacccagaaaacaaggttccattgatcaaggttgctgatgctaagcaattaggtgaatgggctggtttgggtaagatcgaccgtgaaggtaacgccagaaaggttgtcggtgcctccgttgttgttgtcaagaactggggtgctgaaactgatgaattgtccatgatcatggaacacttctcccaacaataa

SEQ ID NO: 550 - DNA, 435 bp, Saccharomyces cerevisiae
atgatgataataatatttatagaattgtgtagaattgcagattcccttttatggattcctaaatcctcgaggagaacttctagtacattctacatacctaatattattgccttattaaaaatggaatcccaacaattatctcaaaattcaccaactcttcacatacatacctgcggtagcaagataggtacactttttctacgtttcacgaaggtagcgataggtacctcactcattgtaggtgcgggggtagcgatggaggtttctgtaccattaccaccacagccactatactcacgtagtgaagtccctagcgtggaattgtgtggtatcgttgctatctgtcgttcgccaccctcggtatatccaacgtgcaggccaatatcactctctaagaaaatcgtatcaggattggtacggacaaactcttcatag

SEQ ID NO: 551 - DNA, 435 bp, Saccharomyces cerevisiae
atgaataccaacgagtccgaacatgttagcacaagcccagaggatactcaggagaacggtggaaacgctagctccagcggcagtttgcagcaaatttccacgctaagagagcaggacagatggctacccatcaacaatgtagcgcgactcatgaagaatactctcccaccgagtgctaaggtatcgaaagatgcgaaagagtgcatgcaggagtgtgtcagtgagctcatttcttttgtgactagcgaggccagcgatcgatgcgctgctgacaaaagaaagacgataaacggggaagacattctcatatcattgcacgccttaggattcgagaactatgcagaggtgttgaaaatctacttggctaaatacaggcaacaacaggcgctgaagaatcaactaatgtatgagcaggacgacgaagaggtgccttga

SEQ ID NO: 552 - DNA, 435 bp, Saccharomyces cerevisiae
atgaccatattttctaggttctcatattttgatagtctattctcctttaaaaagcaagagccttcccccattgaaataatctattgcaatgaaaacaatggtttcataaacataaaatccttagaaagccccactgacgatagcatggaggcggacatttcagatagagaaatggctacaatcctgactagaaacagaaacaatttgggtaaggttgccattgataagaaaggcgttaataatcattgcatagatttgaatgagctgaaaaagggccttgtcgccaatgaacacaaattggataacgataactcaacacggcaccagaacacatattcaccagaggattccgtggaatttgataggttcgatgataaacaaagcagaatactaaagtgtagcactagaaggagctacttgagatacaagaaataa

SEQ ID NO: 553 - DNA, 435 bp, Saccharomyces cerevisiae
atgactttggcttttacgaccttcgctatttccaagataaacaattcgtccacgaatgaagattctaaagtcatgatactgtgcgatgagcatcaccctttcgagaagggttactttaagtccgccatacgagccttcggcaacagcattaagctaggattaatgggtaactcgcgaccagaagacgcagcgtccatattccaagataaaaatattcctcacgatctgacgacggaagaattcaggttgcagctggtctgtatggctttttcctggttcatatttggtctcttcatcgcctgcttactactttgtatcacgcttgtgctaacatcgcgatatcctggagaaaatgaaaacaaagccacggaagttgtgccatccagtaatattgacgacgaagaaaagcaattatcgctttccgacatgatttag

SEQ ID NO: 554 - DNA, 435 bp, Saccharomyces cerevisiae
atgggcaagaaagcacacggaggaaagatgaaacctgagatcgacgaaaatggtactctgctagtaccgccaccaaggacgattgcgaaccaggaccatttccatagattaaactacctctaccaaatatccgcttaccaaacaagagcaagacagaaagcaagaacagacgcacatacgcctttggcacgcaattatatcaaatcaatggacctaattagtaagaaaaccaagacatcactgcttcctacgataaagagaacaatttgtaaaaaatgccatcggttgttatggaccccaaaaaaactggaaatcacatccgacggagcgctttcggtaatgtgtgggtgcggtaccgttaaacgttttaatattggcgccgatcctaattacaggacctactcggagcgggagggtaatctactaaattcttag

SEQ ID NO: 555 - DNA, 435 bp, Saccharomyces cerevisiae
atggtttcgaagaaaaatacggctgaaatcagtgcaaaagatatatgggagaatatatggagtggtgtaagttcgctgcttgatttcttcgcagtattggaaaacctaggcgtggtcaacgataagttatatgtaagtgggctattacggaaagtttggctgtgttactcgtgcatttcagtgataaaatgtgtatggaaattaataaaattatgcaaggtgaaatttaaaatcgatcaacgattggatggggagggaaatggtctagtaaaggataagttgataaacttcaagaaaaaatataacgaacatatcagacatattactgctgctttactccaagatttgagctatttaatggttttaatctatccagggacgaggttatttaaaagattatctaacataataacactttgtagaataattgtataa

SEQ ID NO: 556 - DNA, 435 bp, Saccharomyces cerevisiae
atgtcaaattctaggtattctcagaccgaatcaaacgtatgtaaatcaccggcaacacgcataggtgtttagaatgggacctagcttgctatatggatgttataagctactaactattgcttctgtacaccggatgagcagatgtatcatcccttcatgtacatgtactttaaacagaatgataggaaactagaggggttagccaataaattagctacattcagaaacataaaccaagagattggagaccgagcggtctctgacagttctgtcataaaccaaatgacagattcattgggatcgatgtttaccgatatcaaaaattcgtcctcaaggttaacccgatcattaaaggctggtaatagcatatggagaatggtgggtttggcgttattaatattcttcattctatataccctgtttaagttattttag

SEQ ID NO: 557 - DNA, 438 bp, Saccharomyces cerevisiae
atggacccagagttacaagctattagggaagccagattggctcagttgaaaaacaacagtgggggtaccaacggcgatagaaatagcggtgctaataatggtggaggtgaaaattccgctcccgttggtgcagctattgcaaatttcttggagccacaagctttagaaagattatctcgagtggccttggtccgtagagacagggcccaagcagtagagacatacttaaagaaactgattgctacaaacaacgtcactcataaaatcactgaagctgaaattgtttcaatcttgaatggtatcgccaagcaacaaaattcacaaaataacagtaagattatcttcgaacggaaagatttcagcgaagatctgaattcatttgacaagcagaatgctaaaaatgatgacgacgaagatgatgacgacttctttgattag

SEQ ID NO: 558 - DNA, 438 bp, Saccharomyces cerevisiae
atggatagaaatgtatatgaagcctgcagcaatataattaaggaatttggaacacatgtagtgagcgccgatgaagtactcgcagaaaaaatagataatgctgttcctataccgttcaaaacaagggaggagatagatgccgacgtggaaaaagatagaaacgaaggagttttcgaaggtaatatcattcctgatatcgacctacgtgtagtacactactacgccacgcagttgtgtctaaataagtatcctcatttgattaacgcctttgatgagacaagccttataacattgggtttactcatcgaaaagtgggtaaaagactatctaaccagcatccagacagaacagggaaggcaaagtaaggtaatcgggaaggggccatgcgaattcatatcaaaacatattgattataggcatgcgccaggtaatatctga

SEQ ID NO: 559 - DNA, 438 bp, Saccharomyces cerevisiae
atgggtaaaagaaagaagtcaacaagaaagcctaccaagagactggtccaaaaattagatacgaaattcaattgtttattttgtaatcatgaaaaatcagtttcatgcactctggacaaaaaaaatagtataggaactttatcgtgcaagatttgtgggcagtcgttccaaacgcgcataaattcattatcacagcctgttgatgtatatagtgattggtttgacgccgtcgaagaagtcaattctggccgtggaagtgacacagatgatggtgacgaaggttctgatagtgattacgaaagtgattcagagcaagatgctaaaacgcaaaatgatggcgaaatagattctgatgaagaggaggtagactcggacgaggagaggataggccaagttaaaagaggcagaggcgccttggtagatagtgacgatgaataa

SEQ ID NO: 560 - DNA, 438 bp, Saccharomyces cerevisiae
atgggttccgagacaaaacattctgcaaaagtcaagattgtcacaagggaaagtcctccttccgccaaggagcacatgcgccccactaaaactcaaatattagttccaccgacgcagagtttgcccaatggcaagaaaccaaacttcggtaagtctacaaaacagcggcgagaacctagggaacgcacctcgaagacgggacacgaggacgataaggcaacgatggtcactgttaacatagatgccttcctacatgataaggcccctaaaaaaaaatcgtgcaaatacaagaagaagaaaacgagacagtaccaggatagggcggcggcgtcgatcgattcgaaaccgcacgtagctggtcatacggcctttgccggtgcttcgttcacaacagatatcccacatgaggcagcgctacccaaacctagttttgtttga

SEQ ID NO: 561 - DNA, 438 bp, Saccharomyces cerevisiae
atgtttttaagaaattccgttttgagaacagctccagtcttgaggaggggtataacaacattgaccccggtcagcaccaagttggccccacccgctgccgcctcttactcccaagctatgaaggccaacaattttgtgtacgtgtctggtcaaatcccttatactccagataacaagcctgttcaaggttctatctctgagaaggccgaacaagtttttcaaaacgttaagaatatcttagcagaaagtaattcttctttagacaatatagtcaaagtcaacgtattcttggctgacatgaaaaactttgccgaattcaactctgtatacgccaaacacttccacacccataagcctgcaagatcctgtgttggtgttgcttccttacctttgaatgttgatttagaaatggaagttatcgctgttgaaaagaattga

SEQ ID NO: 562 - DNA, 441 bp, Saccharomyces cerevisiae
atgaaaggctcacccatttctcaatttagtaagacctctattaatgctcttaccaggccttggaagaaatacagagatggtgaattattttatgggttatcaaaagttgggaataaaagagtgccgttgaccacgaagcaaggtaacaagacgatgtacaaagggacaagagcttcagggattggtagacatacaaaattcggtggttatgtgataaactggaagaaagtcagaacctatgttaccccagatatggttaatttcgaattaaagccctacgttaacgcaaatgtaccacctctaaaacacgaatttaaaggatttagcggcggcccattagatcctcgtttacagttattaaagataaaagaatacatagtaaacgggagggtacaaagcgaaggggccaccgacacttcatgttataaggagcgtggataa

SEQ ID NO: 563 - DNA, 441 bp, Saccharomyces cerevisiae
atgaagttggttaactttttaaaaaagctgcgcaatgagcaggttaccatagaactaaaaaacggtaccaccgtttggggtacactgcagtcggtatcaccacaaatgaatgctatcttaactgacgtgaagttgaccctaccacaaccccgactaaataaattgaacagtaatggtattgcgatggctagtctgtacttgactggaggacagcaacctactgcaagtgacaacatagcaagtttgcaatacataaacattagaggcaataccataagacagataatcttacctgattccttgaacctggattcacttttggttgaccaaaagcaacttaattccctaagaagatcgggtcaaattgcaaatgaccccagcaaaaagagaaggcgcgattttggtgcaccagcgaataaaaggccaagaagaggtctatga

SEQ ID NO: 564 - DNA, 441 bp, Saccharomyces cerevisiae
atgactatggatactgcgcaattaaagagtcaaatacaacaatatcttgtagaatcaggaaactatgaactgtatgataaaatattataggggttgtcttttttaaaaaatctactttactgactattcagatcaccgtcacatttattagaatttcaaacgaactaaaagccagactacttcaagaaggttgggtggataaagtcaaagatttgaccaaatcagagatgaacataaatgaatctacgaactttacccaaattttatccaccgtagaacccaaagcattaggtatgtgaatattttatcactaaatttattgaaaagagaacgttactaacagtggaatttttttttctagaaatggtatcggattcaacaagggaaaccgttttaaagcaaataagggaatttcttgaagagattgtagatacacaatga

SEQ ID NO: 565 - DNA, 441 bp, Saccharomyces cerevisiae
atgatagatttatacaattactctaacttagaaggtttactagacggattaacggacttgaatcgaattccgaaggaatactccgcagtattggagccatattttcagaatatagcaagaaatgcacatttaaagtctagagctctaaaaatttgtcgttctaatttccataaatggaacgaagaaggtgcgaagacagtcaatccggaaattataagaagatgccttaacctgtggtatgttttgaagggcaaggaatataaaaagttgaaggatcctccgcctgctgataatatcattaaggatgagattgatgtctcatatgttaagaatttgaatgtagtcaggttggaatttgacgaatttggtaaactcataagtaatccattagagaatttgatcttggaagaggtcgaagtgaatgatttcatacaagaataa

SEQ ID NO: 566 - DNA, 441 bp, Saccharomyces cerevisiae
atgatcagttcgtgtgttactagatgttttggtaggggtaaatgccttccagggcctgccactgcctcgatataccaaacgataagatgtatatccactaattcaaataaagctgctgaggcgccaatatttccaaagctggaagacgtgaagatgcatgagctcataggaaacaacaattttggtaaaaagacctactacgtggagagaagcaggaccggaaatctaccggtgtattccgcttataaaaatggaggtaacaagattatcacggagatcagaaagattgaaggagatgtaattcaactaagaaatgacttgcaggagcaactgcctttcatacccaaaaaatcatggtctgtggtgatgcaatcgaaaaaaattattatcaagggcaatgcagtagaggctgtcaaaagggtattaaccaagaaattttag

SEQ ID NO: 567 - DNA, 441 bp, Saccharomyces cerevisiae
atggcaaatactggctgtttatcaccaggtgcatttttatcaaaggttccagaatttttccagactgcgaatgaaaaacatataactgtgcgtctaacggccaaaagactcatagaacacgatcctgtggaagggaatcttgaatttgattctaccaaccatcctgactatgatgtatctaaaaaggcttctgaaatttcagttagctcaagatctgacagagaatacccactattaatcagaatgtcttatggctcgcatgacaagaaaacaaaatgctcaacagtggtaaaagcaagtgagttagatcaattttggcaagagtattcatctgtatttaaggggggcatgcagaatttgatcaagaagaagaaaaagaagagtaagaacggtaccatcagtaagacaggaaagaaaaacaaggtagcgaagaaaaactga

SEQ ID NO: 568 - DNA, 441 bp, Saccharomyces cerevisiae
atggttttgcctataataattggtttgggcgtgacaatggttgctctaagtgtcaagtctggtctcaatgcatggaccgtctacaagaccctgtcccctttaactattgcaaaactaaataacattcgcatagaaaacccgacggcgggctaccgcgatgcacttaagttcaaaagctcactgatagacgaagaactgaaaaatagattaaaccagtaccagggaggctttgcaccgcgaatgacagagcccgaagccttgctcatcttggatatctccgccagagagattaatcacttggatgaaaaattactgaaaaaaaagcacaggaaggctatggttcgtaaccacccagacagaggagggagtccctacatggcggccaagataaatgaggcgaaagaagttctcgaaagaagtgttttactaagaaagagataa

SEQ ID NO: 569 - DNA, 441 bp, Saccharomyces cerevisiae
atgtcagcatcagcttttaattttgcctttagaagattttggaatagtgaaacaggccctaaaacagtacacttctgggccccaactttgaagtgggggctggtcttcgcagggctaaatgatattaagaggcctgttgagaaggtatcaggagcacaaaatttatctttattagcgacggcactgatttggacgcgttggtcgtttgtcatcaagcccaagaactatctgttagcttccgtcaattttttcctgggttgcactgcaggctaccatctaacaagaattgctaactttaggatacggaacggtgattcttttaaacaggttattcactacataataaaaggggagactcctgcagccgtcgcagcaaagcaaactgcatccacatcgatgaacaaaggtgtgatcggtactaatccgccaataacgcactga

SEQ ID NO: 570 - DNA, 441 bp, Saccharomyces cerevisiae
atgtctaacactctatttgatgatatattccaagtctcggaagttgatcccggtcgttataacaaagtctgccgtatcgaagccgcatctaccactcaggaccaatgcaaactaaccttggatataaatgttgaattgtttcccgtcgccgcacaagattctttgacagtgactattgcatcctctttaaacctcgaagacaccccagctaacgactcttctgcgacaagaagctggagacctccacaggctggtgacagatcccttgcagatgattatgattacgtcatgtatggtaccgcttacaagtttgaggaagtaagcaaggatctaattgccgtttactactcattcggtggcctcttaatgagattagaaggtaactatagaaatttgaataacttgaagcaagagaacgcttatcttttgattcgtcgttag

SEQ ID NO: 571 - DNA, 441 bp, Saccharomyces cerevisiae
atgtctacttttaatgcagaaaccgctgataacttggaagatatcgagaaacaattcgctgttgttgctgttgaacaagcggaaacatattggaaactattaacaagtgttcccggttccaagttacgtttgactaagtttgatgacgaaatatacgagaattttatggagagattcccagaatacaaagatgttgaaagggtcaaaaagtttacggaggaagaattaaaaacaaaagaagccaaggaaagatggagaaagttcttcacaatttttgagaaaaaaatcgaagactataactttggtactttgttgaggacagacgcttcagccgagtatggtcaatttactacttgttttgtcgtgagactacaattttacgcttttgaaattgctagaaataaacacggcttgaacgattggattgtcggtcagaaatga

SEQ ID NO: 572 - DNA, 444 bp, Saccharomyces cerevisiae
atgactgctactagcgacaaagtactaaagattcaattgcgctcagcaagcgctactgtacctaccaaaggttctgccactgccgcgggatacgacatttatgcatctcaggatattaccattccggctatgggtcaaggtatggtttccaccgacatatcgttcaccgtacctgttggtacctacggtcgtattgcgccaaggtcaggcctggcagtgaaaaacggtatccaaaccggtgctggtgttgtcgacagagattacaccggtgaagttaaagtagttttattcaatcattcacagagggatttcgcgatcaaaaaaggtgatcgcgtagcccaattgattctggaaaaaattgtcgatgatgcccagatcgttgttgtagactctctggaagaaagtgcaagaggggccggtggctttggtagcactggtaactaa

SEQ ID NO: 573 - DNA, 444 bp, Saccharomyces cerevisiae
atgataactaaatacttcagtaaggtaattgtcaggtttaatccctttggcaaggaaggtatgtattttttttcgctctgttattcgttctccttacctttggccatcatgatttaaagatttggctaaactaggctgaggtaggctcgaaccgatctatcacaaatactaacagcaaatgatatggtcatatcattgatttcagcgaaagttgctaggttagtacttgctgccattccaccaacgcaacgaaacatgggcacgcagattcaatcggaaattatctcagattacaataaagtcaagcctcttgtgaaagtaacctacaaggacaaaaaagaaatggaagtcgatccatcaaacatgaactttcaggaattagccaatcatttcgaccgtcactcgaaacagctggatctcaaacatatgttggaaatgcattga

SEQ ID NO: 574 - DNA, 444 bp, Saccharomyces cerevisiae
atgcatcagcaacactccgtatgtttcacttcttattttcttccgtggcaataaccttccttttgacttatttatactaacattataataactatgtttcctttttgaactaagaaatcagagaacaaaccacaacagcaaaggaaaaaattcgaaggccctaaaagagaagctattctggatttagcgaagtataaagattctaaaattcgcgtcaaattaatgggtggtaaattagttataggtgtcctaaaaggctatgatcaactgatgaacttggtacttgatgatacagtagaatatatgtctaatcctgatgatgaaaacaacactgaactgatttctaaaaacgcaagaaagctaggtttgaccgtcataagaggtactattttggtctctttaagttccgccgaaggttctgatgtactatatatgcaaaaatag

SEQ ID NO: 575 - DNA, 444 bp, Saccharomyces cerevisiae
atgctggcacaaacattcaaaaaaccacacagagccgttctagaacaggtatctgggaccacggtcttcatcagaaataagagaacaaagagcaagagctcactgtcacctttggcacaaagggtcgtcacgcagttgagtgtgatgtctgcaagcagaaagcagcccaagttgctgaagctggcgcgtgaagacctgattaaacatcagaccattgagaagtgttggtcaatttatcagcagcaacaacgggagcgcagaaatttacagttggaattacaatataagagcattgagagatctatgaaccttctacaagaactcagccctcgtctgtttgaggctgccaatgcttccgagaagggcaagcgattcccgatggaaatgaaggtgcccactgacttccccccaaatacgttatggcattataacttccgaaaatga

SEQ ID NO: 576 - DNA, 444 bp, Saccharomyces cerevisiae
atggcagtacagtttatactgtgctttaataagcagggtgtggtgcggttggtgagatggttcgatgtacacagttcggatcctcagcgtagccaggatgccattgcgcagatttatagactcatatcttccagagatcataagcatcagagtaacttcgtagagttttccgattcgacgaaactcatatacaggaggtatgcgggtctgtattttgtcatgggtgtggacttacttgacgatgaacccatatatttgtgccacatccatctgtttgtggaggtgctagatgcatttttcggcaatgtctgtgaactggatatcgtattcaacttttacaaagtctatatgataatggacgagatgtttattggaggggaaatacaagaaatttcaaaggatatgctgttagaaagactaagtattttagatagactagactag

SEQ ID NO: 577 - DNA, 444 bp, Saccharomyces cerevisiae
atgggaattattacactatccggcaatgttctacatttattgaaagcctacccaaaaaagggccttgaagaggtttctcaaccagagcctaatacagcaaatgattcctcgactgaatataaaggaaaaagcaaggatgattttcaaatggtcgaaaaatccaatacagatgagagatacaattttacaagaacgaaaaaatggtttttattgatgacctcagaatattacaaactaatggaaaacagacttttaatgttttgcattatcgcttgctcttttatttgtgctatccaatttcttttctttataatttattggaccaacattgttccacggaagacgcaaagggcaataactaacctaaattacgattatttaacagcccatctaaaagagcaatgcgttccatatgcgaaaattcttgaccaatgtattctctag

SEQ ID NO: 578 - DNA, 444 bp, Saccharomyces cerevisiae
atgggcatgttggaactagttggtgagtactgggaacaactaaagataaccgttgtgcctgttgtggccgcggccgaagatgacgataacgagcagcatgaagaaaaggcagcagaaggagaagaaaaagaagaagaaaatggggatgaagatgaggatgaagacgaagacgaagatgatgatgatgatgacgacgaagatgaggaagaagaggaagaagtcactgatcagttggaagatttgagagaacatttcaagaacacggaggagggtaaggcccttgtgcaccactacgaggagtgtgctgagagagtcaagatacagcaacaacaacccggctacgcggatcttgaacacaaggaggactgtgtggaggagtttttccatctacagcactatttggacactgccacggcacctagattatttgacaaattaaagtag

SEQ ID NO: 579 - DNA, 444 bp, Saccharomyces cerevisiae
atgtcctccaatcttaccgaagaacaaattgctgaattcaaagaagcctttgccctctttgataaagataacaatggctctatctcatcaagtgaattggccactgtgatgaggtcattgggtctttcgcccagtgaagcagaagtaaatgatttgatgaacgaaatagatgttgatggtaaccatcaaatcgaatttagtgaatttttggctctgatgtctcgtcaactcaaatcaaatgactctgaacaagaactactagaagcttttaaagtattcgataagaacggtgatggtttaatctccgccgctgagttgaaacacgtgctaacatccattggtgaaaaattgactgatgccgaagtagatgatatgctaagagaggttagtgatggatcaggcgagatcaacattcaacaattcgctgctttgttatctaaatag

SEQ ID NO: 580 - DNA, 447 bp, Saccharomyces cerevisiae
atgaacaaaattcagcaaatcaacgataaagaactacaaagtggaattcttagcccgcatcaatcatggcataatgaatataaggataatgcttatatatatatcggaaatctcaaccgagaattaacagaaggtgacatattgacagtcttttctgaatatggagtccctgtagatgtaattcttagcagggatgaaaacacaggagaatcgcaaggttttgcatatttgaaatatgaggatcaacggtcaacgattctagcagtcgataatttaaatggatttaaaattggcggtagagccctcaaaattgatcatactttttataggccaaaaaggagtttacaaaaatactatgaagctgtaaaggaagaattggatcgagatatagtttcgaagaacaatgctgagaaactcattttggctaaaaaggaccaaccaaattaa

SEQ ID NO: 581 - DNA, 447 bp, Saccharomyces cerevisiae
atgaatatcgtcccacaagatacctttaaatctcaagtctctacagatcaagacaaaagtgttctttcatctgcagtgccctccttgccagacacattacgccagcaagaaggcggtgcagtacctctttccacacaattgaatgacagacatccattagaatcaacattgaagaactgggaaaccacacagcgccaaagacaaatggaacagtatcgacaaatatttggcattgccgaaccaatgaaaaggacgatggaaatggaaatcgtcaatcgtaccgacttcaaccccctttcaacaaacggtagtatacaccgtgacatactactgaacaaagagtgcagcatcgattgggaggacgtctaccctggtactggcctacaagccagcaccatggtaggtgatgacgtccacagcaaaatcgaaaaacaattaggcatttaa

SEQ ID NO: 582 - DNA, 447 bp, Saccharomyces cerevisiae
atgcccaaatcccgaccaaaaaggaccattgcgtcttcctcgtcagttttttatggaagttcacctttccaaaatgatggctacatcaaagtaatggaactcgtatcacacattgtcattgaaataaatcattcacctaccgcaacaacggatgaaacgagaaagcagaataatccggagctgaaagtgaaagaaccagtttgtaacctcaagaagtgggaaaataacactaactttatattggaagatcatacgaagaataaaacaaaactttctagcacagataggatacgtaagtggtttagaagacatatattaaaggaagagatcgaaatcctttcccatggaaaacaattgagtagtattgatgaggattattgcccttcaaatgttcttgtaggatgttcaagagatctaaataaactcagatcatttcaaaatttttag

SEQ ID NO: 583 - DNA, 447 bp, Saccharomyces cerevisiae
atggactcgtactcaataacaaacgtaaaatacctggatccgactgaattgcatcgttggatgcaagaaggacacactactacgctgagggagcctttccaggtagtggatgtgcgaggctcagattatatggggggccatatcaaggacggatggcactacgcctattcgcgccttaagcaggatccggagtacttacgtgagctaaagcacagattgttggaaaagcaagcggacggccgcggagcgctgaacgtgattttccattgtatgttatcgcagcagcgcggaccgtctgcagcgatgctgctgcttcggtcgcttgacacggcggaactttctcgctgtcgtctatgggtgttgcgtggggggttctcgcgctggcaatccgtatacggtgacgacgagagcgttacggcgggttacctacccgatctgtggcgttga

SEQ ID NO: 584 - DNA, 447 bp, Saccharomyces cerevisiae
atgggcacatatacgccattaatatacaatatatataacgttcatatatgggtatttacagagagccaggggcaaattggacagatgtctccacgcggcaaaatggaaacagcagtttcacaaggacaacacaaacaacttaaagatggtcaccagcataagggaagaaaactctccgaggagatcgcttctctattgaggctcaaagagtgcaggaggctcaatcctgctagttactatactccacgtagaacatcgcagtcacaatctctcagtggatcaacttttaaagagtataacgagtacattaatgagaaagattcaagtagagcgcagcgtcaaaacgctgccgccgttttaagcaagctcgcccatgacttttgggagaacgactgtgtcattgacgaagacatattcgaagattcgtctgacgaagaacaatcatga

SEQ ID NO: 585 - DNA, 447 bp, Saccharomyces cerevisiae
atggtttctaccgctacatttttcttttttgtttacttaacccttttcgtagtgataggtttcttctcctcattattcataatacccttattgggcatttcctttgtgtttgccattggcgtggtatcatttggcttctgcagcaacatgagtttcaaaatggcccaactcatttatgtccgagctgacgccttcttgaaaaaagtcctcgacaaaatggccctacaaacacagccggcacaactacaggaaccacaggagccactttccacattaaggccagtatctaatccaactattccaagcccattaagacaaacggcgcgcccttctaaattcgtcaccgaagaagatgttattttcgaacctgttagtgctcaaagcgccattgcccgttcattagagactactgctaataaagcgggtaataagttccagctctcttaa

SEQ ID NO: 586 - DNA, 447 bp, Saccharomyces cerevisiae
atgtgtgaatcatcaaataagactgaaaatgatatagtcagattgtcacaagctatggatgtcctggctaagttgatcatttcaaagcaaaaagatggatcacaattacaagttgagtacgagcataagttgaaagaattagagaaattcattaacctactactgggattgcatgaaagcactgtgggaagtatgatgaatactagtgttcttgacatggtactgcggaatggaatagagatcatggaaaaagacgatcaaaaatatgccctgataccgattaaagccaaggaagaggcagataaaactacgagcactattcagggagtaaccagcaaaaagagtagtaaaaagaaaaaaaataagataaaatgttcattttgtcacgaggctggccacacaagggcacactgcggtgcgagactgacagttatacccaagaaataa

SEQ ID NO: 587 - DNA, 447 bp, Saccharomyces cerevisiae
atgttagtaaagacgattagccgaactattgaatcagaatctggatttctacagccgacgctggatgttattgctactctacctgcagacgatcgttctaaaaaaatacctattagtctggtagtgggatttaaacaagaggcctcgctgaattcatcttcatccttatcatgttattactacgccattcccttaatgagggatagacatattaacctcaaatcaggcggaagcaacgttgtggggataccgttattagatactaaagatgaccggattcgtgatatggctagacacatggccacaataatatctgaaaggttcaataggccgtgttatgtaacgtggtcatcgctgcctagtgaagatccctctatgctagtagcaaaccatttatatatcttaaagaagtgtctcgatctcttgaaaactgaactcggtgagtaa

SEQ ID NO: 588 - DNA, 447 bp, Saccharomyces cerevisiae
atgttatcaagggccatattcagaaatccagttataaatagaactttattgagagccagacctggtgcttatcatgcaactagattgactaaaaatacgtttattcaaagtaggaagtattctgacgcacatgatgaagaaacctttgaggaattcaccgcaagatacgaaaaggagtttgatgaagcctatgatttgtttgaagtgcaaagagtgctcaacaactgtttttcctatgatttagttcctgctcctgctgttattgaaaaagctttgagggctgccagaagagtcaatgacttacctaccgcaattagagtatttgaggctttgaaatacaaggtggagaatgaagaccaatacaaggcctacttggatgaattgaaggatgtcagacaagaattgggcgttcccttaaaggaagagctatttccaagctcttcttaa

SEQ ID NO: 589 - DNA, 447 bp, Saccharomyces cerevisiae
atgttcagcctacaagacgtaataactacaaccaagaccaccttggcagcaatgccaaaaggttacttaccaaaatggttacttttcatttccattgtatcagtcttcaattctatccagacttacgtttctggtttagaattgacacgtaaagtctacgaaagaaaacccactgaaacaacccatttgagtgcaagaactttcggtacttggacctttatttcctgtgttatcagattctatggggctatgtacttgaatgaaccacacattttcgaattggtcttcatgtcttatatggttgccctattccacttcggctctgaattattgatctttagaacttgtaagttgggaaagggattcatgggtccattggttgtctcaaccacctctttggtttggatgtacaaacaaagagaatactacactggtgttgcttggtaa

SEQ ID NO: 590 - DNA, 447 bp, Saccharomyces cerevisiae
atgttgtctaacgctaagctccttctatcattggccatggcctctacggctctcggattggtatctaattctagttcctctgtaatcgtggtaccatcaagcgatgctactattgccggtaacgatacagccacgccagcaccagagccatcatccgccgctccaatattctacaactcgactgctactgcaacacagtacgaagttgtcagtgaattcactacttactgcccagaaccaacgactttcgtaacgaatggcgctacattcactgttactgccccaactacgttaacaattaccaactgtccttgcactatcgagaagcctacttcagaaacatcggtttcttctacacatgatgtggagacaaattctaatgctgctaacgcaagagcaatcccaggagccctaggtttggctggtgcagttatgatgcttttatga

SEQ ID NO: 591 - DNA, 450 bp, Saccharomyces cerevisiae
atgaatctacagaacaacgttttaaatcagatacaccagattctgctgcctacgaatcctactctcgataaacctaatgctgaggctacaaaggaagaattttcgtctgcagaaaatagagatgaaaaagactatcttaccaaccagcagccgaaaaatctgagtactccctccaccagttccaacggtgaatttataccgcatattttttattcgctgcaccaaataaggaaggatccaaacaatctctcaaatcaattggaaaccttaacaggttcgattagacatcgtttgaaactttgtaaatctttgatatcggaaaacgaagataccaaggatttattaagtaaaagtccatcagaatggcaggatatcatccatcaacgtgaacaagaactgcaaattaagagagacgtcttggatgatctttatcgcaagttacaacgataa

SEQ ID NO: 592 - DNA, 450 bp, Saccharomyces cerevisiae
atgaatctatacggttattttttacttctcattattgtgattgctttcattgcattgttgccattgttttctggcatcggtacattcaaactaacaaaaccgaaatcgtctgcaacagcacagtcagcgactggtaagcttggtaagagggaatatttgaaaaaaaaacttgatcataccaatgtattaaagtttgatctgaaggacacggaggaaagccttggccatgacagtgcaagtgcctcttccgcttccagaaaatttgaaatagactcaaagacaggccttaaaagacgtgtaattggacagtacaacaaagatccaaatgatttcgatttcgatattgatgacctaattaacgaagatgaactagatgaacggagagaagaagagaaaaagttgaagaagtacaatggtaagaaaaatgaagcttacgaaggatttgtataa

SEQ ID NO: 593 - DNA, 450 bp, Saccharomyces cerevisiae
atgcctgtagatcaagaaaaattagctaagctgcacaagttatcagcagcaaacaaagttggtggtaccagaaggaaaataaacaagaaaggtaatttatataataacaatgacaaggataataccaagttacaagctgaacttcataaactgcatccaatgaccattgaaaacgttgccgaagcaaattttttcaaaaagaatggcaaggttttacattttaacagtgcagttgtacagattgcccctcaatgcaatctcacaatgattcatggccaaccgaaagagaatacacttaatgggctgtatccgagcgtagcctctcaattaggtagccaagaacttgagtatttgacaggtttggctcataacctagaaaatgaacagacggtgctcgaccagctgggcgacagatgcagcgagacaaaacaacaagtgatgaatagctga

SEQ ID NO: 594 - DNA, 450 bp, Saccharomyces cerevisiae
atggctcacagggctttcatacaggttataatcacaggaactcaagtttttggaaaagcattcgccgaggcgtatagacaagcggcttcacaatcagtgaaacaaggtgctacaaatgcatctagaaggggaacaggaaaaggcgaatatggtggtattacgttggatgagagttgtaaaattttaaatattgaagaatccaagggcgatttaaacatggacaagattaataacaggtttaactatctatttgaggttaacgataaagaaaaaggtggaagcttctacttacagagcaaagtttatcgagcagcagaaaggttaaaatgggaactggctcagagagaaaaaaatgcgaaggcgaaagcaggggacgcttcaacagcgaaacctcctccgaattcaacaaattcatctggtgcagataatagtgcaagcagcaatcagtag

SEQ ID NO: 595 - DNA, 450 bp, Saccharomyces cerevisiae
atgtcagccaccagagccaataaagatattttcacactattcgacaagaagggtcaaggcgccattgccaaggattccttgggagattacctgagggcaattggctacaaccccaccaaccagctcgtacaggacatcataaacgcggattcgagcttgagagacgcctctagcttgacgctggaccagattacaggcctaattgaagtcaacgaaaaggaattggatgcaactaccaaggcaaagacagaagacttcgtcaaggcattccaggtcttcgacaaggaaagtacaggcaaggtatccgttggtgacttaaggtacatgctaactggcttgggtgaaaagttaaccgacgctgaagtagacgagctgttgaagggtgttgaagtggacagcaacggagaaattgactacaagaagttcatcgaagatgttttgagacaatga

SEQ ID NO: 596 - DNA, 450 bp, Saccharomyces cerevisiae
atgtcgaacctctacaaaattggaactgaaactagaaataaaatcaagaagtttcgtacatctacagcaagaaccgactccataaaagctttatcaataaagatcgaaccaaaaccgtcctatgagataattgtcgatgaagacgaacaagaagagctagacgaaattgaagatttgagcgaattagccgagatcctacctgataactcacctagatttgtactaactgcatatccaacaacaacaaaagatgggttcaaacagactcccttagttctagtatattggaagccaatgacggtcgtttcacaggaatggaagatgctttatgccggcgcattagaaatgatcagagaggagtgcggtacttttaaattgatagaggtttcttcaggtttggaggatgactcagacgttgaagaattgagggagcaattagaaaattgttag

SEQ ID NO: 597 - DNA, 450 bp, Saccharomyces cerevisiae
atgtctaacgaatctaacgaccttgaaaaaaacatttcgcacttggacccgaccggtgttgacaatgcttatattccacctgaacagccggaaacgaagcattcgcgttttaatattgacagagataccttaagaaaccactttatcgctgctgtgggtgagttttgcggtaccttcatgtttttatggtgtgcttacgtcatttgtaatgtcgctaaccatgatgtggctttgacaaccgagcctgagggctctcatccaggtcaattgatcatgattgcccttggtttcggtttctctgtgatgttttctatctggtgtttctggtggggctttgaacccagccgtttctctctctttgtgtttggccagagccatctcaccagccagatgtgtagtgatgtggtttcctcagatcattgctgggatggctgctggtggtgccgctag

SEQ ID NO: 598 - DNA, 450 bp, Saccharomyces cerevisiae
atgttcaagcatagtacaggtattctctcgaggacagtttctgcaagatcgcctacattggtcctgagaacatttacaacgaaggctccaaagatctatacttttgaccaggtcaggaacctagtcgaacaccccaatgataaaaaactattggtagatgtaagggaacccaaggaagtaaaggattacaagatgccaactacaataaatattccggtgaatagtgcccctggcgctcttggattgcccgaaaaggagtttcacaaagttttccaatttgctaaaccacctcacgataaagaattgatttttctttgtgcgaaaggagtaagagccaaaactgccgaagagttggctcgatcttatgggtacgaaaacactggtatctatcctggttctattactgagtggttagctaaaggtggtgctgacgttaagcccaaaaaataa

SEQ ID NO: 599 - DNA, 453 bp, Saccharomyces cerevisiae
atgaaacagcgtttttctcaagtagcaactgttatattcttcgtcatgagtatccgttctccaagaaatctcggctttttttttactcttgccctttttgtcgtacttgtttgctcccaggaatggttctcctttgaaatgaatagatcttgttcaatgaaagtggaacatagaatgcaatttttgtcaactataatcagtgaacatcagaaatcggatgtgaattgttgggaccaaatcgcaaagaagatgaatgtatacttatttgagcagaaagtttccggctcagacgtgtttttcttagatggagcagattgtgagcgctttttcgaacgtaatttcctccgttatctaccctcaagaaagtcttcccatcctgacctaccaattgctgaattgttgccgtatatcagaaaagccgacattgcctgtgctggtaagcaattgatttaa

SEQ ID NO: 600 - DNA, 453 bp, Saccharomyces cerevisiae
atgcagtttgaagagcggttgcaacagctagtagaaagcgattggagcctggatcagtcaagcccaaacgtactggtgatagtccttggagacactgccaggaagtacgtagagttaggaggactgaaggagcacgtgactacgaacactgtggcaggtcacgtggcaagccgggagcgggtatccgtagtttttttgggccgggtaaagtacttatacatgtacctcacccggatgcaagcgcaggcgaatggtccgcaatactctaatgtactcgtctatggattgtgggatctcaccgcgacacaagatggaccgcaacagctgcggctacttagccttgtgttacggcagtgcctcagtctgccatctaaagttgaattctatccagaaccgccttctagtagcgtgcctgcccggctattgcgattctgggaccatattatcagatag

SEQ ID NO: 601 - DNA, 453 bp, Saccharomyces cerevisiae
atgcttttattttcttcttttttttctcacaacaaatgtccgaaacaaaaaaaggggcctcagccattaaaggtagtgaaaggcacttctaagagttgcgccaaacaagggaagattaaagggaaagaaaagctctggcaggctaaaactggcagactggtcatgagtgaaactggcgaaacttcagagtattataagcaggcgctggaagaatacaaagaggtccaagaagacgaagacccggatgtgtgggacacgagaatatccaagaccggatgctacgtagagaacctcgcattacagctgtgccatgccgaaacaggtgactggaggcagtgcttcaacgagatggcgttatttaggaagtgttgggaaaagaatggtaatagagagcgcgtaagcacagtggacgtggatgggacgaccagtaaggattcggaaaagaagaaatga

SEQ ID NO: 602 - DNA, 453 bp, Saccharomyces cerevisiae
atgggcaatttcattataacagaaaggaagaaagcaaaggaggaaagaagcaatccacaaacagatagcatggatgatttgttaattcgtagactaacagatcgaaacgacaaggaggcccatttaaatgagttgtttcaagataatagtggcgccattggtggcaacattgtcagccatgacgatgctttattgaatacactggcaattctacaaaaagaactgaaaagtaaggagcaagaaatacgaagattgaaagaagttattgcgttgaaaaataagaatacggaaaggttgaatgacgaattgattagtggaaccattgaaaataatgttttacaacaaaaactctcggatctgaaaaaagaacattcccagctagttgcgagatggctaaaaaagacagagaaagagacagaagccatgaacagcgaaatagatggaacgaaatga

SEQ ID NO: 603 - DNA, 453 bp, Saccharomyces cerevisiae
atgtaccatcactatcacgccttccaaggcagaaagcttactgaccaagaaagagcacgcgtgttggagtttcaagattccattcactattctccgcggtactcagacgataactatgagtacaggcatgtgatgttacctaaggccatgctaaaagttatcccatctgattacttcaattcggaagtggggaccctgcgtatattaacagaagacgaatggagaggcctcggcatcacacagtctttggggtgggaacattatgaatgccatgcgccagaaccacacattttgctattcaaaaggccgctgaactacgaggccgagctgagggcagcgaccgctgctgctcaacagcaacagcaacagcagcaacagcagcaacaacaacaacagcaacatcaaacacaatcgatttcgaacgatatgcaagttccaccccaaatctcctag

SEQ ID NO: 604 - DNA, 453 bp, Saccharomyces cerevisiae
atgtctcaacccactcccatcataactacaaaatcagctgctaagccaaaaccaaaaatttttaatttattccgcgtttgcttcatttcattattgctgatcgctgcggttgaatacttcaagtatggtacaagaattaactatgaatggttccattgtaccccaatcaaagaaccccagtctggctcagtaatcaagctttgggcacgtggtgggccaagttgtgacaaaagaggcgaatataaaactatagtaaagagaatcactagagattatgaaccaaatgatgaacatctctcgttctgtatcatcgagaatgataatgttccacccgtccactacccaattcacgaagataaaggtgaacctggctacgtagcttatgtcgggtacgacacagactctgagctggttcaagaactatgtgctgattccacaatttatcacatgtga

SEQ ID NO: 605 - DNA, 453 bp, Saccharomyces cerevisiae
atgtctgatataaacgaaatcgaaattccatccagaaaggatgaaattagacaagttactcccaaggatcccatgcatgagatcgaggataaaagcacataccacgctaagataaagaaatcagattccgggaccgtcctgggtgctataccgttgaattcaaggtcttctagtaactctagcgtgacatcgacgggtcagagcagtaggcgggtgactaagaaaacgaccaagaagaaaaagaagaatgcttgttatttcgatacctgttcaagtgcggcttcgaaattcatcggtgactgtaatttttgcaaaggtcacttttgctcgaaacacagattaatggaaaaccatgcttgtaatggcttaacgagctgcaaagaacagctacatcaaagaaacgctgataagctagaagctgaacaaactaaggctccaaagatacaaatttaa

SEQ ID NO: 606 - DNA, 453 bp, Saccharomyces cerevisiae
atgtgctcagcaggcggtatcagaagaccaatccagatcgaagaatttaagacggcgataagcggcatgtccgacatggagttggcacagattaaaacagaaattgagaacagtatcaatcatttgcagaggtctaacgcccgcttgggtaaatacatagctaagttggagggtgctgacgaccgtcttgaagctgacgacagcgacgacttggagaacattgattcgggagacctggcgctgtacaaggactctgtcagggagaacgaaattgtgctaaacaattacaatgagagagtggacgcattggagcaagaaacggtatatagaaagacgggccatggcaagagtaagcacgaggtagaggcaaaggacaacaccaacaagggccctgacgttgacatggacaattcaaatgtggacgtcgtgacaccaaacagcatattcatttaa

SEQ ID NO: 607 - DNA, 453 bp, Saccharomyces cerevisiae
atgtttctcccaaaattcaatcccataaggtcattttcccccatcctccgggctaagactcttcttcgttaccaaaatcggatgtatttgagcacagagataagaaaagctattgaagatgccatcgaatcggctccagtggttcttttcatgaaaggtactcctgaatttcccaagtgtggattttcaagagcaaccattggattattaggaaatcaaggcgttgacccggccaaatttgcggcttataatgttttagaagacccagagctacgtgaaggtatcaaagagttttcagaatggccaactattccacagttatatgtaaacaaagaattcattggtggatgtgatgttattacaagtatggcacgctctggtgaattggccgatttgctagaagaggcacaggcattggtacctgaagaagaagaagaaaccaaagatcgttga

SEQ ID NO: 608 - DNA, 455 bp, Saccharomyces cerevisiae
atgagcgatgaaaataagagtacgcgtatgtcagttaatctcagtcacaattttgtgactttcaatacaatttttctttactaactcgaggaagagtgaggttttcttccatgaattgcagctattgttaaggcgtctgacatagtatgtaattgtgccatgatatacatgttttgtgtgtgtacatttgaatatatatatttactaacaaggagaaaacttagaccgacaagctgaaagaggatattttaaccatcagtaaagatgctctggacaagtaccagttggaaagagacattgctgggacggtaaagaagcaattggatgtcaaatacggcaatacctggcatgtgattgtcggaaagaactttgggagctacgtgacacacgaaaagggccattttgtttatttctatatcggtccactggcgtttttagttttcaaaacagcataa

SEQ ID NO: 609 - DNA, 456 bp, Saccharomyces cerevisiae
atgaacagatcttttcactttctaataaagtacatatatatacatgttcttcttgttttttattttcacattaagcagcaggctattatgcctttttttatttttttcttttcatcattcgacggactttcatttgaccttcgagtggtagcgtttttagccaagcacgttttcgttggcgtttgttcacccttttttgttgtaggtttttttggttcatctagagtagttgttactgaatggctttcgaagcttgtattacctcctcctccagtttcaataacacaggtcttctctttgtcacgtaagagaggcgaattctccagcggatacatcttgattataaacccttacaaaagtttcctgcgatcacttttagatttttcaattttcaataatactgccaagaacaaatcttcaacatttacattgaacttggaggatgtctcaaaatag

SEQ ID NO: 610 - DNA, 456 bp, Saccharomyces cerevisiae
atgacgaacgatattaaggagatacaaacaatacagccgggattgtccgagattaaggagataaagggtgaactggctaatgtgaagaaaaggaaacgcaggtctaagaagattaataaattgactgatggtcaaatacgtataaatcatgtttcgtctgaaaaaaaaaggagagaattggaaagagctatatttgacgaactggtagcagtagtacctgacctgcaaccccaggaaagtcggtcagaactaatcatatacctgaaaagcttgagttacttaagttggttgtatgaaaggaatgaaaagctgagaaaacaaatcatagctaagcatgaggcaaaaaccggcagcagcagcagcagcgatcccgtacaagaacaaaatggaaacattcgggatttagtaccgaaggagttaatttgggagctgggtgatggacagagtggtcagtga

SEQ ID NO: 611 - DNA, 456 bp, Saccharomyces cerevisiae
atgatatttggacctactagtgtctatagtaagtgctcggccaagtcaagcggtatcattaaagacaccgccaagcttccaatatcacgagtaaggatcaaagttatgttagagataactgtgagttttttattttttgatcgatttccaagatcattcctcaatcataatctatatgattcaatatgtcctttctttgcgtggcaatatacctcatattatctttctatttacaggcagtcctttctatttcatttcttacaaaaggattttagcaacgacttcgtctcagaagagttaatatatgcactagttgcactaggcgcaaaaaattcctttgacaatagcctttcaaagcatacatatgaatattacaaccactcaaagagaaatttactggaagattcgacaaataaaaattcagctttttcaagtgcaagcgtaacaaagccataa

SEQ ID NO: 612 - DNA, 456 bp, Saccharomyces cerevisiae
atggagaagcccagccccaccaggcggcaaactagtagtctctccactatctccaacggtatgaccatgaccaacgataatagggataccacaaataccaacagtggctctacaagcagcaacaattcacaaccatcttcgtcttccacgccaccagcggccagtggacccgtaacggacagaaccaaagtcaactatgtaccaaagagcgacgatccgtcgtcatttcaatactacccagacgacccggagaacccggtcaataagtataaattcgcgttaaaggctgacagtcagtactatgatccttgtgaggagtcctccaagctcagttttcagtgcctcgagcgcaacgattacgaccgatccaagtgccaagaatattttgacgcataccgcgaatgcaagaaacaatggctgacagccaggaggaaaaacagacagcagtgggaatga

SEQ ID NO: 613 - DNA, 456 bp, Saccharomyces cerevisiae
atgggtacagccaagcaaaatcaaaatagaaagaagtttacgagggagtataaggttaaggagatccaaagaagtattacaaagaaaactagactgagaaaggaataccttaaagctttaaaagatgaagggtatgccgtaccagaaaaggaaccaaaaaccgtggcaaaagaatctgtaaggaagattaaggaagccagggcaatagagggaaagaagaaactagacgagaagaaggagatcaagaaacaaagaaagagaatgcaaaaagatgaattaaacaagcaaagaaacgagcaattggaaagaatcagagtttcgaaggaaaaatttcagaggagagaagatagaaagaagaaattgactcaaagaacaaggacaggccagcccttgatgggccctaagatagaggatcttttggataaaattaagacggatgatacttatacctcctag

SEQ ID NO: 614 - DNA, 456 bp, Saccharomyces cerevisiae
atgtctgactgggatacaaatactattattggtagcagagcaagagctggtggttctggcccaagggccaacgttgccagatctcaaggccaaattaatgctgcaagaagacaggggttggttgtttccgttgacaagaagtacggatcaaccaatacgaggggtgacaacgagggtcagaggttgaccaaggtcgaccgtgagacagatattgtcaaacccaagaaattggatccaaatgtcggtagggccatctcgcgtgccagaacagacaagaaaatgtcgcagaaggatttggcaaccaaaattaacgaaaagccaaccgtggtaaacgattatgaagccgctagagctattccaaaccaacaagttttgtctaagttggaaagagccttaggcgttaaattgagaggtaacaacatcggttcgcctttgggagctccaaagaagaaatga

SEQ ID NO: 615 - DNA, 457 bp, Saccharomyces cerevisiae
atgggtggtaacgttctccccattcattatgaccccaaaactgttaaacaattaactaaagaagtatgtaaaattcaagaatatatctggccctgtcttgttcaccccagaataaatcgctaacacaagtctaattaaccttctttctcattcgtagattactgttgcatcatgtataggagctgcccaaggtgctctcttcagtattgcctcagcgctgctgttgagaagattttcatcagtatatagaaatgtcagaactcaagtgcgtgttttttatcattgttcttggatttcaatgggtgctgtcttcagagctgataagcaattgctcaagttccagacaaattattatcgtgaggaacagaaaagaagagaaaagattatggatgaagctgctgagagaggcctttttctggaggatgagagtttgaactcttcccggtcaactacatga

SEQ ID NO: 616 - DNA, 459 bp, Saccharomyces cerevisiae
atggctaggcatttcggtatggccctcgccccatgggatgtcatgggaggtggaagatttcagagtaaaaaagcaatggaggaacggaggaagaatggagagggtattcgttctttcgttggcgcctctgaacaaacagatgcagaaatcaagattagtgaagcattggccaaggttgctgaggaacatggcactgaatctgttactgctattgctattgcctatgttcgctctaaggcgaaaaatgtttttccattggttggaggaaggaaaattgaacacctcaaacagaacattgaggctttgagcattaaattaacaccagaacaaataaagtacttagaaagtattattccttttgatgttggttttcctactaattttatcggtgatgatccggctgttaccaagaaggcttcacttctcacggcaatgtctgcgcagatttccttcgattaa

SEQ ID NO: 617 - DNA, 459 bp, Saccharomyces cerevisiae
atgagcttgaggccttgcttcgtatcattgatagatgaatctgataaacctatattgatttacgtccctaatgaggcggagaatgagatgaatgatgtactcaaatataacgtgctttctaacatatcgttagattattttgaaagtgctttggttgaatggcattctttagattccaaacctcttctgaagtcaatttttcaattggaaggtgtctctgtatttgctatgttgattaagcagacgggcctgaagattgtcattggatttgaacaaaaaagcctaagtggagctgatgatgaatttgaagcaatcaatcagattttcgaaaccgtaagaaaaatctatatacgtgtcaaatgtaatcctttacttgttagcggtgacgaaaagtccattataaaaagcttggaaagaaaatttgatgagttgtttatttcaactgaagttgaattataa

SEQ ID NO: 618 - DNA, 459 bp, Saccharomyces cerevisiae
atgcaaattttcgtcaagactttaaccggtaagactattaccctggaagttgaatcttctgacactattgacaatgtcaagtccaagatccaagacaaggaaggtattccacctgaccaacaaagattgatctttgctggtaagcaattggaagatggtagaactttgtccgactacaacatccaaaaggaatctactctacacttggtcttgagattgagaggtggtggtaagaagagaaagaagaaggtctacaccaccccaaagaagatcaagcacaagcacaagaaggtcaagttggctgtcttgtcctactacaaggtcgatgctgaaggtaaggttaccaaattgagaagagaatgtagcaacccaacttgtggtgctggtgttttcttggctaaccacaaggacagattgtactgtggtaagtgtcattccgtctacaaggttaacgcttaa

SEQ ID NO: 619 - DNA, 459 bp, Saccharomyces cerevisiae
atgcagtaccattccgctctatatgtatatatttacgtaactttcaccactattccctataaggaaaagccggatatcatttcgatctgcttcagcatgctgtcgtttgtttttgatttttctgtccgaatttgctctcgtaccttggagtccttttcctggtccttgatcagctcctcggctttcaaagtagtctcagctttcagtttagctggctcttgtgtacttgcctcccgcagcagcgtcggtatcattgtttcactacttttgtttaacttttccacttgtaactttgttctcttcctttcagcggtgctgatcgacctctttttttgtactttcttgccaacaccaacattcttgcccacacctttctttttcatgctacacttgcccattttttccttgctaaatgcccttgagttattgtaccttattatagcaggcttgcacatctga

SEQ ID NO: 620 - DNA, 459 bp, Saccharomyces cerevisiae
atggtcgaattaactgaaattaaagacgatgtcgttcaattagacgaaccacaattttccagaaatcaggccatcgtggaagaaaaggcttctgcaacaaacaacgacgttgtcgatgatgaagatgactctgatagtgattttgaagatgaatttgatgaaaatgaaacattgttggacagaatcgttgctttaaaagacattgtccccccaggtaagagacaaacaatttctaatttttttggttttactagctcttttgtgagaaatgctttcacaaaatccggaaaccttgcttggactttgaccaccactgctttgttactcggtgtgccactatccttatctatacttgccgaacaacagctaatcgaaatggaaaagacatttgatttacaaagtgatgctaataacatattggcccaaggtgaaaaagatgctgcagcaacagccaattaa

SEQ ID NO: 621 - DNA, 459 bp, Saccharomyces cerevisiae
atgtccttcattaaaaacttgttatttggaggtgttaaaacaagtgaggatccaaccgggctcacaggtaacggggcctcaaacacaaacgattctaataaaggtagtgaaccggtagtagcgggtaatttctttcctaggacgctttccaaatttaacggccacgacgatgaaaaaatatttattgctattaggggcaaagtatacgactgcacaagagggaggcagttttacggtccaagcgggccatacactaactttgcaggccatgatgcgtcgcgtggtcttgcattgaactccttcgatctggacgttattaaagattgggatcagcctatcgatcccttagatgatctgacaaaagaacagattgacgcactggatgagtggcaagagcattttgagaataagtacccatgcattggtactctgattccggagcctggcgtgaacgtatga

SEQ ID NO: 622 - DNA, 459 bp, Saccharomyces cerevisiae
atgtggtttcctcagatcattgctgggatggctgctggtggtgccgctagtgctatgactccaggcaaggttctctttactaatgctttgggtttaggctgttccagatctagggggttgtttttggaaatgtttggtactgctgtgttgtgtttaacagttttgatgactgctgttgaaaaacgtgaaactaactttatggctgcgcttccaattggtatttctttattcatggctcacatggctttgaccggttacactggtaccggtgtcaaccctgcaagatctctgggtgccgccgttgctgccagatatttccctcattaccactggatctactggattagcccacttttgggtgccttcttagcctggtcagtgtggcaattattacaaatccttgattacactacatacgttaatgccgaaaaggcggcaggtcaaaagaaggaagactga

SEQ ID NO: 623 - DNA, 462 bp, Saccharomyces cerevisiae
atgaaattctcaactattttcggagctactacagttatgactgccgtctcggcagcagctgtgtcgagtgtaatgaccactaagactattactgctactaacggtaataacgtttacactaaggtcgttaccgacaccgctgaccctatcattagttacagtaccactagaactgtcgttgtcagtaatagtgatgctacttacacaaaggttgtcaccgaaggaccagataccacctctgaaaagagtacaacaaagacacttactttgacaaacggttcaggttcatcaaccaacctttacaccaagaccgtcactcaagccgtcgaatcatctacatcctcctcatcctcctcatcctcctcctcctcttctgcctcttcttctggtgctgctcctgctgcattccaaggagcaagtgtcggtgcattggcccttggtttgatttcttacctattataa

SEQ ID NO: 624 - DNA, 462 bp, Saccharomyces cerevisiae
atgaactctgaacagctgctgcataactatgtttcggattcgctactcactactctgataagttttcaagagttcaagcagcaactacagtcgtacacgagcgacgagcaacaactgcaacattggtacgaattgcttcaggccagggatgcgcgagtgacctctgagttagaagcacgaatcaagcagtttttcataacgttgcgctctagattactgcgatttctggaaagcgagcaactatcacactcccttagcctcgagacactgatcgacgcgctgtacaagattaatgacctgttgcaacagcgtttgcagattctggatgatgctattcaggaaaagacctcggaactagcagaatttgaaaatatggttcgctcaccgagtgcaggagacaatgccattcctggcctattacaaattatacaatcttatattaatctattagaggaaaactag

SEQ ID NO: 625 - DNA, 462 bp, Saccharomyces cerevisiae
atgacctttttacaatttatcaataataatagacaagaaggacaaggttatatttcagaaaaattattcaaaactaagaagaatgagatgataagaaaaacagttaccaatttagtagctgtaagattaaaaaacttatcccacgaatttgatgtaatagagaattatctgcgctatatagctagcaccagtgaacatctatttactgctattaagcgccactttaacaaatgtgccagaaaacttttgaaagaagcaatcgactccaaatcaaactcagaaactgctacggtggttctgcaagaaggattttctggcatttgcttattgaaagcgtcttcaattatattaaaactaaaattgaagtttccaaaaaagaaagatagaactgatattagcaaattgtgtgacaagaaagaacggatgacacagtggttagaaatttcaattttgatgaactga

SEQ ID NO: 626 - DNA, 462 bp, Saccharomyces cerevisiae
atgggtaagaaaaacactaaaggtggtaaaaaaggtagaagaggtaagaacgactctgacggtccaaagcgtgaacttatttataaggaagaaggccaagaatatgctcaaatcaccaagatgttgggtaatggaagagtcgaagccagttgctttgatggtaataagagaatggcccatattagaggtaagttaagaaagaaagtctggatgggacaaggtgatattattcttgtttccttaagagatttccaagatgaccaatgtgatgttgtccacaaatataatttagatgaagccagaacactgaaaaaccaaggtgaacttcctgaaaacgccaaaattaatgaaacagacaactttggtttcgaatctgatgaagacgttaactttgaatttggtaacgctgatgaagatgatgaggaaggtgaagatgaagaacttgatattgatgacatttaa

SEQ ID NO: 627 - DNA, 462 bp, Saccharomyces cerevisiae
atggttacgttcaactgtgaggtgtgtaatgatactgtgcccaagaagaataccgaaaagcattattatagatgtcctaacgcgtactatacatgcatagattgctccaagacgtttgaagatggcgtgagttacaagaatcacacgtcttgcatcagcgaggacgagaagtaccagaaagcgttgtacaagggcaacaagaagcagaagcagaagcagcagcagaagcagcagcagaagcagcaccagcaccagccagtggcaactcctgcaaagaaagtggagaagcctgtgatcaagaaggcagagaaagtggaaaagacctcgaacggtatcgagcttcacaagggcaagtcgttgtacaaaattttgaaaaccatgaaggataaaggggcaaaaaagaccttcttgaaaagtctggttgtggattctgaggggcaaatcaggtatgcaaaggaataa

SEQ ID NO: 628 - DNA, 462 bp, Saccharomyces cerevisiae
atggttgtcttgaatccaaataactggcattgggtggataaaaacaccttaccttggtctaaggactacttgaacggtaaattaacgagtttgtccactgtttcctctgatgggaagagcaaaattgagttaacccaggtgagtagcatcaccggtgactccaacgtatctcaaaggaagggcaagccgatttgctactttgacttacagttgtcgatgaacgtcaaagtgacaaatttggatactaataaggacgacgaggatgatgacggcatacttgcggacgggaaactagaaattccagagtttatgcatgacgagtctgatattccgattttgtcgcaagggtttgatgcttttgatggattggttaggtctgaatttgtccctaaagtagtggaaacgctactaaaataccaagatgacttgattaaagaacactcaaaggatatacaagtttga

SEQ ID NO: 629 - DNA, 462 bp, Saccharomyces cerevisiae
atgtctagtcaaacagaaagaacttttattgcggtaaaaccagatggtgtccagaggggcttagtatctcaaattctatctcgttttgaaaaaaaaggttacaaactagttgctattaaattagttaaagcggatgataaattactagagcaacattacgcagagcatgttggtaaaccatttttcccaaagatggtatcctttatgaagtctggtcccattttggccacggtctgggagggaaaagatgtggttagacaaggaagaactattcttggtgctactaatcctttgggcagtgcaccaggtaccattagaggtgatttcggtattgacctaggcagaaacgtctgtcacggcagtgattctgttgatagcgctgaacgtgaaatcaatttgtggtttaagaaggaagagttagttgattgggaatctaatcaagctaagtggatttatgaatga

SEQ ID NO: 630 - DNA, 462 bp, Saccharomyces cerevisiae
atgtctcaaaaagcttgttacgtttgcggtaagattggccatttggcagaagactgtgattctgaaagactatgttacaactgtaacaaacccggtcacgttcaaacggattgtaccatgccaagaacagttgaattcaagcaatgttacaattgtggtgaaaccggtcacgttagaagtgaatgtactgtgcaacgttgtttcaactgtaaccaaaccggccacatctccagagaatgccctgaaccaaagaagaccagcagattctccaaagtttcatgttataaatgtggtggtccaaaccatatggctaaggactgtatgaaagaggacggaattagtggattgaaatgttacacttgtggtcaagctggccacatgtccagggactgtcaaaatgacaggctttgttacaactgtaacgaaactggccatatttccaaggattgtccaaaggcttag

SEQ ID NO: 631 - DNA, 462 bp, Saccharomyces cerevisiae
atgtctgacgaagcaaaggaaaagcgtgaattagaaagccaaaaggaatcaagtcataataaatccgaaaagtctgtggaacctaagccaaagagaagaagaagaagaaactatgacgattatgacgctgaagtagcaaaagaggagactaaggctaaaaatggtttgacgaagagcgaaaataatggtactgttgaagattctgaatctgatatggacgatgccaagttagacgcattgatgggaaatgagggagaagaagaagaggacgatttggcagaaattgatacctctaatatcatcacatccggaagaagaacacgcggcaaagtaattgactataaaaagactgcagaagaattagacaagaaggaacctagcacaggctctaaagatgatgtaggatatggtgaaaaagaagaagacgatgaagacgaagaagacgatgattttaaagagtag

SEQ ID NO: 632 - DNA, 462 bp, Saccharomyces cerevisiae
atgttacgtaacacttttactagagctggtggactatcacgtattacatccgtaagattcgctcaaacacatgctctttccaacgctgctgtaatggatctgcaatccagatgggagaacatgccctccactgagcagcaggatattgtcagtaagttgagtgaacgtcaaaaattaccatgggcacagcttactgagcctgaaaagcaagctgtgtggtacatttcttacggagaatggggcccaagaagacctgtattgaataagggtgattccagttttattgccaaaggtgttgctgcaggcctactattttcagtgggactttttgctgtcgtcaggatggcgggtggccaagacgcaaagaccatgaataaggagtggcagctaaagagtgacgaatatttgaagtcgaagaatgctaatccttggggtggttattctcaggtccaatctaaatga

SEQ ID NO: 633 - DNA, 462 bp, Saccharomyces cerevisiae
atgttgtcgaggtttatgtccaacacatggtgtacgcccttgagacaggcgcagagattgttttcctccactacgacaatgcaagcgacattgaatcagattaaaagaggctccgggcctccaagacgcaagaagataagtacagctccacaactggatcagtgtccccagcggaagggtgtcgtattacgtgtaatggttttaaagcccaagaagccgaattctgcgcagagaaaggcgtgcagggtccgtttgactaacgggaacgtggtatctgcatatataccgggtgagggccacgatgctcaagagcattcgattgtatatgtcagaggtgggcgttgtcaggacttgcctggtgtgaagtaccatgttatcagaggtgctggtgacctgagtggtgtggtaaacaggatttcttcgaggtcgaaatatggagccaagaagccaagtaaatcgtga

SEQ ID NO: 634 - DNA, 465 bp, Saccharomyces cerevisiae
atgactccacttttgcaggcggaagcaaaaatgaacacaagcctctaccttacggaaagcatccaacaacatgaattcaacctcaccagccctcagtcattctattcttctccctcggtacccaatagtaaaaataactcgggcattttcagctataacactgccaacaacagtagggtgagttctagtgatgaattcactacccaacaagacggcatgaacaccataatgtacaaaaacaacatcagtaaaactttcgaagacgacatcttttattgtccaagaagtttgctcaccccagaagaacaagtggtataccaggaaattgacaagtattacatggaacaagcactattgacccagttacaaatctcccaaacgtattcctccactcctaaagaggaaaagatagttaagttcaatccctacacttcgaagagtttcagtccagcttcttctgaataa

SEQ ID NO: 635 - DNA, 465 bp, Saccharomyces cerevisiae
atgctaagagttatatggaagcatagttccagagtcactcgttcgatagaactatcgaacatttctaccactaatcacaccaggagtttaaggaggctttcctggatttctccgagaagattttacgctcaatcttgggacgacagacagcctaatgacaaaatagatgcacacataaaggtgcagaaactcatggatcaaataaattcgaggcctaatgttctggaaaagttagaaaaggttagcaatatcatgatcgaaaaaaaattggttaatctagatgggacttctgccaatgaagaaaatacgatgaaaccatggcaaatgattaagatcttaatggacagagatctgagacacgctatgaaggaatttaaattggaattggaaaaatctggcatacagttaggacctgaacaactggccccgctaatgaccgttttaggccttgagaagaaaaaatga

SEQ ID NO: 636 - DNA, 465 bp, Saccharomyces cerevisiae
atggaagccgattggaggagaattgacatcgatgcatttgatccagagagtggcagactaaccgctgccgatctggtaccaccatacgaaactactgtcacattacaagaattacaacctcgaatgaatcaattgcgctcgcttgccacaagtggtgactctttgggagccgttcaattactcacaaccgatcctccatacagtgcagatgctccaacaaaggagcaatattttaagagcgtccttgaagcattgacacaagtcaggcaagccgatattggtaatgtaatcaaaaatttgagtgattctcagagggacgtgctggtaaagtatctctacaaaggaatgtccgtacctcagggccagaaacaagggggtgtcttgcttgcgtggctggaaagaattactcaagtcagtggtgtcacacctatcgttcattatatatcggatagaagaactgtatga

SEQ ID NO: 637 - DNA, 465 bp, Saccharomyces cerevisiae
atggttcaagcagtcgcagtgttaaagggtgatgccggtgtctctggtgttgtcaagttcgaacaggcttccgaatccgagccaaccactgtctcttacgagatcgctggtaacagtcctaacgcagaacgtgggttccacattcatgagtttggagatgccaccaatggttgtgtctctgctggtcctcacttcaatcctttcaagaagacacatggtgctccaactgacgaagtcagacatgtcggtgacatgggtaacgtaaagacggacgaaaatggtgtggccaagggctccttcaaggactctttgatcaagcttatcggtcctacctccgttgtaggcagaagcgtcgttatccacgccggccaagatgacttaggtaagggtgacactgaagaatctttgaagactggtaatgccggtccaagaccagcctgtggtgtcattggtctaaccaactaa

SEQ ID NO: 638 - DNA, 467 bp, Saccharomyces cerevisiae
atgtcgtcatctactccctttgacccttatgctctatccgagcacgatgaagaacgaccccagaatgtacagtctaagtcaaggactgcggaactacaagctgtaagtacagaaagccacagagtaccatctaggaaattaacattatactaactttctacatcgttgatacttatgcgtatacattcatatacgttcttcgtgtttatttttaggaaattgatgataccgtgggaataatgagagataacataaataaagtagcagaaagaggtgaaagattaacgtccattgaagataaagccgataacctagcggtctcagcccaaggctttaagaggggtgccaatagggtcagaaaagccatgtggtacaaggatctaaaaatgaagatgtgtctggctttagtaatcatcatattgcttgttgtaatcatcgtccccattgctgttcactttagtcgatag

SEQ ID NO: 639 - DNA, 468 bp, Saccharomyces cerevisiae
atgaaggttgaaatcgattctttttcaggtgccaaaatctacccaggcagaggtaccttgtttgtccgtggtgactccaaaatcttcagattccaaaactccaaatctgcctctttgttcaagcaaagaaagaacccaagaagaatcgcttggactgtcttattcagaaagcatcacaagaagggtatcaccgaagaagttgctaagaagagatctagaaaaaccgttaaggcccaaagaccaattaccggtgcttctttggacttgatcaaggaaagaagatctttgaagccagaagttagaaaggctaacagagaagaaaaattgaaggccaacaaagaaaagaagaaggctgaaaaggctgctagaaaggctgaaaaggctaagtctgctggtactcaaagttctaagttctccaagcaacaagctaagggtgctttccaaaaggttgctgctacttctcgttaa

SEQ ID NO: 640 - DNA, 468 bp, Saccharomyces cerevisiae
atgaaggttgaagttgattccttttccggcgctaagatctacccaggtagaggtactttatttgtccgtggtgactccaaaattttcagattccaaaactccaaatctgcttctttgttcaaacaaagaaagaacccaagaagaatcgcttggaccgtcttgttcagaaagcatcacaagaagggtatcaccgaagaagttgctaagaagagatctagaaagaccgttaaggcgcaaagaccaatcactggtgcttctttggacttgatcaaggaaagaagatctttgaagccagaagttagaaaagctaacagagaagaaaaattgaaagccaacaaggaaaagaagagagctgaaaaggctgctagaaaggctgaaaaggctaagtccgctggtgtccaaggttccaaggtttccaagcaacaagctaagggtgctttccaaaaggttgccgccacttcccgttaa

SEQ ID NO: 641 - DNA, 468 bp, Saccharomyces cerevisiae
atgaattcaactaaaaggctgaaaatgtcaacaacctttcatgattatgacttggaagagccattaacctcaaatgccagaccactaaagaactccgttattacaatccgagtaataaaatctttcccatatagaaacgtcaagaacatagtgctgcacgattacgatcttgctgataaaactgcaaaggacctgttcaatgacgttttgaacaaaattcaaaatgaaggttcattcagaccattccgtaatgttaagtttgatactttaaagatatacacgcacgcacatggttccaagacggttaatctcgtgatcaattttgaccacgatgacgactggactttagacatagagaatgacaaaaaaaagctgttcgagtatggcattgagaatgaaaccgaaatttcgcttttcaacaaagaggattacctaaggtttaaagaaaaccctgaagaaaaatggtga

SEQ ID NO: 642 - DNA, 468 bp, Saccharomyces cerevisiae
atgaccaaagtagatttttggccaactcttaaggacgcatacgaaccactctatccgcagcagctggagattctgcgccagcaagtcgtctccgagggggggcccaccgctaccatacagtcaaggtttaactacgcatgggggctgatcaaatccactgacgtgaatgacgaaaggcttggtgtgaaaatcctcacagacatttacaaagaggccgagtcccgtagacgagaatgcctatattatctgaccataggttgctacaaactcggtgaatactctatggcgaagagatatgtagacactttatttgagcatgagcgtaataacaagcaggtgggcgctttgaagagtatggtagaggataagatccagaaggaaacactcaagggtgttgtcgtcgctggaggcgtactagccggcgctgtggccgtggctagtttcttcttaagaaacaagagaaggtaa

SEQ ID NO: 643 - DNA, 468 bp, Saccharomyces cerevisiae
atgagtggaaatcaaatggctatgggatcagaacaacaacagaccgtagggtcccgaacggtgagtgtggaagaggttcccgcagttttgcagcttcgagcaactcaagatcctccaagaagccaggaggcaatgcctacaaggcacaatgtaagatgggaagaaaatgtgattgacaatgaaaacatgaataaaaaaaagaccaagatatgctgcatttttcatccacaaaatgaggatgaagaagagtgcaaccatcattcagatgatgatggatcctcttcttccggatcctcttcttcagaatctgagaatgagaaggatcttgactttaacgaacgtagacaaagaagattggaaaggcgccatcgtaaacttgagaaaaaaaggtcatatagccccaatgcttatgaaatccaaccagattattctgaatacaggcgaaaacagcaggaaaagaaggactga

SEQ ID NO: 644 - DNA, 468 bp, Saccharomyces cerevisiae
atgatgaggggagcgagtaagaggtcaatcagcagtgccgcagtgctgctgattaaaaagaacaagctaccaccgcgaccaaagttcacgccagagatggaagcacaatgcactgagaaattccttcatggcggcagagggcccggtggccaaaagattaataagtgtaattctaaggtacaactacggcatgaacccactgggatcgttgtcgagtgccaagaaacgcggtcacgtgagcaaaatcgaaagcttgcccggcttaagctcgcgcgcgaacttgcggcgtcgtacgacacgatgccgtccagagaggaggcgcttctacagtggcaccgtcaacagaaacgctcgcagcgccggcgcagcgtcgcgaagtacgagcagcgtgaagaggccgctcgagtcgaaaaagaggaacgcgaggcccgagacagagaaatggtgcgcgagttattccgccggtaa

SEQ ID NO: 645 - DNA, 468 bp, Saccharomyces cerevisiae
atgcgatcgatttttctgctgcattttgactataaaacgtgtgaagaggaagatttcgaagactggaatttggcagatgggaaatgccttaatggcgccaaatacatgtataaaaggaggaaacaggacgcccgttgtttggtaaaaaggacattcaaagatatgattttgcatgaaataccttgtgacagttgtactgaatccgactacgaatgctcttctgaatttgttagagatgcaaagggtgactgtataccagattatgatcagattgccctttccgatatatgtgacaaagctaatggcgaaactgtatcattagagccattacaattaattaaaggagataaatgcaaaaagcccatggaaattgaggccatgaacattccatgtgaaaaaatcctgagggagagctcgaatggtaagaaaatagcaaccattgaaaacaagtttgactttgaaatttaa

SEQ ID NO: 646 - DNA, 468 bp, Saccharomyces cerevisiae
atgctttcactacgtcaatctataagatttttcaagccagccacaagaactttgtgtagctctagatatctgcttcagcaaaaacccgtggtgaaaactgcccaaaacttagcagaagttaatggtccagaaactttgattggtcctggtgctaaagagggtaccgttccaacagacctagatcaagaaactggtttagctaggttagaattattgggtaaattagagggtatcgatgttttcgacaccaaaccattagattcgtccaggaagggtaccatgaaagatccgatcatcattgaatcttatgatgattatcgttatgtcggttgtacgggttctcccgctggttcacatactattatgtggttaaaaccaactgttaacgaagtcgccagatgctgggaatgtggttctgtttacaaactaaaccctgttggtgttccaaatgatgaccaccatcactaa

SEQ ID NO: 647 - DNA, 468 bp, Saccharomyces cerevisiae
atggatagaccaagaacattacgcacatatagaggactcataagagccattctgaaatatgaaaggccaagcaagatagtcaattggggcaatctacgaaaggcaatgataacaaagttggaatatgctaagaaacaaaatcagagagactcgcatgagaacatcaacagacagttagagaaatggaaaaaactagatccggtaagcgacagatctttgaatttgtttatagccgactctaagtcattacgttccatattacaaaacgatataaagtgggagaaaaaggtggcccagggacaaaacgttgacgagatattcgaacacgctttggacatcatcaagttcttggacaaccaaagagaatacgaggagctggtcgacagatacaatcctggcaacaagttgacacaggatgagaaagtgaaaagaactgcaaacgtggttgggctggacgttccgacatag

SEQ ID NO: 648 - DNA, 468 bp, Saccharomyces cerevisiae
atgtcgttggtcaaacttgcgaatacgtgtgctcatttacagaactgctcgaaagttagagttgccttaacatcgatcccatatacgaaattgcagctacagtttgcgtataacctttaccaacaagggttcttatcgtctttacagaagggatcgactatgggaccagacaaagattttgttgaagtaacaccagacaatatctctactagaaggctttgggttggattgaagtatagagataacaaacctgtcctcagcagctgcaaattaatttccaaaccaaattcaagaatacacctgccaatggaagacatgaagaaactatgctctggcgtaactattagaaacatcaaaccactacaaccaggagaactgattctagttcgagctcataacaacattatggacattaatgaagccatatccaaaaagttggatggagaagtactatgcagagtaaaatga

SEQ ID NO: 649 - DNA, 471 bp, Saccharomyces cerevisiae
atgacgcaattaaaatatttgttgctggtttctaggcaaggaaaaatcagattaaagaaatggtacacggcaatgtccgctggtgaaaaggcaaaaattgtgaaagacttgacacctacgatattagcaagaaaacccaaaatgtgtaacatcatcgagtataatgaccacaaagtagtatacaagcgatatgctagtctatattttattgttgggatgacgcccgatgttgacaatgaactgctgaccttggaaattatccatcggtttgtcgaaacaatggacacatatttcggcaatgtttgtgagctagacattatatttaacttcagtaaggtctacgatatcttgaatgagatgattatgtgcgatggctccatcgcagagagcagtaggaaggaagtactgcaccatgtgaccgtgatggacaccatggagagcaacgataatcttgaaagggtattgagttag

SEQ ID NO: 650 - DNA, 471 bp, Saccharomyces cerevisiae
atgagtatgagttcaactgtaattaaattcagggctggtgtttgtgaatacaacgaagattcacgtctatgtacgccaattccagttcagggtgaaatcgagatcaaaccaaatgaagaggaagaattgggattttgggatttcgagtggcgtccaacggaaaagccggtcgggagggaacttgatcctatttctttgattttaattcctggagagaccatgtgggttccaataaaatccagtaaaagtggcagaatatttgctttagttttttcatccaacgaaaggtacttcttttggctgcaagagaagaactcaggtaatttgcccttaaatgaattgagtgcgaaagataaagaaatttacaataagatgattggagtgctgaataatagtagtgaaagtgatgaggaagaaagcaatgacgaaaagcaaaaagctcaagatgtggatgttagtatgcaagattaa

SEQ ID NO: 651 - DNA, 471 bp, Saccharomyces cerevisiae
atgagttcccggtttgcaagaagtaatggcaatcccaaccacattaggaaaagaaatcattctccagacccaataggaattgataattataaaagaaaaagactaattatagatttagagaatttatccttaaatgataaagggcccaagaacggacatgcagatgataacaatcttattcataacaatatagtattcacagacgctattgatgataaggtcctgaaagagatcatcaagtgttccacaagtaaacgcggcgacaatgacttgttttatgacaaaatatgggaacgtttgagagaaaaaaggctacaaataataaaatgggtagattataaggaaattgcttatctaagctggtggaagtggttccataatcaaatgacttcgaaatacacttatgatggagaggctgataccgatgttgaaatgatggcagtggatactgatgtggatatggatgcgtaa

SEQ ID NO: 652 - DNA, 471 bp, Saccharomyces cerevisiae
atgatggatggttccataacaaggaaggtaacatcaacgttgtccaaccaattggcgacctggaaatggaaactgcagttatcgttattggaaagaaaattagcgacaataaacaatgattattttctcctgcaatgggaactcctttttataactaatgaagtgatgaaatggaaagaaatgattgcctttttggaaagccagttattttgcacaacgcaaaatttcgtggcacaagagacacatgacagggaaacctttcaaagcctggtagatgattataacaaacagttgagcgaaaataacctgattatttctgtattgaaaagtagaccacagctatcatcatttcctatatatttgagcgatgaggtgtgttcacaccttaaattcgtcatcgcggaactaaattcattgataatagttttttttatttctttagtatttttgtgggtatcgatagaagtttaa

SEQ ID NO: 653 - DNA, 471 bp, Saccharomyces cerevisiae
atggcacgttcaagaggatcatcaagacctatatcgagatcgagacctactcagacaaggtccgcttctaccatggcggctccagttcatccacaacaacaacaacaaccaaatgcctattcacaccctcctgctgcaggtgcccaaacgagacagccaggtatgtttgcgcagatggcctccactgctgcaggtgttgccgttggtagcaccattggacacaccctaggtgcaggtattaccggtatgttttccggatccgggtctgattccgctcctgttgagcaacaacagcaaaatatggccaacacctccggccaaacccaaacggaccagcagttgggaagaacttgtgaaatagacgcgagaaactttacacgttgtttggatgaaaacaacggcaacttccagatatgtgattattacttgcagcaactaaaagcctgccaggaagctgcacgtcaatactaa

SEQ ID NO: 654 - DNA, 471 bp, Saccharomyces cerevisiae
atggcagtagaagagggtggttgcgtgacgaaacgtttacaaaatgagctgctacagctacttagttctacaacagaaagtattagtgcgtttcccgtagacgataatgatttaacatactgggtagggtatattacaggccctaaagacacaccgtatagtggacttaaattcaaggtttcattgaagtttcctcaaaactatcctttccatccgccaatgattaaatttttgagtccaatgtggcatccaaacgtggataagagtggcaacatttgtttggacattctgaaagagaaatggtctgcagtgtataatgtagaaacaattctattgtcattgcagtcattacttggcgaaccaaataacagatctccgctgaacgctgtggcagcagaactttgggatgcagatatggaggaatacagaaaaaaggtcctggcctgttatgaagaaatcgacgattactga

SEQ ID NO: 655 - DNA, 471 bp, Saccharomyces cerevisiae
atgggtaaagacaacaaggaacataaggaaagcaaagaaagcaaaaccgtagacaactatgaggccagaatgcctgctgtgttgccattcgctaaaccattggcctctaagaaactaaacaagaaggtcttgaagaccgtgaagaaggcttccaaggccaagaatgttaaaagaggtgtcaaggaagttgtcaaggccttaagaaagggtgaaaaaggtttagtcgtcatcgccggtgacatttctccagctgatgttatttcccacatcccagtcttatgtgaagatcactctgtcccatacatcttcataccttcaaagcaagacttaggtgccgctggcgctacaaaaagacctacctcagttgtctttatcgtcccaggtagcaataagaaaaaagatggaaaaaataaagaagaagaatacaaggaatctttcaacgaagttgtcaaagaagttcaagctttatga

SEQ ID NO: 656 - DNA, 471 bp, Saccharomyces cerevisiae
atggtactgtttggactaggtagactattttacgtcattttattattgattaatgccgttgcagtactgagcgaagaaaggttcttaagaagaagtatgtaaacaggagaggcaaccataaacaacttattttaaagcaacaattaatactaactttattgaatatgctaatacattatttcaccgatttttgcagttggccttggaagatcaaatgatgagacacctgtttttggtcaggatcaaaataccacgaagtccaaggttgttcaattgattggcgccgtacagacattactgaggagtatgttatgttgatggagaacggttaaagttacatttcatcagttttttcccgttctttttcaccttttgtgagaaaattttactaacgtttcgtatattattcttgtagtaccattaattggaataaatatactggtgattgtttatgaattactattgggatga

SEQ ID NO: 657 - DNA, 471 bp, Saccharomyces cerevisiae
atgtccaacactagcgaagataacattaccgtaaggtttgtaaccgaaaacgataaggagggttggcaaaggctttggaaatcctatcaagatttttatgaagtctcttttcccgatgacttggacgatttcaatttcggcagattcctagatcctaacattaaaatgtgggcagccgtagctgtggaaagttcgagcgaaaaaattattggaatgataaactttttcaaccatatgactacttgggatttcaaggacaagatatacatcaacgatctctatgttgatgagaattctagggtcaaaggcgcgggcggcaaactaatccaatttgtctacgacgaagctgataaactgggcacaccaagcgtgtattggtgtacggatgagtcaaaccatagagctcagctgctatacgtcaaggtcggctataaagccccaaaaatattatacaagaggaagggatattaa

SEQ ID NO: 658 - DNA, 471 bp, Saccharomyces cerevisiae
atgttcgccagactcgctaatcctgcccacttcaagcctctcacgggctcccacataacaagagctgccaaaagactttaccatcctaaggtaattgaccactacacaaacccaagaaacgttgggtccatggataagtccttagctaatgtcggcacaggaatcgtgggcgcccctgcgtgtggtgatgtgataaaactacaaatacaggtgaatgataaatcgggtattatcgagaacgttaagttcaagaccttcgggtgtgggtctgccatcgcttcctcctcctacatgaccgagctggtacgcggtatgtcacttgatgaggccgttaaaattaaaaacacggaaatcgcgaaggagctaagtcttcctccagtaaaactgcattgttccatgcttgcagaagacgctatcaaggcggcaatcaaggactacaaaacaaagaggaacccctccgttttgcattga

SEQ ID NO: 659 - DNA, 472 bp, Saccharomyces cerevisiae
atgaagagtttgttctatctcaaattgctcctctgggttgtgctattgtctttatgccttcttatggcacaccggaaaaccaaagttggtatgtatatttaagcatttgaaaatgcaaagtgcaaaccgtatctaaatactaacagctgtaatagccgacaaatttcgtgcactgcgttcaagaatacaattacgttttaatagacatatacgtttaaatgattcctttgctgatgacctagaaaacggtctccattccaggaatttcgatattatctcggagaatagcaacgacgtaagaggtggtttggatgatgtctccaagaatgagattaaacaaattatggaaaacgataatgtagatttcgataaggctagactattatatatggaaagaaagttcggccaaaatggtattgcccccgatggaacccctattgatccaaaagcattcacctttgatagtaggtaa

SEQ ID NO: 660 - DNA, 474 bp, Saccharomyces cerevisiae
atgaacggcggaggcaagaatgttttgaataaaaactcagtgggctcagtatcagaagttggtccggactcaacacaagaggaaacgccacgagatgtccgtcttttgcatctgctcctcgcatcacagtcgattcatcaatatgaggaccaagtaccgctacaattgatggattttgcacataggtacacacaaggagtccttaaggacgcgttggtttacaacgactacgctggcagtggaaattctgccggcagtggattaggagtagaagacatacggcttgccattgcagcgagaacacaataccaatttaagcctacggcacctaaggagctcatgttacagttagctgcggaaagaaacaagaaggcattacctcaagtgatgggtacgtggggtgtcaggcttcccccagaaaaatattgtctcacagcgaaggagtgggaccttgaggacccaaagtctatgtga

SEQ ID NO: 661 - DNA, 474 bp, Saccharomyces cerevisiae
atgaatggaaacagcactaacaatgaacaattgcagcaagaactggccactactcaagaccaagtggcttcgattattgagtccttcgttgaattaggtgtctcgatatatgattttcctggtactccagaagccaccaagggaatgatcaccaacttgcaaagaaatgtggatcgcttgtacaagctgaacgtgagaagcaacgatcctcaatccagcttgtctaaggtggacattcccttggaagttgttcaatacattgaggacggtagaaatccagatatttacacaagagagttcgtggaagccataagaagatccaaccaatatcaaagaggcaagatgcatggattgaagcaattaagagattcacttgctgacaagattgtggatgaatttccagagttgaaagaacctgttgaagatattataaagagaacatctcccattgacaatgtctccaatactcactaa

SEQ ID NO: 662 - DNA, 474 bp, Saccharomyces cerevisiae
atgatagaggcgttggaaatagttctattgctcgttatacaatcacttcaatatatctgtcgcacatgcatagcttttttgctaataccattcttaggcctgtatgcattcgatctcttcctatacgtttatcggatgatactttatctgtcacaaatgttcaattacaagagaaaactaggacgttctaaaacaaataataggccgcatagtcccaggctacataagatatacagtagtggggattgcatggataccttaattggccaagtaagggatttgagagtatttttgttatccacgatccacagccactctaaaagattcttttctacgagatttcagacaaaatcaggcattaactctgctattgacgcgaatgatgttgaaacaacatctgacgtatctagttttacaaatttacatttaacaaggtcatcggaagaaggttattatatcgcaggatcgatataa

SEQ ID NO: 663 - DNA, 474 bp, Saccharomyces cerevisiae
atgccaattgaccaagaaaaattagctaagctacaaaagttgtctgctaacaacaaagttggtggtactagaagaaagcttaacaagaaggcaggctcttctgccggtgccaacaaggatgacaccaagttgcaaagtcaattagctaagttgcacgctgtcaccattgacaacgtcgccgaagccaactttttcaaggacgacggtaaggtcatgcacttcaacaaggtcggtgtccaagttgctgctcaacacaacacttctgtattctacggtctaccacaggaaaagaacttgcaagatttgttcccaggtattatctctcaattgggccctgaagccatccaagccttgtctcaattggctgcccaaatggaaaagcacgaagccaaggctccagctgatgctgaaaagaaggatgaagctattccagagttagttgaaggtcaaacttttgatgctgacgtcgaataa

SEQ ID NO: 664 - DNA, 474 bp, Saccharomyces cerevisiae
atgccgcgcataaagaccagaagatccaagcctgcacctgacgggttcgaaaaaatcaagccaaccctcacagatttcgaaatccaactcagagatgcccaaaaggacaagtcgtctaagctcgcagcaaagtccaatgagcagctctgggagataatgcaactccaccaccagcgctctagatacatatatactctgtactacaagagaaaggccatctccaaagacctttacgattggttgataaaggaaaagtatgctgataaattgctaattgccaaatggcgcaaaaccgggtatgaaaaactgtgctgtctgcgctgcattcaaaagaacgaaactaacaacggtagcacttgcatctgcagggtgcctcgtgcacagttagaggaagaagcacgcaaaaagggcacacaggtgtccttccatcagtgcgtccactgcggctgccgtggatgtgcaagcacagactaa

SEQ ID NO: 665 - DNA, 474 bp, Saccharomyces cerevisiae
atggacccacagacgctcattactaaggccaataaggtttcttactatggcaaccctacgagtaaggaatcatggaggtatgattggtaccaaccatctaaggtgagctccaatgtgcagcaaccacaacaacagctaggggacatggagaataacttggagaaatatccattcaggtataaaacatggttgaggaaccaggaagatgagaaaaatctacagagggagagctgtgaggatatattagatttgaaagaatttgatagaagaatactgaaaaagtcgttgatgacatcgcacactaagggtgatacaagtaaggccaccggtgctccttctgctaatcaaggagatgaagctcttagtgtggatgatataagaggcgctgtcggtaatagtgaagccattcctgggttatctgcgggagtgaacaatgataatacaaaggagagtaaagatgtgaaaatgaattaa

SEQ ID NO: 666 - DNA, 474 bp, Saccharomyces cerevisiae
atgtcatacaaacagtattttgatagtttgcctttgaaattgaagtcctttttccaaagataccccccttcaatcaagtattctccagtgtctacatctactaaagccattaatgccaatcctttcctgccaaataaacatccggtcacacaacgatttcatgatccgaaatattcacttagaagaatgagtgacgtatataagttggcactgcgttatggagtagaagagtttttaccaccgatcgaaaacactaagaaacttttcttcgaggagaaatacaataaaaagaccctcatgaaaggtgttctcttgcccaagggtcataagcatgaattgaaattaaacgaaaagctaaaaaaacgtgaagaagctttaaagaaggtagatgagttgattgcttccaagaagggttcgaagtatgccaagagagtagaaaaaatgaaaaaaaaccaaagtataggctggttctga

SEQ ID NO: 667 - DNA, 474 bp, Saccharomyces cerevisiae
atgtctgacgaagaacacacctttgaaaatgctgacgctggtgcctccgccacctacccaatgcaatgttctgccttgagaaagaatggtttcgttgtcatcaaaggtagaccatgtaagattgtcgacatgtccacttccaagaccggtaagcacggtcacgccaaggtccatttggttacccttgatatcttcactggtaagaagttggaagatttgtctccatccactcacaacttggaagttccatttgtcaagagaagcgaataccaattgttggatattgatgatggctacttgtccttgatgaccatggacggtgaaaccaaagacgatgtcaaggcaccagaaggtgaattgggtgacagcatgcaagctgctttcgatgaaggtaaggatttgatggtcactatcatttctgccatgggtgaagaagctgccatctccttcaaggaagctccaagatctgattag

SEQ ID NO: 668 - DNA, 474 bp, Saccharomyces cerevisiae
atgtctgacgaagaacatacctttgaaactgctgacgctggttcctccgccacctacccaatgcaatgttctgccttgagaaagaacggtttcgttgtcatcaagagtagaccatgtaagattgtcgacatgtccacttctaagactggtaagcacggtcacgctaaagtccatttggttgccattgatatcttcactggtaagaagttggaagatttgtctccatctactcacaacatggaagttccagttgtcaagagaaacgaataccaattgttggacattgatgacggtttcttgtctttgatgaacatggacggtgacactaaggatgatgtcaaggctccagaaggtgaattgggtgacagtttgcaaactgcttttgatgaaggtaaggacttgatggttaccatcatctccgctatgggtgaagaagccgccatctccttcaaggaagctgctagaaccgattaa

SEQ ID NO: 669 - DNA, 474 bp, Saccharomyces cerevisiae
atgtctgctaaacccgctactgacgatgccaaagatgaacttctatcaccatttcgccggctatatgcattgacaaggacaccttatcctgcgctcgcaaacgcagcactattagcatccactccggtgctatccccaagctttaaagtgcctccaacgcaatctcctgccctctcgataccaatgtctagggtattctctaaatcttctactgccagaatcggtataactactaaaaccgcccttttcttttctacaatgcaagctataggtgcatacatgatctatgacaacgacttggaaaatggggctggcttcattgctacatggtccgccttatatttgattgtagggggcaagaagtcctttagtgcgttaagatatggaagaacttggccgttggtgctatcctcggtttcattggccaacgcagtcctttatggccaacggttccttgctaccggattccagtga

SEQ ID NO: 670 - DNA, 477 bp, Saccharomyces cerevisiae
atgatcaatggcgtatattacaatgaaattagtagagatttggatatctcttcctccactcaatgtcttcggtttctcaaagaaacagttataccgtccttagcaaataatggtaacaacagtacatcaatacagtatcatggcatatcgaagaacgataacattaagaagtctgtaaataagttagataaacaaatcaacatggcagatagaagtttgggtctacaacaagtagtttgtatattctcttacggtccacatattcaaaaaatgttaagtattttggaaatatttaaaaagggttatattaagaacaataagaaaatttatcagtggaataaattaacatcgttcgatataaaaagagaaggcagaaatgaactacaggaagaaaggctcaaggttccaattttggtcacccttgtttctgattcagagatcattgatttaaacctacattcattcaccaaacaataa

SEQ ID NO: 671 - DNA, 477 bp, Saccharomyces cerevisiae
atggggaaaaagacttttagagaatggcaatatttcaagttatcaatgtatgtatatttttgactttttgagtctcaactaccgaagagaaataaactactaacgtactttaatatttatagtacttcattcgatcaagatgtggacgatgcacatgctattgatcaaatgacatggaggcaatggttaaataacgcattgaaacgtagttatggtatttttggtgaaggtgtagaatattcattcctgcatgttgacgataagctggcttacatcagagtaaatcatgcggataaagatacattttcttcgtccatcagtacatacatatctactgatgaactcgtcggttcaccattaacagtgtcaattctacaagaatcttccagtttgagacttctggaggttactgacgatgaccgcctatggctgaaaaaagtaatggaagaagaagaacaagactgtaaatgtatatag

SEQ ID NO: 672 - DNA, 477 bp, Saccharomyces cerevisiae
atggtgacagggggaatggcaagcaagtgggatcagaagggtatggacattgcctatgaggaggcggccttaggttacaaagagggtggtgttcctattggcggatgtcttatcaataacaaagacggaagtgttctcggtcgtggtcacaacatgagatttcaaaagggatccgccacactacatggtgagatctccactttggaaaactgtgggagattagagggcaaagtgtacaaagataccactttgtatacgacgctgtctccatgcgacatgtgtacaggtgccatcatcatgtatggtattccacgctgtgttgtcggtgagaacgttaatttcaaaagtaagggcgagaaatatttacaaactagaggtcacgaggttgttgttgttgacgatgagaggtgtaaaaagatcatgaaacaatttatcgatgaaagacctcaggattggtttgaagatattggtgagtag

SEQ ID NO: 673 - DNA, 477 bp, Saccharomyces cerevisiae
atgtcacaggcagcaaaaaacgtgatagtaaagctaatagtaggagcaggccaagcggcaccatcacctcccgtggggcccgcattgggctccaagggtataaaagccattgacttttgtaaggaatttaatgcaagatcagcaaactatcagccaggtgtaccggttccagtattaatcacaataaaacctgatagaacatttacgtttgaaatgaaatctccaccaaccggatatttgctgctaaaagctcttaaaatggacaagggacatggacaaccgaatgtggggacaatgttaggcagtgcacctgccaagggaccaacccgtgctttaggagagttatcgctgaagcacgtttacgaaatagccaagataaaaaagagtgatgaaaggcatagtttattggagatggaaggtattgttaaatcaatagttggcgttgcaaaaagtatgggtattaaggttgtaccttga

SEQ ID NO: 674 - DNA, 477 bp, Saccharomyces cerevisiae
atgtcagccgatcattcgagagatccatgtcctatagtcatactaaatgatttcggtggtgcttttgccatgggtgccattggtggtgttgtttggcatgggattaaaggttttagaaattcgccattaggtgagcgtggttcaggagctatgagcgccattaaagcgcgtgctcccgtactgggtggtaattttggtgtgtggggtggtttattttcgacttttgattgcgctgtgaaggccgttagaaagagagaggacccatggaatgctatcattgcagggtttttcactggtggcgctttagctgtaagaggtggttggaggcatacaaggaacagttcgatcacgtgtgcttgtttgttgggtgtgattgaaggtgtgggactaatgtttcaaagatatgctgcttggcaagccaaacctatggctcctcctttgcccgaagcaccttcctctcaacctctgcaagcttag

SEQ ID NO: 675 - DNA, 480 bp, Saccharomyces cerevisiae
atgaagtgcactttagtttccacattgtttgccatcaccaatattctagttgcacatgcacaagtaagcaactcctcagacacgttggacgtacaatttgcgaatagtacgaactcgtacatagaaggaaaatttaattcgactgatgaagccttcaacagcagcgcatcttggtccttagcagctcagcagaaaaagatatctaatgcagctgtatatgatgtgggtggttggaatggctcattgtatcgttccaatagaagcgctgttgcagatcatcaacccggcaaaaagcaagatgccgctatttcacagatcagtgatggtcaaatccaagccactgcgtctggacctgagactaccgctgctactaccccaagtagtaccgcaaatgtctctgtctatgaaggtgctggtatgaaggttgaatccaagaacatgggttatatagttggagtagcagcgctattatttttataa

SEQ ID NO: 676 - DNA, 480 bp, Saccharomyces cerevisiae
atgagcttacccgatggattttatataaggcgaatggaagagggggatttggaacaggtcactgagacgctaaaggttttgaccaccgtgggcactattacccccgaatccttcagcaaactcataaaatactggaatgaagccacagtatggaatgataacgaagataaaaaaataatgcaatataaccccatggtgattgtggacaagcgcaccgagacggttgccgctacggggaatatcatcatcgaaagaaagatcattcatgaactggggctatgtggccacatcgaggacattgcagtaaactccaagtatcagggccaaggtttgggcaagctcttgattgatcaattggtaactatcggctttgactacggttgttataagattattttagattgcgatgagaaaaatgtcaaattctatgaaaaatgtgggtttagcaacgcaggcgtggaaatgcaaattagaaaatag

SEQ ID NO: 677 - DNA, 480 bp, Saccharomyces cerevisiae
atggggatatattcattttggatctttgataggcattgtaactgtatatttgatagagaatggacattggcgtccaatagcgcaagtggtacaataaactccaaacagaatgaagaagatgcaaaacttctgtatggtatgatattttcgttacgctccattacacaaaagctctccaaagggtctgttaaaaatgacatacggagtatatctacaggaaagtatagagtccacacatactgtacagcttcagggctatggtttgttctattgtccgactttaaacagcagtcttacactcaggttttacagtatatttacagccatatttatgtcaaatacgtgagcaacaacttattatcaccgtacgatttcgctgaaaacgaaaatgaaatgagaggtcaagggacaagaaagatcaccaatagaaactttatatccgttctcgagtcatttctagcaccaatggttaatcagtga

SEQ ID NO: 678 - DNA, 480 bp, Saccharomyces cerevisiae
atgtcacgcatgccatctagtttcgatgttacggagagggatttggatgatatgacctttggcgaaaggattatataccattgtaagaaacagccattggtacccattgggtgcttgctgactacaggagctgtcattctggctgctcaaaatgttcgtcttggtaataaatggaaagctcagtactacttccgttggcgtgtgggtctacaagcggccacactagtcgcactagtcgcaggttcatttatctatgggacttctggtaaggaactgaaggcgaaggaggaacaattgaaggagaaagccaagatgagagaaaagttatggatccaagagctggagagaagggaggaagaaacggaggcaaggagaaaaagagccgaattggcaagaatgaagacccttgagaacgaagaggaaatcaagaacttagaaaaggaactaagcgacctggaaaataagcttggaaagaagtaa

SEQ ID NO: 679 - DNA, 480 bp, Saccharomyces cerevisiae
atgtcgcacaacgcaatggaacattggaagagcaagctgagcaaaacaagtacctcgacgtacgtcctcttggccgtgattgctgttgtatttttggttacaatcagaagacccaatggcagcaagggaaaaagcagtaaaaagagggcttctaaaaagaacaagaaaggtaagaatcagtttgaaaaagcgccggttcctctgactctagaagaacaaattgacaatgtgtcgttgagatacggcaacgagttggaaggtcgtagcaaggatctaataaacagatttgatgtggaagatgaaaaggacatctacgagcgtaactattgcaacgaaatgcttttgaagttgctgattgagttagacagtatcgatttgattaacgtggatgagtccttaagaaggccgttgaaggaaaaaaggaaaggcgtcataaaggaaattcaggctatgttaaaaagtttggactctcttaaataa

SEQ ID NO: 680 - DNA, 483 bp, Saccharomyces cerevisiae
atgatgcctgctaaactgcagcttgacgtactgcggaccctgcagtccagcgctcgtcatggaacgcaaacgctgaaaaactccaactttctcgagcgcttccacaaagaccgtatcgtcttttgcctcccattcttcccggcactttttctcgtcccagttcaaaaagtactgcagcacctctgtcttcgattcacgcaagttgctccatactttataatacaactctttgatctgccttccagacatgcggaaaacttggctcccttgcttgcctcttgtcgaatccaatacactaattgtttctcttcttctagtaatggccaggtaccaagcataatttctctgtatctgagagtagatctctcccctttttacgctaaaaaatttcaaataccctacagggtccccatgatatggctcgatgtcttccaagtattctttgtattcctcgtcatttcgcagcattctctccacagctag

SEQ ID NO: 681 - DNA, 483 bp, Saccharomyces cerevisiae
atgactgaattgtgtcctgtctacgcccctttctttggtgccattggttgtgcctctgcaattatcttcacctcattaggtgctgcttacggtactgctaagtctggtgttggtatctgtgccacttgtgtgttgagaccagacctattattcaagaacattgttcctgttattatggctggtatcattgccatttacggtttagttgtttccgttttggtttgttattcgttgggtcaaaagcaagctttgtacaccggtttcatccaattgggtgccggtctatcagtcggtttgagtggtctagctgctggtttcgctattggtattgtcggtgatgcaggtgttagaggttcctctcaacaaccaagattattcgtcggtatgattttgattttgatttttgctgaagttttgggtctatacggtttgattgttgctttgttgttgaactccagggctactcaagatgttgtctgttaa

SEQ ID NO: 682 - DNA, 483 bp, Saccharomyces cerevisiae
atgagccagttagttctagacttaaaatgtttgaaggataaaatagcaacgaattacgatattcataacaatgtttacggtggaaacggaatggaaccaaacattattcatccgtccaaaagattcaggattgttgttcgattagtagatttcttgttctgtaaatcggatgaagaattcattaaaggttttttctgtcaaatgatagttagaaatcttcattgcctcaattcaacaaatggcgcagaggagatgcgtttgtatatgagcgaaagattattttcagcccataaagatgatttgagattgataaatgggcaggtactggatgttcgcattggggtatggtatggaatacaccaaagtccgccaatttttgaaatcattgattttaagatactatccaggaatgacgttcgtgatttctgtgaatttgtcaaatcaccacttggtgagaagtttctgaacatctctaactcctaa

SEQ ID NO: 683 - DNA, 483 bp, Saccharomyces cerevisiae
atgggtgtttatttggcagtactcttttcgttactggtcatcgaaatggccattctgtttattttggtacttccgcttccacagcgtatgagaaggtggctgtatatacgctacagtatcataagtactaataagaaattcagaacttatatggttggaatcatgatcttcgttggtcttttgttcatcgattcatggaaaaggtcacagatcagagtgtctacgtaccgcaaccagaaaaatccctatataataaatagtgtaaccccagtggatgcactggcttcaagggcatataaccaaaggaatgtttacatttcaggcttcatcatctacttttatatatgtatactcaccgtgatgagtatattgcgaagaatagtggaatggaatgacaaaatgaaggctggagatgacattctgaaggaaaagttaagacgaaagcaaaaatatttagaggaattgcagaagaagaaattttaa

SEQ ID NO: 684 - DNA, 483 bp, Saccharomyces cerevisiae
atgtctataccccattccgtattttcggcactcttggtcttcgtggcgctagctactacaaccttagccagtacagaagcttgcttaccaacaaacaaaagggaagatggtatgaatattaatttttatgagtacacaataggcgaccaaaccacatacttggagcctgaatatatgggctatgaatactccaatacaaagaagttaggttccgttagcggacagaccaatctctccatatactatagtccgccttgtgagagcactcctacctgtgtgacttatgcagttttgaagcgtgatgaggatggatatgatccttgcggacctctttatgaaactaaaaaacgtgacactgaatactgtgacccaaatactgcctattggagttctgatctttttggtttctatactactccaactaatgtaactgtggaaatgacagggtacttaatatggagtatgggcaaccgacgccgttga

SEQ ID NO: 685 - DNA, 483 bp, Saccharomyces cerevisiae
atgttacgttcaattattggaaagagtgcatcaagatcattgaatttcgtcgctaagcgttcatatgcagaagctgctgccgcatcatcaggtttgaagttacaatttgctctaccacacgaaactttatatagtggctccgaagttactcaagtgaacctgcctgctaagtcaggacgtattggtgtattggccaaccatgttcccaccgttgaacaattactaccaggtgtcgttgaagttatggaaggctctaactctaaaaaattctttatatcaggtggatttgcaacagttcaaccagactcgcagttatgtgtaactgcaattgaagcttttccattggaatccttttcacaagaaaatataaaaaatttgttggcagaagctaagaagaacgttagttcatctgatgccagggaagccgcagaagctgcaattcaagtagaagttttagaaaacctacaatccgtattgaaatag

SEQ ID NO: 686 - DNA, 486 bp, Saccharomyces cerevisiae
atgaaagttcttgaggaaaggaatgcatttttaagtgactatgaagtcttgaagttcctaacagatctagaaaaaaaacatctttgggaccaaaaaagtttggctgcgctgaagaaaagtcgctcgaaaggtaagcagaataggccctacaatcatcctgaattgcaaggtattactcgcaatgtggttaactatctcagtataaacaaaaactttatcaaccaggaagatgaaggcgaggaacgagaaagcagtggtgcaaaagatgctgaaaaatcgggtataagcaaaatgagcgatgaaagctttgctgagttgatgactaaactgaattcttttaaattattcaaggctgaaaaactgcagattgtcaatcaacttcctgccaatatggtccacctttactccatagtggaggagtgtgatgcaagatttgacgaaaaaacaattgaggaaatgctagagatcatctctggctacgcatga

SEQ ID NO: 687 - DNA, 486 bp, Saccharomyces cerevisiae
atgaagatcagtcaatttggctctttagctttcgccccaattgtgctactacaactgttcattgttcaagcgcaacttctcacagattcaaatgctcaggatttgaatactgcccttggacagaaagtgcaatacacctttcttgacactggaaattctaacgatcaactacttcatcttccaagcaccacctcttccagcattattactggttcattagctgctgctaatttcaccggttcttcatcatcgtcgtctataccaaaagtcacttccagcgtcataacatctataaattaccaatcctcaaattctacggtagtcacccagttcacgccattgccttcttcgtcgagaaatgaaacaaaaagctctcaaacaactaatactataagttcaagtacaagcacaggaggtgtaggttcagtcaagccatgtctttacttcgttttaatgttagaaacaatcgcttatttgttttcttaa

SEQ ID NO: 688 - DNA, 486 bp, Saccharomyces cerevisiae
atgaagctaggacatcgtgagcaacaattctacttgtggtacttcatcgttcacattcccatcaccatattcatcgactcatcagtggttattcccgctaaatggcaactagggattgcgcaaaaggttgttagtgatcacatcgcaaagcaacacgatttcctgctatcagagaaaccagaatggctatactggtttgtagtccttgagctagttctgcaactaccccttttcgtctatttcgtcaataaattctggaattcaagcgaattacaagttaatacaaatagcagattgaaaaagtggttgcgtatctatggctggaatgcctctctaactaccttgatatgtatcgttgttattttcaagcgtggttacattccttacgatgtgctaaaaacaagcttgtccatgacccagaagtgtcagttagcctcggtgtacctacctacattcctaattcctttgcgtttgtgttttgtgtag

SEQ ID NO: 689 - DNA, 486 bp, Saccharomyces cerevisiae
atgacaaagaaggataagaaggaagtaaaagttcaaacggttaccacggaggatggtgaaaccgtgaaagtttttgaagacctgcagggttttgaaactttcattgccaatgaaactgaagatgatgatttcgatcatttgcactgtaaattaaattactacccaccatttgtgctacacgagtcgcacgaggaccctgaaaaaattagtgatgctgcaaattctcattctaagaagttcgtgcgtcacctgcaccagcatattgaaaagcatcttttgaaagatattaagcaagccgttaggaaacctgagcttaaatttcacgaaaaatcgaaggaagagacatttgataaaatcacctggcattacggtgaggaaactgaataccatggtagacctttcaagatagacgttcaagtagtttgcacacatgaagatgctatggtatttgtcgattacaaaacacatcctgtaggcgcaaattaa

SEQ ID NO: 690 - DNA, 486 bp, Saccharomyces cerevisiae
atgacaattgaaaaaccaaaaatatcggtcgcattcatttgtttgggtaacttctgtagatcaccaatggcggaagccattttcaaacatgaagtcgaaaaggctaatctagaaaatcgattcaacaagattgattcatttggcacttctaattatcatgtgggggaaagccctgatcatcgtacagtgtccatttgtaagcaacatggcgtcaagattaatcataaagggaaacaaataaagaccaaacacttcgatgaatatgactatataatcggtatggatgaatccaacattaataacctaaaaaaaatacaacctgaaggttctaaagctaaagtttgcctttttggtgattggaatactaatgatggcactgtgcagaccattattgaagatccttggtatggtgacatacaagatttcgagtacaacttcaaacaaatcacctatttctccaaacagtttttaaaaaaagagttataa

SEQ ID NO: 691 - DNA, 486 bp, Saccharomyces cerevisiae
atgagtaagaacaggtcatcgctacagtctggtccacttaatagcgagttattggaggagcaaaagcaagaaatatatgaggcgttttcattgttcgatatgaacaatgatgggttcctcgattaccacgagttgaaagtagcaatgaaggccctgggatttgagctacccaagagagaaatacttgacttaatagatgaatatgatagtgaggggcggcatttgatgaagtatgatgatttttatattgtaatgggggaaaaaatattgaagagagatccgttagatgaaataaaaagggcattccaattatttgatgacgaccatactgggaaaataagtattaaaaacttgaggcgtgtagctaaagaattaggagaaactttgacggatgaagagctgagagcgatgattgaagagtttgatttggatggtgatggcgagattaatgaaaacgaatttatagctatttgcaccgatagttaa

SEQ ID NO: 692 - DNA, 486 bp, Saccharomyces cerevisiae
atgatcaagtatactatcgatgagctttttcaactgaagccaagtttaactttggaagttaatttcgatgcggtggaatttagagccatcattgaaaaagttaagcaattgcaacacttgaaagaggaagagtttaacagtcatcatgttggtcatttcggtcgtagaagatcttcccaccatcatggtagaccaaagattaagcacaacaagcctaaggttacaaccgattcagatggttggtgcacatttgaagccaagaagaagggtagtggagaagatgatgaagaagaaacagaaaccacaccaacttctactgtgccagttgctaccattgcccaagaaactttaaaagtcaagccaaataacaaaaatatttcttccaacagacctgctgataccagagatattgttgcggacaagccaattcttggtttcaacgcatttgctgctttggaaagtgaagacgaagacgacgaagcataa

SEQ ID NO: 693 - DNA, 486 bp, Saccharomyces cerevisiae
atgccacaagtacagtcgtggtttcctgttcagaaacaaccgacgctagcggtaacatttacaccattaccacaactgtcccatgctcatctaccactgccaccatcacatcttgtgacgaaaacggatgccatgttccagcaccaactgctaccgacgcaactgcaaccgtttcctccaagtcatacaccactgttactgttactcactgtgacaacaatggctgtaacaccaagactgtcacttctgaatgttctaaagaaactgcagcaaccaccatttctccaaaatcatacactactgttaccgttactcactgtgacgacaacggctgtaacaccaagactgtcacttccgaggcttccaaacaaacatcattggccactagcacagtcaccaagtctgctgctccaacttctcatactgctgcttccagcaccttcactggtattgtcgttcaatccgaaggtatggctgctggtttga

SEQ ID NO: 694 - DNA, 486 bp, Saccharomyces cerevisiae
atgctacaactgaaattcatatggccagtggccagaatcacacctatttataggccatttaccagtcatccattcagaaatttagctacttcctcaagcatcagtagtacaaaagctaagactactaagacagatacaactccactaaaattatcaaatgaactatatgcaatattcaagattcataatcgtccatatttggtgaccgagggcgacagagttattcttccattcaaattgaagcaagcggaggtgggtgacattttaaacatgaccgatgtaacaactttaggatctagaaactacaagctagttggtcatccaatcaatacttctctgtatactttaaaagcaaccgttgttgggaaaactaaaagggctttccaaactagggaggtaacgaagagaagaaatagacgggtccgtcatgcaaagagtaaaggtgatttgacaatcttaagaatatcagaactgagtatgaactga

SEQ ID NO: 695 - DNA, 486 bp, Saccharomyces cerevisiae
atggagaagatcaaagagaaattgaatagcttaaaattagaatctgagtcatggcaagaaaaatatgaggagctgagagaacagctcaaagaattagagcaatctaacactgaaaaagaaaacgagattaaatctttgtccgctaaaaacgagcaactcgacagtgaagtggagaagttagagagtcaattgtctgatacaaagcaattggctgaagactccaataacttgagatctaataatgagaactacaccaagaaaaaccaggatctagaacaacagctagaagacagtgaagccaaactgaaggaagcaatggataaactgaaagaggccgatttgaactctgagcaaatgggtagaaggatcgttgctttggaagaagaaagagatgaatgggaaaagaagtgcgaagaattccaaagcaaatatgaagaagctcaaaaagaattggacgaaattgctaattcattggaaaatttatga

SEQ ID NO: 696 - DNA, 487 bp, Saccharomyces cerevisiae
atggatgatatttgtagtatggcggaaaacataaacagaactctgtttaacattctaggtactgagattgatgaaatcaatctcaatactaataatctttataatgtatgttttcatttcaaggatagcctttgaatcaatttactaacaatacttcagtttataatggaaagtaatttgactaaagtagagcaacatacattacacaaaaatatttctaacaataggttagaaatataccaccacattaaaaaagagaagagcccaaagggaaaatcatcaatatcaccccaagcacgggcatttttagaacaggtttttagaagaaagcaaagccttaattccaaggaaaaagaagaagttgcaaagaaatgtggcattactccacttcaagtaagagtttgggtatgtaatatgagaatcaaacttaaatatatcctatactaacaatttgtagttcataaataaacgtatgagatctaaataa

SEQ ID NO: 697 - DNA, 489 bp, Saccharomyces cerevisiae
atgaccacatctttttatgatttagaatgcaaggacaagaaaggcgaatcttttaagtttgaccaactgaaaggcaaagtagttctcatagttaatgttgcctccaagtgcggcttcacgccgcagtataaagaattggaagaactatacaaaaaatatcaagataaggggtttgttattttggggttcccatgtaatcagttcgggaagcaggaaccgggctctgatgaacaaattacggaattttgccagttgaattatggcgttacattcccaattatgaagaagattgatgttaacggaagtaatgctgactctgtctataattatttgaaaagccaaaaagcaggtttactaggtttcaagggtatcaaatggaattttgaaaagttcttagttgattccaatggtaaggttgtccaaagattttcctccttaacaaaaccatcgtccttggaccaagaaatccaaagcctgttaagtaaatga

SEQ ID NO: 698 - DNA, 489 bp, Saccharomyces cerevisiae
atgatcgaagagaagaaggaacttaagaaacgcagggttcttcaaatggccagattttatggtgcggccgccttcaccctgattaccatgaggcttatctccagggccataaaagtacgaaaatgtatgtattttgtcctagttcagtggccaaaactaataataggatatagttactaacaccgtctactgaaagcagacgtccccagcatatttcaacaaaattacaagcttccacctttttcccaaaggaatgaagccatgtcagcgttaacgtatgcatccgccgcttcaataggtacgttcagcacattgatattcggcttttgttgggcacttgacatttcaacggcaagagagtttgtatttaagactagagagttcatgagccttccacaagccttagaaaccgacacgagcatggacgaagaaacttccaaactaactaagcaattgcaagacctcctgtcgagcgaaaacaacaagtag

SEQ ID NO: 699 - DNA, 489 bp, Saccharomyces cerevisiae
atgcaacaaagatcaaataggagaagctgctcctatataccactcggggtacataataatgccgaaaagagcttgtgcaccgaagttgctccagcaagaaagaacaaaaggtctattacgacttctcccatagtcaacatcaacgttgtagaaagaagactgtttaatttggaattggaaaaacaacaacttcgtgccaaaaatctgtctgagaacacaggtggcggaagccccaatgggggtgcttatctggacgccaaaaaaggagtaagagaacaagatcaataccaaggaggtccctcgaaagagcttgacaggctacaaccaccaccttcaatgaagaaaagccctccaaggaagaagaagagcctaaaggacttgatatatgaaacgaacaagacattctatcaggtggattctaacaaggttaaatataaggtaggtctatccaagaaacagctattaccatccaaaacggtagacaactaa

SEQ ID NO: 700 - DNA, 489 bp, Saccharomyces cerevisiae
atgcacaatatgtttccagcactcacaaagacactgtcgttgcaaggctacaagattatcaactctcaaacagggtccgctgcatggtcgtgcggtcgtaggtggtttagtagtgataaagatgaccacgacgatgtggtgacgaggattaaaattgcccccataaagagaactaacgagccattggataagaaaagagctcggttgatatatcaatcacgcaaaagagggatcttggagacggacttgctgctatctgggttcgctgccaaatatttgaagaagatgaacgaagaggaactggaagaatacgattcgctattgaatgagttggactgggacatatactattgggccacaaaaaatttcaaaaccagccccttgcctgacaagtgggccaattctaaattgctgaagcagctacaagaattcagtgaaaataaagagaaggaaattttaagtatgccggacttgtccaagtatcaatga

SEQ ID NO: 701 - DNA, 489 bp, Saccharomyces cerevisiae
atgccaagagaattcaaatcctttgggtctacagaaaagtctttgctgtcaaaaggacatggagagcctagttacagcgaaatatacgctgagcctgagaactttttagagattgaggtgcacaaccctaaaactcatataccaaatgggatggattcgaaggggatgtttacagattacgaaataatatgccgtacaaacttgccaagttttcacaagagggtatcgaaagtaaggagacgatactcagactttgaattcttccgcaaatgcttgatcaaggaaatttctatgcttaatcacccaaaagtcatggtacctcatttaccgggtaaaattctcttgagtaatagatttagtaacgaagtcattgaagagaggagacaaggtttgaatacctggatgcaatcggtagccgggcacccgcttttacaatctggttctaaagttctcgtgaggttcattgaagctgaaaagtttgtcggctga

SEQ ID NO: 702 - DNA, 489 bp, Saccharomyces cerevisiae
atggtaatgagggaagaaacaataaaatcgctagaagatccttacaaatatcactacaaagaagaatggttaaatactaaagatcccgatgaacaacaattattcgaaatatttgcctttggaaacattaaagatctaccggaaaacataatcctaacatcattaatgcgatcaaaactggagaaattaacattggtaacattaagcgaaatatataatgagttaagttacgagttaattaaagaagaatgtcaaattgaagacgatggtatcatcgaaagccatttaattcagctacagaatatttttaaagcagagatggattcagtcagtaaatctatgaaattttcaagaagatttgactgtagagatgtgtactgtcatgaaaaggaactgactataattaaaaatccgcgagtgacgaaagagtatttagttcaaaatcttcggagctgggaaacaaagctcaaacagaatatattggagtaa

SEQ ID NO: 703 - DNA, 489 bp, Saccharomyces cerevisiae
atggtgatgctccattctaaaaacgttaaagggtttctggaaaacactttgaaaccgtatgatttgcattcggtagacttcaagacatcgtctttgcaatcgtctatgattataaccgccactaatgggggtatactgtcctatgcgacgtcaaacaacgatgtaccgaaaaattccataaacgaaataaactcggtcaataacttgaaaatgatgagcttattgattaaggataagtggtcagaggatgaaaacgatactgaggaacagcactccaatagctgttaccctgtggaaatcgactcctttaagacaaaaatatatacttacgaaatggaagatttacatacctgtgtcgcacagatacccaatagcgaccttttgctattgttcattgcggaaggtagcttcccttacggactactggtaattaaaattgaaagagctatgagagagttgactgatttgtttggctacaagctaggttga

SEQ ID NO: 704 - DNA, 489 bp, Saccharomyces cerevisiae
atgtcccaagtctattttgatgtcgaagctgatggccaaccaattggccgtgtcgttttcaagttgtacaacgacatagtcccaaagactgcagaaaacttcagagctctatgtaccggtgaaaagggattcggctacgctggctctccattccacagagttattccagacttcatgttgcaaggtggtgacttcactgctggtaacggtaccggcggtaagtctatctacggtggcaaattcccagatgaaaacttcaagaagcaccacgacagaccaggtttgttgtccatggccaacgccggtccaaacaccaacggttctcaattcttcatcaccaccgttccatgcccatggttggacggtaagcatgttgtctttggtgaagttgttgacggttacgacatcgttaagaaggttgagtccttgggttctccttccggtgccaccaaggctagaattgttgttgccaagtccggtgaattataa

SEQ ID NO: 705 - DNA, 489 bp, Saccharomyces cerevisiae
atgtcttcttcccaggtcgtcagggattctgccaaaaaattagttaatttactggaaaaatatccaaaggatcgtatacaccacttggtctcattcagggatgtacaaatagcaagatttagacgtgtagcgggtctgccaaatgtagatgacaaaggaaaatctataaaagagaaaaaaccctcattagatgaaataaaaagtataattaacagaacttccggtccattaggactgaataaggagatgttaaccaaaattcaaaataaaatggtagatgagaaattcacggaagaaagcatcaacgagcaaattcgtgccttgagcactataatgaataataaattcagaaactattacgatattggcgataagctctataaacctgcaggaaatccccaatattatcaacggttaataaatgccgttgacggtaagaaaaaggaaagcttatttactgcaatgagaactgtattatttggtaaataa

SEQ ID NO: 706 - DNA, 491 bp, Saccharomyces cerevisiae
atgtttttacgtactcaagctcgtttcttccatgctactaccaagaagatggacttctcgaaaatgtccatcgtcggccgcattggctctgaattcactgaacatacttctgctaataacaatcgttatttgaaatatagtatcgcttcgcaaccaagaagagatggccaaaccaattggtataatatcaccgttttcaatgaacctcaaatcaattttttgacagaatatgttagaaaagggtatgttatttattcttcaattttacttactttacaattacgcgttataatttactaacatttcctttccataatttattcagcgctttggtatatgttgaagcagatgctgctaactatgtcttcgagagagacgacggttctaagggtactactttgagcttagttcaaaaggacattaatttattgaagaatgggaagaaattagaagatgctgagggccaagaaaatgctgcttcttcagaataa

SEQ ID NO: 707 - DNA, 492 bp, Saccharomyces cerevisiae
atgaatagcgcaggccgcgtccatcgttcacgagcaggatctaggggccacgcggcaatttcacctttgacaatggcatctttcagtgttgcgaggggaattcgttcttcgaatgtatatgacgacacagacgatgaattgtccatcttgacctttttcagcgccgttaggagaaaccgccttactagctcattgccgccgatcctctctgcaaggtgttcatcagcctgtttcagcgtgcggatagttttgcccttgtcgttgacgatttccatcagcgctttgatgtattcgacaaactcagcgttagggcgcaaactcaccggagcgttctctatacagactaacatcgaacaaagttgcgggtttttcaggaccagcatcatggcaactttaccacccattgagtgtcctattataatagggcctccattggtgtttaattcgtgctttgtgataaagtgtttcacgtcttccgacatgacttcgtag

SEQ ID NO: 708 - DNA, 492 bp, Saccharomyces cerevisiae
atggaccatagtgaatcgctaacgtttaaccaacttacgcaggactacataaataaactcaaagatgctttccaaatgctggatgaggatgaggatggtctgattagtaggggagatcttaccaagatatatgcaacattggggaagacattgacagatgaggaatggtccaaaatggtacctgacaatgacaccagtaccgcggaagttggagaagaaggtgtaagctttcccatattcttatctatcatggggaagaacttatcgcagtttcccgagcgtgaagaattggaagaaagtttaaaagccattggaagaggacacgatttaaacgttcccttgaatgaggtcattgattctttaaaggaagccggttttgaaaatcctgaggaagaatttgctaaacttttcaaattgtttactacaaatcagcaagcgaccgaagagagaactttcagaggtaagcttttcttagattcaatcaccgattaa

SEQ ID NO: 709 - DNA, 492 bp, Saccharomyces cerevisiae
atgtcagaattctataagctagcacctgttgacaagaaaggccaaccattccccttcgaccaattaaagggaaaagtggtgcttatcgttaatgttgcctccaaatgtggattcactcctcaatacaaagaactagaggccttgtacaaacgttataaggacgaaggatttaccatcatcgggttcccatgcaaccagtttggccaccaagaacctggctctgatgaagaaattgcccagttctgccaactgaactatggcgtgactttccccattatgaaaaaaattgacgttaatggtggcaatgaggaccctgtttacaagtttttgaagagccaaaaatccggtatgttgggcttgagaggtatcaaatggaattttgaaaaattcttagtcgataaaaagggtaaagtgtacgaaagatactcttcactaaccaaaccttcttcgttgtccgaaaccatcgaagaacttttgaaagaggtggaatag

SEQ ID NO: 710 - DNA, 492 bp, Saccharomyces cerevisiae
atgtcgcagaagattggacacagtggcttggcttttgcgcgcctttggcaccatgtcgacgttgcccgtgataagaggacattgggtagattggcttcagcaattgcaattaccttaattggtagacataagccggtctatcatccgtcacaagactgtggagactacgtagtagtgactaattgccaaaaaatccgtgtaacaggtaagaaatttgagcagaagacttactggtctcattcaggtagacctggtcagctaaagttacagacaatgaacaaggttgttgccgataaaggatttggagaaattttgaaaaaagcagttagcggtatgttgcctaaaaataaattgagaaagcaacggttagaccgcttaaaagttttcgatggaagtgaaaacccttataaacaaaatattactgcctttgcccatgagcaatcatcaataccagagcctcttaaagaatcaatttttaaccaattgaaatag

SEQ ID NO: 711 - DNA, 495 bp, Saccharomyces cerevisiae
atgaccaatgaaggaataggtataaatagagatacttcaactatatgccttcgagaatatgtctttattcatttctttcctgttaagcttatatcagcactaacaaacaaaacaaatacaatggtcaaattaacttcaatcgctgctggtgttgccgctatcgctgccggtgttgccgctgctccagccactaccactctatctccatctgacgaaagagtcaacttggtcgaattgggtgtttacgtctccgatatcagagctcatttggctcaatactacttgtttcaagcagctcatccaacagagacctacccagttgagattgctgaagctgttttcaactatggtgacttcaccaccatgttgactggtattccagctgaacaagtcaccagagtcatcactggtgtcccatggtactctaccagattgagaccggctatctccagtgctctatctaaggacggtatctacactgctattccaaaatag

SEQ ID NO: 712 - DNA, 495 bp, Saccharomyces cerevisiae
atgacgaaaaaggataagaaagcaaagggtcctaagatgtccaccatcactacaaaaagtggtgagtccttaaaggtttttgaggatttgcatgattttgaaacatatttaaagggtgagacggaagatcaagagttcgaccatgtccattgccaactgaagtactatccaccctttgtcctgcatgatgcgcatgatgatccggaaaagatcaaagagactgccaattcgcactctaagaagtttgttcgccatttacaccagcatgttgagaagcacctgctaaaggacatcaaaaccgctatcaacaagccagaattgaaattccacgataagaaaaagcaggaatcctttgaccggattgtttggaattatggcgaagaaacggagttgaacgccaagaaattcaaggtgtctgtcgaagttgtatgtaaacacgatggcgcaatggtagatgttgattacaagacagaacccttgcagccactcatctaa

SEQ ID NO: 713 - DNA, 495 bp, Saccharomyces cerevisiae
atggcagaacaaattagtcacaaaaagtccctgagggtgagcagtctgaacaaagatagaagattgctcttaagagaattctacaacttggaaaatgaaccgaataaaggtcgtcaagaagcacgtataggggaaaaagccagcgaggctcattctggggaggagcaagtcacagatgtgaatatagataccgaagcaaacactgagaaaccagtgaaagatgacgaattgagtgcaactgaagaggatctcaaggaggggtcagaagatgcagaagaagagataaagaacctgccctttaagaggctagtacaaattcacaataagctcttgggcaaagaaaccgagactaacaattctatcaagaataccatttacgaaaactattatgacctaataaaagtcaacgaccttctcaaagaaattacaaacgccaatgaagaccaaattaacaagttgaagcaaacagtagaatctttaatcaaggaactgtaa

SEQ ID NO: 714 - DNA, 495 bp, Saccharomyces cerevisiae
atggtatctagtgcagttaaatgtggcatatgtcgcggagttgatggtaaatataaatgtcctaaatgtggcgtacgatattgctccttgaaatgctataaagatgctgcaaagcatgttcataaggaaagcgaacaacccagggctggtacagaagctaatgtggaagttgttaataacgataagatcataaacagttcactcgcaatgaataaaacattaaagacgaaggcattcgatgatatatatcaaaatagcgcagaattgcaagagctgttgaaatacaacacggtgaagttccatttggcaaaggtttatagaattttgtccagtactgttaacgatggaagttctggaaaaatgaacagcgatctacaaaaagaactagctgtaaattatttgaatacattacgatatggtggtatacattataatgaagcaattgaggaattttgccagattttattagataaattaaatgcggtgaagaaataa

SEQ ID NO: 715 - DNA, 495 bp, Saccharomyces cerevisiae
atgtcaacgcaactcgcaagtaacatatatgctccattgtacgctccctttttcgggttcgcaggttgtgcagctgccatggtgctttcctgtttgggagctgccattggtacagctaagtcaggtattggtatcgccggtataggtactttcaagccggaattgatcatgaagtctttgattcctgtggttatgagtggtatcttagccatttatgggcttgttgtggccgttttaattgcaggtaatttatctcctaccgaagactatactctcttcaatgggttcatgcacttgagttgtgggctctgtgtgggatttgcctgtttgagtagtggctacgccattggtatggtcggtgacgttggtgttagaaagtatatgcaccaaccaaggctttttgtcggtatcgttttgattctaattttctctgaagttttagggttatatggtatgattgtagctttgattttgaacactagaggctctgaatga

SEQ ID NO: 716 - DNA, 498 bp, Saccharomyces cerevisiae
atgcctccaaagtttgatccaaatgaagttaagtacttgtacttgagagctgtcggtggtgaagtcggtgcttccgccgccttggctccaaagatcggtccattgggtttatccccaaagaaggttggtgaagatatcgccaaggccaccaaggaattcaaaggtatcaaagttactgtccaattgaaaatccaaaacagacaagctgctgcttctgttgttccatctgcttcctctttggtcattactgctttgaaggaaccaccaagagacagaaagaaggataagaacgtcaagcatagcggtaacatccaattggatgaaattattgaaattgccagacaaatgagagacaaatccttcggtagaactttggcttccgttactaaggaaattttgggtactgctcaatctgtcggttgtcgtgttgatttcaagaaccctcatgacatcattgaaggtattaacgctggtgaaattgaaattccagaaaactaa

SEQ ID NO: 717 - DNA, 498 bp, Saccharomyces cerevisiae
atgcctccaaagtttgatcctaatgaagttaaatacttgtacctaagagccgttggtggtgaagtcggtgcctccgctgctttggctccaaagattggtcctttaggtctatcgccaaagaaggttggtgaagatattgctaaggccaccaaagaattcaagggtatcaaggttaccgtccaattaaagatccaaaacagacaagctgctgcctctgttgtcccatctgcttcctctttggtcattactgctttgaaggaaccaccaagagacagaaagaaggacaaaaacgtcaagcacagtggtaacattcaattggatgaaattattgaaattgccagacaaatgagagacaaatccttcggtagaactttggcttccgttactaaggaaatcttaggtactgctcaatctgtcggctgtcgtgttgacttcaagaatccccatgatatcattgaaggcattaatgctggtgaaatcgaaatcccagaaaattag

SEQ ID NO: 718 - DNA, 498 bp, Saccharomyces cerevisiae
atgaaagttaaaataaacgaagtgcacagtgtgtttgcttggtcatggcacatccctagcacatctgatgaggacgcagccaataacgatccaattggcaatgatgaagacgaggatgtctgtggtatctgtcgtgccagttataacggtacctgtccaagctgtaaatttccaggcgatcaatgccctttagtgattgggctatgtcatcataacttccatgatcattgtatataccgttggcttgatacaccaacctcaaaaggactgtgtccgatgtgtaggcaaactttccagctacagaagggtctagcaattaatgacgctcatgtccaaaagttcgttgaaatagtttcaagaagaagagaagaaatgatagaggagggcgtcgcagaagagtttgtggactttgatgaaccaataaggcaaaacaccgataacccaatcggtagacagcaagttgataccatcctggacgaagactttttgttacgataa

SEQ ID NO: 719 - DNA, 498 bp, Saccharomyces cerevisiae
atgacagatgctttggaacagagcgtccttgcgttggagggaacagtttcagtattgaaggattctgtggagtctttaaaatgtgcaaatgagccaagcacgaaccttgcatcgacaatgttgcaaaccaaaagggttttccgtttagttcccgaatatgatgttgaaagatcaaaattagatttgattgaagaggtagaaccgctggttaggactctgggcgataagttacgtaaatctatgggtagaatgcaaagggaactcgatactttgcagcaaacttatgaattaaacgatttaaggctaaagaagaacattagtatggatgacgatgatgctctgaatagtccagacatgggtcaagaatacgaaggcagagacgcggacgacgtggttatgatggcatcttctactaatgaggaattggaagaattgaagaaactaaaggaaaagaagaagcaactggagaataagttggaaatactcaaacagaaatag

SEQ ID NO: 720 - DNA, 498 bp, Saccharomyces cerevisiae
atgaccactcgaaaaacagtagattcaagacttttagaatggcaaaccacatgcaagcatccagtgataaacttgactccagagaaagtcgataaattataccacttgaaattgaaaagtgaaagcaaaaatatcagttcaaacaggctattgcccatttcattatcaagcttacaaaaaaaaatggagaaacttttcatcaaagataaaagtcactcacacaagccttcccttccagatcctaaggtgccaaccctacgcacttataaagatggtggatttttcattagcggaaaaggttcaatgaaactaccagatatcgaaagcgctattcataaatttttatggaagaaatacgggaaaggattggtttactgttatgggtgtgatccaactggaaaaaagaggcatacagagtggttcaatgtgcctgtattggagctaccatcagtactaagacttattgattcttattgccttggaggagaatctcgttag

SEQ ID NO: 721 - DNA, 498 bp, Saccharomyces cerevisiae
atgagatttccttcaatttttactgcagttttattcgcagcatcctccgcattagctgctccagtcaacactacaacagaagatgaaacggcacaaattccggctgaagctgtcatcggttacttagatttagaaggggatttcgatgttgctgttttgccattttccaacagcacaaataacgggttattgtttataaatactactattgccagcattgctgctaaagaagaaggggtatctttggataaaagagaggctgaagcttggcattggttgcaactaaaacctggccaaccaatgtacaagagagaagccgaagctgaagcttggcattggctgcaactaaagcctggccaaccaatgtacaaaagagaagccgacgctgaagcttggcattggctgcaactaaagcctggccaaccaatgtacaaaagagaagccgacgctgaagcttggcattggttgcagttaaaacccggccaaccaatgtactaa

SEQ ID NO: 722 - DNA, 498 bp, Saccharomyces cerevisiae
atgcaattgttttccatcctctctttgttgtcatcattgatgtgttcattgaccgttttagggtcttccgcaagttcctatgttaagtttcctgttcaaaagtttgctgatattataaatataggcacacaggatgtttctaccgtcttcaaaagaaatgaggttcttaacaccacagtgataaatggaataggagtgtatgttgtcaagatggaaatcggaacgcctccacaaacggtgtacctacagttagatactggctcttcagatatgattgtgaataatgctgacattgcctattgcaaatcgatgtctgacggatctgactacgcttcaactgataattacgaactcacggcaacattcactgggcctcgttctactaccacctcaccagagcttataacactgtccgctcttataggggtaaattcaatgcaagaaactcatctacttttaagaataacgcgactttcttcaatgacatatacgtattag

SEQ ID NO: 723 - DNA, 498 bp, Saccharomyces cerevisiae
atgcttcctgttataacgagatttgcaaggcctgctctgatggccatcagacctgtgaatgccatgggggttttgagagcgtccagcataacgaaaaggctttatcatcccaaggtcatagagcattatacacatccaagaaacgtcggctcattagataaaaaattgcccaacgtcggcactggtctagtgggtgcgccagcgtgcggtgatgtgatgaggttgcagatcaaagtcaacgactctactggcgttattgaagatgtcaaattcaaaacttttggatgtggctccgccattgcctcctcttcatatatgactgaattggtacaggggatgaccttggacgatgcggcaaaaattaagaacactgaaattgctaaggagttgagcttgcccccagtcaagttgcattgctctatgttagcggaagatgcgatcaaggcagctattaaggactacaaatctaagagaaacactccaaccatgttatcgtaa

SEQ ID NO: 724 - DNA, 498 bp, Saccharomyces cerevisiae
atgtcgaaaaccgctcagaaacgtctcctcaaggagcttcaacagttaattaaagattctccacctggtatagtggctggtcccaaatcggagaataacatattcatttgggactgcctaattcaagggcctccagatacgccatacgctgatggtgtttttaatgctaagctagagtttcctaaagactatccgttatctccacctaaacttactttcacacccagcatactacatccaaatatttatccaaatggggaagtgtgcatatccattctacactcccctggtgatgatcctaacatgtacgaattagcggaagaaagatggtcgccagtgcaaagtgtagaaaaaattctattaagtgttatgagcatgttgagtgagcccaatatcgaaagtggtgccaacattgatgcttgcatcttgtggagagataatagacctgaatttgagagacaggtaaagttatccattttgaaatcattaggattctga

SEQ ID NO: 725 - DNA, 499 bp, Saccharomyces cerevisiae
atgtcaaaagtgtatgttattataagttttgaaagggatttcaacatatactaacaaattcttgaaatgtaccctcactgtcctattgtaaatcagaccaagaaattttaggttgttagaagaattagaaaagggtgaaaaagggtttggtccagaatcatgtagttatggtttagctgatagcgacgatattaccatgaccaaatggaacggcactattttagggccccctcatagtaatcatgaaaacagaatctattccctttctatagattgtggcccaaactatccagattctcccccaaaggtcactttcatttccaagataaatctaccatgcgtcaatccaactacgggggaggtccaaactgacttccacaccttacgtgactggaaaagagcctacaccatggaaactttattacttgatcttagaaaggaaatggcaaccccagcgaacaagaaattgcgtcaaccgaaggaaggagaaaccttttag

SEQ ID NO: 726 - DNA, 499 bp, Saccharomyces cerevisiae
atgtggctcacagaggctcaaagtatgtttttaatattttagatgctctttgcttctccgagagacgttagttccttttttactaacaacttacttttcactagaatttggtgtggccttcactttcggcggttttctcttctttttgtttggtatatttactttttttgatcgtgccctattggccttgggcaatattttgtttttaattggagtattcttaataatcggttcacaaaagacatatattttttttaccaggccaaacaaaaggcgcggttcactatttttcctagttggtgccttcttaatactgttgaaatggacatttttgggctttataattgaatctctaggtattataggtctctttggtgatttttttggcgtcatcgtacaatttttgagatcaatgcccataattggtcccatactttctcacccagcaatcgctccaatagtagataaattagcgggagttagggttctgccagtataa

SEQ ID NO: 727 - DNA, 501 bp, Saccharomyces cerevisiae
atgagcggtagtaggggcaatagcagcaatagtagcgtcagtaataatagtaataataacaataataatgacgggggcgacgagagattgctgtttctaagaagcgtgggcgaacgcaatgaaattggctttccctctagattcaagtcggcgcattacaagaaaccgacaagaagacacaaatcagcgaggcagttgatctcggacgaaaacaagcggatcaacgccttgttgaccaaggctaacaaagctgcagagagttctactgctgctaggcgacttgtgcccaaagcgacgtactttagcgtggaagcgccaccgtctatcaggcctgccaagaagtactgcgatgttactgggttgaagggcttctacaagtcgcctacgaacaacattcggtatcacaacgcagaaatctatcagttaatcgtaaagccgatggcccccggcgtcgatcaggagtacttaaaattgagaggggccaacttcgttctaaaatag

SEQ ID NO: 728 - DNA, 501 bp, Saccharomyces cerevisiae
atgggtagatattcggtgaagagatacaagactaaaagaagaacacgagacttggacctgatctataacgatttgtccaccaaggaatcagtacagaagcttctgaaccagccattggatgaaaccaaaccgggccttggtcagcactattgcatacactgtgccaaatacatggagactgctatagcgttaaaaacgcatttaaagggcaaagtgcacaaaagaagagtcaaggagttgaggggtgtcccttacacacaagaagtctctgatgctgctgcgggctacaatttgaacaagttcttgaaccgtgtacaggagatcacgcaatcggtgggtccggagaaggaaagtaatgaggccttgctgaaggagcatttggacagtaccttggcaaacgtcaaaacaacagaacctactctaccgtgggcggctgctgatgccgaggcgaataccgctgccgtaacagaggcagagtctactgcctcagccagtacttaa

SEQ ID NO: 729 - DNA, 501 bp, Saccharomyces cerevisiae
atgtcaagatatggcaaaaaccttgtgcattatataatcgtggaacacgacgatcaacgcggccaaaagccgatcgacgacgacgacgaaaaaaatttttattaccactgttccttcaccttcgaaactttttttcgggcgacggcgtttcttttagctcctgcggtatgtgcggtgcgggaggtcccttgtcgcctcacacggacccgatataacgctacggaatacatcgaggggtatgggtggatgatatcactgcagcaaggtctgggtgttgcagaattttaccggccttggcccctcagcgtccagctacagcgttatactactccaagtcgccgttcccgttttgctgttctcacccctcagagaaaatgccaccagaacgaagccaatggtcaggacttatcgttacttatactgttgagccggatatatccgctgtgctctaataccagccaaacgagaagggtagcggcaagaaagggtaaactttcatga

SEQ ID NO: 730 - DNA, 502 bp, Saccharomyces cerevisiae
atgtctgcaacgtatgtacactaatatctgaaacgtatcgcctaatcttttctcccggttctcttttgactaacgtatatcatctatgaccatctttcttttccccagtgctaaacacgacagtaacgctagcccaaattctgactctgaagacggtcaccaccacaacaataagaaggaatgcgctatcgaatatctgaaggcacggttaaatagtgcatcagcagtcgcttgcggctacctccaagcttttgtcagtaagacgcaagactttgccaaagtatgctttttagaacttcagaatcccgttgtcttggtcaacttgttgctgcattcttcagtggtatgttatttatgtaacgggtatgcgaaccacaacgccagattcttgaaggggaaacctaactctacagtcttagcaacaaccgccggcgctctgggtcttttgacgctggacggtataatttcaaagaaatactactccagatacgacaagaaataa

SEQ ID NO: 731 - DNA, 504 bp, Saccharomyces cerevisiae
atgaacaacgagactagtggtaaagaaacggcgtctgcacctctgtgttcgcccaagttacctgtagaaaaagtgcagagaatagccaagaatgatccagaatatatggacacttcggatgacgcattcgtagccacagcgtttgctacagaattcttcgtccaggtgctgacacatgagtccctacataggcaacagcagcagcaacaacaacaggtaccgccgctcccagatgaactcacgctgtcgtacgatgacatctctgccgcaattgtgcactcttctgacggccatctgcagtttttgaatgatgtgataccaacaacaaagaatttgaggcttctagtggaagaaaaccgagttagatatactacaagtgtcatgccccctaatgaagtttactccgcctatgtggtgaacgatacggctccgaagcccaacattgtcgagattgatcttgataatgacgaagacgacgacgaagacgttactgatcaagaataa

SEQ ID NO: 732 - DNA, 504 bp, Saccharomyces cerevisiae
atgaatctaagatttgaattgcagaaactattgaacgtttgctttttgtttgcatctgcttacatgttctggcaaggcttagccattgctactaatagcgcttctccgatcgtggtggtgctttcaggctccatggaaccagctttccaaaggggtgatatccttttcctatggaatagaaatactttcaaccaagtaggtgatgtcgtggtgtatgaggtcgaagggaaacaaatccccattgtgcatagagttttgaggcaacataacaatcacgcggacaagcaattcctcctgaccaaaggtgacaataacgccggcaatgatatctcactatatgctaataagaaaatttacttgaacaagtcaaaggagattgtagggaccgtcaagggctactttccacaactagggtacattacgatttggattagcgagaacaaatatgccaagtttgcattgttaggtatgttggggttgagtgctctgctggggggcgagtag

SEQ ID NO: 733 - DNA, 504 bp, Saccharomyces cerevisiae
atgattatttacaaggatatcttctctaacgacgaattgttgtctgatgcttacgacgctaagttagttgatgacgttatctacgaagccgactgtgctatggtcaatgtcggaggtgacaacatcgatatcggtgctaacccatctgctgaaggtggtgacgatgatgttgaagaaggtgctgaaatggtcaacaacgttgtccactctttccgtctacaacaaaccgcttttgacaagaagtccttcttgacctacattaagggttacatgaaggctgttaaagctaagttgcaagaaactaacccagaagaagttcctaaattcgaaaagggtgctcaaacttacgtcaagaaggttattggttctttcaaggactgggagttcttcactggtgaatccatggacccagatgccatggttgtcatgttgaactaccgtgaagatggtaccactccatttgttgccatctggaagcacggtattgtggaagaaaagatctaa

SEQ ID NO: 734 - DNA, 504 bp, Saccharomyces cerevisiae
atgattccttaccaggagtggcatagccaactgcaatcgttgtatgactcccagattttccataactgggccctttgccaagatgtccatttgaatgatgaaaaggatggacttcttttgcgtttaatacctactcgacaactgcagaaaaatactgagcgtatagaaaataaattactaaatcatatagaattatatcttacatattcaaaagtatataacgagcccttactacttttgcgaatatgggaggagaaaagcatagatggtattccaatgaccaaattgatgctcccaactgatatcgaatcgctgcttgatgttcaaggcaaattccaactaggtttggatactatcattaacctggaaggtagcgtttggtattctttccatccatgcgatacatcatgtatagtaggtgaccaggctgagttcatgtcaacttacttaagacgatgggtcagtattttcatatttagttggttaggttatgaagattcatag

SEQ ID NO: 735 - DNA, 504 bp, Saccharomyces cerevisiae
atgcaagaattttattctttttcaccaatagatgaaaacggaaatccattccccttcaactccctgcgtaacaaagtggttttgatagtcaatgtagcatctcattgtgcgttcacacctcaatacaaggaattagagtacttgtacgaaaaatacaaatcacatggtctagtgattgtggcctttccctgtggtcaattcggaaatcaagagttcgagaaggataaagagattaataagttctgtcaagataaatatggtgtaaccttccctattctacataagatccgttgcaacgggcaaaagcaagatcccgtctacaagttcttaaagaattcagtaagcgggaagtctggaataaaaatgataaaatggaattttgaaaagtttgtggtagaccgaaatgggaaggtggttaaaaggttttcatgcatgactaggccactagagctttgtccaataatcgaagaattactgaatcaaccaccagaagaacagatttaa

SEQ ID NO: 736 - DNA, 504 bp, Saccharomyces cerevisiae
atgcagggcgatatcagaaggaaaaaagatcttttacctcgttataaaacaggaagcaaatataattccagaagaaggggcggttatctgactacccctatgaaaaagattatagtatacattatactgttatgtggcgtttatttcgttataaaagttgcctattctgatctgaataaagaaactgagatcaagctagaaagccattcttctgatgtttctgcaagtgcaagcgatcataccaatattgcagccggcggtgcagctgatgcgactaacaataagcaaccacaacaagctaaagtacctaaagaaaagttcaataatgaagtcgcaaagcaacaagaagtaaagaatttggagaacgatttgaaaccacaaattgattcagaaaagcaaaaacaaataaacaaggacaaaaaagaacaaaaacagcaactccagaaagagaaacaagatctcgccaaggaaaatttggctaacaatgaaatccttgataattaa

SEQ ID NO: 737 - DNA, 504 bp, Saccharomyces cerevisiae
atggctttaagtttaggacagttcatcaatgtgggtggtatggtgaaggatttgaaaagtttcaactttagcgtatatggtagatggtttggatatatcaacataatcttgtgtattgcactcgggatagcgaatctgttccacgttagtggggtgatagcttttggtatcattagtataatccaagggttagtgatcctattcattgaaataccatttttgttgaaaatctgtccccttagcgataatttcattgaattcatcaagagatttgaaacaaatggatggagatgtcttttctatctagcaatggcgataatccagtatatttccattgcagtgatggctacgagtctaattgtggtagctgtcgggctaacgatatcgtcaatcagttatgcggtagcatatactaaacaccaagagttccagaatacgaacattatcaaaaatcctacagatgacgatttccctcacgaggccgttgttagagagatgttgtaa

SEQ ID NO: 738 - DNA, 504 bp, Saccharomyces cerevisiae
atgtctactattccctcagaaatcatcaattggaccatcttaaatgaaattatatctatggatgacgatgattccgatttttctaaaggtctaattattcaatttatcgaccaggcacaaacaacttttgctcaaatgcaacgacagctggacggtgaaaaaaatcttaccgaattagacaatctgggccattttttaaagggttcttctgctgcattaggcttacaaagaattgcctgggtttgtgaaagaattcaaaacttgggaagaaaaatggaacatttcttccccaacaagaccgaattggtcaacactctgagcgataaatcgattattaatggaatcaatattgatgaagatgacgaggaaataaagatacaagtggacgataaagacgaaaattccatatatctcatcttgatagcaaaagctttgaaccagtctaggttggagttcaaactggcgagaattgagttatctaaatattacaacacaaacctataa

SEQ ID NO: 739 - DNA, 504 bp, Saccharomyces cerevisiae
atgtctaggaagctgaaaaaaacgaatctgtttaacaaggatgtaagttccttgctttacgcttacggcgatgtgccgcagccactacaagctactgtgcagtgtttggatgaattggtatctggatatttggtggatgtttgtactaacgcattccatacagcccagaattctcagcgcaataagctccgattggaagatttcaagtttgccctccgtaaagacccgataaagcttgggagagcagaagaactgatagctactaataagttgattacggaagctaagaagcagttcaatgagacagacaatcaaaattcattaaagaggtacagagaagaggatgaagagggtgacgagatggaagaggatgaggatgagcagcaggtgacggatgatgatgaggaagcagcgggccgtaatagcgctaaacaatcaacagattcgaaggcaacaaagattaggaagcaggggcctaaaaacctcaagaaaacaaaaaaatga

SEQ ID NO: 740 - DNA, 504 bp, Saccharomyces cerevisiae
atgtctgtgaaacccattgacaactacatcacgaacagtgttcgcctttttgaggtgaatccatctcaaacgctcttctccatatcgtataaaccaccaacacagaagacagacaccaaagtgtcctttagaactcataactcgcatttatccttgaactataaatttactactaataagagtaaagatgtttcaagattacttagtgcattaggcccacgaggcgtatctataactccaggtaaaattgaaaaaatagcacagtcgaagaagaaaaataacaaaataaaagaatcgagtaaaaaaataaaaggtaagagcatccaagacattgttggtttagccaccttaattgtcaacacagatgtcgaaaagagcgatcctgcggctaagaaaactgctacagaaccgaagcaaaaagctaatgctgtgcaaaataacaatggtaactctgcagcttcaaaaaagaaaaaaaataaaaacaagggcaaaaaaaagcgttaa

SEQ ID NO: 741 - DNA, 507 bp, Saccharomyces cerevisiae
atgaaagaagcatctgatagagaagaagcaccaaaaatggtggaaaaaaactatagtacaggttttaggaaagcccacggagagaaggatcaatcagtgactaagccaatctcgttagatggtagaacaggtgaagtaattgttagaaaatccaccgggaaaactaaaatacgtaaaggtcaaacggaagaagagtatacacagcaattgcagcactacttcgaagtagaacaaggccctgtgcggacaaaggtaggatggatggatgaggtagatcccttggttgagatccgggaaggcaagtacgatatctccaataagcatcagcgacaggtgcttagtggtttctgccatcgtttattttaccaatgtaagtacaaggagtgtctggatctcagcacctattttctggggctctttgaaccgttcaacgtgaagaataaaatgaagagggagcttgaagagttggaatatatgatcgagcgatgtcgtgggcatgtattataa

SEQ ID NO: 742 - DNA, 507 bp, Saccharomyces cerevisiae
atgaataagtggagcaggctgtacgttataactgtacgcaggacttttccagggagaagaaacattgtactgacgcagtactggaataagagcaagaaaatgagtgacgaatcgaatgacgtgaagtggaacgatgccctgacaccattgcagctgatggtgctgagagataaggccactgaaaggcccaacaccggtgcgtatttacacaccaacgagtccggtgtctaccattgtgccaactgcgacagaccgttgtattcgagcaaggccaagttcgacgctcgttgtggatggcccgcattctacgaagaggtatcccctggagccatcacatatcatcgtgacaattctttaatgcctgcgagggtggagatatgttgtgcaaggtgtggtggacacttgggacatgtgtttgaaggtgaaggctggaaacagttgctaaacttgcccaaggacaccagacactgtgtgaacagtgcgtctttaaacctcaagaaggattaa

SEQ ID NO: 743 - DNA, 507 bp, Saccharomyces cerevisiae
atgagttctcaaagtaatactggtaattctattgaggcaccacaactacccattcctggtcaaactaatggctctgcgaacgttactgttgatggagctggtgttaatgtcggtatccagaatggttcgcagggtcaaaagaccggaatggacctttattttgatcaagctttgaactacatgggagaacatcctgtgataacaggttttggggcctttttaactttatattttacagccggtgcatataaatcaatatcgaagggacttaacggtggaaaatccactactgccttcttgaaaggcggatttgacccgaaaatgaattctaaagaggctctacagattttgaatttgacagaaaatacattgactaaaaaaaagttgaaagaggttcataggaaaattatgttagctaatcatcctgacaaaggtggttctccatttttggccactaagataaacgaagctaaggactttttggaaaaaaggggtattagcaaataa

SEQ ID NO: 744 - DNA, 507 bp, Saccharomyces cerevisiae
atggtatgtgccattacattacgtgtcaacacttctgtctctaacaagcgttcttactaacatgaaaaacttttttaaaactgtgctctcttgttggactggtacctcgtgacaaaggtattggttttttcattgttgctcagaactatgtaatattctctttagtcccaaaaaaacggaattgccaccctactacaagctgaaaaggaagcccacgaaatagtatcaaaggctagaaagtacagacaagataagttgaagcaagccaagactgatgcagccaaggaaatcgactcatacaaaattcaaaaagacaaggaattgaaggagtttgaacaaaagaatgccggtggtgttggtgaattggaaaagaaagcagaggctggtgtgcaaggtgaattagctgagattaagaaaattgcagagaagaaaaaggatgacgttgtcaaaattttgatcgagactgtcatcaagccttctgctgaagtccatatcaatgccttgtaa

SEQ ID NO: 745 - DNA, 507 bp, Saccharomyces cerevisiae
atgtcatcgactaagtttttgaaaccactctgcagaataagggcttttcatacttcaattgccagatcctttaccattccttttctgccaaagattccacagaaacctggaggtgtgagtgggaccgcaaatgattcctcttatatgccgcccgaaagcagagctcagggttcgtaccattggattgtcgagcgcggactgtccttagcggttcttccgctgatcgcagttcccttggtcactacaggccctatttccacttttaccgacacatttctttccttggtcctgctaggtcattgtcatatcggatttcagtcttgcattatagactatatttctgaaagagtctatggaaaggtacatcattacgcgatgtatttattgagcttgggctcctttttatcgttcgtcggtatatataaattagagagtcaagaagctggtcttattgcctctttaaaatcattatgggataacaaacctgtggaaaaaaagaggcagtaa

SEQ ID NO: 746 - DNA, 507 bp, Saccharomyces cerevisiae
atgtccaatctattaaacaagtttgctgataagttgcacggcaacgatcatgatgaacgttacgaagacgacaatgacgaccagactagacaacagcgtcatgaaaaacatcaacagagggaattcaggaatcaaggatccaaggccgatccctacggcgaagaaaaccaagggaatttccctcaacgccagcagccacagtctaatctaggcggtaacacgcagtttggcggtaacgacttccagcaacaaactactgactacactgccggcactggtggtggcacttatacccaaacttaccgcgaaactaacactcaaggtcagttggacgacgatgaagacgatgacttcttgacttcgggccaacagcaaaaacaaggtcgtacaagaggtgctcaaagtaaccgctaccaatcctctaatatcggcagcggtagacgcgatctgtctgggtcaggaaacgatgaatatgatgatgatagtgggaaccaaggcgtctggtag

SEQ ID NO: 747 - DNA, 507 bp, Saccharomyces cerevisiae
atgtcgaatgaaaacttatctcccaatagtagtaacccagatttaactaaactgaataacggcgaaagcggaactattgataccagcaaattctcgcccaacgaaatgaagctatacaaaatgtacggaaagctgccatcaaagaaagatatttttaagcataccatgcagaaaagaaaatatttcgacagtggtgattacgctttgcagaaagctggcattcaaaacaatgatccaataaactatggaaagaataacctgccattaacaaatcccagcaaactacgagaagatataataaaaagaaggataagcacttgtccgtcaactgcctcaaccgctggtgtagtagataatgcgacgttgatacaaaaggagggaagtatatcgagtggaccaccatcgtctaataacggtactattggaggtggtagtacaagttcaacgccagtggggaaccacagctcttcgtcgtccagtttgtatactgaatcacccattagataa

SEQ ID NO: 748 - DNA, 509 bp, Saccharomyces cerevisiae
atgactttgaataacgttgcaaggcccgacctttgtgtttcgtatgtttttcaccgacaattttctttcaaatttgctgatattgccaatatatactaacagttcaaccgctccctttctaccacaggtacaagaaaattgcgccaccaaaaggactatattctgccacaccaagcatatctggtgtggttaaccaatccatgcctatggccgctattttcttgaggaacaagttcattgcctggttctccctgattcagagtgtacactactacctgaacaccgacgaagacatcatcgttgcctataaggaaaataaggcaccatctccaatggaccagcctcctgcaatcaagctattcatgagtttaatcgggttatgcgtgtgttacatgaacttagttttccctcaacaaatagctcaaccatcgtctagcggctctaaaggtaatactgaaacgacaattgagacaactaccgaagtagagacggaaacagctaagcagtag

SEQ ID NO: 749 - DNA, 510 bp, Saccharomyces cerevisiae
atgacgccctatgcagtagcaattaccgtggccttactaattgtaacagtgagcgcactccaggtcaacaattcatgtgtcgcttttccgccatcaaatctcagaggcaaaaatggagacggtactaatgaacagtatgcaactgcactactttctattccctggaatggacctcctgagtcattgagggatattaatcttattgaactcgaaccgcaagttgcactctatttgctcgaaaattatattaaccattactacaacaccacaagagacaataagtgccctaataaccactacctaatgggagggcagttgggtagctcatcggataataggagtttgaacgatccgcaaacgatgctatggccggaaaagaaggaagacgaaaaaaactgccaagaaacttttaaaggggcctgttcgtgtaccaaaaggttttgcaagggttatttctctgtaaatatttttgggataaacctgaatatatcttatagctctggaaagtga

SEQ ID NO: 750 - DNA, 510 bp, Saccharomyces cerevisiae
atgagcagtgaaattgcctactcgaatacgaacaccaacactgaaaacgagaaccgcaatactggcgctggcgtagatgtaaatacaaatgcaaatgcaaatgcaaatgcaactgcaaatgcaactgcaaatgcaactgcaaatgcaactgcagagctgaacctccccacggtcgatgagcaaagacagtataaggtacaactgctattgcatatcaacagcatattacttgctagagttattcagatgaataatagtttacaaaacaatctacagaacaatataaataatagcaataacaataacatcatcaggatacagcaacttatatctcagttccttaaaagggttcatgccaatcttcaatgcatatctcagataaaccaaggagtgccctcagcgaaaccactgatcctcacgcctcctcagctagccaaccagcagcaacctccacaggatattctttctaaactctatcttctcttggcaagagtgttcgagatatggtag

SEQ ID NO: 751 - DNA, 510 bp, Saccharomyces cerevisiae
atgatagcgtggtccctagtggctacgttgcaatgcaaaatgacagggaagagttctttctatacatgtagagcacttatgggcctatttgaaggtggttttgtggctgatttggttctctggatgtcgtacttctacagctcttcagaattgtcaataagactgtcgttcttctgggtgacactatctctaacacaaatcatcacttcaattgtggccttcggggtttttcacatgagagggataggtggcatggcagggtggcaatggctttttttgatagaaagaattttcactttagtcatcggtatcagtgcatacttcttgatggtaccctccgtagttcaaacgaagaaaccttggagcaagaaaggatggttcactgagagggaagaaaaaatcatcgtaaacaagattctgagagatgatccgacaaaaggggatatgaacaataggcaaggtatgtcacttaaaatgttatggcaggggataacagattactatatatag

SEQ ID NO: 752 - DNA, 510 bp, Saccharomyces cerevisiae
atggcagttaaaggattaggcaaaccagatcaagtttatgacggttccaaaatcagggtcggtatcattcatgcccgttggaaccgtgtcattattgacgctcttgtgaaaggtgctattgaaagaatggcttcccttggtgtcgaggaaaataacataataattgaaactgttcctggatcctatgaattaccttgggggacaaaaaggtttgttgacagacaagcgaagttgggaaagccgctagatgttgtaattcctattggtgtacttatcaaaggtagtacaatgcactttgaatacatttcagattccaccactcacgcattgatgaacttacaagaaaaagtcgacatgcccgtcatttttggcctcttaacttgcatgactgaagaacaagccctggccagagctggcatcgatgaagcgcactccatgcacaaccatggtgaagattggggtgctgcagcagtggaaatggctgttaagttcggtaaaaatgctttttga

SEQ ID NO: 753 - DNA, 510 bp, Saccharomyces cerevisiae
atgtacattcctaaacattttgagtccatggaactctcaaggtacaaattatcaaaaaaacccccgctaggaacactattctcctctaaggctagcaggcaaggtttcttcggatggagaacttcttccaataaagatgaccccgattttggtatgtgcgcatcacatattccatttgtattcgtggagttcgataatggagagcataaacttattgcacatttagcacggaagaataaacatgtggaaatgctggaaagagttcaaaaatgcttagtggtatttcagagcgtcgattcatacatttctccggcgtggttcccaatgaagaaaaagacccataagttcgtaccaacatgggattttgccgctgtgcacgtttacggtacaccaaggattatccgcgacgataaagactggcttattaatatgttatcaactttgactgaccaagaagaagagaaaagacctgagggggaaaatgtacgaagtaaagtggagcgtttctga

SEQ ID NO: 754 - DNA, 510 bp, Saccharomyces cerevisiae
atgtggagcaggaacgtcagattgcttggatcatggacaaggtcctacatggtccccgccaccaagagaaaaaccatccccgtgtacccacctgtgcagcgcatagcttcgtcgcagattatgaagcaggtggccctctcagaaatagagtctctggatcccggggccgttaagaggaagctcatcagtaaaaagaacaaggaccgcttgaaggcaggcgacgtggtccggattgtgtacgactcgtccaagtgctcgtacgacacctttgttggctacatcctttccatagaccgcaaacaactggtgcaagacgcctcgttgctgttgcggaaccagatagccaagacggccgtcgagattagagtgccattgttttcgccgctgatcgagagaatcgacttgctaaccccccacgtctcgagcagacaaagaaacaaacactactacatcagaggtacaaggttggatgtcggcgacctcgaggcaggtctaagaagaaagaaatag

SEQ ID NO: 755 - DNA, 510 bp, Saccharomyces cerevisiae
atgttcacaaatacacgtacaatattaatatacaatagtaaggtgatgaacacacacacacacacacacacacacacacacacacacatatatatatatacaggagatcaagttagtgtgaggggacgactactgagtttgaagttctttaaagtgttaaagttatttttcccctctcccacctcgttggcaacctctcacccaccgcttagcagcatgtctccgtacatgaccatacctcagcaatacttatacataagcaagatacgttccaagctgtctcagtgcgcccttactcgacaccaccacagagaacttgatctacgaaaaatggtgggccacgccaatatgctggacaggatcctcgacgaaatagacgaaatcgacagcgaggtagtactgtgtgacgctgccgatggttcttctactgcagaagctcattccgcttccccagcatccagcgactcttctcctctcactaataacatccggcccattagcattatgtga

SEQ ID NO: 756 - DNA, 513 bp, Saccharomyces cerevisiae
atgagtaagaatgttggtaagctagtgaaaatatggaatgaatcagaagttttagttgatagaaaatcgaaatttcaagcaagatgttgcccattacaaaatcaaaaggatataccctccatactccaagaactaacgcaaaacaacaaaagcgtctccaaggcatcccacatgcacatgtatgcctggagaacggccgaggtatcaaataatttgcacttacaacaagagcagaaaaagaagggcaataaagcaaataagagtaataatagtcatgttaacaagtcaaggaacataacggtgcagccaaagaacattgagcaaggatgtgctgactgtggcgaagctggtgctggacagcgtttattgaccttacttgaaagagcaaacatattcaacgtcttggtaatagtgaccagatggtatggtggcacgcctttgggctcatcaagattcagacacatttcaacatgtgcagtggaaaccttaaagaagggtggatttcttccttaa

SEQ ID NO: 757 - DNA, 513 bp, Saccharomyces cerevisiae
atgagttcaagttcttatagggattcatattttcaataccgccatttaccagcaccacatcacatattatatgcggaatggaatcaagatatactggcgcttccggacgaagtggcaaatattacaatggctatgaaagataatactcgcaccgacgcggaggagggaagagctccccaagatggggaaaggaattctaatgtacgcgagagcgctcaaggtaaggcattaatgacaagtgaacaaaatagcaaccgctactggaactcttttcatgatgaagacgattggaatctattcaatggcatggaactggagagtaatggagtagtgacgtttgctggacaggcgttcgatcattctttaaacgggggaaccaattccaggaacgacggtgccaatgagccaagaaaagaaacgataactggttctatttttgataggcgcatcacacaattggcgtacgcaagaaataacggttggcacgaactggctctcccacagtcacgatga

SEQ ID NO: 758 - DNA, 513 bp, Saccharomyces cerevisiae
atgcagtgcgcgataactcctagagaggcagtaatagcaaaacaaagacagtataagcattatttgggtatggaaagaccattgtgggtacgttggttgaaagtctatgcaattggtggcgctattattggaagcgggtttctgcttttcaagtacacaacgccaacagatcaacagttaatcagccagctttccccagaattacgtttacaatatgagagggagaaaaaactacgtcagtcggagcagcaggctttgatgaaaattgttaaggaaacttctcaaagtgacgatccaatttggaagacgggcccccttcaatcaccttgggaaaggaacggtgataacgttcaaagcagagatcactttgctaaggtgagggcggaggaggtgcaaaaagaagagttggctaggatcagaaatgaactgtctcagctaagatctgaaacggaggagaaaacaaaggaaatagtccaggataagcaggttaaaagctggtggcgcttctggtag

SEQ ID NO: 759 - DNA, 513 bp, Saccharomyces cerevisiae
atgccatctgacgtagcatcgaggaccgggctgccaaccccgtggaccgtcaggtatagtaagtccaagaaaagagagtattttttcaatccagagacgaagcactcgcaatgggaggagcctgagggcaccaacaaggaccagctacacaagcacttaagagaccatccagtgcgtgtaagatgcctgcacattctcatcaagcacaaggattcaagaagacccgcatcgcatagatccgagaacattacgatatccaagcaagacgctacggacgaactgaaaaccttaatcacgaggttggatgacgactctaagacgaactccttcgaggccctggctaaagagagatcagattgctcttcatacaagcgaggcggcgacctcggctggttcgggagaggcgagatgcagcctagctttgaagacgctgccttccagctcaaggtcggcgaggtaagcgatatcgttgaatcaggaagcggtgttcatgtgatcaagcgggtaggttag

SEQ ID NO: 760 - DNA, 513 bp, Saccharomyces cerevisiae
atggagggccgcaaaagtgaagatgaaaagaacgaagccgctttagcctgtgatgtctttgaatcctccaatgccaaactaccaaagaatgtattcagaagttcctttacttggtattgctatgaagttatcaataggtcagcattccatatttggttattgttatgtttaacgctcattgttggttggaaggttttttcaggcatcggtggtagaagaccatctgactcaaacatggacggcccccaaaccaaacataaacggaatccaggttttttgaggcgtcattcgaccatcgttatcttagttatatctttagcagtgtctttctcatgggaagctttcaaaatgtatcgtgaacgcaccttcgggaaacaaatcactcagtttgccaaagaaattattaaaagtgcgccaagcacagatatggaaagctgggaccgtgttgcagcggattttaactcttatatgtacgaaaataaactttggaacacagaatactttttttgttga

SEQ ID NO: 761 - DNA, 513 bp, Saccharomyces cerevisiae
atgggttcaaacacttccaaagtgggtgctggtgcagaaaaacaacaagtctatactccgctaacacagatcgatttttcacagtctttggtttctcaattggattcatcgaaggaatcagactatgtcaccaagcaaaatgcagaaaagttcattgagaagaaggtttcacaaaggctatctaacctagaagttgaaacgttaaagaagtttgaagatactttgaacaattcactattatcagacgacgacaaggatgccgttgatggaatatcatcaagttcattgaataatcaaatcgagtcgttgaacaagaaactaacattatttgatcaattagagttacaaaagttggagaaatatgggggtgccaaaggtaaatctgataaaaaaaccgacaacggcagcatttctataaaggcaaaattgactgagtgtcttttggccaataagggcaagccattgaattgttacgaagagatggaagaattcaagaagctcgttatgggttga

SEQ ID NO: 762 - DNA, 513 bp, Saccharomyces cerevisiae
atgttacgcactactagactatggaccacccgcatgcccactgtgagcaaattgtttttgagaaacagctccggcaatgccctaaacaagaataaactaccatttttgtactcatcccaaggacctcaagccgtgaggtacacttcccaacatgagtggatagctgtgcatcaggacaagactgcctttgtcggaattacaaaatacgccactgatgccttaggggacgctacctatgttgagttgccagaagtgggcactgagattgcccaaggtgagtcgctagggtccattgagtccgtcaagtcagcctccgagatctaccagcctgccgatggtaccgtagaggaaattaacactaatcttgaggaaaatccaggtgtggtgaacgaagatcctatgggtgacggctggctagtcaaaatgaagcttggtgagggcgttaatgtggaacaggtcgagggtctaatgtccttagaacagtacgaaaagacactggttcatgatgactga

SEQ ID NO: 763 - DNA, 516 bp, Saccharomyces cerevisiae
atggttcccttatttggtttattttgcattttttctcaattgtactcattatgctccgcatatgttgatatcaccagcggttaccaagtatttttcaacttgccaactaatatgacaaacaatcaaatatgctggctattccaagcatcttactatgatatttattctgataaaagtggtagaacacttagaacgggacggtttgaacccggcgatcagcaatctttgatttatagggataccttagttgagttggaggctattacagattcttatgagtacagtaacctagatctatcgacttataacggacctgagccatataattctgagactgattattgtacagatataatggatttggtaatgcgtgtatatgatgaagaaggacattatgttcatccagttgcgaataactcaacaaatgcttgcgctcatccaactcctcctacgttaaacaatctattgataagtaattattctgacggaagaaattataaagagtcttctatataa

SEQ ID NO: 764 - DNA, 516 bp, Saccharomyces cerevisiae
atgtcacaatcattacgtccgtatctaacggctgttcgttattccctggaagctgcgttgactttgagcaatttctcttcgcaggaagtggagaggcacaacagaccggaagttgaagtccctaacactagcgccgaattgttgctccaaccgatgcatatatctcgtaatgaaaatgaacaagtattgattgagcccagtgtaaactcggtgcgtatgagtttaatggtgaaacaggcagatgaaattgagcagattttagttcacaagtttactagatttttggaacagcgtgctgaagcattctacattctgagacgtgtaccaatacctggctacagtatttcttttctaataactaataagcatactgaatcaatgaaaactgggaaattggttgattttattattgaattcatggaggacgtggataaggaaatcagtgaaattaaactgtttttgaatgccagagcaagatttgttgcggaagcatatcttgatgaatttgtctattag

SEQ ID NO: 765 - DNA, 516 bp, Saccharomyces cerevisiae
atgttttttattaaagacctttcgcttaatattacccttcatccgtcctttttcggtcctcgaatgaagcaatatctaaagacaaaactattggaagaggttgaaggttcgtgtacgggtaaattcggatatattctttgtgtcctagactatgataatatagatattcaacgtgggagaatattgcccacagatgggtccgccgagttcaacgtgaaatatagagctgtagttttcaaaccatttaaaggggaagtagtggacggcacagtcgtttcatgttctcagcacgggttcgaagtgcaagtaggtccaatgaaagtatttgtgacaaagcatctgatgcctcaagatttaacctttaatgcgggttcaaacccaccatcataccaaagttccgaggatgtcatcaccataaaaagtagaattagagttaaaattgaaggttgtatcagtcaagtgagttctattcacgcaatcggtagtatcaaagaagattatttgggtgctatttaa

SEQ ID NO: 766 - DNA, 519 bp, Saccharomyces cerevisiae
atgctgaaaattgttactcgggctggacacacagctagaatatcgaacatcgcagcacatcttttacgcacctctccatctctgctcacacgcaccaccacaaccacaagatttctgcccttctctacgtcttcgttcttaaaccatggccatttgaaaaaaccgaaaccaggcgaagaactgaagataacttttattctgaaggatggctcccagaagacgtacgaagtctgtgagggcgaaaccatcctggacatcgctcaaggtcacaacctggacatggagggcgcatgcggcggttcttgtgcctgctccacctgtcacgtcatcgttgatccagactactacgatgccctgccggaacctgaagatgatgaaaacgatatgctcgatcttgcttacgggctaacagagacaagcaggcttgggtgccagattaagatgtcaaaagatatcgatgggattagagtcgctctgccccagatgacaagaaacgttaataacaacgattttagttaa

SEQ ID NO: 767 - DNA, 519 bp, Saccharomyces cerevisiae
atggagcacgtatcaaagaggtcaattgggcaattctttaagaggaaaacttcaactgtagatggaagcaaatcacagaaatgcggaaccactaaccaactgcggaagctgctgcataaaagaagggtacagaagcaggcagtgccggttgaatcccagtacagaattccgggtgattttagggataatcaaagcgtgagagtcaaaaactctatgtacaacagctcaccgtcagtaacgccatctacgcatcatatcaatgaaaggtatgttcgctatgacatcaacacaaggcctttggttgttgtgctcgcgatctcaattgtattttttggctgtctcctggtcctcaaggacatcatcatccagtcatcagaaaacatcctgagtgtttccaaatggaaaatcataggggcctccttcatgggtacgccctacacaggtcttctcacggggctcgttggccctctcctgtcaccattttcggctgtttcgtcgtggctttcattcatcttttga

SEQ ID NO: 768 - DNA, 519 bp, Saccharomyces cerevisiae
atgtcaaaactatcgtcttatcctcatgccgccgattttataaatatggaagaaccgccaaaatctaaagagtttttcgatgatctttgtgccgtccctaatttactcaaaagacgttttccaaactctcgaagatcgacgcattattgtgaggctttaaattattctaggaaaaagcttcctgttgtgttgtctaaaatgacactgcaagagttgaggcacaatatgtcaacattttttttgcaggaaaaggatcaaataaatatttatgacacctgtaaggtgatagacatgggggaccgtgtcttgctcgaaactatgcctccacagccaagagatttatttgaaaaattgcatgcaagtaaaacaaatttagtagttcagacagcagctttggatgaacccctacttacagtaaaagcagagctacagtcatcttcctttccacaaaaatcaagcctatttctgtatgaggattataaaaaatttatttatcaacaactagatatgtttagttaa

SEQ ID NO: 769 - DNA, 519 bp, Saccharomyces cerevisiae
atgtcattggtgaattcgttaacacactacgaaattttaagaattccatcggatgcaacacaagatgaaatcaaaaaggcatataggaatcggttactaaatacgcaccccgataaactttctaaaagcatacatgatacggttagcaacgtcacaatcaataagattcaagatgcttataaaatactatcgaatataaaaactcgtcgcgaatatgataggttgatccttgaaaactataaacgccaaggatttcataattgtggtgatgggctggatgaattttccttagacgatttctcatttgatgaagataagctggagtttatgatgaattgtcctcgctgtcaatttgttggtggttttcattttagtgagagtttgttagatgaatgcattgataatgtagacgctatggaacggagtcattctggttatcaattattaacccaatgtagcgcatgcagcttatggctgaaggttaattttgacatcgaggaagagcaagaaggacaataa

SEQ ID NO: 770 - DNA, 519 bp, Saccharomyces cerevisiae
atgtccacaccagctagaagaaggttgatgagagattttaaacgtatgaaggaagatgccccaccgggtgtatctgcttcaccattacctgataacgtcatggtatggaacgccatgattatcgggccagccgatactccatatgaagacggaacttttaggttattgttggagtttgatgaagaatatcccaataagccaccgcatgtcaaatttttgagtgaaatgtttcatcccaatgtctatgcaaatggtgaaatttgtttggatattttgcagaacagatggactccaacatatgatgtcgcatccatattgacatccattcaaagtttattcaacgatccaaatccagcttcgccagcaaacgttgaagctgcaacattattcaaagatcataaatcacagtacgtcaaaagagttaaggagacggtagagaaatcttgggaggatgatatggacgatatggacgatgatgatgatgatgatgacgacgacgacgacgacgaagcagactga

SEQ ID NO: 771 - DNA, 519 bp, Saccharomyces cerevisiae
atgtctgcaaatagcaaggacagaaatcagtccaatcaggatgcgaagcgacaacagcagaatttcccaaagaagatttcagaaggtgaggccgatttatatctcgaccagtataacttcactaccaccgctgctattgtaagctcagtagaccgtaaaatcttcgttcttttgcgtgatggaagaatgctattcggtgtactaagaacctttgaccaatatgcaaatttgatacttcaagattgcgtggagagaatatattttagcgaagaaaacaaatacgctgaagaagaccgcggcatattcatgattcgtggtgaaaatgttgtcatgttaggcgaagtagacatcgataaagaagatcaaccccttgaggccatggaacgcataccatttaaggaggcttggctgaccaagcaaaaaaatgatgagaaaaggtttaaagaggaaacccacaaaggtaaaaaaatggcccgccatggtatcgtttacgatttccataaatctgacatgtactaa

SEQ ID NO: 772 - DNA, 522 bp, Saccharomyces cerevisiae
atgaatttcaaggagccgctagtgaattttttaaaatgcgtcttgaataacataaactcggcattttcgcataggattgatcaattgcaattgcagctgttgcgggaaacaaatatcttgagggttttgaacaggggaatagagagactgtttagcgagaatccaaggacccattctgtttcccgtatcgtggtggaaaaagatgtgggctgcagaattggacgatatgtggaaggttctaaatatgaactggtagagtccagggcgaaagaaatacaaatatattatgaaaggatggtttttgaaataacacaagaattgaaaggggacaagcgggtgtttgccttgattgcaaatctttcccaaagatatagcgcagagaggaaagaaatacgaaatgtaaaggtgcatggtgggcggccatgtaatgagaacgaattccaggtgattccgataagattcaaacctattaatttggaaagaagagcacgactgataagaaagaagaagactattaattaa

SEQ ID NO: 773 - DNA, 522 bp, Saccharomyces cerevisiae
atgacccacagcttgaaagctctattcgccttgctatttctttacacagctgctgtcaatgcgggtgtgattggcatattcaacgcccttcccccaccaaacaccaaaccaattaacggcgaatctccactttaccaatgtgacattctagacaagcaacttgtggaaatcaaagaggtcaatttggaccctaaccctcctgttcgtggcgaaaatttgactatttctgctaacggtgaggtctttgaaactatagaagagggggcatatatcgacgttgaagtccgtctaggatacatcagactgttatcccagacttttgatttgtgtgaaacattagaagataacgatatcgaaggcttatcctgtccaattgaaccgggtgaatacaacattaagaaaatagttgagatcccaggcgaggttccacctggcaaatatgttgttgtagcaagagcttacactgaaaaggatgatctgatcacttgcttaaccggagaagtcatcttcccaccaaggtga

SEQ ID NO: 774 - DNA, 522 bp, Saccharomyces cerevisiae
atgagttttgcatcgaggaatattggacgtaagatagcaggagtgggagttgacattgtatacttgccaagatttgcacatatactagagaaatattccccattcgacccatgtggccgttctaccttgaataaaataacacggaagttcatgcatgaaaaggaaagatttcatttcagtaatcttctcatcgaagaaaactgcttaactccacgattgcatgaatatatagcgggagtttgggctttgaaggaatgctcattgaaagcgttgtgttgctgtgtttcaaagcatgatctacctcctgcccaagtactgtacgctggaatgctatataaaacacaaaccgatacaggtgtacctcagttagagtttgataagatgtttggaaaaaagtatccaaagtatcaacagctctcgaaaaactacgattctctcttttccactcatgagtttttagtttcgctatcccatgataaagattatttaattgcagtaacaaacttggtagaaagagagtaa

SEQ ID NO: 775 - DNA, 522 bp, Saccharomyces cerevisiae
atgctagccctagctgataacattctacgtataataaatttcctatttttggttatttccatcggtttaatcagttcgttgttaaacacccaacataggcacagctccagagtaaactactgtatgtttgcttgtgcatatggtatattcaccgattcattgtacggtgtctttgccaacttcattgaaccattggcatggccactagttttgttcacactggactttttgaactttgtgttcactttcactgccggtacagtgttggccgttggtatcagagctcactcatgtaacaacagctcatacgttgacagtaacaagattactcaaggttccggtaccagatgtagacaagctcaagccgctgttgcattcctctacttctcttgtgccatctttttggctaagaccctgatgtctgttttcaacatgatctccaatggtgcctttggttctggttctttctccaagagaagaagaactggccaagtcggtgttccaaccatttcccaagtctaa

SEQ ID NO: 776 - DNA, 522 bp, Saccharomyces cerevisiae
atggtacgtttaaaaagtagatatatcctttttgaaattatattcccacctacagacaccaacgttgaggaatctgtgtcgaaagcagacatcttgctttcgcatcacagagcatcgcctgcggatgtgtccataaagtcgatactccaagagatacgacgctcgctgtcgttgaatctgggcgactatgggtctgcaaaatgtaactctctcttgcagttgaaatacttttcaaataagacgtctacggggataatccgatgccatcgagaggattgcgaccttgttatcatggcattgatgttgatgtcgaaaattggcgacgtcgatggactgatcgtgaaccccgtcaaggtaagtgggaccatcaagaaaatagagcagtttgctatgagaaggaattctaaaattctgaacataatcaagtgtagtcaatcatcacacctcagcgataatgactttattatcaatgatttcaagaaaattggaagggaaaacgaaaacgaaaacgaggacgattag

SEQ ID NO: 777 - DNA, 522 bp, Saccharomyces cerevisiae
atgtcatctaccagtgataataatgctaatagtgcaagagagaaaaaaccactgaaattcgtgtcagaaggagttggtaatgtagaggcccagaggatacgagagcaagtggagcaaaaaaaatatgaagcggaatataaaaggaaaaccaggaagtccctgcgagatcagcttaggtctaatgctattagtaaacaaaaacaatataacggtttggtgagagaccgtgaaagttttactaggttgagtaaagaggacctggaattttaccagaagagcaagaatgagttgctaaaaaaggaaaaagaactgaataactacttagacgtcaaggcaatcaattttgaaaagaaaaaaaaagcattactaatggagaacgattctactactaatacagaaaaatatttagagaccggcactagtttgggcagtaaaacacaaataaagggcgtaaagacatccagccctaaaccaaaaatcaaggtatccataaaaaaattgggtagaaaactggagaactga

SEQ ID NO: 778 - DNA, 522 bp, Saccharomyces cerevisiae
atgtccaacaaggcaagtgaccaatcagcacgcacggcttccatcctcaagactgatattaccagagaaaacacaatcaccagaagcagcagcagcaacaacgacaactaccatcaccacaataacatcaataattacaatgaatcggcgaagacaggagaggacgccaataaagagaatatacctaatttagaggaggagattgcggcctttcgaatttttaggaaaaaaagcacttcaaacttgaagtcgtcacacaccactagcaatttggtaaaaaagacaatgttcaaaagggatcttttaaaacaggatccgaagaggaaactccaactacaacaaagatttgcatcaccgactgacaggctggtatcaccatgctcattgaaattgaatgagcacaaagttaagatgttcggaaagaaaaagaaagtcaatcctatgaaactgaactttaaaggcaaccttgctgccgattcagaggatgtagaaatcgatgaagatgaggagtatttctactaa

SEQ ID NO: 779 - DNA, 524 bp, Saccharomyces cerevisiae
atgaagattgtcttacaaaaagtcagccaagcatctgtagtcgtcgattcaaaagttatttcaaggtatgttaccggttttttcagcttcgttagtgcaccaattttttttactaacacctctatctatgtgacagtattaaacatggttatatgctcctagtaggtatttccattgatgattctatggcggagatagataaattatcgaaaaaggttcttagtttgagaatcttcgaagatgaatccagaaatctatggaagaagaatattaaagaggccaatggtgaaattctatccgtgtctcaattcactttgatggcaaaaaccaagaagggaactaaacccgatttccatttggcccaaaagggtcatatagctaaagaactttatgaagaattcttaaaattactaagaagtgatttgggtgaggaaaaagtaaaggatggtgaattcggcgcaatgatgagttgctctttaactaatgaagggcccgttacaatcattcttgacagtgaccaataa

SEQ ID NO: 780 - DNA, 525 bp, Saccharomyces cerevisiae
atgaaagtttccgataggcgtaagtttgaaaaagcaaactttgacgagtttgagtcggctctaaataacaaaaacgacttggtacattgtccctcaataactttatttgaatcgatccccacggaagtgcggtcattctacgaagacgaaaagtctggcctaatcaaagtggtaaaattcagaactggtgcaatgaataggaaaaggtcttttgaaaaaattgtcatttccgtcatggtcgggaaaaatgtacaaaagttcctgacatttgttgaagacgaaccagatttccagggcggaccaatcccttcaaagtatcttattcccaagaaaatcaacttgatggtctacacgttgtttcaagtgcatactttgaaattcaatagaaaggattacgataccctttctcttttttacctcaacagaggatactataatgagttgagttttccgtgtcctggaacgttgtcacgaaatagcgagtgccaggccgaacgacagctctacgatgcgtactttcactga

SEQ ID NO: 781 - DNA, 525 bp, Saccharomyces cerevisiae
atgattaagcggtctctcgcaagtttagttcgagtcagctctgtaatgggcagaagatatatgatagcagcggcaggaggagaacgtgccagattttgtccagctgtaacaaataaaaagaatcatactgtaaatacttttcagaagagatttgtagaatcctcgacagatggtcaagttgtgcctcaagaagtgttaaacttaccgcttgaaaaataccatgaagaggcagatgactacctagaccatttactagatagcttagaagaactgagtgaggctcatccggattgtatacctgatgtagagctaagccatggcgtaatgacattggaaattccagcttttggaacgtatgtaataaacaaacagcctccaaataagcaaatttggttggcatcaccattgtccgggcctaacagatttgaccttctcaatggggagtgggtttcgttaagaaatggcacaaagctaacagatatacttactgaagaagttgagaaggccatttctaaaagccaataa

SEQ ID NO: 782 - DNA, 525 bp, Saccharomyces cerevisiae
atgattccgaggactagaacactactgcaaagtaaaataccaattaccaggtactttgccagatgttgggcgcctcgcgtacgctacaacgtgtgccgtactctacccgcagcagcgttgcataccaatatcatcgcacataatgaagtgaaaaaggacgataagaaggttcatttggggtcttttaaggtagacaagcctaagatgatgatagctttcacctgcaagaaatgtaacacccgatcttcacacacaatgtccaagcaggcgtacgagaaaggtactgtcttgatctcttgtccgcactgcaaagtgagacatttgatagcagaccatctgaaaatattccatgatcatcatgttaccgtggaacagttaatgaaagctaacggagaacaagttagccaagacgtgggcgacttggagtttgaagacatcccagattcgctaaaggacgtcctgggaaaatatgccaagaacaactcagaaaatgcatcccagctccctcacccttcccagaaatga

SEQ ID NO: 783 - DNA, 525 bp, Saccharomyces cerevisiae
atgcaacatttcgaaagttcagataagatagaaaaggatgatgatacatcaagaattaaattacgctcttcttctttggccgctccaatcctcgaggctgttcaagaagcccagccttttgaagaagccactttctctaacttacagaagatacatccgttaacagaaaactcaacttgcaatggttatgttatttacgataaagatggaaatttgaaatccatgaaggatacatttggtaggaatataaaaacacctgatatttcaaatcctacaagagcaagaaatgaaaggccattggatacaatacgtggatttgaatactccataacaaaagatccccgctggttgcaagagctagaaacatctaagttgggatttaaacctagacctggatttgccgtcattaatcaagactcacaggcttcaataaatttatctcaactggaagaaaaagttatggaaagccaaaaaaaaaaggagaaaagacacatatcacggctttctcggttactctgcagatga

SEQ ID NO: 784 - DNA, 525 bp, Saccharomyces cerevisiae
atgctatcagctgcagataatttagtgcgcatcataaatgctgtttttcttattatatccataggtctaatcagcggcctgataggtacacagacaaagcatagttctcgagtgaacttttgtatgtttgccgccgtttatggtctggttacggattcattatatgggtttttggctaatttctggacatcattaacatacccagcaattttgcttgttttggattttttaaatttcatatttacgtttgtagcagccaccgctttggctgtaggtataagatgccattcgtgtaaaaacaaaacatatctggaacagaataagatcatacaaggctcaagctccagatgtcatcaatctcaggctgctgttgcgtttttttacttttcctgttttctattcctcatcaaagtgactgtggccacgatgggtatgatgcaaaatggtggatttggctctaataccggattcagcagaaggagggcaagaagacaaatgggcatacctacaatttcccaggtttaa

SEQ ID NO: 785 - DNA, 525 bp, Saccharomyces cerevisiae
atgggcgaaggtttgctggatttaagatctcagcttggattttacaagttttaccaccacaatcctaagaacgttttgatccattccatatttgtccccacaatcctatttagtggtagctgtatgctccacagagtcaaaatatatcagagtatttcattgactgctgtgctaagcgttttattttccatattttattgtcttctgtatttacccacagggctattagcaggagttctcttgcttttgttaaatcttgcactcatcgatcacagggttgatttaacatttaagcaggaactgggtttgtttactattggttggattttccaatttgttggccatggtgtctttgagaaaaggaggccagcgttaattgacaatctagttcagagcttggtgctggcaccatattttataatgttcgagttccttttcaaattgggtttcatgcctagattaaaggcaactctcgaacatgatcttgaaattaagcaaagaaatttgcggatgcaaagacaataa

SEQ ID NO: 786 - DNA, 525 bp, Saccharomyces cerevisiae
atgtctactaaagcccaaaaccctatgcgtgatttgaagatcgagaaattggtcttgaacatctccgttggtgaatctggtgacagattaaccagagcctccaaggttttagaacaattatctggtcaaactccagttcaatccaaggccagatacactgtcagaactttcggtatcagaagaaacgaaaaaattgctgttcacgttaccgtcagaggtccaaaggctgaagaaattttggaaagaggtttgaaggtcaaggaataccaattgagagacagaaacttctctgctaccggtaacttcggtttcggtattgacgaacacattgacttgggtatcaagtatgacccatccatcggtattttcggtatggatttctatgtcgtcatgaacagaccaggtgctagagtcactagaagaaagagatgtaagggtactgttggtaactcccacaagacaactaaggaagacaccgtctcttggttcaagcaaaagtacgacgctgatgtgctcgataaataa

SEQ ID NO: 787 - DNA, 525 bp, Saccharomyces cerevisiae
atgtctgccaaagctcaaaaccctatgcgtgatttgaagatcgaaaagttggtcttaaacatttctgttggtgaatctggtgacagattgaccagagcctccaaggttttagagcaattatctggtcaaactccagttcaatccaaggccagatacactgtcagaactttcggtatcagaagaaacgaaaaaattgctgttcacgttaccgtcagaggtccaaaggctgaagaaattttggaaagaggtttgaaggtcaaggaataccaattgagagacagaaacttctctgctaccggtaacttcggtttcggtattgacgaacacattgacttgggtatcaagtatgacccatccatcggtattttcggtatggatttctatgtcgtcatgaacagaccaggtgctagagtcactagaagaaagagatgtaagggtaccgttggtaactcccacaagacaactaaggaagacaccgtctcttggttcaagcaaaagtacgatgctgatgttttggacaaataa

SEQ ID NO: 788 - DNA, 525 bp, Saccharomyces cerevisiae
atgtctgctatcccagaaaacgccaacgttaccgtcttaaacaagaacgaaaagaaagccagagaattgattggcaaattgggtttgaagcaaatcccaggtatcatcagagtcactttcaggaagaaggacaaccaaatctatgctattgaaaagccagaagtcttcagatctgccggtggtaactacgttgtcttcggtgaagctaaggttgacaactttacccaaaagctagccgctgctcaacaacaagctcaagctagcggtattatgccatctaacgaagacgtcgctaccaagtccccagaagacatccaagctgacatgcaagccgccgcagaaggcagtgtcaacgccgcagcagaagaagatgacgaagaaggtgaagttgatgccggtgacttgaataaggatgatatcgagttagtcgttcaacaaactaacgtttccaaaaaccaagccatcaaagccctgaaagctcacaatggtgacttagtcaacgctatcatgtccttgtctaaataa

SEQ ID NO: 789 - DNA, 525 bp, Saccharomyces cerevisiae
atgtctttggccaaatccgctgctaacaaacttgactgggcaaaagtcatctcttctctacgtataacagggtcgactgccactcaattatcgagttttaaaaagagaaacgatgaggcacgtagacaattactagagctgcaaagtcaacccaccgaagtagatttcagtcattatagatctgtgttgaaaaacacttcagtcattgacaagatagaatcatacgttaagcaatataagccggtcaaaatcgatgcctccaaacaattacaagtgattgagtcttttgaaaagcacgcaatgaccaacgccaaggagacagaatccttagtttccaaggagttaaaggatttgcaaagcaccttagataatattcaatctgcaagacctttcgatgaattaactgttgacgacctgacaaagatcaaacctgaaattgatgctaaggtagaagagatggtcaagaagggtaaatgggacgtacctggttacaaggacagattcggcaatttgaatgtgatgtag

SEQ ID NO: 790 - DNA, 528 bp, Saccharomyces cerevisiae
atgtttacttcgaagcctgctttcaaaattaagaacaaagcatccaaatcatacagaaacacagcggtttcaaaaaagctgaaagaaaaacgtctagctgagcatgtgaggccaagctgcttcaatattattcgaccactcaagaaagatatccagattcctgttccttcctctcgatttttaaataaaatccaaattcacaggatagcgtctggaagtcaaaatactcagtttcgacagttcaataagacatctataaaatcttcaaagaaatatttaaactcatttatggcttttagagcatattactcacagtttggctccggtgtaaaacaaaatgtcttgtcttctctgctcgctgaagaatggcacgcggacaaaatgcagcacggaatatgggactacttcgcgcaacagtataattttataaaccctggttttggttttgtagagtggttgacgaataattatgctgaagtacgtggtgacggatattgggaagatgtgtttgtacatttggccttatag

SEQ ID NO: 791 - DNA, 528 bp, Saccharomyces cerevisiae
atgaatgaaagtgagaatagtccccaacataatgaagttacggttcctatggtagaggatacttcaagtaatgctgatattccaatggagcaaattcaacgcgaagacaataagaactacgataaacatgacaatgaatgcttcgatatgaatggcaatcacaataataactctgataacttacaatttgacagtgtaccatcttctgcaacgaaagatttgaaaaacatcaaaagtgtcaccaaccaaaatgtaaaaatagaagaatcgagtagcacaaattcagtcattgaagagtcatctgaacctaaaatatcaaaattagaaaatgtgaaccttgccgcgacggtaggtggttcacaaactagaaaatacctgaatacaaatgtgacaccgcatttattagcgggcatgaggctcatagccgtacaacaaccagaagatccgttacgtgttttaggtgaatatctaatcgagcagagcaatatactgaagagtggagaaaaagagagtaatgctagtaaatga

SEQ ID NO: 792 - DNA, 528 bp, Saccharomyces cerevisiae
atgaccacatcacacagaccacagttagaagcaagaagcggtgcaaaagcggccgcttatacaccaacaggcatcgagcatgccagattactaccaggacatacaacattaaaatacaggaaatttaaagaggaggaaaatcttagagcaaactgtgcgcaagaagataggagcaacgataaatctttagaggaggcagtaatgaacgaagagaaacaggatgttgtggggagtgggaacctccaagaaacccgcagtgagaaagaccaaaaagactcgttgcaagagctgctggttactcaaaaaaataaagtggaagataaagcagagcttgaaggaaatgaacaattaaagggaggaaattcgtctaggcgatcgtggagaaagggcacggcgtttggacgccataaagtaaccaaagagacaaatattaaggaacatgcaacaaaaaaatcagcgtccggatacattaacgatatgacaaaatctgaatatcatcaagaatttctccataagcatgttagatag

SEQ ID NO: 793 - DNA, 528 bp, Saccharomyces cerevisiae
atgcctcagtattttgccattattggtaagaaggacaatcctgtctatgaaatcgagtttaccaatgcagaaaatccacagggttttcctcaggatttaaaagaattaaatccgttcatactgcatgcatcactagatatcgtagaagatttacaatggcaaattaatccgacttcacagttaaatgggaacggtggaaacggatccaatggcggtggtgggttccttcgatctagagctgtaaacaatactgataattgttatctaggtaaagttgatcatttttatggactagcaataacggcttatattagctatagtgggatgaagttcgtgatgatccatgggaactcagccaacagtagcgtagttattgacgacaataatatgaggtcattctaccaagaggtacacgaactatacgtaaagacactaatgaacccgttttataagattacagaccctattaggagcccggcattcgactcgagggtaaggacattagcacgtaagcatttgtccaaataa

SEQ ID NO: 794 - DNA, 528 bp, Saccharomyces cerevisiae
atgccttctaaaaactccatcaacagacctaagctgacttcaaatttgcaccacaaggtgcactctttaaataagaaaagagctcaaagagaaagagctggtctcttgaagccagctagatccagcgtaaattcgaaatctggggaaataaaatcagtagcgttggacctatacttccaaaacaagaagaacgaaagtcagaattccactgctgtgacattacaaaatgcttcatcttctccggcctccatcaccacgaggacactttccaaaaagagagctaagaaaatcgagagaaacttaaaatatgctacacagagaaaattattggttgacgcaagcgctaagctagaagacgaaatggatattgatctagatggcggtaagaaagtgaaagagaatgaaaagaagagttctttgactttggttaaggaagccttatggagtgtcattgacgatactgcatcccagggattgatcatcgaaaacggacaaggcaccaccctgggcggcccatttttcccatga

SEQ ID NO: 795 - DNA, 528 bp, Saccharomyces cerevisiae
atgcgtaataatgtgactgaattggtcaacagtataataggtgttcaaacacctggatcgctaccagatactctttctggggcacattcattgcagagacgcataagctattttgacgtcaattggatatcatggaattgggacaatgtaaatgttgatcttaataaagaggtaaaaaaaagtaggcccctccttggggaggaggacgatcaatgcatgttcggttggttcgcaaataatccagggtggaaatattactggtcggtaactgataatcctgatccaggatataaagagaattactctgacattggagatgaaaatgctgtccacggtgaattatattttaacacatatggggggttgatggcttctgtaatgacaacaaagatggtgctcaatgcgaagagacagcttgtggttattgatacaattgtggtaaaggccatctgcgattatgttatgaaatattggaaaaaaaaggttaaccttactacgatatcattatatttgatgttaaagttataa

SEQ ID NO: 796 - DNA, 528 bp, Saccharomyces cerevisiae
atgcttatcaaccacttgagtaagatccgaaccgtaaggcacttttctaatattaaacccgttttatccaaggaagtttcgcgacgagtaattgttgcacctgcatcacacttcaaaacctccagtccaaatgtgaaaagtaacatccctattcatgaatataaacaactaccggaagattctaactacattgaaaagcattataaggaactacaagtatttttgaatgagtttttgattaagaaattaaacaagacctatgcggattttgaaggagatccagacgagttggtatttcaattggaaaaattcattgaactagaagttactccgagatacacaaatcattcagcacctgatggttgtgaagagagattcaaatccatcggagacaggatagtcgttgaccgctatttagattttgtgaaagatgtcagactaacactgctgctaaatggaggacactccttcatatttgatgtcatgctacaagccaaagaagtatttgacaaaatgcagaaagaatga

SEQ ID NO: 797 - DNA, 528 bp, Saccharomyces cerevisiae
atggaatctattatcctcagcattgccatctttattggcgtcctccttggcactagcgttggtgctggcagtggtagtagcattagtcctgacgttgatgctggcagtggtagtcgcactagtcctgacgttgatgctggcagtggtagtcgcattagtgctggagttggtactttcagtggtagtagcactagtcctgacgttgatgctggcagtggtagtagcactagtcctgacgttggtgctggcagtggtagtagcattagtgctggagttggtagtcgcattggtactggcattggtagtcgcattggtactggcattggtactggcattggtagtcgcattagtactagcattggtagtcgcattagtcctgacgttggtactagcagtggtaatcgcattagtactggcgttagtactggcattagcactaccatgaatgcacgtgtcgctgtcctcatcactgctgcaatactttctgcacctgtcactgctattgctctcctggaagctagacggtaa

SEQ ID NO: 798 - DNA, 528 bp, Saccharomyces cerevisiae
atggacggccttagctttgttgataaagggaaaataccagatggttacaaaaatgaaatagatcaattagtaaagaaggaatttgcgaatataaaaagagagcctgttcatcccgaaatacgaggtatacttgcgaagagaaagggggccgataatagtgtttctacgcttacaaatgcattgtacaccgaatacttgaaacaacgtaataacaaaaaaaggcgaacaccggattttaatgacgacgatgatactttatttttggaagagtatagaaggaaatacccgaggattgatacttccagatacataccgaacgagtcttccgaagttagcttgttaggaattgtagattcttatttaaaacatcaggaaatagttttggatacacttctaccgcaaacggtatcgaatcaatggagaattaataatgattatattcgtcaaacgtgtactatagtggaagaaatgaacatccagcagaggaaacaaattaacgatttggaaatatacagaaagaggttataa

SEQ ID NO: 799 - DNA, 528 bp, Saccharomyces cerevisiae
atggatttgaaaagggattggttacgatggaaaattacaataggtagtgggcctggcagtattgtgctggatttcccatcatttttggtagggtgcgtattcacaacaatgatggggccaatattacagaagcttataggtaaacttttggtaggtttaataacggtatgcaaattcttagttattattggaagcattgtcttcgttatcggagttgcatcaaagaaatacacatatgacgatttcaaagtaagtataaaaagatcaggagagccaggggaatcacatgatatgaggactgaaccaaaaagaactgcgaaaacggcaactgttccaatggagaaagacgagggcgtaggttcttataattattttgaaatacctataacgaaagaaacatctacaattccttatattaattgtgatggcacgagctcacttagaaagccacccaacggtccatcaagcgtaggcttatctaactccaacagatacgaaaattttataaacatggcacgacataaataa

SEQ ID NO: 800 - DNA, 528 bp, Saccharomyces cerevisiae
atggtccttttacacaaaagcacacatatatttcctaccgattttgcctctgtttcacgcgccttttttaatagataccccaatccatactccccccatgtactatccatagacacaatatcaaggaacgttgatcaagaaggaaatttgcgcacaacgaggctgttgaaaaagtccggaaagctgcccacatgggtcaaaccctttttaagaggtataacagaaacatggataatcgaagtttccgtagtgaaccccgctaactccacaatgaaaacttacactaggaatctggatcacactggaatcatgaaggttgaagaatatactacctatcaatttgacagtgctacaagtagtacgatagcagacagccgggtgaagttttcaagtggcttcaatatgggtatcaaatctaaggtagaggattggtcgcgcactaaatttgacgaaaacgttaagaaaagcagaatgggcatggcatttgttatccaaaaactcgaagaggcgagaaatcctcagttttga

SEQ ID NO: 801 - DNA, 528 bp, Saccharomyces cerevisiae
atgtcgacggataccatgtatttcaacagctccaggctgttgccatcggctggcaggaacaagacaaataatctaatcaaacaaaaaactagaaataatcgtgcgaggggaaatgctgctaagaacgccaataataacaactatatcacagatataccacctcctcaaactcttcctaacggtcagaaacctaacttcggccattcttccaacaagaaaccatcatttaatcaaaagaagcactctccaccttcttccccttcctctacaactactttaggtaaaaaaaacagacagaataataaagaaacgccacgacagaacaacaaagatgatactcgtttactgagtcagaacctaaagaatctgcttctgaaccagaaacaatccccgcatggctctcaagggataataccaatgggttgtaatggcagtgccaaaaaactcagtcactcttatgcaggctccactttcgccactaatggtccaagggaggctaaaaacttgcccaaaccaagttttttataa

SEQ ID NO: 802 - DNA, 531 bp, Saccharomyces cerevisiae
atggaaatagtgtacaagccattggacatacgtaacgaagagcagtttgctagtattaaaaaactaatagatgcggatctatcagagccgtactcgatatacgtatataggtatttcttgaaccaatggcccgagttaacgtacattgccgttgacaacaagagtggaacgcctaacatacccattggttgcatagtgtgtaagatggacccgcatagaaacgtgagactgagaggatatataggaatgctagccgtagagtccacataccgcgggcatggcatagcaaagaaactagtggaaattgccatagataaaatgcaaagggaacattgcgatgagatcatgttagaaacagaggtggaaaattcggcggctctaaacttatatgaaggaatgggtttcatcagaatgaaacggatgttccgctactacttgaatgaaggggacgcctttaaactgatattgccgttgactgaaaagagctgcactcggtctacgttcctaatgcatggccggctggccacataa

SEQ ID NO: 803 - DNA, 531 bp, Saccharomyces cerevisiae
atgggccgtgatatatgcacattagacaatgtttacgctaacaatttgggcatgctaaccaaactagctcatgtgacagtaccaaacttatatcaagatgccttcttcagtgcattattcgctgaggatagcttagttgcaaaaaataaaaagccatcttcgaagaaggatgtacatttcacacagatggcttattacagtgaaataccagtgggtggtttggttgctaaattagttcctaaaaaacaaaacgaactatctctcaagggcattcaaatcgaatttttgggcgtgttgcctaattataggcacaaatccatcggttcaaaattactgaagtttgcagaagacaaatgctcagaatgtcatcaacataacgtgtttgtctatttaccagcagtggatgatcttacaaagcaatggtttatagctcatggcttcgaacaagtgggcgaaactgtcaacaatttcataaaaggtgtaaatggcgacgaacaagatgctatcttattgaaaaaacacatttcttaa

SEQ ID NO: 804 - DNA, 531 bp, Saccharomyces cerevisiae
atgtctgacttagttaacaagaaattcccagctggcgactacaaattccaatacattgctatcagccaaagtgatgctgacagtgaatcttgtaagatgccacaaacagttgaatggtccaaattaatttctgaaaacaagaaggttatcattaccggtgctccagctgctttctccccaacctgtactgtcagccatattccaggttacatcaactacttggatgaattagttaaggaaaaggaagttgaccaagtgatcgttgttactgttgacaacccgttcgctaaccaagcgtgggctaagagtttaggtgttaaggacaccacacacatcaagtttgcctccgacccaggctgtgctttcaccaaatccattggtttcgaattagccgtcggtgacggtgtttactggagtggtagatgggccatggttgttgaaaacggtatcgttacttacgctgccaaggaaaccaacccaggtaccgatgtgaccgtttcctcagtcgaaagtgtcttggctcatttgtag

SEQ ID NO: 805 - DNA, 533 bp, Saccharomyces cerevisiae
atggctggagactccgataatgtgtcgcttcccaagggtatgttagttatattgttgttgcaaaactcaagctttgatgcgggtactgagcggttatactaacttagagaaaacactgaatgatcttagcgaccgtacaaaagatgatatctgaaatactggaccaggatttgatgtttaccaaggatgcaagagaaatcatcatcaactccggcatagaattcataatgatcctgtcctcgatggcttccgaaatggcggacaacgaggctaagaaaaccatagcgcccgagcacgtgatcaaagcgctagaagagttggagtataatgagtttataccattcttagaggaaatattattgaattttaagggttcccagaaggtgaaagaaactagggattccaagttcaagaagtcaggtctctcggaagaagagctgctacgacaacaagaggagttgtttagacagtcaaggtccagattacaccacaatagtgtatctgatccggttaagtcggaggattcttcttga

SEQ ID NO: 806 - DNA, 534 bp, Saccharomyces cerevisiae
atgaaactggcgcaagacatgaatgtagatgaaatatttctcaaacaagcggcagaagctatagcggtaatctcatcaagtcccactcatacggaccccataatacgagagctactccacagaattcgacaatccagcccattgagcgcagttataccagcaccagaaaatgttttaaaggctggggagccggaaaatatggctagaggtcttataaggattccagaaacacaaacaaaaagaacaggaggtaacaaccatagcaaggaaggcgcacagctctacagctgtgcgaaatgtcagttgaaattcagcagaagttctgatctgagaagacatgaaaaggtacactcactcgtgctgccgcatatttgctcaaactgtggcaaagggtttgccaggaaggatgctctaaaaagacattctaacacactgacctgtcaaagaaacagaaagaaactaagtgaaggttcagacgttgatgtagatgagctcatcaaggatgcgataaagaatggtaccggcctgttgtaa

SEQ ID NO: 807 - DNA, 534 bp, Saccharomyces cerevisiae
atgacgtcgaatagcgacggttcaagtaccagtccagttgagaaaccaattaccggcgatgttgaaactaatgaacctaccaaaccaatacggcggctttcaacgccatcgccagaacaagatcaagaaggcgatttcgacgaagaagacgatgatgacaaattcagcgtgagcacatcaactcccaccccaaccataacgaaaactaaggacagcagcgacacaagtacggttacgaggcggaagcagccgatcaggtacatcgagaataagacccggagacatgtcaccttctcgaagaggcggcacgggatcatgaaaaaagcatatgagctctccgtcctaaccggcgccaatattctgcttctaattctggcaaactctggcctggtctacactttcacaacgcctaagctcgagccggtggtacgggaagacgagggtaagagcctcatcagggcatgcatcaatgcttcagacactcctgacgctaccgacacgtcgccggcacaggaacaatctccggcaaactga

SEQ ID NO: 808 - DNA, 534 bp, Saccharomyces cerevisiae
atgagcaaatccactaacgttagttatgaaagagtagagctattcgagaacccgaaagtacctatcgaagttgaagatgaaattctggaaaaatatgcggaatccagtctggaccatgatatgaccgttaatgaactaccaaggttcttcaaggatttgcaactagagcccacaatttggaaactggtgagaaatgaagacgtcattatagaaggaactgacgtaatagatttcacgaaactggtacgatgcacatgccagttactgatactgatgaataatttaacagtaatagatgatttatggtcgatgcttattagaaactgtggcagagacgtggatttcccgcaagtggccttaagagatcatgtattaagcgtaaaagaccttcaaaaaatctccaatctcatcggggctgaccaaagttctgggaccattgaaatgattagttgtgctactgatggcaagaggcttttcatgacatacttggactttggttgcgtattgggaaaactaggttacttaaagatgtga

SEQ ID NO: 809 - DNA, 534 bp, Saccharomyces cerevisiae
atgagcagcattccagctggcactgatcctgggtcctgcggtgctaatttcaagaatgaccgcaagcgcagagataagatcaacgaccgtattcaagaactattgagtatcattcccaaagacttctttagagattattacggcaattctggtagcaatgacacgttaagtgaatccactcccggtgcgcttgggttgtccagcaaggccaaaggtacagggaccaaggacggaaagcccaacaagggccaaattctcacacaggcggtagagtacatatcacatctacaaaatcaagtggacacacagaacagagaggaggtggaactgatggtgaaggccactcagttggccaagcagacaggcaccattgtcaacgatataaacttagagaacaccagcgctgaagtcgccctgtccaggattggcgtgggaccgctggccgcaacaaatgatgactcagtaagaccgccagcaaagaggttgagctccttcgagtacggagggtatggtgagtacggtaatggtagctaa

SEQ ID NO: 810 - DNA, 534 bp, Saccharomyces cerevisiae
atgtcgaacatcacttatgtcaaaggtaacatcttaaaaccaaagtcatatgctaggatcctcatccattcttgcaactgcaatggctcgtggggtggtgggatcgcttatcaacttgctttgcgctacccaaaagcagagaaagattacgttgaagtatgcgaaaagtatggttctaatttactaggcaaatgcatattacttcccagttacgaaaactcagatctgctgatttgttgcttgtttacatcatcatttggaggttcaagtcatggagaaaagcaaagtattttgaattatacaaaacttgctttagataaattgaagacctttagagaagcaaaagacaaaactcgaacaagtgaagattcaatcggtgactatttaaacggccacatcaaatacccaataggggaatataaattggaaatgccacagataaatagtggcatattcggagtcccttggaaagagacagaacgcgtgttagaagaatttagtggcgacatgagttttacagtatatcagctgtaa

SEQ ID NO: 811 - DNA, 534 bp, Saccharomyces cerevisiae
atgttgaagagcacgctgaggctttcaagaatctctctcagaagaggtttcacaacgatcgactgtttacgccaacaaaattcggatatcgataaaatcatactaaatccaatcaaattagctcagggaagcaacagcgatcgtggccaaacctctaaaagcaaaactgataatgcagatattttatcaatggaaattccagtagatatgatgcaatctgctgggagaataaacaagagggagcttctatccgaggcggaaattgctagaagtagcgtggagaatgcacaaatgagattcaattctggaaaatctataatcgtgaataagaacaaccctgcagaatcatttaagagattaaacaggatcatgtttgagaacaatattcccggagataaaagaagtcaacggttttacatgaagccggggaaagtggctgaattgaagagatctcaaaggcataggaaggaattcatgatgggcttcaagaggttgattgaaattgttaaagatgccaagaggaaaggatactaa

SEQ ID NO: 812 - DNA, 534 bp, Saccharomyces cerevisiae
atgttgaagtctatatttgcgaagcgatttgcttccacagggtcatatcctggttctacaagaattactttgccaagaaggcctgcaaaaaaaattcaactggggaagtcacgaccggctatttatcaccaattcaatgtcaaaatggagttgagtgatggaagtgtagttatccggagatcccaatatccaaagggtgaaattagattaattcaagaccagagaaataatccgctgtggaatcctagcagggatgacctagtcgttgtggatgctaattctggtggtagcttggacagatttaacaagaggtatagctctttgttttctgtcgattcaacgaccccaaattcaagctctgaaacagttgaactatctgaagaaaataaaaagaaaacacagattaaaaaggaggagaaggaagacgtttctgaaaaagcgttcggtatggatgactatctatctctgttagacgatagtgaacaacagatcaaatcaggtaagttggccagtaagaagagagacaagaagtga

SEQ ID NO: 813 - DNA, 534 bp, Saccharomyces cerevisiae
atgtttaatactacaccaattaatatcgacaaatggttgaaggagaacgaaggccttttgaaaccaccggtgaataattattgcttacataaagggggattcactgtgatgattgtcggtgggcctaatgaaagaaccggttatcacatcaatccaactcccgaatggttctatcaaaaaaaaggatctatgcttttaaaggttgtggatgagacagacgctgaaccaaagttcattgatatcatcatcaatgaaggcgattcatatttattgccaggaaatgttcctcacagtcctgttcggtttgctgatactgtgggtattgttgtggaacaagataggcctgggggagaaaacgataagataaggtggtactgttctcattgtcgccaagtggtccacgagagtgaactgcaaatgttagacttaggtacccaagtgaaagaagccattttagattttgaaaatgatgtcgaaaagaggacatgtttccattgcaagacgttaaactacgcacgccctcaatctaattaa

SEQ ID NO: 814 - DNA, 534 bp, Saccharomyces cerevisiae
atgtttcgagccggatcatcaaaaagattcttacgaaacacactaatagcaatttcatgggttccggtacttctaacaatcaataataatgtggtccatattgcgcaagttaaaggtacctctatgcagcctacgctgaacccgcaaacggaaacgctggcaacagattgggtgctgctttggaagtttggagtcaagaacccaagtaatttatctagagatgacattatccttttcaaagctcctacaaaccctcggaaagtttactgcaaaagggttaaaggtttaccgtttgataccattgacacgaagtttccataccctaaacctcaagtgaacctgcccaggggacacatatgggtcgaaggggacaattattttcattcgattgatagcaatacttttggccccatttccagtgggttggtcatagggaaagctataacaattgtttggccaccctccaggtggggaacggatctcaaactgagtaccggtagagactgcattagcaaaagagccattttagaatga

SEQ ID NO: 815 - DNA, 537 bp, Saccharomyces cerevisiae
atgaccttgtggccacatccggggtcatacaagatcaagtcagcaactttgttctgcagcagagacaagttggggtgtgctttcttgtcggaaagttccctttgcatgtatttcttatataactctctgtctatctgggctctgggcccccacacagcaggacccttgcttctgttcagcattttgaattgcactccagcgagatcagttactttgcccatcagcccatcgagagcgtcgatttcctttacaaggatgcccttacccactccaccaatagaggggttgcacgaacacttaccaatatctgttaacgatggtgtaatgagagtagtatgcgcaccagtcctagatgacgcagctgcagcttcgcagcctgcatgtccagcaccgatgaccacgacctgtgtcttggttgtgggttggaagcttgtcaaagaagatatggtcaaccgcctcctgaggacctgtaagggaaatgaagtacacgaagacgccaaggttgttacacgcagcatcgttctttggggcgtttag

SEQ ID NO: 816 - DNA, 537 bp, Saccharomyces cerevisiae
atgactggataccctgacgtggccgccttcgatttggactacaccatttggccctgctattgtgatacccatttgcacggtccctttaagccagttaaaagtagtaatggcgaagttctcacaattatatgtagagatggttacgagctcacaatctacaaagatatcccacgtatactaggtgatcttaaagataatggagttaagttaatgaccgcgtcacgaacgtgggcacctgagattgcccaggaaatactgaaaatattcaaggtcaagtatgctggtgtcgtaaccccgttggccaacctgttcgatgaatttcagtggggagaaagaagtaaaattggccatttaagggacggtttgaaagatctttataataccagcgatttaaaatcgaaaaagatttgtttatttgatgatgaaagtagaaacaaagaagtggagaaatacggagtgaagtttgtttatgtaagagacccagagaatggaccatcttggaaactttatcaagattacctgagtggaaaggtttga

SEQ ID NO: 817 - DNA, 537 bp, Saccharomyces cerevisiae
atgagttctgctaaacctattaatgtatattcaatcccggagttgaaccaagctttagatgaagccctaccttctgttttcgcgagattaaattacgagagatcatacgctttactcgatgctaaattgtacataggttattccatagctgttgtagctggtttgagtttcttcttggataaaaaatttgagagagatcagattgttacgtatcaaaagcttttggtaggcgcatattttgtgctctcgctacttttctggtatttctctcgttttattgaaaaggggactgtttatgtgggaaagagaagaggtacaaaggaggaaatatatgtaaagacaaagttcgaaaagaacgaaccattatatctggttgagcttgttcagaaaaaaaagggagaaaactccaagaaggagttgaaggcaaaattagaagtgaataaggtttttaatgaaagtggatatttacagaacgatgcgtattttaagtggttctctgaacagcacaatgtcctcgacaccaaaaaaaatgaataa

SEQ ID NO: 818 - DNA, 537 bp, Saccharomyces cerevisiae
atgccggttactaaatctttatctaagttgcaaaagaacttatccaagaaagggaaaaatatcacggttcatccgaagggtagaaagtatgaaaagctggtcagggctactatgcgtgaagataaaatcgcagccaaaaagaagcttcatcaagacaaaagagtccacgaactagctcgggtaaaatttatgcaggatgtagttaactctgatacattcaaagggcaaccaatatttgatcacgcccacacaagagagtttattcaaagttttattgaaagagatgatacggaattagacgaactcaagaagaagaggaggtcaaacaggccaccaagcaatagacaagtgctactgcaacaaaggagggatcaagagttaaaagaatttaaggcggggtttctctgtccagacttgagtgatgcgaagaatatggaatttctaagaaactggaatggcacttttggccttttgaatactctaagattgatcagaattaatgataaaggtgaacaagtcgttggaggaaatgaataa

SEQ ID NO: 819 - DNA, 537 bp, Saccharomyces cerevisiae
atgcctgcgtatcactcgactttccctgtagatcctaacactgaccgcatggtagggaactttgcgcttctgcccttgaacactaagttcaggggtcctgcataccccagcaattccgattacgatattatcgacgagtgcttggacctatttcgtgccaattccttcttcaagaattttgaaattaaatcacccgccgacagagtgctcatctacggaattctctttatcaatgattgcctagcccatttgaaaataacaacgtcatttaacgaagccgtcaaagtgttaaccaatgtggccttggacaactttactttaccaggtacaccgggtttccctctgaataatgtttaccaagttccagtacaagatcataattcgatggacttgttgaagacttatattcagcaattccgtcaagaattggcaatgagactattagaaagagtctatagctctacagattctaaggaatatccctcaaagttttggttggcgttcacaagaagaagattcatgaacaaatctctataa

SEQ ID NO: 820 - DNA, 537 bp, Saccharomyces cerevisiae
atgtcttcctccaagcgtattgccaaggaattaagtgatttagggaggtatgttaaaaataaaatgaatgatttttcttgatctgtaaagaaaaaggattactaacatgagtttcttttttgaacttttttccgaagagatcctcctgcttcatgttcagcaggacctgtaggggatgacctgtatcattggcaagcctctattatgggtccttcagactcaccctacgctggtggcgttttctttttgtctattcactttccaactgattatccattcaagccaccgaaggtaaactttacgaccaaaatttatcatccgaatattaattcgagtggtaatatctgccttgatattttaaaggaccagtggtcaccggcgctaaccctttcaaaagttttgttgtctatttgctctcttttaacagatgctaatcccgacgatcctttggtccctgaaattgctcaaatctacaagacagataaggctaagtatgaagccaccgctaaggagtggactaaaaaatatgctgtttga

SEQ ID NO: 821 - DNA, 539 bp, Saccharomyces cerevisiae
atgtcaaatccatttcaaaatatagggtatgtgtaaaagaaatagggaaacatctattcgtaaagcctaaactaacattggatatctttttctatttcccggacttcttttttggttatttccttattggcctatcccttgaagcagagtttgattgcaccatatatataaccaaagtgaagacgaaagtaggaaaacactaccaatgcgatttcaacagtaagaatttactatacatttctgcagccgggattgcgtctatttatgtggtcaagaccatagtgaaagctagaagagatgctaaatttataccaaaggcgcggggaaacaatggtgaagtgaatgaaaaaaactattatgataaccttgctcaagtcaaaccagggttccccatacctaaagatggaggagacaacattgattgctctgaggaccatcaattagtaagaaagagtaaatatgaaggtagcgggcttagtgctgtaacaagaaaaagaggtgacaaattaggttttttagataggaggagaaacgagtaa

SEQ ID NO: 822 - DNA, 540 bp, Saccharomyces cerevisiae
atgaaaaagaccccagacccatctccaccttttgcaagcacgaagaacgtaggcatgtcaaacgaagaaccggaaaaaatggttaacgatcgaattgtggtgaaggccatcgagccaaaagatgaggaagcctggaacaaactgtggaaggagtatcagggtttccaaaaaacggttatgcctccggaagtagccaccactaccttcgcaaggtttatagaccctacggtcaaactatggggtgctctagcctttgacaccgagaccggcgatgcaattggctttgcacactacctgaaccatttgacgtcgtggcatgtcgaagaagttgtctacatgaatgacttatatgtcactgaacgcgcaagagtcaaaggcgtaggtagaaagctcatagaatttgtatacagccgtgccgatgagctcggtacgcctgcagtgtactgggttacagaccattacaatcaccgcgcacagttgctgtacaccaaagtggcttacaagacagataaggttctttacaagagaaacggatactga

SEQ ID NO: 823 - DNA, 540 bp, Saccharomyces cerevisiae
atgaaatcatttcaaaaatcttatgaattcgattacccatgggagaaagtcaccacggcgaactggatgaaatatccaaacaagatctccacacacgttattgcagtcgatgtgctccgccgagagctcaaagaacatggcgatgtacttcttacagaacggctgataaccatacgtcagaacacccctcactggatgtccattttagtggggaacactaatttagcatacgtgcgagaggtctccaccgttgatcgaagggacagatctttaactatgaggagttgcaatatgaccttcccgcatattttgaagtgttacgaaaccgtacgttatgttcctcatccgaaaaatccatcgaatgtgactcttttcaagcaggatgcaaagtttctgtctggtgttccgaccaaaacctttagtgagaaagtagaaaactggggcgttaaacgttttagtgataacgcggtgaaggggaaagtcgggtttgatagtattctagcaatgttcaacgatatctggaaaaatgctaacgaataa

SEQ ID NO: 824 - DNA, 540 bp, Saccharomyces cerevisiae
atgagagaatataccagtaaaaaagaactaaaggaagagattgaaaaaaaatatgaaaaatatgatgcagaatttgaaacaatctctgaatctcaaaaagacgaaaaagttgaaacagtggatagaacaccctctgaaaacctctcttatcaattgggctgggttaatttattattagagtgggaagcaaaggaaattgctgggtataatgtggaaactcctgcgcctggttataaatggaacaatttaggaggattataccagtcattttataaaaaatacggaatctactccattaaggagcaaagagccaagctgagagaggccgtaaacgaggtctataaatggatatctactttatctgatgatgagctctttcaagcgggaaatagaaaatgggctacaactaaagctatgtggcctgtgtataaatggatccatatcaacacggttgctcctttcacaaactttagaggaaaaattagaaaatggaagagactagtgcctgaagaacaacgcataaaaaggaggaagatataa

SEQ ID NO: 825 - DNA, 540 bp, Saccharomyces cerevisiae
atgatatcatatgaattccaaactcatctaccgaaaggaaaagatagctcattgaacgcttcatccgaaaacaaagaattgtatgtacaagccacgcactttaataacacaattctattgcaaatcagactaaatggggaaatggattccacctatgaggtatcttcaaaaggactaaacccaattctcgatatcaacgtaccactggcaggaaacctaggaaacacgggtggcgattatgacgatgaggaagaagaatttgtaagagaccatttatctgattatcaagtggttaccaagttgggagatagtgccgatcctaaagtacccgtggtatgcgtacagattgccgaactatataggagagttattctaccagaagtgagcggtacgatggcccaagacaacatgcaattcagcttgctgatatccatgagcagtaagatatggagagcaacgaaggaacaaagcgctgacgataatgattttggcaaattagtttttgtgttaaagtgtatcaaagatatgtatgcaaagtga

SEQ ID NO: 826 - DNA, 540 bp, Saccharomyces cerevisiae
atgatcaatttcctcctttttgtcttgacgattttggcgactttaacaaacatttggttttctggtgttctctcccctgccatggtgatccggatatgtttaggtggctctatggtagtccttcagatatggtcattcagtagaccaataagtaatgaaacattccgtacaaaacttctactagaggtaataactcatagaccatcgatagctgggaaagaatggaaaaccataacgtataacatgaatcaatatttgttcaaggctggcttatggaaaacaccataccactttttttgtgaacaccagtgctatgaatttttcaaggatctcataaagggaaaatatcctgatgtacagtgggatacagcgaatacacagccgttcatcagtgttccagaaaatcaggctgcaactcaaaattctgatgttgaaccaaccgtaaagtggtgcctctttaaagcagccgaaattcaagcccatgctgtgcgggaatattggcaaagtcaatatccagatgtgggcatacctgcaatatga

SEQ ID NO: 827 - DNA, 540 bp, Saccharomyces cerevisiae
atgcctggtcttaagcttgttgaagctttagaatacaggtgtgaccgattggagcggcttataggcgccggatacagcgcgaattccgatgtttcagtgcaattagatgaactatacaatcagttacatcgtctatatttccagggtctaaagtattctcaagatctcctgcaactctttaatactttcatggctgaagacatcgagaacgtgggagctcctgatgatatttgtatttttgctagttgctttgacgatatttatacattatatagtgcatttgacgaactaaacagccaatatatggagttttgccaaatcagtaaaagttcattggatcagatttccttcaaagacgcaaatattgaaacgaaacagttgaagaagttacccgagttggtggataactgcaacataatgattttgaggtcaattgcaattctaaaccgtttcatcgactggaatattgaagttaacggattcttccagttccagaaaaagaggctgttgaatttacaaaaggtaatttatagtacgtga

SEQ ID NO: 828 - DNA, 540 bp, Saccharomyces cerevisiae
atggggtcgggcgatttgaatctgttgaaatcatggaatcccaagcttatgaaaaatagaaaaaaagtatgggagaccgaacaggatctaattaccgaacagcagaagcttaacacgcgattgaaagaaattgaaaaagaacgagaactaaatgaactgctgaacgaatcgagcaaggataagccggagactctcaagaatgacttggctttgaagaagtcgggcttggaatggatgtatcaggatgcaaaactgagtgacgaaaaggaagactatttattaggtaagaaaaaactagattcatctatactaaaccaacctgcaacaccgcctgtaagggcggccactactatttccgcttctggtgccgcaacatccataagttcgcagaagaagaagtcaaaattgcttaaagatgatccaatgagtaagtttaaggtaactaaacaacaaagaagaactccagactcaacaaaaaaaagagcaatgtcgcaacgagggaaaccgttgtccaagcccgctccggacctagactactaa

SEQ ID NO: 829 - DNA, 540 bp, Saccharomyces cerevisiae
atggtggttttagacaagaagttattggaaagattgacttctcgtaaggttcccttagaagagctcgaagatatggaaaaacgatgctttttgtctacttttacatatcaagatgcctttgatttggggacttacataagaaatgcagttaaagaaaatttccccgaaaaaccagttgcaattgatatctccttaccaaatgggcattgcttgtttcgcacagtgacctacggtggcagtgcattggacaatgatttttggatccagagaaagaagaagacagcgcttcgatttggtcattcaagtttctatatgggctgcaagaaaggtgacaaaacaccggaggaaaagttttttgtggactcaaaagaatacgctttccatggaggtgctgtcctaatacaatcggagagaagtgactacccctatgcctgcttaactataagtggattgaagcaggaagaagaccatttaatggcagtcagctctttaattgcatttgctaatgaaagtctagaagaagatttgaatttggattga

SEQ ID NO: 830 - DNA, 540 bp, Saccharomyces cerevisiae
atggttaaggtatatattcatgacaacaaggttgactccgattatcgcgcaccccacaattctggaacagaactttccctggatgaattagccaagttaggagtgatttataaatactgtgcaaatgaggaagaagtgaatgaaattgctaggcaaagagaatataaaaatagagatgtggtcaacatctgcgaaggttccttcaaaagtgaagcagagtttaatgaaaaactagcaacattctaccaagagcatttacatgaagacgaagaaataagatactgtctcgagggtgctggatactttgacgtcagggatgcttccacaccagagaactggattaggtgtttggtagagtcaggtgatttactgattcttccaccaggcatctatcatcgtttcaccttgacaactagcaaccacatcaaggccttgagactgtttaaggacgagcccaaatggcaagctatcaacaggtcaaatcaggctgattcattgcctgtacgcaaggactacattgccctgatcaatcagtactaa

SEQ ID NO: 831 - DNA, 541 bp, Saccharomyces cerevisiae
atggctgtcaagactggtatgtttacctgaactaatgaactgtagagcaaaagcaaaatgaactgaaccactaagccaacaacagaaatacaaacaggatgagattaagctccagagatatgcaaacatcgtttatatcctgcacccagcgttgcagtactccgtggagtctttgtttatttattttgctcgtatactacgtgagtactagtgtgcttgttactaacataagatattctatttttttcctctaggtatcgctattggtttgaacaagggtaagaaagtcacccaaatgactccagccccaaagatctcctacaagaagggtgctgcctccaacagaaccaagttcgtcagatctttggttagagaaatcgccggtttgtccccatatgaaagaagattgatcgatttgatcagaaactccggtgaaaagagagccagaaaggtcgccaagaagagattgggttctttcaccagagccaaggctaaggtcgaagaaatgaacaacatcattgctgcctctcgtcgtcattaa

SEQ ID NO: 832 - DNA, 542 bp, Saccharomyces cerevisiae
atggctgtatgttagaaagatattataaatcccagttagatgctgaactgatcaatagcaaattataaaccacatccatctaaatgaccttaccacctacaatttggatttgaaatagaagcaatgtgtaaaatatagggaaaggattaggagtgttaaccatactaaaatttttcttatccgaaacagaaatctaaagtcgccactacgcagattaaaatatggtcataaactgcttattctgagaacttttggtggtccagcgtggtttatgtcaggtggtattgccttggatccgtgaatgcatcacattgatgagtttgaacattgttactaacattttttacaattgtacacttcgtatgtgcacgatatgtttcccttttaattaggctcaaaagtctttcagaatcaagcaaaaaatggctaaggctaagaagcaaaacagaccattgccacaatggatcagattgagaaccaacaacactatccgttacaacgctaagagaagaaactggagaagaaccaagatgaacatctaa

SEQ ID NO: 833 - DNA, 542 bp, Saccharomyces cerevisiae
atgtcttcttctaaacgtattgctaaagaactaagtgatctagaaaggtatgtctaaagttatggccacgtttcaaatgcgtgctttttttttaaaacttatgctcttatttactaacaaaatcaacatgctattgaactagagatccacctacttcatgttcagccggtccagtcggcgatgatctatatcactggcaagcatccatcatgggacctgccgattccccatatgccggcggtgttttcttcttgtctatccatttcccaaccgactacccattcaagccaccaaagatctccttcacaaccaagatatatcatccaaatatcaatgccaatggtaacatctgtctggacatcctaaaggatcaatggtctccagctctaactctatcgaaggtcctattatccatctgttctttgttaacagacgctaatcctgacgatcctttagtaccagaaatcgctcatatctacaagactgacagacccaagtacgaagctacagccagagaatggacaaagaaatacgctgtataa

SEQ ID NO: 834 - DNA, 543 bp, Saccharomyces cerevisiae
atgagtggaagtaatatgggatactatgacgtactcgcagggctttcagcgctggaaaagtcatcccaggtagtgttcagtgcgactgagcttcaacagcttacgcaacaatctcatgctaccgacaagggcatagagggcagtgagaatagtaaagcgaaggtatccaagcccaaaagagtagctgtacatggttacctaggcggtaaagtgtcgctcgccgatgcggcacaggtggagtatgaagtaggccattcactgctgggcagttatgtgccacgccagcagttggaagccctgtcaagtgtcgacttttcgcaccatttccaccgcacattagaatgcaaagctgctctagagacacacgatgtttttcttgccggcgcaggacaattgtctctacccttccaatcacacatagagagccccaggaatagcgaggctaaaaggaaaagaaaagtgataatatgcaaacggtgtcaatcacgatttataggttcccataggcggtctcaacttagagaacatgcctgcgtagattaa

SEQ ID NO: 835 - DNA, 543 bp, Saccharomyces cerevisiae
atgccaccaccatcaagaagtagaataaacaaaacaagaacattaggaatagtgggtacagctatagcagtgttggtcacgtcctactatatatatcaaaaggtgacaagtgcaaaggaagataatggggcacgacctccagagggtgattcagtaaaagagaacaaaaaggcaaggaagagcaaatgtattataatgagcaagtcgatacaaggactgcccataaagtgggaggagtacgccgctgatgaagtggttttgctggtacctacgagccacactgatggatcaatgaaacaagccattggggatgcctttcgcaagacgaaaaacgaacacaaaatcatatattgcgatagcatggatggattatggtcatgtgtaagacggctaggtaaatttcagtgcatattgaactccagggacttcacaagtagtggtggtagcgatgcagcagtcgttcctgaagatataggcaggtttgtcaaatttgttgttgatagcgatgtagaggatgtgctgattgacactttatgcaattaa

SEQ ID NO: 836 - DNA, 543 bp, Saccharomyces cerevisiae
atgctatacacaaggttgttacgtcacaactcacaattcaccaagttttcaggcacatcgcccaatcttggctcaaaacctttattttcgaagggtaatttgtacactagtcttttagtgacaacactgtatgggacaggtctggcatgcctatatctagaatcaaatagcttgaataagtccaaagagcaagaagatccccatgccatcgcagaagacgacattgtaaatatagtccatgacgctcccaatagaatattcaagccagcacttgatacctatcaagagaaagagcttgacttacaaaagagtgacctccataaagtacttcattctttgacgtacagtgatgtctctcaattttcgattgtttgggggtttctcattcaactttcgagcctaataggcaattccaccttaggcaaaaaatccattctttataagggaagtgtcgttagtgttttagggttcccaccgttgatttatatggcacttaaacttaggatgaaacagctggaaaaagctggagtgcgctttgagtaa

SEQ ID NO: 837 - DNA, 543 bp, Saccharomyces cerevisiae
atgggctcatcaaccgggtttcatcatgccgatcatgttaactattcttcaaatctgaataaggaagaaattctagaacagcttctgctttcatacgaggggctatcagatggacaagtcaattgggtttgtaatttgtcaaacgcttcgtcattgatctggcatgcgtacaagtcattagctgttgatatcaattgggctggattttacgttactcaagctagcgaagaaaacacactgatattgggcccatttcaaggaaaggtcgcttgccaaatgattcaattcggtaaaggtgtttgcggaactgcagcctctacaaaggaaacgcagattgttccagatgtcaacaagtatcccggtcatattgcgtgcgacggtgaaaccaagagcgaaattgttgttccaatcatatccaatgatggtaagacattgggcgtcatagacatagattgtttggattacgaaggattcgaccacgtagacaaagaattcctagaaaaacttgctaaattaattaataaatcatgtgtctttaaataa

SEQ ID NO: 838 - DNA, 544 bp, Saccharomyces cerevisiae
atgtcagactacgaggaggcgtatgtgcattcatattggagaaattgcgtgctttagttttaattatatttactaacttctatcattgtgatacaggtttaacgacggtaatgagaacttcgaagattttgatgtagagcatttttctgatgaggagacttatgaggaaaaacctcaattcaaggatggtgaaacaaccgatgccaacggtaagaccatcgttactggtggtaatggcccagaagattttcaacagcatgagcaaataagaagaaagacacttaaggaaaaggccatcccaaaagaccaaagagcaactactccatacatgaccaaatatgaaagggcaagaattttaggtacaagagccctacaaatttccatgaatgcgccagtttttgtagatttagaaggtgaaactgatccattgcgtattgccatgaaggagttggctgaaaagaaaattcctttggttattagaagatatttaccagatggttcctttgaggactggagtgtggaggaactcattgtggatttgtga

SEQ ID NO: 839 - DNA, 546 bp, Saccharomyces cerevisiae
atgaatactgaaggtgcttctttaagtgaacaattgctggatgcagctagaagaaacaatctggatcttttggagaccgtatttgatagcttagataatgatcctgagaagattgcaaagctaattaacgaatccaaagaaccactggggaatacagcgttacatttatgttgtaagtatggatcctgggaagttctcgacaagattctcgatcaagacggtgaaatcgaaatagacccacaaaacgacgttgatggcgacactccgttacatgttactgtcagatacagtcaagaggagcctgagcatggaacttttattgctagaaacttaattgaagtgggtgcggatcctagggtgagaaactataacaatcaaaagccagttgatttggttcatggtgatgaactggatgaattaattgaccttttgcagggtgccgagttagcgattgatagtaccaatggatcaggtgataacaatgaggatggggaaatgatagatgatggtccatctgacgatgacgaagaagatgataaaaaatga

SEQ ID NO: 840 - DNA, 546 bp, Saccharomyces cerevisiae
atgacaaacagtagtgaaaaacaatgggaaagaatccagcaattagaaaaggagcacgtggaggtatatagagagttgttgatcacgttggacaggttgtacttgattagaaaacacaatcatgcggtaatattaagccatactcaacagcgcctcttggaaattagacaccaacttcaaattaatcttgaaaagactgctcttcttattagactgttggagaaaccggacaataccaatgtattattcaccaagctacaaaacctcttagaagaaagcaattctctggactatgagctcttgcaatcgttaggtgctcaatcttcattgcacaaacagttgattgaatcaagagcagaacgcgacgaattgatgtcaaaactgattgagttatcgtcgaagtttcccaaaccaactataccgccagacgacagtgatactgctggaaaacaggttgaggtagaaaaggaaaatgaaacgatacaagaattgatgattgctttacagatacactccggatatacaaacatatcctacacaatttga

SEQ ID NO: 841 - DNA, 546 bp, Saccharomyces cerevisiae
atgagacagctaacagaagaagagaccaaggttgttttcgaaaaactcgccggctatattggtagaaatatttcttttttagtggataataaagaacttcctcatgtcttcagattacaaaaggatagagtatattacgtacccgatcatgttgcaaaattggctactagtgtagcaagacctaacttgatgtctctgggtatttgtttaggtaaattcacgaaaactggaaaattcaggttacatattacttctttgacagtattggctaagcatgccaaatataagatatggattaaacctaatggggagatgccattcttatacggtaatcatgtgttaaaggcacatgtgggtaaaatgtctgatgatataccagaacacgccggtgttattgtgtttgcaatgaatgatgtgccattagggttcggtgtcagtgcgaaaagtacttctgagtcaagaaacatgcaacccactggtatagttgctttcagacaagcagatattggtgagtatttgagagatgaagacaccttgtttacttag

SEQ ID NO: 842 - DNA, 546 bp, Saccharomyces cerevisiae
atgagtgaaacaaggatggcacagaacatggatactacagatgaacagtacctgagacttattgagctactctcaaactatgattccaccttagagcagttgcagaaggggttccaggatggctacatccaattgagcagatcgaactactataataaagactcattacgaggaaactatggtgaagattactgggatgaaacgtatataggtcaactaatggcaacagtggaagaaaaaaactccaaggtagttgtcgaaatcgtcaaaagaaaagctcaagataagcaagaaaagaaagaggaagaagataataaattgactcagagaaaaaaaggaacgaagccagaaaagcaaaaaactcagagtcacaaacttaaacaagactacgacccaattttgatgtttggtggagtactgtccgttccttcttcattgagacaatcgcagacaagtttcaaaggttgtattcccttaatagcccaattgattaattacaagaacgaaatattaacgttggttgaaacgttgtctgagcaggaataa

SEQ ID NO: 843 - DNA, 546 bp, Saccharomyces cerevisiae
atgatgttgccaagatccatgaaatttatgactggaaggagaattttccatactgccacagtaagggccttccagtctaccgctaagaagagcttaactatcccatttttgcccgtattaccccagaaaccaggtggtgttaggggcactcccaatgatgcctacgtccccccccctgagaataaattagagggctcataccactggtatatggaaaaaatctttgccttgtccgtcgttccattggctacgacggctatgctgacaaccggtccgttatccactgcagctgattctttcttttctgtcatgcttttgggatattgttacatggaatttaactcttgtatcaccgattatatttctgaaagagtttatggtgtttggcacaagtacgccatgtatatgttgggccttggttctgcggtctccctttttggaatctataaactagaaaccgagaatgatggtgttgttggtttagtaaaaagtctatgggattcttccgagaaagacaacagtcaaaagattgaagccaagaagtag

SEQ ID NO: 844 - DNA, 546 bp, Saccharomyces cerevisiae
atgccttataaaacagctatagattgcatagaagagttagctactcaatgctttttgtcaaagcttactgatgatgatgtgtctactttcaggcgggtctgtagtaaggagaatgacattataaagctggcacttagaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataa

SEQ ID NO: 845 - DNA, 546 bp, Saccharomyces cerevisiae
atggctggcaaagcagggaggaaacaggctagttcaaatgcaaaaataattcagggcttatacaagcaagtctctttgtttttaggaatggctatcgtacgtctattcatttcacgtaaggttacaattggccaatggattaagctggtggctttgaacgttcctatgttcgttgctctgtatatcattgtgctatccggtaagcccaaatatgatggcaatcgcgtagtaaaacaaggtatagacttgaacgacaatacaaatttgatatcatatttttttgatttgatatatctatcactttttggtaacattggtattatagctttcaggacattcaaattttggtggtgtctactattgtgccccatctatgctggttacaagttatatggcctcaaaaacatgttcatgcctggcgctcaacaaactcaggcagataatcgctcaaaaaatgctaatgagggacaatccaaatccaaaaggcagatgaaaagggagaggaggggtgaaactgactctaaaattaagtacaagtatcgttaa

SEQ ID NO: 846 - DNA, 546 bp, Saccharomyces cerevisiae
atgggtctatacgcttctaagttattcagcaatctttttggcaacaaagagatgcgtatacttatggttggtctagatggtgccggtaagaccaccgttttgtacaagttgaagttgggcgaagttatcactaccattccaaccattggtttcaacgttgagactgtccaatataagaacatttccttcactgtctgggacgtcggtggacaagacaggattagatctttatggagacactactacagaaacaccgaaggtgttatttttgtcatcgattccaacgatagatcgcgtattggtgaagccagagaagtcatgcagagaatgctgaatgaagatgaattgagaaatgctgtctggttagtcttcgctaacaaacaagatttgccagaagccatgtctgctgctgaaatcaccgaaaaattaggtttacattctattagaaaccgtccatggtttatccagtctacttgtgcaacctcgggtgaaggtctgtacgaaggtctggagtggttaagcaacaacttgaagaatcaatcctaa

SEQ ID NO: 847 - DNA, 546 bp, Saccharomyces cerevisiae
atgggtttgtttgcctctaagttgttcagtaacctttttggtaacaaagaaatgcgtattcttatggttggtcttgatggtgctggtaagaccaccgttttgtacaagttgaaattgggtgaagttatcactaccattccaacaattggtttcaacgttgaaactgtccaatataagaacatttcattcactgtctgggatgtcggtggacaagacagaattagatctctatggagacactactacagaaacactgaaggtgttatctttgttgtcgattctaacgatagatcgcgtattggtgaagctagagaagttatgcaaagaatgttgaacgaagatgaattgagaaacgccgcttggttggtgttcgctaacaagcaagatttgccagaagccatgtctgctgctgaaatcactgaaaaactaggtttacattctattagaaaccgtccatggtttatccaagccacgtgtgctacctccggtgaaggtttgtatgaaggtttggaatggttaagtaacagtttgaaaaactcaacttaa

SEQ ID NO: 848 - DNA, 546 bp, Saccharomyces cerevisiae
atgtctatttctgaatcttacgcaaaggaaataaaaactgcatttaggcagttcactgactttcccatagagggtgagcaatttgaggattttttacctattattggcaaccccacgctattccaaaagttggtacacacgttcaagacgcatttagaagaaaagttcggcaaagaaaagatcgactttattgcaggtatagaagctagaggccttctatttgggccatccctagcactggcattgggagttggatttgttccaataaggagagttggaaaattgccgggtgagtgtgcttctataacattcacaaaattagaccatgaagaaatttttgaaatgcaggttgaagccattccctttgattccaacgtggttgtcgtggatgatgttctcgccaccggtggaacggcatatgctgcgggcgaccttatcagacaagtgggtgctcatattctggaatatgactttgtgctagtgttagatagtctacatggtgaggagaaattatctgctcctattttttccatattgcactcctga

SEQ ID NO: 849 - DNA, 547 bp, Saccharomyces cerevisiae
atgagcatgtataacaaacactgatttttgttttgagttttaaaagatatccatttactaacattcgaggtgtacaagcacaagttttgcagtgttgcgtacttctcttactaaaggggcacggctaactgggacaagatttgttcaaacaaaggccctttcgaaggcaacattgacagatctgcccgaaagatgggaaaatatgccaaacttagaacagaaagagattgcagataatttgacagaacgtcaaaagcttccatggaaaactctcaataacgaggaaatcaaagcagcttggtacatatcctacggcgagtggggacctagaagacctgtacacggaaaaggcgatgttgcatttataactaaaggagtatttttagggttaggaatctcatttgggctctttggtttagtgagactattagccaatcctgaaactccaaagactatgaacagggaatggcagttgaaatcagacgagtatctgaagtcaaaaaatgccaatccttggggaggttattctcaagttcaatctaaataa

SEQ ID NO: 850 - DNA, 547 bp, Saccharomyces cerevisiae
atgccgaaagtaattctggagtctcattcaaagccaacagactcagtttttctacaaccatggataaaggcattaattgaagacaactcggagcatgatcaatatcatccctctggccatgtaattcctagcttgaccaagcaggacttagcgctaccgcatatgagcccgacaattttaaccaatccgtgccatttcgccaaaattacaaaattttataacgtttgcgactacaaggtatacgcatcgataagagattcctcacaccaaatacttagttgagttttcccaagagtgtgtatctaattttgaaaggactcataattgcaggatcacatctgagacgaccaattgcttaatgatcattggcgatgctgacttagtctacgtaacaaattctcgagcaatgtctcacttcaaaatttgcctaagcaacatttcgtccaaagaaatagtgcccgttctcaatgtaaaccaggccacgatatttgatattgatcaagtcggatcgttaagtactttcccatttgtatataaatatttatga

SEQ ID NO: 851 - DNA, 548 bp, Saccharomyces cerevisiae
atggtcagtataacatgattttataactatttcgctttattctttcatgggattagcaagaaggcttggaatacaaacatgaattttcaaagtttattcctgctcttgtgtttgagagagtccgttcaaaggatgcttctccatgactgtgaaataaaagtgagatatgcaaaaactttgaataatctactaacaagttaatacgttattttttatcgtttacatttcaacaggccccagttaaatcccaagaatctatcaaccaaaagttggctttggttatcaagtctggtaagtacaccttaggttacaagtccactgtcaagtctttgagacaaggtaagtctaagttgatcatcattgccgctaacactccagttttgagaaagtccgaattggaatattacgctatgttgtccaagactaaggtctactacttccaaggtggtaacaacgaattgggtactgctgtcggtaagttattcagagtcggtgttgtctctattttggaagctggtgactctgatatcttgaccaccttggcttaa

SEQ ID NO: 852 - DNA, 549 bp, Saccharomyces cerevisiae
atgatattacttcatgccatatatactctttgggtaattatactacttccgctactcaatgcagagaaatttgtcccaaaagtaacggaggctcctatagaaacatcatttaatctagtgagttttgatgattccaacacttctatcagattagatggttggggggttgtatggataagtttcgacgctggagaaaattgggaaacggtcaaagaaattgaagagcgcattttcagatttactgttgatcctttccatggacaggaaagaggtttcgcttttatatgtgaatcacccaaattctacattaccgacgaccgtggggagtcatggagggctttaactataccctcatcagaagaatatttagatggcgactgttttataactactcatcctagaaacaaagaacttcttattgcgaattgctatagctatatgatagacgcagacgttttatatgacccaagtgaaatttacttgagcaatgatgggaatccttttttaaaattaaaccttccttggaaaagaaaaaagacgacgatataa

SEQ ID NO: 853 - DNA, 549 bp, Saccharomyces cerevisiae
atgccgttatttttggttctgaaagcaacattatcagaaaacgtgaccaaggtttcaattgagaatacaaacgaatcaagggcagaatttgccttcgatctacaatgtaccagttgtagagaattacacgattctaaagtcatcatcaatacatttgaagaatatgctatgccggcatcaaaaggtaccgcatctttcttgatgaagtgtaaattttgttcaaaagaattgtcagttaacctgtgcgcttttgaggatgaatatttaactgatcagagtgacgacaaatgggccaagataaaagatgtgcggaagaagcatggtttatcgaaggtcaaagaagattctttcattcctttaagccttgattgcagaggttgtgaattaatcaaattttatcccgacaccataacgtttgaagtttctctaagttcggggaaagtaatgtcatgccaactagaggataatgaatggtatgattatgatgacaaccttggggaagaagtaacaatgactgatttctcatcaagcattattaaaggtaagtaa

SEQ ID NO: 854 - DNA, 549 bp, Saccharomyces cerevisiae
atgtccatcgaggaggaagatacaaataagatcacatgtacgcaagactttcttcaccaatactttgtaactgaaagggttagcattcaatttgggttaaataacaagaccgtaaaaaggataaataaagatgaatttgataaggcagtaaattgtatcatgtcatggacaaactatcctaagcctgggttaaaacgaacagcttcaacgtacctcttaagcaattcctttaagaaatctgcaacagtatctcttccgtttatcttaggcgacccagtatgcatgccgaagagggtggaaagcaataataatgatacctgtcttctgtatagtgacacattatatgacgatcctttaatacagaggaatgatcaagcaggagatgaaatagaggatgaatttagctttacattgctacgaagtgaagtaaatgaaatcagacccatatcttcgtccagcaccgcccaaatactgcaatcggactattctgcgctgatgtatgagagacaggcttcaaatgggagcatatttcagtttagtagtccctga

SEQ ID NO: 855 - DNA, 549 bp, Saccharomyces cerevisiae
atgttaaaaagacgctctaatgctctcattactttgagtagaactaaattgtttcccataacaaccgttgcctattaccacaggcgcctcctcaaccaacaacgaagagctgtttcaacgtcaccgaagaaagaaatcaagagcctagaagacttggctaatttggattctttggatggtgttgatactgaactgatacgcgatttgattaatgagcatactacaaaattaaatatcaaaaaggagttagatatgctcaaaaaattctcgcaagaggaagaatcaggacatgagatccctgtaaaaagatttattaggcctctttggatgttcattctaatgggatcttccgtttatttactgcttcacttctcttggtggaaactagagcatgaggagagagaaagtcagctaaagaaagaggtagaaatcctggaacaccaattaaatgagttaattgtacaggataaaacccacaatactagtaggggaaagggcagtaatgaatcaacacatatgaagccttggtataggagatggttttggtga

SEQ ID NO: 856 - DNA, 549 bp, Saccharomyces cerevisiae
atgtttaaacgttccatcattcaacagtcccgcttattctccaattctgcttctagactaggtaaaaaagtgttctttgatcctgcggtcaatggaaccaaaatcggcagaatagaatttgaattatatgataatgtggttcctaaaactgctgaaaatttcagagccttatgtaccggcgaaaagggctggggctataaaggtgtccctttccacagaatcatcccagacttcatgatccaaggtggtgacactgatttgactaacggttttgggggcaaatccatttacggttccaagttcgctgacgaaaattttgtcaaaaagcatgacaaggcaggtttgttatctatggcaaatgctggaccaaacactaacggttctcaattcttcattaccactgtgccttgtccatggttggatggaaaacacgttgtctttggtgaggtaaccaaaggtatggacattgtcaaagcaatcgaatcatacggtactgcttctggtaaaccaagagctgaaatcgttatcgaagaagctggtgagttatga

SEQ ID NO: 857 - DNA, 552 bp, Saccharomyces cerevisiae
atgaacagttacagcctattaactagatctttccacgaatcttctaagccccttttcaatttggctagcaccttgttgaaggcttccaagagaacgcagcttagaaatgaattgataaaacagggtcctaaaaggcccacatctgcttatttcttatatttgcaagaccacagaagtcaattcgttaaggaaaatccaaccttacgtcctgctgaaatcagcaagattgccggtgaaaagtggcaaaatttagaggctgatataaaggaaaaatacatttctgaaagaaaaaagttgtattctgaataccaaaaggcgaagaaggagtttgacgaaaaacttcctccaaagaaaccagcaggacccttcattaagtatgccaatgaagttcgttcgcaagtttttgcacaacatcctgacaagtctcaattggatctaatgaaaattatcggagataaatggcaatccttggatcaaagcattaaggacaaatacatacaagagtacaaaaaagctatccaagaatataatgctcgctaccctctcaactag

SEQ ID NO: 858 - DNA, 552 bp, Saccharomyces cerevisiae
atgaattctttgatttttggtaaacaattagcatttcacaaaattgtgcctaccactgcaattgggtggttggtaccgctaggaaatccttcactgcagattccaggccaaaaacaactgggatctatccaccgttggttgagagaaaagctacaacaagatcataaggacactgaagataaagattttttctctaataatggtattctactagcagttcctaaaaaaaaagtatcacaccaaaaaaaaaggcaaaaactttacggtccaggtaagaagcaattgaagatgattcaccatttgaataagtgcccatcatgcggccattataagagagccaatacactgtgtatgtattgtgttggacaaataagtcatatatggaaaacgcataccgctaaagaagaaattaagccgagacaagaggaggaactttccgaactagaccaaagagtcctatatcctggtagaagagataccaaatataccaaggatttgaaagataaagataactatttggaacgtcgcgttcggactttaaaaaaggactag

SEQ ID NO: 859 - DNA, 552 bp, Saccharomyces cerevisiae
atgccaaacttctggattcttgagaatcgtaggagctatacgtctgatacatgtatgtcgaggatcgtgaaggagtacaaagtcatactgaaaacattggccagtgatgaccccatagcgaacccctaccgggggataatcgagtcacttaacccgattgacgaaaccgacttgagcaagtgggaagctataatttctgggccgtcagacacaccttatgaaaatcatcagtttcgaatactaatagaagtccctagttcctaccccatgaatccaccaaagataagttttatgcagaacaatattttgcactgcaatgttaaatcagccacaggagaaatatgtctgaacatccttaaaccagaggagtggactcctgtatgggatttgttacactgtgttcatgctgtttggagactcctaagggaacccgtttgtgattctccacttgacgtagacattggtaatatcatccgctgtggcgatatgagtgcctatcaggggattgtaaagtacttcctagcagaaagagagcggatcaacaaccattga

SEQ ID NO: 860 - DNA, 552 bp, Saccharomyces cerevisiae
atgggcaattcaatttcgaaggttctgggaaaactatttggctcgaaagaaatgaaaattttgatgctaggcctggataaggctggtaagacaacaatattgtacaaactaaaattaaataaaataaagacgtctactcccactgtcggttttaacgtggaaaccgttacttataaaaacgtaaaattcaacatgtgggatgtaggaggacaacaaagattgagacctctctggagacattattttccagccaccaccgcacttatctttgtgatagattctagtgctagaaaccgtatggaagaggccaaagaagagttatatagtatcataggtgagaaagagatggagaatgtagtactgctggtatgggcaaacaaacaagatttgaaagatgcaatgaaacctcaagaggtttccgattttttagaactggagaaaaatttgaaaaaccaaccttggtgtgtcatcggtagtaacgccttatccggacagggtcttgttgaaggattatcctggatttcgaacaacacaaacgttccaaagaaataa

SEQ ID NO: 861 - DNA, 552 bp, Saccharomyces cerevisiae
atgggtaacatttttagttcaatgtttgacaaactatggggttcaaacaaagaattgcgtatattgattttgggtttggatggtgcaggtaaaactaccatcttatatcgtttacaaattggcgaagtagtcactacaaagccaaccattggtttcaatgtagagacgctaagttataaaaacttaaaattgaacgtctgggatcttggtggtcaaacaagtatcaggccctactggaggtgttattatgcagacactgctgcagttattttcgttgttgattcgactgataaagatcgtatgtctacagcctctaaggaacttcatttgatgttacaggaagaagaattgcaagatgcagcactgctggtttttgcaaataaacaagaccaaccgggtgcattaagtgccagtgaagtctccaaagaactgaatcttgtagaattgaaggacagaagttggtctatcgtagcatccagtgcaattaaaggcgaaggtattaccgaaggtttagattggttgattgatgttataaaagaggaacagttatag

SEQ ID NO: 862 - DNA, 552 bp, Saccharomyces cerevisiae
atggttagaaaactaaagcatcatgagcaaaagttattgaaaaaagtagacttccttgaatggaagcaggaccaaggccaccgggacactcaggtcatgagaacatatcatattcagaatcgtgaagattatcataaatacaataggatatgcggtgatattcgtcgtcttgccaataaattatcattattacctcccactgatccatttcgtcgcaaacatgagcaattattactggacaagctatacgctatgggtgtcctgacaactaaatcaaagatttctgatctggaaaataaagttactgttagtgccatctgtaggaggcgattacctgtaataatgcatagattaaaaatggcggaaactatacaagatgcagtcaagttcattgaacaagggcatgttcgcgtgggtccaaatttgatcaacgatccagcctacctcgtaacgagaaatatggaggactacgttacttgggtggacaactctaagatcaagaaaaccttgttgagatacagaaaccaaatcgacgattttgatttttcataa

SEQ ID NO: 863 - DNA, 552 bp, Saccharomyces cerevisiae
atgtacaaaacatggcgtctatgcagaacacatacagtgggtgggttatgccatgatggaagtcatcggttcgtatctacgggaggggcaaagattggtaaaaaatttgaaaatatgaatcaaataagggattatttatcaagacctgtatggtccgtccacgaatatttaggcataaacactaaagaggaaaaactagagccaccgtctgctgaagctgtaaaaaaattgttgcggttatcaggtcttcccttggaaggagcagatattaaagaaattcaaatgcgacttgccaagcaattatcattcatcaacaaactccataacatacctgtcgaaggtgaaaagcacaccaaggaatatgatgctcggttggtgcaaagaaatacgaaacagctgaactacacaaagctacttgaaggcatcagccaccaaaagcaggatgctgagctaggagaagttagcggatcttggaaagcaactggacttgccgcggaatccaaaaatgcatattttgttgtcaaagagggactactcaaaaacaggaagtaa

SEQ ID NO: 864 - DNA, 552 bp, Saccharomyces cerevisiae
atgtcaaacagtcatcatacatcccagggaagaagaaacaaactttcagtgtgggttaaaaaaataataaacaccactaccacaactaacgcatcggtctcgagcagtaaaccaagacgcggcactagggctggccccacaagagttaagcgtgctgagttggatccggatggaacaaccatcagttcgtcgttgcgaccattggttgatcgaaattcgttgcattcgagcgaatccgatgacgaaggagaccgtcgagtggcatgggatgaaccaccaacaggcaaagtaagacagcagcagcagcaacagcagcaacaacaaaacgacaacgcaagtgttattccgctagtatcgttttgttcctcgtcagtgaagtcgtctactttctcggacattcattcaatacagtctacgaggcccacaatattctctaacaggacgtttgagacgaattctagcgttctggccatcccaccacagagtatattggatcgatcaagaaccctcccgccgtcgaacgcaagtaacactaccacaagaagaccgtga

SEQ ID NO: 865 - DNA, 552 bp, Saccharomyces cerevisiae
atgtcccagtcgaaccctatcttacgtggcctcgctattacaacagccatagcagctctatcagccaccggttatgctatctactttgactatcaaagaagaaatagcccgcaattcaggaaagtgttgagacaaagggccaaagagcaggccaagatggaagaacaagctaaaactcatgctaaggaagtgaagctgcaaaaggttaccgaattcttatccatggaattagccaaggaccccatccctagtgatccctccgaaagagaagctacatttaccaccaacgtagaaaatggtgaaagattatccatgcaacaaggtaaggaactggaagcagcctctaagttttataaagcattgactgtataccctcagccagccgatttattgggaatttaccaaagatccattcctgaagccatttacgaatatattatattaatgattgccatcttgcctcctgctaatgtggcttctttcgttaaaggagttgttggaagcaaggccgaatctgatgcggttgctgaagctaacgatatcgatgactga

SEQ ID NO: 866 - DNA, 554 bp, Saccharomyces cerevisiae
atgtatgcatataatagaggaattggatgactaaatgttcttatattggagttagtggagatgcgtggtagatttgaattaaatagaaagtgctggggttgataaaccacgaaatatcgcagttgaggagaatgataagccaggatagatggtagcgcatttttggggcaatctcactgtaggtccaccacaactcaatatgactacatcgaatcagttataaggcaagtttttagtttactaacaaatatttccatcttattttttttttttgcagggctaagagaacaaagaaggtcggtatcacaggtaaatacggtgtccgttatggttcatcattgagaagacaagttaagaagcttgaaattcaacaacatgccagatatgactgttccttctgtggtaagaagactgttaagagaggtgcagctggtatttggacttgttcctgttgtaagaagaccgttgccggtggtgcttatactgtttctactgcagctgccgctactgttagatctaccatcagaagattaagagaaatggttgaagcttaa

SEQ ID NO: 867 - DNA, 555 bp, Saccharomyces cerevisiae
atgaacaccaatagtaatactatggtaatgaatgacgcaaatcaagcacaaataacggccacatttacgaagaagatattagcgcatttggatgatccggactccaacaaattggcccaattcgtacagctttttaatccaaacaactgcagaataatatttaatgctacccccttcgcgcaagcaacagtttttctgcaaatgtggcaaaaccaggtcgtacaaacacaacatgccctaacaggagtagactatcacgctattccgggatccggcacgttgatatgcaacgtcaattgcaaagtcagattcgacgaaagcggcagagacaagatggggcaagacgcgactgttcccattcaaccaaataacactgggaacagaaatcgacccaacgatatgaacaagccaagacctctatggggtccatattttggcatttccctgcagctgatcatcgacgaccgcatatttagaaatgattttaatggtgtaatatcggggtttaactataacatggtttacaaacccgaggattctctgctaaaaatttag

SEQ ID NO: 868 - DNA, 555 bp, Saccharomyces cerevisiae
atggaagatatcgaaaagataaaaccatacgttaggagtttttcaaaggcgttagacgagctgaaaccagaaatagagaaactaacgtcgaagtcactggatgaacagctgttgctattatctgatgagagggctaaattagaactaattaatcgttacgcgtatgtattgagttctctgatgtttgctaatatgaaagtcctaggcgtcaaagatatgtctcctatactcggcgaactgaaaagagtaaaatcatacatggataaggctaaacaatacgataataggataaccaaatccaacgaaaaatcgcaggcagagcaagaaaaagctaagaatatcatttccaatgttttggacggtaataaaaaccaattcgagccctctataagcaggagcaactttcaagggaagcatacgaaatttgaaaacgatgaactggcagagagtacaacgactaagattattgacagtaccgatcatataaggaaagcaagtagtaagaaaagtaaaagattggataaagttggaaaaaagaaaggagggaagaagtag

SEQ ID NO: 869 - DNA, 555 bp, Saccharomyces cerevisiae
atggaggcagatgatcatgttagcttatttcgcttccccttcaagattcccacctttcgtggtataagaaaaggtggggtctatctttcaggtgctctctatgctctaggcttttggatatttctagacgcagtgctctattctagatattccaatgcatcagatgttcatgttacgttcattgactggattccttttctttgcagcacactgggaacattgattgtgaattctattgaaaagaatagattattgcagggagctttatcgtcagatggtggtgccttcggtagtggtgtaggcgatttagattcaagcatggcatggcaagctcgaaccgttttattttttggctttgctttattagctggtgggctatcaggctccattgtcgtgttgatcatcaaatttttagtcaaggattacaatacctatccaactttggggatgggagtaaacaatgtgttggggaatgtatgcatattattgagttgcgttgttttatggatagcccaaaatgttgaagatgaatattcatattctttgacgctctaa

SEQ ID NO: 870 - DNA, 555 bp, Saccharomyces cerevisiae
atgggagccgtactcagctgttgtagaaaccattccggcgaagagaatgaagctttgctgagggaacagcaggcaggctatggaagtcaaggaaacgcaaatgacgaatacgatgccgaacaaatgcggttgaaggaacacgaacacgaacagaaactgctggccagggaacaagagttaagagacattgttgcaaacaccaacgataaactaatagacatatcgatgataaacaatagtggcattgtaattcaagggacagacctgcaagaagctcttgataaaagacaacaggaagaaggtggagattcccgggaagacgaaaggagtgcaggtgatgacaacctcagtgggcactcagtgccttcaagcggatccgcacaggcaactactcaccaaactgcaccaaggactaatacgtttactctgcttacatcaccggattcagcgaaaatatcaaaggaacagttaaagaagttgcactctaatatactaaatgaaattttcagccagtcccaggtaaacaaaccaggccccttgacggttcccttttaa

SEQ ID NO: 871 - DNA, 555 bp, Saccharomyces cerevisiae
atgtcgtcgcttatttcaaaaaccattaagtatgatccagccaaggataaattaatcacattagcatgtggatgtttttggggtacagaacatatgtataggaagtatttgaatgaccgtatagtggattgtaaagtaggttacgctaatggagaagagtctaaaaaggatagcccctctagtgtctcttataagagagtttgtggtggtgacacagattttgcggaggttttacaagtatcctataatcccaaagtgataactttgagagaattaactgatttcttttttagaatccatgatcctactacatctaattcacaaggacctgataaaggtacacagtatcgcagtggattgttcgctcattcagatgctgatttaaaagaattagccaaaataaaggaagaatggcaaccaaaatggggtaataagattgccacagttattgaaccaatcaagaacttttacgatgctgaagaataccaccagttatatttagataagaatccacagggatatgcatgccctactcattatctgagagaaatgtag

SEQ ID NO: 872 - DNA, 555 bp, Saccharomyces cerevisiae
atgttctcctttgtccaaagattccagaatgtatcgaaccaggccttttcaatgggaattgtaatggttgtattcatcatggcatcctcatactatcaattaatcaataataacgcgttctcagtacctagtaatatcgataacgtcaaaactttaataaatgttagaacaagtagatattttggctcacagagaggcaaggcaaaggaaaatatgaaaattaaatttgatctaaatacagatctcactcccctattcaattggaatacaaagcaagtttttgtctatctaactgctgagtataacagtactgaaaaaataacaagtgaggtaacattttgggataagatcataaaaagcaaggatgatgctgtgattgatgtgaacgatctaagatccaagtattctatctgggatattgaagatggaaaattcgaaggcaaggatttggttttcaagttacactggaatgttcaaccatgggtaggtttgctaacttacggtgaaactgtaggcaactatacactgaccgtggaaaataaaaacaaagtttag

SEQ ID NO: 873 - DNA, 555 bp, Saccharomyces cerevisiae
atgttgaaatacttggttcaacgaagattcacttctacattttacgagctgttcccaaagaccttccccaaaaagctacccatttggactatcgatcaatccagattaaggaaggagtataggcaattacaagcacagcaccatccagacatggcccaacaaggtagtgaacagtcatcaactcttaatcaagcttaccatactctcaaagatccccttagaaggtcacaatatatgctaaaactcttgcgcaatatcgatttgacgcaagaacagacctcaaatgaagtaactaccagtgatccacagttactattgaaagttctagacatccatgatgaattatcccagatggacgacgaagctggtgtgaagctgcttgaaaagcaaaacaaggaaagaattcaagatattgaagcccagttgggacaatgctacaatgacaaggattacgccgccgcagtgaagttgaccgtggagctaaagtactggtacaacttggccaaggcattcaaagactgggctccaggaaaacaattggaaatgaatcactaa

SEQ ID NO: 874 - DNA, 557 bp, Saccharomyces cerevisiae
atgaggtatgttattcattaccaagactatatccgccacggctggatgcaggcatcgctccctgtggcttaagaaaataataggcacaaaactaacaataaaaacatccactactctgtcgcatgttccctgtgctcagatcattcgtaacaaataacgatatacctgttggatatgtaacgccaaaattcccctcattatactggcccatcaacaactcgaagtataatactgcattcttatactatatatctgacatttggaaattttcgctgtactggactttgatctttaatggtgcattttacgttactgctggtgtgtatgctagcttgacccatagaaagaaggctggaagtgtatggatattcgtcatgtacgtcttatacggaggcgttcaaggcttgacgactggtacagttatggggtttttaataggtgcgatctatagatctggtttattttctatgtctacatgggtcccactttgttgcgcagtagtccaaatccttttcgatgtggtgctaagttattccatggttggttccgttatgtga

SEQ ID NO: 875 - DNA, 558 bp, Saccharomyces cerevisiae
atgaaatgtctatatatcttgagtggacatacggatcgtatttattcgacaatctacgatcatgaaagaaaaaggtgcatctctgccagtatggataccactattagaatttgggatttggaaaatataaggaataatggagaatgttcctacgcaacaaattcagcatcgccatgcgccaaaatacttggtgctatgtacactttgcggggtcacagagccctagtcggtttattgggattatccgataaatttttagtcagtgcttctgtagacggttcaataaggtgttgggacgctaacacttactttctgaagcactttttcgatcacacgcagttgaatacaatcaccgcattgcacgtttctgatgaggtattagtgagtggatctgaaggtttgctcaatatttatgatttaaatagtgggctgttagtccgttcagatacattgagtggtgctgataatgtttggaacgttagttttaaggacaacacacttgtggcagcggtagaacgagacaagcgaaatcttttagaaattttggactttagttga

SEQ ID NO: 876 - DNA, 558 bp, Saccharomyces cerevisiae
atgaacatcagtggcaccttaaatacgctccggttgctttataacccatcactgtgtaagcctagtctagttgtccccacttttaacgatcttcctataccaatccacgattctataaaggccgtggtcttggataaggacaactgcatcgccttccctcatgatgacaaaatatggccagattacttgcaacactgggaaaccttaaggtcgaaatactctaacaaagcactcttgattgttagcaataccgccggttccaattctgataaggactattcgcaagcaaaacttttggaagataagacaggtatacctgttttgcggcactctacaaagaaaccaggttgtcacaacgaaatattagattatttttatagaaacaaaaccataacaaatccaaaagaggttgctgttgttggagataggctttttactgacatcttgatggcaaacctaatgggttcatacggggtgtggattcgagatggtgttaaagtttcggcaaatcctctctccaagttcgaaaaaaaattatacaactttttgggattttga

SEQ ID NO: 877 - DNA, 558 bp, Saccharomyces cerevisiae
atgacaacaacctcaacaaccagtgtagatggcagaacctcctcgactttgaaggctactttatctgcttcaggtccaaattcaaatggtccaacgcccgctgtgcttcctcagaagccaaaattaacaggttgggcgcaggcagctgccaaagcccttccaaggcaacagcaacagcaacagcaggcacgaaaagatgattccgtggctgtacaacctgctaatacgaagactaaaaccatcgcatctaccgcgccgcctgctaatataaagggtagttccaccgccaatggatcatccacaaataagaaatttaaaagagcgaataaacaaccttacaatagagaagaagttagatcgtatatgcacaaattatttcagagctataccgctggtgaaaaaagtcattcaatgaaaacttataagcaagtactatcagaaacggcaagtggcagagtttcaacagccactgactggggtactgtatcaagcagtaaaaataagaataaaaaatacggctgtttgtccgatattgctaaagttttaagaaaccaatga

SEQ ID NO: 878 - DNA, 558 bp, Saccharomyces cerevisiae
atgagcaagttttcacttaagttggggagtaagaccttgaaaaaaaatatttccaagaagacgaaaaaaaaaaactcattacagaaggccaacttattcgattgggatgatgcggaaactgcaagcctttcgcataaacctcaaagtaagataaagattcaaagtattgataaattcgatcttgatgaagaatcatcttctaagaagaaattagtgatcaagctgagtgaaaatgcggataccaaaaaaaacgatgctcctctggtggaatatgtcaccgaaaaagaatataatgaggtacctgtcgaggaatttggagatgctttacttcggggtatggggtgggaaagtgactccgagcaagattctaaaggcgacaagacacagagtcgaaacaaggacgtttcaaatgtttcacagatacatcctgatggactgggaattggtgccaagttaaataaggcaataaacgtggaggaggcttcatttatgcccgtcgtaaaaatcgataaaataacgggcactaaagttgatgacgacaaaaaaaataagtcatga

SEQ ID NO: 879 - DNA, 558 bp, Saccharomyces cerevisiae
atgcaggctaaattattgtttaccagactaaactttagacgtccctccacaactttacgccagtttcccctaacatgttttttatttcatagcaaagcattttactcggatctggtcactaaggagccgttgatcacaccgaaaagaataataaataagacgcctgggttaaacttatctatttctgagagggcttccaacagactagctgagatctaccgcaatagtaaggaaaatttaagaattagtgtggaaagtggtggatgtcacggtttccagtacaatctaactctagaacccgctaccaagccagatattaagaatgatgtcaaagacaaggagttttcagacgaccttgacgatgatgattccaaggatataatatacgtgttacccgaagataagggtcgagtgataattgatagtaaatcactaaacattttgaataacactacactgacatacactaatgagttgatcggttcttcgttcaaaatcatcaatggtagcctaaaaagtagttgtggttgtggaagtagttttgatattgaaaattaa

SEQ ID NO: 880 - DNA, 558 bp, Saccharomyces cerevisiae
atggatgcattcagcttaaagaaggataatcgaaaaaaatttcaagataaacagaaattgaaaagaaaacatgccacacccagtgatagaaagtaccggctattgaaccgccaaaaagaagagaaagctaccacagaggagaaagatcaagaccaagaacagcccgccctgaagtcaaacgaggacaggtactatgaggacccggtactcgaggacccgcattctgcagtcgccaatgcagagttgaacaaggtgctaaaagacgtcctcaaaaatcggctccagcagaacgacgacgccacagccgtcaataatgttgctaataaagatactttgaaaatcaaagacctcaagcagatgaatacggatgagctcaatcgttggctcggacggcagaatacaacatcggctataacagcggctgagcccgaatcattagtcgttcccattcacgtacaaggtgatcatgatcgtgcgggcaagaagatcagtgccccttcgaccgatctaccggaagaactagagaccgatcaggatttccttgatggactgctctaa

SEQ ID NO: 881 - DNA, 558 bp, Saccharomyces cerevisiae
atgttcagacaatcaattaggccacttgtttcaaatagactaaccttcattcgttataacagttctccagcctacacggctgcagtcagcctattgaaaggagatttgaaaaaggctatgattgccaaggatgagatgaagaagacagcaatcagaaatatgttatctgccataaaaaacaaagaaattgctttaaaagggaagagcgctgatgagtactccctgtacgacatgtactccaagttaatatctcaaagaaaggactcgatcaatgagttccttgctaacaagagggacgatctggtggccaaagagcaaggtgaaatggacattataaagaaatatatggaccaattgccagtgtcttcagagcttgatattgatcaaaatgtgaagaaattactggacgccctcaaaacaaaggcaggtgaaaaaaaagttcaaattaaggaaatcatgggagaaatcgactggaagtcattgccaacagaatggaagacatctccaactgccatcaaaaatagcattgttaagcaattcaaggaaattttcaaatga

SEQ ID NO: 882 - DNA, 560 bp, Saccharomyces cerevisiae
atgagttcaaggtatgagaaattattagactattctaaagttagagtagcgctttttgttaaacatctaccataacacctcgatattgggagttattgaccacgagtgaacttcgtttactaactatagcgtgtgtatatagatttgcagggggaaacgcttatcaacgtgatactggtagaacacagttattcggaccggctgatggatcaaatagtctcgatgacaatgtatcatcagcgctagggagcacagataaattagactactcccaaagtactttggcatctcttgaatctcaaagtgaggaacagatgggagctatgggtcagagaataaaagcactcaagtcattatcgttgaagatgggtgatgagattagaggcagcaatcaaactattgaccagcttggtgatactttccataacacttctgtaaaactcaaaaggacttttggaaacatgatggagatggccagaagatctgggatcagtataaaaacatggttaataatattttttatggtaggcgtgctatttttttgggtatggattacataa

SEQ ID NO: 883 - DNA, 561 bp, Saccharomyces cerevisiae
atgagtaggatcctagagagcgaaaatgaaacagaaagtgacgaaagctccatcatatccacaaataatggaacggcaatggaaagatccagaaataatcaagaattaagatcatctcctcataccgttcaaaatagattggaactttttagcaggagattgtctcagcttggtttggcgagtgacatttctgtcgaccagcaagttgaagattcctctagtggcacttatgaacaggaagagacaatcaaaacgaatgcacaaacaagcaaacaaaaaagccataaagacgaaaaaaacatacaaaagatacagataaaatttcagcccattggttctattgggcagttaaaaccatctgtttgtaaaatatcaatgtcacagtcttttgcaatggttattttatttcttaagagacggctgaaaatggaccatgtttattgttatataaataattcgtttgcgccaagtccgcagcaaaatattggtgaactttggatgcaattcaagactaatgatgagcttattgtaagttattgtgcatccgtagcgtttggttaa

SEQ ID NO: 884 - DNA, 561 bp, Saccharomyces cerevisiae
atgagtgctaacaatggtgtcactggcaaactctctagtagagtcatgaatatgaagtttatgaaatttggtaagacggatgacgaagagagttccaactccaatacgccgtctaatatcaactcagatgtggaacctatagagcagaaaggtaaactctttggtctggatgactcagcgtgggacctcaatagctacaaagatgatttaaaaaaaatttcaggtaaggagaagaaaaaggtgaaaagagtagtatataagaagcgacccaatctcataatctccaacgttggttacagtgaactgcgaaaacctgagggtgtgataagtgggagaaaaacctttggcgataattctgatgatagtggttccaggaagagaaagtttgatgaaggcgaacaaaatgaagacgagaaaagggatgctaaggataaggaatttacagggagccaagacgatggagaggatgaatatgacctagataaattatttaaggatagcatcaaaaagaaaaagaccaaccataatggtaaaaataaaaatagaaattcaaaaaagtag

SEQ ID NO: 885 - DNA, 561 bp, Saccharomyces cerevisiae
atgccggtcttaaatacgagaacttcttatcccaatatcgactttcatggtactaaggtttctgatgttctagatgcctttgaatttgaaaagcatgatgatcccttaagggataaatggaacactttacagtttttggaaaagagctttgaatctaaatttgaatctgcatcagagttaatccaaggaggcgagctagctgctattaaagaaagaaattttcaattagccaaactaaataatctttgctttcgggtacgagagtccatcaaaagaagacaagacctggagaaaaagttaagaactttatcgcaggacactgacaacgaattgctttttctgatgttggaaaatgagagaagaaagaaaagttcagtgataatagagtttctttctgagataatcagagagaaatccaaaagattaactgcagaagagcaaggctttgtaaatcaaaatgaagtaaaacccctcattctggacctttctgcacggataaatagattgaattctattctagaaacaaaaaatacttgtattagaagattaagtaatcaataa

SEQ ID NO: 886 - DNA, 564 bp, Saccharomyces cerevisiae
atgagtgcgaaacaagggtgggaaaagaaatcaacaaacattgacattgcaagcaggaagggtatgaacgtgaacaatctttcggaacatctacagaacctgatatcaagcgattcagagctgggctcgcgcttgctatcattgctgctggttagcagtggcaacgcggaggagctcattagcatgataaataatggccaggatgtctcgcagtttaagaagctccgcgagccgagaaaggggaaggttgccgcaacaacagcagttgttgtaaaagaagaggaagctcccgtgagcacttctaacgaactggataagattaagcaagagcggagaagaaagaacacagaggcgtcgcagcggttccgcattcgcaagaaacaaaagaattttgagaacatgaataagctgcagaacttaaacacgcaaatcaacaaacttcgcgatcgtatagagcaattgaacaaggaaaatgagttttggaaagcaaagctcaatgacattaacgagattaagtctttgaaattgttgaatgacattaagagacggaacatgggcaggtag

SEQ ID NO: 887 - DNA, 564 bp, Saccharomyces cerevisiae
atgagtgtcagccttgagcaaacgctcggattcagaataaaagttacgaacgtgttggatgtagttactgaaggaagattgtattcgttcaattcatccaacaacactcttactatccaaacaacaaagaagaatcaatctccacaaaacttcaaggtgataaaatgtacattcatcaagcatttggaagtcattggtgataagccctcgtttaactcattcaaaaagcaacaaatcaaaccctcatatgtcaacgtggaaagagttgagaagcttttgaaagaaagtgtaatagcatctaaaaagaaagaactcttaaggggcaagggtgtgagtgcagagggtcagttcattttcgatcaaatcttcaagaccataggagatactaagtgggtggctaaagacatcattattcttgatgacgttaaggtgcaacctccatacaaggtcgaagatatcaaagtgctacatgagggaagtaaccaatccattacattaattcaaagaatagtggaaagaagctgggagcagctagaacaagacgatggtaggaaaggtggatag

SEQ ID NO: 888 - DNA, 564 bp, Saccharomyces cerevisiae
atgataataacaattaaattcgagtcgaaggaaaaattggtctccatgaaacaatatataacagtagttggagtgtccgttaatcaagagggcaccttttcttggcgtcctgggactttttatatgaaaattcatgaagaaagtgcggcgggcccctttgcgaagggggccgaaatatcggatcttagtaatagttctgctattggatgtggtattagcataaatcaagagggaggcgatggttctattagggtaaaagagagcagcttgaggaagaaacaggaaaggatgagtacaaaatatccgacaacgatgagttgccgagaggcatttgatcaactgacgagttgctattcgattggagggcaatttagaagctattacagatatggagattttacatcatgtgacaagcaggtgtccaaattcaagttttgtattatccacggcaatgaccctgtgaaagtgcaggaatggtataaagatcaggtttccaacaataaggcattggaaaataccagtggggttatatggcaggagagggagaccactgcaaataagtga

SEQ ID NO: 889 - DNA, 564 bp, Saccharomyces cerevisiae
atgcaagtctccccagctattgtaaaaggtatcgcagtctcatcattaggtttatacgccggtattttaacttcatctaccgtgatttctattaccaccccaataaatgttctaactcaacatttgaagaatgttttgtgcacattaggatgctggagcaccgttttaggtggtttagctactggtgcctttggactcagctactatctagctgcaccaggagaaagaccaaactaccttttgtgcggacttggtgtcgccccattatctgcagcctacctatacttagtatcactgttcaatcacaagctagccccaaaatgcacacgtgaccaaaatgatttagaaaagcaaaaggatgaaaaattaccccaacatcacccggaagtcaaagatggggaagctgcatgcccattctcaaagatgaacaacgccaaaacattaaaacctgaatccgaaagaagcgtaaaatgtcactcatacatgtcattgcacatgagcattgtaaccggtataacaatttttacctttggtaagtgtatcctagatggattcaaagcatga

SEQ ID NO: 890 - DNA, 564 bp, Saccharomyces cerevisiae
atgctacctttatatcttttaacaaatgcgaagggacaacaaatgcaaatagaattgaaaaacggtgaaattatacaagggatattgaccaacgtagataactggatgaaccttactttatctaatgtaaccgaatatagtgaagaaagcgcaattaattcagaagacaatgctgagagcagtaaagccgtaaaattgaacgaaatttatattagagggacttttatcaagtttatcaaattgcaagataatataattgacaaggtcaagcagcaaattaactccaacaataactctaatagtaacggccctgggcataaaagatactacaacaatagggattcaaacaacaatagaggtaactacaacagaagaaataataataacggcaacagcaaccgccgtccatactctcaaaaccgtcaatacaacaacagcaacagcagtaacattaacaacagtatcaacagtatcaatagcaacaaccaaaatatgaacaatggtttaggtgggtccgtccaacatcattttaacagctcttctccacaaaaggtcgaattttaa

SEQ ID NO: 891 - DNA, 564 bp, Saccharomyces cerevisiae
atgtcccgtcctatcgtaatttctggcccaagtggtacaggtaaatctacactgttgaagaaattgttcgctgaatacccagattctttcgggtttagtgtttcatccactactagaaccccaagagctggcgaagtaaacggtaaggactataactttgtctccgtagatgaattcaaatctatgattaagaacaatgaattcattgaatgggcgcaattctccggtaactactatggtagtactgtcgcttccgtcaaacaagtcagtaaatctggtaagacttgtattttagatattgatatgcagggtgtcaaatctgtcaaggctatcccagagttaaatgccaggtttttgtttattgctccaccatcggtcgaggatttgaaaaaaagattagaaggtagaggtacggagaccgaagaatccatcaacaagaggttaagcgccgctcaagctgaattggcatatgctgagacaggtgcccatgacaaagttattgtcaatgatgatttggacaaggcctacaaggaattgaaggattttatctttgcagaaaaatga

SEQ ID NO: 892 - DNA, 564 bp, Saccharomyces cerevisiae
atgtctatagcaagttatgcccaagagttgaagttggctttacatcaatatccaaacttccctagtgaaggcattctcttcgaagatttcttacccattttcaggaacccaggtcttttccagaagttgatcgatgctttcaaactgcatttagaagaagcttttccagaagttaaaattgattatatcgtcgggttggaatcccgtgggttcttgttcggaccaactttagctttggccctaggtgttggtttcgttccagtcaggaaggcaggtaagctacctggcgaatgttttaaggctacgtacgaaaaggagtacggttctgatctttttgagatacagaaaaacgctattccagcaggttccaacgttatcattgttgatgacattattgccactggtggttctgctgctgcagccggcgaattagttgaacaactcgaagccaaccttttggaatataactttgttatggagttggatttcttgaaaggcaggagtaagttgaatgctccagtgttcactttactgaacgctcaaaaggaagcgttgaaaaaatga

SEQ ID NO: 893 - DNA, 564 bp, Saccharomyces cerevisiae
atgttatataacaaagagcagggaacaagcggcgctagtagctctggtcgtagaacgaaattccacttcgatcgttttgtacaaatggttctgttcattgccgctaatcccaattattgctgttcagtagccagtatcccgaaatctggtgtcacgccagatttaaaaagagcagatattcttgaacagaagatcaaaagcttaaatagtgcgctgagtccaaaattgaaggaagaaagtcgtcttggtgggcctttgcataacccctctattctaccagccccatctttttcatcactaccaatatcatccaatggaaagaaatctttagcaggatatagacctaaaagtaggaagaaacaaactatactccccaacggtcaaccaaaagagtgcgccacttgtggtgacacctggacttctcagtggagaagtggacctaatggaaatgttgagctatgtagtcgatgtggcatagcatataggaaaaaaatggagaaaaaaatacgatcgcaacaatcctccgatgatggtactaaaaattttatatttaaaaataaatag

SEQ ID NO: 894 - DNA, 567 bp, Saccharomyces cerevisiae
atgaaggaactgctttactatacattcattgaaactgaagtgactggtgcatttttggtgtttagggaaaagactcaaaaccttgtttttgcctcgttaggtaatgataagctttttttattgggaaaggtggaaggcttcttgaagaaacatgagaaacaggatacaatgtacgatttacaggaactaaaagaggcagaaacatataagaaatcaatcgaaaattatacaatatgtttagaaaacaaaatgccattaccatcgggcgctattccctttgagttcctgtttggaacagattttcaacgtaaagtttggaatgagcttttaaacgtggaacacggccacgtcgtaacatatggtgatattgcaaagagaatagggaagccaactgccgcaagatctgtcggaagagcttgcggctcaaataacctggcattgttagtaccttgccatagaatcgttggtagcaatagaaaattaaccggatataaatggagctgtaaactgaaagaacagttattaaataatgaaaaggaaaatagcttaagccttagtagattgtag

SEQ ID NO: 895 - DNA, 567 bp, Saccharomyces cerevisiae
atgaatcctcaagtcagtaacatcatcatcatgttggtcatgatgcaactctcccgtcgcattgacatggaggacccaaccatcatcatgtacattagaattttatactgttcttccatcggtatctcttggatcatctaccaaatggccagaaagagaattgttgctaaaaacgacatgactaccatgaagtacgtcgaacctggtaatgctatgtccggcgaaggtgagaagctgcaagttactaccgtcagagactacgatttgaaggaaatagacagtgctatcaagtctatctacactggtatggctatgatgggtttcatgcatttgtacttgaaatacaccaacccattgttcatgcaatccatttctccagtgaaaagcgctttggaacacaacgaagtgaaaattcacctcttcggtaagcctgcaaccggcgatttgaagagaccattcaaggctccatctttgtttggtggtatgggtcaaactggtccaaagaccgacaagaaatctatcgaagaagctgaaagagccggtaacgctggtgttaaggctgaatga

SEQ ID NO: 896 - DNA, 567 bp, Saccharomyces cerevisiae
atgcctttagaatctatatgggccgatgcccctgacgaagaaccaataaagaagcagaaaccaagtcacaagcggagtaataacaataaaaagaataataatagcaggtggagtaatgaatcaagttcaaacaataagaaaaaagattctgtaaacaaagtgaagaataacaaaggtaaccacgaaagtaaaacgaaaaataaaataaaggaaactcttcccagagaaaagaagccgcctcatagtcagggcaaaatatcgcctgtaagtgaatcattggcgataaatcctttctcccaaaaagcaacagagatatctcctccaccagtttcacctagcaagatgaaaactaccaaaacacaatccaaacaggataccgcttctaagatgaagttattaaaaaagaaaattgaagagcagagggaaatattgcaaaagactcatcacaagaatcaacagcaacaagtgttgatggattttctgaacgatgaagggagctccaactgggttgacgatgatgaagaggagcttatccttcaacgtttgaagacctctttgaaaatatga

SEQ ID NO: 897 - DNA, 567 bp, Saccharomyces cerevisiae
atggattacgatagctctgatacaatgaacggtggttcaagtaaccccttaatcactaagatgaatacaatgaaattattatatcaacactatttggataaagtcactcctcacgctaaggagaggtgggctgtattgggtggtttgttatgtttgtttatggttcgtattacaatggccgaaggctggtatgtgatttgttatggtctaggtctatttttattgaatcaatttttagcctttttgaccccaaaattcgatatgtccttacagcaagatgaagaaaacaacgaattggaagctggagaaaaatcagaagaattccgtccattcatcagaagattaccagagttcaaattctggtataacagcattagagccactgtcatttccctcttgttgtcgctattttcaatcttcgatattccagtattttggcccatcttattgatgtatttcatattattgttttttttaactatgagaaggcagattcaacatatgataaaatatagatatatacccttagatatcggtaagaagaaatattctcattcttctaactga

SEQ ID NO: 898 - DNA, 567 bp, Saccharomyces cerevisiae
atggatttacccaaggacaaaagtgacagaactcatcaaagaattaatctaaataacagtgggacagatcgaactaatgatttgtaccttcatattgtccaaacgttcggttgcatagaaacaactgcaacggaaaatgccacgaaactgttaatgctgggtgacgtcgaagtagaaatatctgcgagcagcgtttcaattgagtggacacagaagtcaatgataagccaaacaattgccgatagtatagtaataatgatcatcggtttgtgtgcaagcgacaagaacgtgctatctgaatcagaattgaaagagagaaaccataacgtttggaagatccaagaattgcaaaatctgtttcgagaacaatttggagacagttttagcatcgatgaaggaataggaaaaaaagaaaatgtaaagaatggtagcgtcaccataggcaagagtaaagccacgatcgatttctccaccatgaagctgattgattgtaattcgaacccactaaagggaagagtggagagcatactaagcattggccagaaattaacaactccattgtgctga

SEQ ID NO: 899 - DNA, 567 bp, Saccharomyces cerevisiae
atgggcaaaaccgcggataatcatggtccagtacgttctgagacagcacgtgaaggaagagaaaaccaggtttactcacccgttacaggtgcaagattagttgctggctgcatatgtttaacacccgacaagaagcaagttctcatgattacttcttctgcacacaagaaaagatggattgtccccaaaggtggcgttgagaaagacgagcctaattacgagacgactgcccaacgagaaacttgggaggaagctggttgcataggtaaaattgtcgccaatttgggtacagttgaagacatgagaccccctaaggactggaacaaagacattaagcaattcgagaactctcgaaaagattcagaagtagcaaagcacccgccaagaaccgaatttcatttttatgaattagagattgaaaatctccttgataaatttccggaatgtcacaaaagacatagaaagctatactcttatacagaagctaaacaaaacttgatagacgccaagaggcctgaattgttggaggcccttaataggtctgctatcattaaagacgacaaatag

SEQ ID NO: 900 - DNA, 570 bp, Saccharomyces cerevisiae
atggatgataagaaaacatggagtacagtcactttgagaaccttcaatcagctggtaacgtcttcgttaattggatactcaaaaaagatggatagcatgaatcacaagatggaaggaaatgcgggccacgaccacagtgatatgcatatgggagatggagatgatacctgttcgatgaatatgctattttcgtggtcatacaagaatacgtgtgtcgtctttgaatggtggcatatcaagaccctgcctggactgattttaagttgtttagcaatttttggtctagcctacctctatgagtacttaaagtactgtgtccataagagacaattatcccagagagtattgttaccaaatagatctctgaccaagatcaaccaagccgacaaagtgtccaatagtattctatatggtttgcaagtgggattctcattcatgctcatgcttgtattcatgacttataatggttggttaatgttagctgtcgtgtgtggggcaatatggggtaattacagctggtgtacttcgtatagtcctgagatagatgacagctccctcgcctgccattaa

SEQ ID NO: 901 - DNA, 570 bp, Saccharomyces cerevisiae
atgggtaaagctaagaaaacaagaaagtttggcctcgtaaaaagaactttgaacaccaagaaagaccaaagattgaagaaaaaccaggaaaatatcaaaactaaagaagaccctgagctaaccaggaatataccacaagtatcaagtgcacttttctttcaatacaatcaagctataaagccaccttatcaagtactgatagataccaattttataaatttttctatccagaaaaaagtcgatattgttagaggaatgatggactgtctactcgcaaaatgtaacccgttaatcacagattgtgtgatggcagagttagaaaaattgggccccaagtaccgtatcgccttgaaactggctcgagatcctagaataaagagactaagctgttcgcacaagggtacgtacgcggatgactgtttagtgcatcgagtcttacaacataagtgttacatcgtagctacaaacgatgccggcctgaaacaaagaattagaaaaatccctggaattcctttgatgagcgtaggcggtcacgcatacgtcattgaaaaattgccagatgtcttttaa

SEQ ID NO: 902 - DNA, 570 bp, Saccharomyces cerevisiae
atggtgccgaatttggatttggaaacagctatacagataatctcctcactggagacccagttgagcgagcttgaaggcgccacgaaagaatatgaaaatgatttggaacaagtaatatcaaagttaaaaagcgatcttcttgagagccaacaacaaaataagtgcaataagaaacagataacagatttagagatacaggtagatgagttggaaaatgaaaatatccaactgaggaataagatagagacattacaattggagagtgaccgacgactggaacgcaacgttctactggaacacgagttactcgacaccaaagaggcgctgcaaaagttaagagtcagcaaagaagaagccactagcggtgagactagaaggaacaccaggtcgttacccagtcaaaataaaaaaatgaagttgtttaaggatactatcaaagtctcgaccacatcttcaaccttgtacttgcagaacatggcaaaaactaacaacgctgcaagaagtcactgtaatattccaaatacccaaataacacaatccactgtgatagcaacaacgtcttccgtttaa

SEQ ID NO: 903 - DNA, 570 bp, Saccharomyces cerevisiae
atgtccaattttttacttgtgatccctgaagacgtgatcaagggctgctccaaggcagataaactagttgttacaggagaattcgataactggagacattccgattatgttctgcagtatgacggcagcacacagaactacagggtgcaaattcccagaagaaagggccaacgtagcaccatgttcaaagtggtgataaacgacaaaaaatgggtcactctcaactacttcgacactgtcacagacaagtcaggttacaccaacaatattctccactttaaggacaatgaggccagtcaactcatggatatacctctatcaccacatacacggtccaacaccgcaaaagggaaaccggaagacgactctttaaatgattatgtcaacttgtcgtcacatagtgacctaagcagcacagaggagatagtgtgctggaattctgatatggaggacgaaaacatggatgcaaccatccagtgtgatttccatcaggcgttcaatagcaggaaagagtctctaaatgggctaatgtgcattgccaagaaagtcaagacgtactggaacaaatag

SEQ ID NO: 904 - DNA, 570 bp, Saccharomyces cerevisiae
atgtcttctttatcgctatatactgttcaggctgttttaatactagatcagcaaggagaacgaatttatgcaaagtattatcaacctcctcatagatctgatgaaggacaccaattgctcttcaattcggtgaagaagcaaaaagagtttgagaaacaactataccgtaagactcacaagcaagattcggagattttaatcttcgaggatcatttagtcctttacaaagaatacattgatatcacgatatatttagttgcttcgctggaagagaatgaaattgttcttcagcaaggattttcagcaatcagaggagctttggatttgattttgaactcaggaatggacaaaaaaaacatccaagaaaactatgatatggttttattagctattgatgaaaccattgataatggtgttatcctcgaaactgactctaacactattgcatccagagtttctaaaccacctacgaacgaaccccaaatggcattagatttggataagggtttcttaggcgcgtggggtttcgcaaagagcaagtttcaagaaaggttacagcaaggcttatga

SEQ ID NO: 905 - DNA, 573 bp, Saccharomyces cerevisiae
atgacggttggtacacttcccatctggtcaaaaaccttttcttatgcaattaggtcattatgcttcttgcatataatacatatgtatgcatacgaatttactgagacgaggggagaatcaatgttgccaacactgtcagcgaccaatgattatgtgcatgtcttgaaaaatttccaaaatggtagaggcataaaaatgggtgactgcatagtagcactgaaacctactgaccctaatcataggatttgcaaaagggttacgggtatgcctggtgatctcgtgctcgtggatcccagtacgatagttaattatgtcggcgatgtgcttgttgatgaggagaggtttggtacctatattaaagtccctgaaggtcatgtttgggtaaccggagataatttgtcacattcattagattcaagaacatacaatgcattacccatggggctgatcatgggcaagattgtagctgctaacaattttgacaagcccttctgggacggttcgatacgcaatatttggggtttcaaatggatcaataatacatttctagatgtgcaggctaagagcaactga

SEQ ID NO: 906 - DNA, 573 bp, Saccharomyces cerevisiae
atgagtgaacaggagccttacgaatgggctaaacacctattggacaccaagtatatcgaaaaatacaacattcagaactcaaacacattaccttcaccaccaggatttgaaggtaattcctctaaaggaaatgttacaagaaaacaacaagatgctacatctcaaactacttctttggcacaaaaaaaccaaataacagtattacaagtacagaaggcatggcaaattgcgttacaaccagccaaatctattccgatgaatatttttatgtcgtatatgtccggtacatccttacaaatcattcctataatgactgccctcatgctactctctggacccattaaagcaatattttcaacaaggagtgcattcaaaccagtgttgggtaataaagcaacacaaagtcaagtgcaaactgctatgttcatgtatatcgtattccaaggcgtcttaatgtacattggatacaggaaactaaattcaatgggtctcattcctaacgctaagggtgattggctaccctgggaacgaattgctcattataataatggattacaatggttttccgattga

SEQ ID NO: 907 - DNA, 573 bp, Saccharomyces cerevisiae
atggatccattgactgtatacaaaaactcagtgaaacaacagatcgattccgcagacttactagtggcaaatttggtaaatgagaatttcgtactgtcggagaagctggatacaaaagcaaccgagatcaaacagctgcagaagcagatagactcgctaaacgcacaagtcaaggagctgaagactcagacttcccaacaggcagaaaattcagaagtcataaaggacctttacgagtacctctgtaacgtacgtgtacataaaagctacgaggatgattctgggttgtggttcgacatctcgcagggcacccactcagggggatcttccgatgattattcgataatggactataaactcggatttgtcaagggccaggcccaagtcacagaagtcatatatgcgcccgttcttaaacagcgatccaccgaggaactatactcgctacagtcgaaactaccggaatacctcttcgaaacgttgagtttccccctctcgtcgctaaaccaattctataacaaaatcgctaaaagcctgaataagaaaagagagaaaaaagatgaaaccgagtaa

SEQ ID NO: 908 - DNA, 573 bp, Saccharomyces cerevisiae
atgggagccaagacgtcaaagctttccaaagatgacctgacatgtttgaaacaatccacctattttgatagaagagaaatccagcaatggcataaaggatttttgagggattgccctagtggccaactagctagggaagattttgttaagatatacaaacagttttttccatttggttctcctgaagattttgctaatcacctttttacagtttttgataaagacaacaatggattcatacattttgaagagtttatcacagttttgagtacaacgtccagaggaactttggaggaaaaactgagctgggctttcgaactttatgatttgaaccatgatggatatattacatttgatgaaatgctaaccattgtggcgagtgtttataaaatgatggggtctatggttacacttaatgaggatgaggcaacgcccgaaatgagggtaaagaagatcttcaagttgatggataagaacgaagatggttacattacgctggacgaattcagagaaggttctaaagtcgatccctctattattggtgccttaaacctttacgatggcttaatatga

SEQ ID NO: 909 - DNA, 573 bp, Saccharomyces cerevisiae
atgtccagattaagaagattcaatagaaagatcttaagcttgagttctgactacactcatgacggtgaatctgatcaagaagatgtatccatattaccattagatacagaagagcaggaagaactcatacaaaaatttgagactaatgctcacatcacaaataagctgtacataaacctgttaagcatattgtatttgctatatggcggactgctaatgatactcgtaagaaaatcgcgagggtatattaagttagcacttcttgctggcgctaattctttgatctgttcgtgcatcacacttagatatgatattgtaaacgactatcttttgttcaaaaagtttaagttaagagtgagcaatttttctattaacataataaacattattttactagtacttatggcttggataagtttcaatcatgtggtcgaagataaaaaaacggtgctctgtttgcaagttccaatgtttttattctgggtcgctgtgcttgtgaaaagatgggctcgaaatatcgaagatgaaatcgcagatctaagatgcttgaaatacaaatacaaaaatgcttag

SEQ ID NO: 910 - DNA, 573 bp, Saccharomyces cerevisiae
atgtccggtaaatggagactagtgctgaccgggataggcaatccagagcctcagtacgctggtacccgtcacaatgtagggctatatatgctggagctgctacgaaagcggcttggtctgcaggggagaacttattcccctgtgcctaatacgggcggcaaagtgcattatatagaagacgaacattgtacgatactaagatcggatggccagtacatgaatctaagtggagaacaggtgtgcaaggtctgggcccggtacgccaagtaccaagcccgacacgtagttattcatgacgagttaagtgtggcgtgtggaaaagtgcagctcagagcccccagcaccagtattagaggtcataatgggctgcgaagcctgctaaaatgcagtggaggccgtgtaccctttgccaaattggctattggaatcggcagagaacctgggtcccgttctagagaccctgcgagcgtgtcccggtgggttctgggagctctaactccgcaggaactacaaaccttgcttacacagagtgaacctgctgcctggcgtgctctgactcagtacatttcatag

SEQ ID NO: 911 - DNA, 575 bp, Saccharomyces cerevisiae
atgtcctctcaaaaaagtatgtaaatgaatagctccttcgttgttgccaccgtacagacactttactaacttttaagttactacatgttcgaaacttagtcgatttaactaaactaaatcccgagcagctgaatgctgtaaaacagcaattcgaccaagaattgcagcatttcacacagtccttgcaagcattaaccatggctaagggcaagttcacagaatgtattgatgatattaaaacagtctcccaagcaggaaatgaagggcaaaaactactggttccagcatctgcatcattatacatcccaggtaagattgtagacaataagaaattcatggtcgacattggtacaggatattacgttgaaaagagcgctgaagcagcaatcgcattttaccaaaagaaagtagacaagcttaacaaagaatctgtacagatccaagatattattaaggaaaagacccagtattccttgtccatcgaggcccaaataagacaagccgctattagacagcatgaagcgatgagtaaacaacaacagcagcaacaaaaaaaggagtcgtctacagcctag

SEQ ID NO: 912 - DNA, 576 bp, Saccharomyces cerevisiae
atgaaagtgggtattataatgggttctgtgagggcaaagagggtatgcccagaaattgcagcatacgtaaaacgtacaattgaaaatagcgaagaattaatagaccagaagctgaaaatacaagtagtagatttacaacagattgctcttcccttatatgaagatgatgacgaactgatccctgcgcaaataaagagcgtggatgagtatgcagacagcaaaactcgatcgtggagtcgcatcgtaaatgcattagatattattgtattcgttacacctcaatataattgggggtatccagcagccttaaaaaatgcaattgatcgtctttaccatgaatggcacggaaaacctgccctggtggtaagctacggcggtcatggcggtagtaagtgtaatgaccaacttcaagaggtactacatggtttgaagatgaatgttataggtggagtggcggtgaaaataccggtaggtacgataccgttacccgaggacattgtaccacaactcagcgtgcacaatgaagagatcctgcaattactcgcatcgtgcatcgaaacaacgaggaataaataa

SEQ ID NO: 913 - DNA, 576 bp, Saccharomyces cerevisiae
atgaaatacatccaaactgaacaacaaatcgaagtcccagaaggtgtcactgtcagcatcaagtccagaatcgtcaaggttgttggtccaagaggtactttgaccaagaacttgaagcacattgatgttaccttcaccaaggtcaacaaccaattgatcaaggttgctgttcacaacggtggcagaaagcacgttgctgctttgagaaccgtcaagtctttggttgacaacatgatcactggtgtcaccaagggttacaagtacaagatgagatacgtctacgcgcatttcccaatcaacgtcaacattgttgaaaaggatggtgccaaattcattgaagtcagaaactttttgggtgacaagaagatcagaaacgttccagttagagatggtgttactatcgaattttccaccaacgttaaggacgaaattgtcttgtcaggtaactctgtcgaagacgtttcccaaaacgctgctgacttgcaacaaatctgtcgtgtcagaaacaaggatatccgtaaatttttggacggtatctacgtttctcacaagggttttattactgaagatttataa

SEQ ID NO: 914 - DNA, 576 bp, Saccharomyces cerevisiae
atgaagtacattcaaaccgaacaacaaattgaaatcccagaaggtgttactgtcagcattaagtccagaatcgtcaaggttgtcggtccaagaggtactttgaccaagaacttgaagcatattgatgttaccttcaccaaggtcaacaaccaattgatcaaggttgctgttcacaacggtgacagaaagcacgttgccgctttgagaaccgttaaatctttggttgacaacatgatcactggtgtcaccaagggttacaagtacaagatgagatacgtctacgcgcatttcccaatcaacgtcaacattgttgaaaaggatggtgctaaattcattgaagtcagaaactttttgggtgacaagaagatcagaaacgtcccagttagagatggtgttactatcgaattctctactaacgtaaaggacgaaatcgtcttatctggtaactctgttgaagacgtttcccaaaatgccgctgacttgcaacaaatctgtcgtgttagaaacaaggatatccgtaagtttttggatggtatctacgtttcccacaagggtttcattgtcgaagacatgtaa

SEQ ID NO: 915 - DNA, 576 bp, Saccharomyces cerevisiae
atgcaaacgctaaagtgtgttgttgtcggtgatggtgctgttgggaaaacgtgccttctaatctcctatacaacgaatcaatttccagccgactatgttccaacagtgttcgataactatgcggtgactgtgatgattggtgatgaaccatatacgttaggtttgtttgatacggccggtcaagaagattacgatcgattgagacccttgtcatatccttctactgatgtatttttggtttgtttcagtgttatttccccaccctcttttgaaaacgttaaagaaaaatggttccctgaagtacatcaccattgtccaggtgtaccatgcctggtcgtcggtacgcagattgatctaagggatgacaaggtaatcatcgagaagttgcaaagacaaagattacgtccgattacatcagaacaaggttccaggttagcaagagaactgaaagcagtaaaatatgtcgagtgttcggcactaacacaacgcggtttgaagaatgtattcgatgaagctatcgtggccgccttggagcctcctgttatcaagaaaagtaaaaaatgtgcaattttgtag

SEQ ID NO: 916 - DNA, 576 bp, Saccharomyces cerevisiae
atggaaaaatttggtttaaaagcgctagtaccgctccttaagctagaggacaaagaactttcaagtacatatgaccattccatgaccttaggagcggacttatcgtcgatgctatattcgttgggtattccaagagattcacaagatcacagagtcctcgatacttttcaatcaccgtgggcagaaacatccagaagcgaagtggagccccgatttttcacaccagaatcattcaccaatattccgggcgtattacaatccactgtaactccaccatgcttcaattccatccaaaatgaccaacagcgtgttgccctttttcaagatgaaactctatttttcctcttctataaacaccctggtacagtcatccaggaactaacgtatttggaactcaggaaaaggaactggagataccacaagacgttgaaggcctggctcaccaaagatcctatgatggaacctattgtatccgctgatggtttaagtgaaaggggatcatatgtgttttttgacccacaaaggtgggaaaagtgccaaagagatttcttattgttttataatgctattatgtaa

SEQ ID NO: 917 - DNA, 576 bp, Saccharomyces cerevisiae
atggaggatcaggatgctgcatttatcaaacaggctacagaagcaatagtggatgtatcattaaatatagataacatagatcctataataaaagagttattagaaagggtaaggaataggcaaaacaggttacaaaataaaaaaccagcactcataccggcagaaaatggtgttgatataaatagtcaaggcggtaacataaaggttaaaaaggaaaacgcattaccaaaaccaccgaagtccagcaaaagcaaaccccaagatcgtagaaatagtactggtgaaaaaagatttaaatgtgcgaaatgttcgttggaattttcaagatcatcagatttgagaaggcacgaaaagacacacttcgccatattgcctaacatttgtcctcaatgtggcaaaggttttgcaaggaaagatgcattgaaaagacattatgatacactgacatgtaggagaaacaggactaaattactaactgcgggtggtgagggtatcaatgaattactgaaaaaagtcaagcaatccaacatcgttcatcgtcaagataacaaccacaatggtagcagtaatggctga

SEQ ID NO: 918 - DNA, 576 bp, Saccharomyces cerevisiae
atggcctcctcaagtagcacgctaccgcttcatatgtatattagacccttaatcattgaagatttaaagcagattttgaacttggaaagccaaggtttcccaccaaacgaaagagcttcagaagaaattatcagctttcgtttgatcaattgtccagagctatgttcaggtcttttcatcagagagatcgagggcaaagaagttaaaaaggagacactaattggtcatattatgggtactaagatacctcatgaatacattactatcgaaagcatgggcaaattacaagtggaatcgagtaatcatattggtattcactctgtagtaatcaagccagaataccagaaaaaaaacctggctactttacttttaactgactacattcagaaattgagtaatcaggaaattggtaacaaaattgtccttattgctcacgagccattgataccattttatgaaagagttggtttcaagatcattgctgagaacaccaatgttgctaaggacaaaaacttcgcagaacagaaatggatcgatatggagagagaactaattaaggaagaatacgacaactag

SEQ ID NO: 919 - DNA, 576 bp, Saccharomyces cerevisiae
atggctgtttctaatatatggcaatcgtactcttcctccaatttacattggatttatcctctgtataccaataactgttcacaaaatgtaaagtcatcatttacagcagaaatattattgaaaagaagatgtaatgatattcaagatatacttaatgacaggatgattgaattgttgctacagggcgcgtgtgacccaaataagcagcagaattaccttcaggggatgagtccaagtaggaagaagaaaacccacgttaagaaatttttgaaaaagcaaaaaaaatcaaggaaaccaatcactctggagcatggttgcttgtcaggacccgtgactctacgtttcggaaattttgcaggaatcagagatttgagaggtaccaggtgcccgctccacggcataaaacatggtgtccatccaaaacccggggagaggtgtgcatgtcagcaagctaccctctttccaagtccactagctcggtttagttgtgaccagtctgctgtacttggttgcgctgcctcctccacacgggtctatgacagtatagccgatgagttttcatccctatatttttaa

SEQ ID NO: 920 - DNA, 576 bp, Saccharomyces cerevisiae
atgggactactaagtattatcaggaaacagaagctcagggacaaagaaattcgctgtctgattctaggactagacaattcggggaagtcaacgatagtaaacaaactattgcccaaggatgagcaaaataacgatggtataatgcctactgtgggttttcaaatacatagtctgatgataaaagatgtgacaatatctctatgggacattggggggcaacgcacattaaggccattttgggataactattttgataagacacaagcgatgatatggtgtatagatgtgagcctttcaatgcggtttgacgaaaccttgcaagaactaaaagaattaatcaatagagacgaaaatcgaataggatacgagtgtgctgttatcgttgtgttgaacaagattgatttagtggaggacaagtccgagcttcatcgaaggtgtttactggtagagagcgagttgaagtgtctgttcaagccggacatccgaatagagctcgtcaaatgtagtggcgttaccggagaaggtattgataacctgcgtgaccgtctggtggaatcctgccattttacccaataa

SEQ ID NO: 921 - DNA, 579 bp, Saccharomyces cerevisiae
atgctattgtttcctggcttgaagcctgttcttaatgcttccactgtcattgtaaatcctgtacgagctgtttttccaggattagtactttcaaccaaaagatccttttatagcattaatcgtttaaatgctgaaaataaaataaacgatattgcaaatacgtcaaaagaggcatcctcttcagtgcagatgtttaagcccccagagttctctcaatttaaggactcttatcaaaaagactatgagagaatagcaaaatatactttgattccattaacaatggtacctttttatgcctcctttaccggcggggttataaatcctttactcgatgcgtctttatcgtccatttttttgatatatttacagtatggcttcacaagttgtattattgactatataccgaaggaaaagtatccaagatggcataagctcgccctttattgcctctatggaggatccatgttgtccctgtacggtatctacgaattggaaacgaaaaataatggttttgttgacctggtaaagaaactttggaatgaaaatgatgaccatttgtatatatttggaagaaactga

SEQ ID NO: 922 - DNA, 579 bp, Saccharomyces cerevisiae
atgtctgaaaaggccgttagaaggaaacttgttattattggtgatggtgcttgtggcaagacctctttactatatgtatttacattaggaaaattccctgaacaatatcatccgacagtgttcgagaattatgtcactgattgcagagttgacggaataaaagtgtccttaacgctctgggatacagcgggacaagaggaatatgaacgtttacgtccattctcatattcaaaagcagatataatattaattgggtttgctgtagacaattttgaatcactaattaacgcaaggacgaaatgggcggatgaggcattacgatattgtcctgacgcaccaatcgttcttgtaggcttgaaaaaagatttgaggcaagaagcccattttaaagagaatgctaccgatgaaatggttcccattgaagatgcaaaacaagttgcaagggccattggggccaagaaatacatggaatgtagtgcactgactggtgagggtgtggatgatgtctttgaagtagctacaagaaccagtttgcttatgaagaaggaaccaggggctaactgttgcataattttataa

SEQ ID NO: 923 - DNA, 582 bp, Saccharomyces cerevisiae
atgacagagaaacacaaaactatggggaaatttaaggttattgtattggcaggtactgcaggtacaggaaaatcaaccattgcaggtgaactaatccatgaatttaaagatatatacccggatttgaaattcatcgaaggtgatgatttacacccgcctgccaacgtagaaaagatgacaagagggattccattaaatgacgacgaccgttgggactggttgaaaaaagttgccgtagaatctacaaaagctgcagcaagcactaaggagcatttgtcaattgttgcttgctcgagcttgaagaagaaatacagagatttgattaggcacacatgccctgaatcggagttccattttatctttttgtatgcaagtaaaatagaagttctgaaaaggctcaaaacaaggaagggtcatttcatgaaagctgatatgatggagtctcaattcagggatctggagttaccagacatcaacgacgaaactgactgtgacattgttcccttagatttcaaaacgttttatcaaattgaaaaagatgttatacaggtggtaaaaagtaaagttttgaatattgagtaa

SEQ ID NO: 924 - DNA, 582 bp, Saccharomyces cerevisiae
atgacagctcatgcaaatgaaaggattagcgatgtatcccctagtgctaggggttcaagttcggaatcgaagtatgacaagctctgccgagttcttttctttattgcaattacaaaaagctcattcactccggagcacatattgtataagcattcaatatttactgataagccaattttagctgatatagttacttttatgtatgcggcgtttgtttccattggatggtttctgatatggggggaaagagcatacagaactcaagaaatgggtcaacctccaatgtactcgaatataaactatcaccttttaagttttaagaaaagacaccccaagaaatttacatgtgcgttatggttggtatttttccttgcatatacggttttgacagttttaatttggttagttcagttgatttttcgaaaaggtaatgtttttcaaatgttattgcaacttattatattagatatcgccattgcattggtcaatgtagcaattgcattcacttttgaaatatatctttcacagaaagccgctatcgagattcgcgacgaaggtttaaataatcttgacaccgcttaa

SEQ ID NO: 925 - DNA, 582 bp, Saccharomyces cerevisiae
atggttacccttgaatacaatgcaaacagtaaactgatcactgcgagtgatgctgttgttgcactatctaccgaaactaatatcgatcaaataaatgttctcactacatctttgattggagaaaccaacccaaattttacaccacaaccgaatgaagctctaagcaaaatgatcaagggtttatttgaaagtggtatgaagaatttacaacaaaaaaaattgaatgaggcattgaagaatgtttctttagcaatcgaaatggcacaaagaaaaagagcgccttgggaagcttttgctattcagctaccagagctacactttatgcttcgtagtaaaatagatttatgtttaatactcggaaagcatttagaggcgttgcaagacttggatttcttacttggtacgggacttatccaaccagacgtatttgtcaggaaggcggactgtttgctaaaattgagacagtgggaagaggctagggcaacatgcgagagaggtttagctttagccccagaggatatgaaacttagagcccttttaatagaaactgcaagaaatctggccgaatataacggtgaataa

SEQ ID NO: 926 - DNA, 582 bp, Saccharomyces cerevisiae
atggtttctaccacgcaatcgaggtctttgaaggccatgggagaagagatctggaaaaataaaacagaaaaaattaatacagaattatttacgctaacatatgggtccatagtggcacaattgtgccaagattatgaacgggactttaacaaagtgaatgatcatttgtatagcatgggatataatattgggtgtagacttattgaggatttcttggctagaacggcattgccacgctgtgagaatttagtgaagacaagcgaagtactaagtaagtgtgcattcaaaatatttttaaacatcacacccaacataacgaactggtcgcataacaaggatactttttcattgattttggatgaaaacccattggctgactttgtggagttacccatggacgctatgaaatcgctctggtattccaatatattgtgtggtgttttgaaagggtcacttgaaatggtgcagctggattgtgatgtctggtttgtgtcggatatcttgagaggagactctcagacggagatcaaggttaagttaaatagaattttaaaagacgaaataccgatcggcgaagattag

SEQ ID NO: 927 - DNA, 582 bp, Saccharomyces cerevisiae
atgtccccaactggaaactacttaaacgctattacaaaccgtcgtaccatctacaatttgaagcccgaattaccacaaggtgtcggtttggatgatgtaaagagaactgtacacgttattctcaagaatacgccaacagcttttaactcacaagtgaatcgcgctgtcattatcgttggtgatacacacaaaaggatatgggatgctgttgcgagcgcaatgccaactgctgaagccaagaagagaccagagtcttgcagagatgaggcttacggttcagtcattttcttcactgatgaaggaccaactgaaaaactgcaaagagattttccagccttggcagccgctttcccaacatgcgccgctcatacgaccggtgctgtgcaaattcagtcttggactgccctcgaactattgggattgggggctaatttgcaacactataatgactacgtcaaatctgctttgcctcaagatgttcctattgcgtggactgtacaatctcaattggtctttggtgttccaactgccttgccagaagaaaagacttttatcaataacgtaatcaacgtttatcactga

SEQ ID NO: 928 - DNA, 582 bp, Saccharomyces cerevisiae
atgtctgctgttgcaacttatttgaaaactttaactgctcgtcgtactatttacgctttgaaaccggagttacctggtgaaattactatcaacgacatccaatccgtcgtccaaaccatcattaaagaaacacccaccgctttcaactcccagccaaatcgcgctgttatcttgactggtgaaactcacaaaaaagtttgggacgaagtgactaaggctatagaaagccctgccggtcaaaagaggcctgcttcagcaagggatgaggcctttggttctgtaatcttcttcaccgacgacaaggtaactgaaaagctaaaggctgacttcccagcgtacgcagctgcattccctagtttcgcggaccatacctctggtgccgctcaaatcaactcgtgggttgccttggaggcaatgggcctgggtggtcacctacaacactacaatggttacataaaagctgctttgccaagcaaaatccctgagtcttggaccgtacaagctcaattagtcttcggtaccccagccgcacctccaggtgaaaagacctacatcaaaaacgatgttgaaatcttcaattaa

SEQ ID NO: 929 - DNA, 582 bp, Saccharomyces cerevisiae
atgtgtttagtcaaaactacggctcatttgcttttttattcctttgtgtatgtacagattaagacacaagaaaaaatttgaacaattatgattaattgagaataactgactaacaacttttatgtaccaacttaatctttcagatttggaggaacgacgttttattcctatgtagcttctccaatcgcattcaaagttcttgaaaaagaccaattttctgctttgcaaaataagatcttcccgtattttttccaaatgcaagcggcatcacctgtcatcctggcccttaccgctccaattgccttgacaacaggaccattatcttctttggtggttgcatctgtcagtgggctaaccaatttgttttggttgttgccctggacccataaagttaaagaacaaagaaagaatattgcgaagaaatacacgggtagtgaattggaagcaaaggatgctatattacgtaaagaatttggcaagtcgcacggattgagtcttttgttcaatctttctaatgtttgcgggatgcttgcgtacggtgtttgtttgtcaggtggtttgttaagaaaaattccaaaataa

SEQ ID NO: 930 - DNA, 584 bp, Saccharomyces cerevisiae
atgagtagtttgtgtctacagcgtcttcaggaagaaaggtaagtagtagttttcctccttttatgcttacattctgtaggcatacacaatttcatccagcggtatactaacaaatcgatgaacttaacttgttttacttgaataacagaaaaaaatggagaaaggatcatccatttggattttatgccaaaccagttaagaaagctgatgggtccatggatttacagaaatgggaagctggtatcccaggcaaagaaggtacaaactgggcgggtggtgtgtacccaattacagtcgaatatccaaatgaatatccttcaaaacctccaaaggttaaatttccagccggattttatcatccaaacgtgtatccaagtggcacaatatgtttaagtattttaaatgaagatcaagattggagacccgccatcacgttaaaacaaattgttcttggggttcaggatcttttagactctccaaatccaaattcccctgctcaagagcctgcatggagatcattttcaagaaataaggcggaatatgacaagaaagttttgcttcaagctaaacagtactctaaatag

SEQ ID NO: 931 - DNA, 585 bp, Saccharomyces cerevisiae
atgggttactatgacattgatgatgtcctagcagatgggacagagtttccttgtaaatttcaatatgatattcctggtcttggttatttggaaaacaacccaggacgacccataacgaaaaacactaaactaagcctgccactatggttagcaagaatccttgcaattgtgggtggtgacgaagccttggtagatgaagaacctgtaccttttgtggaactcctgccaccagatatgttttctacgaaagttatgaacgctataaagaccgatccggtggctctggacttgcattccataaattcgcatttcttcagtctagccataaaatggataatgttgtttagcgaaaaagaactggccaatgtcgttagtgagctacttttgcaacgtgcccaagaacttaatcatcatgctagtagtttatcgattgatctcaatgcagactcgaccggaaaaaattcagcgaacactaatatagcaactagcacatttttactgaaactagaagaaatggagaaggagatatataaaaagtctcatgaatcttataaggacacgaaaaggtggatgtttaaaaaataa

SEQ ID NO: 932 - DNA, 585 bp, Saccharomyces cerevisiae
atggtgacttctaatgttgtcctagtgagtggtgagggtgaacgattcaccgtagacaagaaaatcgcggagagatccctgctattgaaaaactatctgaacgatatgcatgacagcaacctacaaaacaactcagattcagaatcagattcagactcggaaacgaaccacaaaagcaaagacaacaataacggtgacgacgacgatgaggatgacgacgagattgtgatgcccgtgcccaatgttcggtcttccgttttgcagaaggttatcgaatgggccgagcaccacagagactctaacttccctgacgaagatgacgacgattccagaaagagtgctcccgtggactcatgggacagagaattcctgaaagtggaccaagagatgctatacgaaattattctggcggcaaactacctcaacatcaagcccttgcttgacgctggctgcaaggtggttgctgaaatgatcaggggaaggtctcccgaggaaattagaagaacgtttaatatcgtcaacgacttcactccagaggaggaggctgccattaggcgtgaaaatgaatgggctgaagaccgttag

SEQ ID NO: 933 - DNA, 585 bp, Saccharomyces cerevisiae
atgtccttacgtatactagcgaagagatcttcttctatctggatgaaaacgcgcgttacaccagcgctaatttctcctattactatcacaacccgtttcaattctacgactacaacagcaccatcacataaggatgatgtaaggccagttgatcctaaaatttctaaaattgtacaggacatttcacaattgactcttttggaaacttccagtttaatcaacgagctgaaaaccgtattgaacattccagaaatttccatgcctatgggcggattcatggcaggcgctgcaggcgcaggtgctggtaatgtacctagctccactggtgaagctggtagtggtgctgaagaagaagctaagcctgaggcaaagaccgtgtttacggtgaagttggactcgttcgacacgaagactaaggctaaagtcatcaaggaagtcaagggattattggggctttcattagttgaagctaagaaattcgttgaagctgcaccaaaggtcttgaaagaaaatgtcgccaaggatgatgctgaaaagattaagaaaaccttggaagacttaggagctaaggtcagtttagaatga

SEQ ID NO: 934 - DNA, 585 bp, Saccharomyces cerevisiae
atgtcgaattttggcagaagaacttgggatagagaggagtatgctgagcaggctagaagcggctatgacgatcgatccttaaaggctacgctaacaccgattgaattacaagctttaaaatccaaatatacaaattacgatcatttaatcaagggctcgctaaaagacctaaataaaaggaaactaacagcaaatacagagagcttatcgtctttcaagaggggaaagaagttcggattttactgcgatatttgtaacctaaccttcaaagacactttacaatacattgatcatctcaaccacaaggtccatgcaataaaatttgaaaatttgtttgatgaaccgttaattatagatataagagataatgatgacgtaccgcaagaggagtttgagttgtgctatcataacttgataaaggattttgtagaggtgcgttctatggagactcagtccaagaggaaaaggcttttggacacagatgtggagaaagcaaagaaagtggctactaagccttctattgagagtgaatcaaaagtcagtcaaatgatgggattttccaattttgccacctctaaaaaatga

SEQ ID NO: 935 - DNA, 586 bp, Saccharomyces cerevisiae
atggaaaacgataagggccaattagtatgttcgagaaatctataagattttttatattttaacggatgaatggaaagtgcatggctgtttaaataaatgtaagaaagatatcataatgcaaacaaaacgtaggcatccgcaatgtatggaaaacatacttatggttaccgataataagcaactccgaaggtgccatagaccagctctgaatgcagcctacaaaagttgagcaatttctgacaaaattcttcgattactttcttcacatgtattaaatcatcactcaccaccaccaacaatgtgttttttaaactagcataactaacaaagatttgttttacatcaggtcgaactttacgttccaagaaaatgttctgctaccaacagaatcatcaaggctgatgaccacgcatctgttcaaatcaacgtcgctaaggttgatgaagaaggacgtgctatcccaggtgagtacgttacctacgctttgtccggttacgttagatccagaggtgaatctgatgattctttgaaccgtttggctcaaaacgatggtttgttaaagaacgtctggtcttactcacgttaa

SEQ ID NO: 936 - DNA, 588 bp, Saccharomyces cerevisiae
atgacaacaattcagccttttgaacctgtcgatttattcaaaactaacaatgtcaaccttgatatcttaacagaaaacttccctttagagttttattttgaatacatgataatatggccagacctttttttcaaaagttcagaaatgactgttgatcctacatttaagcataatatctctggttacatgatggcaaaaacagaaggcaagaccacggagtggcacactcatataactgcagtgacagtagctccaagattccgccgaatatcgctagcttcgaagttatgtaatactttggagaccatgaccgatgtcatgccccatgaagtcaactttatcgatcttttcgtcaagtgcaataaccaattggccatcaaactttacgaaaaattgggatacagtgtctacaggagagtggtgggatattataactcagctgaagatgggtatccagataccctgaaaaaagtagatgacaataaagatgcttttgatatgagaaaagctatggctagggacaggaacagaagcgtacggccggatggaagaagccataaatgctatccacatgatgtaagattttaa

SEQ ID NO: 937 - DNA, 588 bp, Saccharomyces cerevisiae
atgacagatccccacttgaacacgccccaagtgagcacgtcacccacatttgaaagatcacaggacttcctcaacatcgacgaaccgccctgtgcacaggaaacacctagtgtttctacattcaacctcccgggtccaagcgctcccgctcaaagcgtagacaagccagtccccatgattagacggcggtctaccaattatatggacgcactaaattccagggaacaagcccgggaacgcgaaagcagtatcggggagcacgccccgggagccgaacgtaggagtagcggacccatggatttccagaatactatccacaatatgcaatacaggaccactaacgactctgacctgagccacgctggcgtggatatgggtgactccatctcccatacaccgatctgttctcgtgctggcaacagacccattttcaaaaactcgtaccttgacaacaacagcaatggtaacagcgcaagagtcccacacggctctcctccacagttgggcacgcgtagaaagtcgtcttttaagtacgaggactttaagaaggacatctataaccagcttcacatgtttggagagaagtaa

SEQ ID NO: 938 - DNA, 588 bp, Saccharomyces cerevisiae
atgattggcagaggtgtgtgctgcagatcgttccacactgctggatctgcctggaagcaatttggatttcccaaaacacaagtgacaacgatttacaacaagactaagagcgcatctaactataaagggtatttaaagcacagagatgctccaggaatgtactatcaaccatcagaatccatcgcaaccggatctgttaacagtgagaccattccacgtagctttatggcagccagtgaccctcgtagagggcttgacatgcctgttcaaagcactaaagcgaagcagtgtccaaatgttctcgtaggtaagagcacagtgaacggcaaaacctatcatctgggacctcaagaaattgatgagatccggaagttacgtcttgacaatcctcaaaagtatacacgcaaatttttggctgcaaaatatggcatttcgccattatttgtatccatggtctcgaaacctagtgaacaacatgtacaaattatggaaagtagattgcaagaaatccaatcacgctggaaggagaagaggcgtatagccagagaggaccgtaagcgtagaaaactcctgtggtaccaggcgtga

SEQ ID NO: 939 - DNA, 588 bp, Saccharomyces cerevisiae
atggagccattgatatcggcaccgtacctaacaacaacaaaaatgtctgctcctgctacgcttgatgctgcctgtattttttgcaagattattaaaagtatgtcacattactaataaagagcttacactcacaccaatgatggcgatagtctctatgtagtacatatacataaagcagaatactaacaatcgatccgctatgcaacaggcgaaattccatccttcaaattgattgaaacaaagtactcgtatgctttcttggacatccaacctactgctgaaggtcatgctttaatcattcctaagtaccatggtgcgaagttgcatgacatcccggacgaattccttaccgatgctatgccgattgccaagagactggccaaggcaatgaagttggacacttataatgtgttgcagaataatggtaaaattgcgcatcaagaagtcgaccacgtccacttccatttgattcctaagagagatgagaaaagtggtttgattgtagggtggccagcccaagaaacggacttcgataagttgggcaagctacacaaggaattgcttgccaaactagaaggctccgattag

SEQ ID NO: 940 - DNA, 588 bp, Saccharomyces cerevisiae
atggccttcaccacaattcgatcgttaaccattttttccggttcttcgtttgacatgcctacgttcttcgtgcttgcaaaaggtggagatgggtctggggtctttttcattagtctgcactcatctattttatatgcccgttttccgcttttaaatatcttgtcgcaacactctccagtatactgttcgcgaaggtttccgcctgataacgatttaataaccggattgggaaatatacgatgcggtcaattggtgaaaaaggccttacgcagagtatgcaatgtaccgcctgatcatcagctgatcgcttcagtgcgatcgattggatatgctagagtagcattcgtgttttgtacgtgtacgtctgaatgtcgggataatttgcagagtgtgacaagaacttcaggccatcaaacaacaattagtcaaccatgcacagatatacagtcaacacggaagtgctcgaccatttttgtctctgctgttatgcaaacgggaactataactttcttctggacgttccatttccccatccccttacaacgcatagtaaaccaaaagcagccaccgcctcaatcctacgtttaa

SEQ ID NO: 941 - DNA, 588 bp, Saccharomyces cerevisiae
atggtgaccgtggtggcggagacattgacgaaagagtccttcgaggagtatgggacgataatttcgccagatgaagagatttcaaggatgcaaaaccttgaaaaaggtgcaaaccagggaacagcgatcaaattgcttcaagtaagccaggtagagaataaatctaccagtaaagttcccaattggaacctattccgttgctttccacagccgcacctgaatagagtattcactcaaggctccaatcaggcgatttctcattctatcaaagtcctcgaaaagcatccgtgtagtacgcagacgtttgtgcctatggggagaacgtcagcggaagtagcatacttggtagtagtcgctaaagaaattggaaataagccagacttgtctacgttgagggcttttacatgtttgggtaatcaggccgttacctatggcttaggtacctggcatgcgcccatgatagtacttggcaaggaagaacatttggatttttcagtcttaatctacgaaagtctggaccctgacaggcccgagaaggactgtgtggaagaacactacagcgatggcgacgtttgtattatcatctaa

SEQ ID NO: 942 - DNA, 588 bp, Saccharomyces cerevisiae
atgtccgggtcgttaaaatctctagacaagaaaatagctaaaagaaggcaggtgtataagcccgtgctagacaatccgttcacaaacgaagcacatatgtggccgcgcgtgcatgatcagccattgatttggcagctgctgcaatcctctatcataaataagttgattcacattcaatcgaaggagaactacccttgggagctgtatacagatttcaatgaaattgtgcagtatttgagcggcgctcacggaaacagcgacccagtatgtctatttgtgtgcaataaggaccctgatgtaccgcttgtgctcttgcagcaaatcccgctattatgctatatggcgcccatgacggttaaactggtgcagttgcccaagagtgccatggataccttcaagtcggtttctaaatatggaatgctgctgctgcggtgcgacgatagggtcgacaagaaattcgtatcgcagatccagaagaacgttgatctgcttcagtttccctggttaaatgctatcaagtatcggcccacatctgtcaagctgttgaaaactacagtgccaattgtctcgaagaagaggcaaaagtag

SEQ ID NO: 943 - DNA, 590 bp, Saccharomyces cerevisiae
atgtcttggcaaggtatgtgaacgagacaattatcaattgattaagaaagaaatgagtcggaggttagcttgtgtgacaatgtttggcaatgcccgatttttgttgatgcgcgtaatttcgaagattaaccactcagagtaaattactaactggaatatcaaaaaacatatgaaatttcaaacatgaatttctttccgtttttttctcctacttttaaacagcatacactgataacttaataggaaccggtaaagtcgacaaagctgtcatctactcgagagcaggtgacgctgtttgggctacttctggtggcctatctttgcaaccaaacgaaattggtgaaattgttcaaggcttcgacaatccagctggtttgcaaagcaatggtttgcatattcaaggccaaaagttcatgttgttgagagctgacgatagaagtatctacggtagacatgatgctgagggtgttgtttgtgtaagaactaagcaaaccgttattattgctcattatccaccaaccgtacaagccggtgaggccaccaagattgtcgagcaattggctgactacttgattggtgttcaatactaa

SEQ ID NO: 944 - DNA, 591 bp, Saccharomyces cerevisiae
atgaaacagatagtcaaaagaagccatgccatcagaatagttgcagcattaggaatcataggcctgtggatgtttttctcgtctaatgaactatccatcgctacgccgggcctaatcaaggcgaagtctggtatagatgaagtgcaaggggcggctgctgagaagaacgacgctcggttgaaagagatcgagaagcaaaccattatgccattgatgggcgatgacaaggtgaagaaggaagtgggcagggcgtcgtggaagtacttccataccctgctggcccgttttccggacgagcctactcctgaagaaagagagaaactgcacacgtttattgggttgtatgcagaactctatccatgcggggaatgttcatatcactttgtaaagttgattgagaagtatcccgtacagacatctagcaggacggctgccgcaatgtggggatgccacattcacaacaaggtgaacgaatacctaaagaaagacatatatgactgtgctaccatcctggaggactacgattgtggatgtagtgacagcgacggtaaacgcgtgtctctcgagaaggaggctaaacagcacggttga

SEQ ID NO: 945 - DNA, 591 bp, Saccharomyces cerevisiae
atgaaagcaaccattcaaagagtaacatctgtatttggagttccccgagcatctgtattcgtgccaagaatcagcacaccatttattttgcataattatatctctaatggcagaatggaccttttttccaaagaattccacaatggccgcgtatccaaatctgatctttggtcaagcaacaaggaagaggagctcttagtatctcaaaggaaaaaaagaccgatctctcctcatttaactgtttacgaacctgaaatgagctggtatctttcctctttacatcgtatatctggcgttttactggctcttggattctatgctttcacaattactttgggtgtgacgacaataatgggaatggatacgacttttcaggatctaaacaagtggtatcacgaaaagatgcctaagtggtcccaatgggtggccaaaggctctgcagcatatctgtttgcattccattttggtaacggtataaggcatctcatctgggatatgggctacgaattgaccaaccgtggggttataaaaaccggatcaatcgttttagccggcacactcgtcttaggaacgtatttactggctcagtaa

SEQ ID NO: 946 - DNA, 591 bp, Saccharomyces cerevisiae
atgaatgttacagttactgtttatgataaaaatgtcaagtacagattagaagagaatatcaaaaataacaagggtcccagcaacgatgatcaaccagcatacaataatgaatcaaagagcacggacggaagtgattatgcaatgtttcccactaacattaagtacatatttgaggacaacaatgatgaactagtagattcaagtgatgctgctttgacagcaggaatagataaggtcggagatgaacttgaaaatgtcataattgtccaattggatgaatcgggatctcttgaggatatcacactaatcagcgaccaatatgagcttttgtcacataggacaaatagtctcagcttggaggaaaaccaaatgagaacattatcatcacatggtgatgataaatctaatgatgaagaggaagaacttagcgttgacagtgatagattcagagtggactcggacattgagctcgatgtaatttcacaattttgcgatctgtctccttttcttcgcgatttgagtttgaatgacttaattaaactctacgtcacacaaaatgaacaattacaaatgctctccaattccgtatga

SEQ ID NO: 947 - DNA, 591 bp, Saccharomyces cerevisiae
atgagcaaaatacaggtggcacatagcagccgactagccaaccttattgattataagctgagggttctcactcaagatggccgcgtttacatcgggcaattgatggcatttgataaacatatgaatttagtgttgaatgagtgtatagaagagagggtacccaaaactcaactagataaattaagaccgagaaaagattcaaaagatggaaccactttgaacatcaaggtagaaaaaagagtgttgggactgactatactaagaggagaacagatcttatccacagtggtggaggataagccgctactatccaagaaggaaagactagtgagagataaaaaggaaaagaaacaagcgcaaaagcagacgaaactaagaaaagagaaagagaaaaagccgggaaagatcgctaaacctaacacggccaatgcgaagcatactagtagcaattctagggagattgcccaaccatcgtcgagcagatacaatggtggcaacgataatatcggcgcaaataggtcgaggtttaataatgaagcgccccctcaaacaaggaagtttcagcccccaccaggttttaaaagaaaataa

SEQ ID NO: 948 - DNA, 591 bp, Saccharomyces cerevisiae
atgagtagggccaaagaattacaagagaagctcaacttgcaagcgaaactccagtctactttcagtaacaatactgctgcagttttggactggctgaaagaatcagatgaaaccggcattagcaatgatacagagcgtaacaaacagttaaaagatcacaaggagttggaggatggtaagaaggcatttttcaagcttcccgttttgcagattggatcgggcctacacttccgcacacaagatgacgcttccgccaaagaagatatacatacgattggtgagtttattgagggtgataaaaaggtaagttcgttggcaaagaaaaagaaaagaagtgacccagggttgcaacgaaataatatgtacaggatcactaaagatgatacgaaagccatgattgcgcttaaaagaaaaatgaggaaaggcgagaaggaaggactaaggaagaaacaagagcatagcaaaagcagcgtttcgaactcatatagtgccagtgatgaagaggatgaagatgcagggacaatgccgcaaaagtccacaaaaaaaaaatttggtttactttttgataaaaaaaagaaggcacgtaaataa

SEQ ID NO: 949 - DNA, 591 bp, Saccharomyces cerevisiae
atgcagataataaccactacgttcattcaaaaagtaattttaggatcacaccaattacatgagcaattatctatagtggaagcccgaatgattgaatctgccatagtttcaatgctcacagaatcattttgcgaaaatgagcagacattaaaatacttagcacggctactttcaccgatgtcttatatggatgttattaatgcaagaaggggaaagaaaatatgtgggtacccgctatgctataagagtgcggcagaaaattcatctgatggcttctttatccactcaatgtattgtaataattatcacagtaaatgttcgttgtatttaatgagacagttatcacaaacgcctctgcatgaaaggcgaggcgtgcatttaactagttacattaatctagagtttgatgatatgtactcggtaagccttttagaagaattagttggaagtgaggtacctatagataccgtcaaatcgctgataacgagtttcaaggatcttgagtttgatgatacctacaagaatgagcctttaccattggatgtgtactttggacagttgactactgatgaggaaacctgtatagaatag

SEQ ID NO: 950 - DNA, 591 bp, Saccharomyces cerevisiae
atgccaccaaaaggttggagaaaagacgcccaagggaattaccccactacttcgtatattaaagaacaagagaacattacgattcaggacctgttatttcctaaaagcactattgtgaatttggcacgcgaagtgccacagcaaagcggcaaaaagctgctgataaataaagacgcatcactagcgttacagcgtggtgctacagtatttgttaaccacttgctcctgtttgcaagggaaattgcaaagagtcaagataaaaaaagctgcagtgtagatgatgttctgagtgctttggaccatataggacactcggcattgaagggtccggttagagataaactagatgaataccaagctgctgttgaacagaggaagaaggaaaaactagatagtggtgaagtagatgctgatggcgatatagatatgggtgaagataaggagaatgtgcccgtggaaaaggttaaagagcatgacgaaatagaagaacaaggcgatgcattacaggacgtagaagagtcctccgaaaagaaacagaaaacggagagccaagatgtagaaactagagttcaaaaccttgagcaaacgtaa

SEQ ID NO: 951 - DNA, 591 bp, Saccharomyces cerevisiae
atgggcgtattagaaaatatagtacctggtgagctttatgatgcgaactatgatccagatcttttgaaaattagaaaagagactaaaataaaattgcacgaatacaacacccttagccccgctgatgagaataaaaagagccaggtaataagagaattacttggtagttgcactgataactttataattgaaccgccgttttactgtgattacggaagtaacatctatatcggagacaacttttacgccaatcacaatcttgttatattggatggggccaaggtagtcatcggtgacaacgtatttatcgcccctaatgttggtatttatacggcaggtcatccaattgacgtggaaagacggcttcaaggattagaatatgccatgcctgtgaccattggagacaatgtatggattggaggtggagtgtcaataattcctggagtaaatataggtaaaaactccgtgattgccgccggtagtgttgtgattcgtgacataccagaaaatgtagtggcagcaggtaatccttgtaaggtgataagaaagatcactgaaaaagatagtacaactacaaactatcgaaaatga

SEQ ID NO: 952 - DNA, 591 bp, Saccharomyces cerevisiae
atggtagcagaagttcaaaaacaagccccaccatttaagaaaaccgccgtagtcgacggtatcttcgaggaaatttcactggaaaagtataaaggtaagtacgttgttctagcttttgtcccattggctttttcatttgtctgtccaactgagattgttgcgttttccgatgccgccaagaaattcgaagatcagggcgcccaagttttatttgcctccaccgactctgaatattccttactggcatggaccaaccttcccagaaaagacggtggattaggtccagttaaagttcctttgcttgctgataagaatcattccttatccagagactatggcgttttgattgaaaaagaaggtatagctttaagaggtttgttcataatcgacccgaagggaatcattagacatatcactatcaatgatttatctgttggcagaaacgtcaatgaagctttgagattagtcgaaggtttccagtggactgacaaaaatggtacagttttgccatgcaactggaccccaggagccgccaccatcaaacctgacgttaaagattccaaggagtatttcaaaaatgccaataattaa

SEQ ID NO: 953 - DNA, 591 bp, Saccharomyces cerevisiae
atggtcgctcaagttcaaaagcaagctccaacttttaagaaaactgccgtcgtcgacggtgtctttgacgaagtctccttggacaaatacaagggtaagtacgttgtcctagcctttattccattggccttcactttcgtctgtccaaccgaaatcattgctttctcagaagctgctaagaaattcgaagaacaaggcgctcaagttcttttcgcctccactgactccgaatactcccttttggcatggaccaatatcccaagaaaggaaggtggtttgggcccaatcaacattccattgttggctgacaccaaccactctttgtccagagactatggtgtcttgatcgaagaagaaggtgtcgccttgagaggtttgttcatcatcgacccaaagggtgtcattagacacatcaccattaacgatttgccagtcggtagaaacgttgacgaagccttgagattggttgaagccttccaatggaccgacaagaacggtactgtcttgccatgtaactggactccaggtgctgctaccatcaagccaaccgttgaagactccaaggaatacttcgaagctgccaacaaataa

SEQ ID NO: 954 - DNA, 591 bp, Saccharomyces cerevisiae
atggttgataataggcgtacgtttacggcaccccaaagcttacttgaaacaaatcttacttttccgaatgatgaaccgtcacttactacaatcacagttacgcgagaaagatgtgttgatccaagcttgatagattcatttttgaggtttctaaggcatggaagtgatgatataataagacaaaaattaaacaactataggaaaggctctattaatggaaaaaataagtgtaaggaatttttgaagcaagaactatatccgaactggcaaatacggaataatataatttcattttgcgaaaaagaggcagcagagatgaagaacgagaccgatcagcagtgcggtaataataaaaagactactgcggaaccacttatagacgcaagaattgatccttacgctgcaagagaaagagcggagaaacaggaagctcaatataaggattggacgaaggtgacagagtgggtggcaaataatagaaaaatagaacaaattttaacttctacaacagagggcattttaaggcaaaactgcgagcaaaataatgactacttgaaggagtttacgcaattctgcaaggacaacagttga

SEQ ID NO: 955 - DNA, 591 bp, Saccharomyces cerevisiae
atgtcacaatcaatatcactaaagggttcaacaaggacagttacagaatttttcgagtacagcattaattccattttgtaccaaagaggcgtatacccagcagaagatttcgtaacggtgaaaaagtacgatcttacgttactaaagacacatgatgatgaactgaaagattacattcggaaaattcttctacaagttcacaggtggcttcttggtggaaaatgcaatcaattagtattatgtattgtagacaaggatgagggagaggtggtggaaagatggtccttcaatgtgcaacacatttctggcaatagcaacgggcaggatgatgttgtagatttaaatacaacacaatcacaaatcagagctttaatcaggcaaatcacctcaagcgttacctttctgcccgaactaacaaaagaaggtgggtacacattcacagtacttgcatatacagacgcggatgctaaagttccgttagaatgggccgactccaatagtaaagagatacctgatggtgaagtagttcaattcaaaacattctctaccaacgatcataaagttggtgcgcaggtcagctataaatattaa

SEQ ID NO: 956 - DNA, 594 bp, Saccharomyces cerevisiae
atgaaatacatacccccattaaatttttcgccagtggtgagcacggatgtatcgttatatcgatcgggatacccgatgccgttaaattatagtttcatcaagcatcagttacacttgaagaccataatatatattggcgataaagataggcctctcgaagaatatcaaagcttcctggagtcagaaaagataaaatactatcacatatttatggattcaagccgcgatgaaggaattcaagaaagaatgaaccaggtcttgcacttggtgctggatgtcagaaactatcccatcttagtgcattccaataagggcaagcaccgtgttggtgtagttgtgggaatcataagaaagttgttacagggatggtccactgcaggtatatgccaagagtacgggttattttctggtgggatgaaagatggagtagatttggagtttatcacaatgttcgaaaccaatctgaaaataccgagaaacgttatccctggctttgctaaacactgcttgtatttgaatgagctagaggctgcggaaggaagtgatgatgagtcaggaagtgagtctattctcactgccaagcaaccaatatga

SEQ ID NO: 957 - DNA, 594 bp, Saccharomyces cerevisiae
atgaagttattgcatttatatgaagcgagcttgaagagaaggcccaaaactacgaatgcgataatgacaggtgcgctatttggaattggtgatgtttctgctcaattgttgtttccaacatccaaagtaaacaagggttatgattataaaaggacagctagggctgtcatctatggttctttaattttctcctttataggtgacaagtggtacaagatcttgaacaacaagatttatatgcgtaacagacctcagtaccactggtctaatatggttttacgggtagctgtcgatcaattggcgtttgcgccgctaggtttgccattttatttcacctgtatgtccatcatggaaggtagatcatttgacgtagctaagttgaaaataaaagagcaatggtggcctacacttttgactaattgggcagtttggccacttttccaagcgattaacttttctgttgttcctttacaacataggttactagctgttaatgtcgttgcaatattttggaacacttacttatcttataaaaactcaaaggttatggagaaagacaaggtacctgttcattatccacccgtggtcgaataa

SEQ ID NO: 958 - DNA, 594 bp, Saccharomyces cerevisiae
atgagcaacaacgaaattgtatttgtcactggcaatgccaacaagttaaaggaagtgcagtcgattttgactcaagaggtcgacaacaacaacaaaaccatccacttaatcaatgaggccttagacctggaagaattgcaggacacggatctgaatgccattgcgttagctaagggaaagcaagctgttgcggccttgggtaagggtaagccagtgtttgtggaagacactgcgttgagatttgacgaatttaacggtctaccaggtgcttatataaaatggtttttaaagagcatgggattggaaaaaattgtgaaaatgttggaaccctttgaaaataaaaacgctgaagcagttaccaccatttgttttgctgattctcggggtgaatatcacttctttcaaggtattacaagaggcaagatcgttccaagccggggacccactacattcggctgggattcaatttttgaaccttttgatagtcatggactgacttacgcagagatgagcaaagacgcaaagaatgctatttctcatcgtggtaaagccttcgctcagtttaaagagtacttgtatcaaaatgacttttag

SEQ ID NO: 959 - DNA, 594 bp, Saccharomyces cerevisiae
atgatgcattttagaaagaaatccagtatcagtaacacgagtgatcatgacggagcgaaccgtgcctcagatgtcaagatttctgaagatgacaaggcaagattgaagatgcgtactgcttccgttgctgatcctattctagacgctgtgcaggaagcccaaccttttgaacaagctgctgataccttccacgacaacatgaacagacaatcttatttttccaacgaagaaggtcatgttctgtgtgatgttttcggtcaacccatcacacaggcagatatatcgaatccaactagggcaagagacgaaagacctttggacactataagaagtttcgagtatgctgtctccggagacccggtctgggcccaacagttggagactccaacttacgggttccgcgtaagacctgatttccctgtgtttggtgctgctgtgacttacgatgcgaacggtatgccacagcaagtgggtggtgcttccagtcaaatgtatggtgaacaagcagtgtatcagccacaacaacacgtacagactgaggaaaagcaaaagaagaagaagaagggattgtttggtagaatgaagaagaaataa

SEQ ID NO: 960 - DNA, 594 bp, Saccharomyces cerevisiae
atgatgttaagactagtaactaaagggttgccgaaagtgacaccttctgcagctaaggctgtgctagtgcgtggttccttgctgcactcattctctaccagcgctagattcaataatagtgtcgctgaagatgaggccaagatcgttttgaaagacaagaacaggccattgagaattgacagagaattgcctgacccaaccacggagaggagaaagcgaatagctggatttttgttgttttctgtggccattgggtccgcactatctttgatcttcaactatgaaaagacggagtcccccattatctccaacacgctgtattatataagacggtctccagcaactaaaaacatactgggtgagagcatagaatttgatggtatcatcccttgggtctacggtgaactgaactctgtgaagggtaggattaacattacgttttatatcaagggggacaaaaacgttactggaaccgttagactggttgccgataggaacactcacgacgaagagtttttgattcatgaatggagcgtcactgccgctggccaaaagatcgatttgctagctgaaaataccaagacaccaatttaa

SEQ ID NO: 961 - DNA, 594 bp, Saccharomyces cerevisiae
atggaactccgtagtttttctagacagcctgatggcatacttgctaacccaagattgggaagggaggaagtattggaaggtgaacatccgcaagatgctagattagcccgacaaagcatttggttgagcccaagtttaattgcggagtatatacagctttttttcaattttattataggaactataggactgtctcttgctattaaattcattttgatgataagaaacgatgttaacttaaaactggagcataacgtgagggaagaattagataaaattgcaacttgcaaatcaaggtattttgaaaaccagtgcgaacctcatatgagggttccagcattggaggtacgttgcaatgaatggtcaaaatgtatgaacaaggaaatagtgtctggctccgattaccaatgggctaaagcatgggctcgtactctggcggaggtaataaatgctttttttgaagcgttcagtatacgatctttccttttcattttaattagcataataggtataatatttgttaccaatacgagtttcggatcatacagggtttatctcaataataaagatacaaaatcggttcgccatgcatag

SEQ ID NO: 962 - DNA, 594 bp, Saccharomyces cerevisiae
atggaagcaagacggtatggaccgaatatcattgttacaggaacaccaggatgtggcaagtcgtctacgtgtgagtttttaaaaaataaactgaaggattacaaatactataacatttcggatttcgccaaagataacgactgtttcgaaggatatgatgagggccgtaaatcgcacattgtcgatgaagacaaactgctggacatgctagagcctcttttgagacagggaaatagtattgtcgattggcatgtcaatgatgtgttcccagagaggctgattgacttggtggtggtgttgagatgcgataactctaacttgtattcaagattgcatgcaagaggctatcatgactctaagatcgaggaaaacctcgatgccgagattatgggtgtcgtcaaacaggatgccgtggaatcatacgaaccgcacattgtggtagagctacaaagcgatacgaaagaagatatggtatctaacgtatcccgtattgttgcttgggaaaagatgtggttagaacaacatccagatggagtcacaaatgaatatcaagggcctcgtagcgatgacgaagacgatgaagacagtgagtag

SEQ ID NO: 963 - DNA, 594 bp, Saccharomyces cerevisiae
atgtctgtttgtttagccatcacaaaaggtatcgcagtttcttctataggcctctactctggtcttttggcttccgcttcattgattacatctactactccactagaggttttaacaggatcccttactcccactttaaccactttgaaaaatgcggccaccgccttgggagcgtttgcgtcaactttcttttgtgtgagctttttcggcgctcctccctcattgagacacccctacttactctatggtatgcttgtagctccattatcttcatttgttctaggatgtgcctccaactatcagtctagaaagtacagtaaagtctctaaggaatcttctttatttcccgaagacagcaaactcgctgcttccgaactgagcgattctattattgatttaggtgaagacaaccatgcttcagaaaatacacctcgagacgggaagcctgcagcaaccacagtatcaaagccggcagaggcattgcacaccggtcccccaatccatactaaaaatctaattgcagcaactgctattgctattgttggctttgtacaagccgttattggcgtttatggggaaggacaatttatctag

SEQ ID NO: 964 - DNA, 594 bp, Saccharomyces cerevisiae
atgtttaccagtgccattagattgtcatcgcaaagactgttcgctagtcaaccttctgtcaccgctgcggcattgcgctcgactgctacaaccttacccttaagatcatattctcagcccgcatcccttcaagactccagtatcttgacatggtctgattttttcaaattgaggaaacagcagcgtagaatcaatgttggttcttcgctgtttactgctcttttgggctgtaacgtttcatgggcttacctttccacaatggaaatagacccgactcaaatgctattcggattcgacccattaactgtaatttcagctgggataatagcctctggtgcactaggctacttgttgggtccgatagttggttcgcaagttttcaaactttcccataaccaacaattggcacagttcaacaacaaaaataaagagtttctaaaacatatcatcaataacagggtcgatgcctcttctcaaagtttcagtaatcctgttccagattattacggtgaaaagataggttccttaaaggaatataagcaatggttaagagattgtcacgcttacgcaaagaaagccaaagaatttttgtga

SEQ ID NO: 965 - DNA, 597 bp, Saccharomyces cerevisiae
atgacaggttactttttaccaccacaaacaagttcttacacgttcaggtttgctaaggtcgatgactctgcaattctatcagtcggtggtaacgttgcgttcgaatgttgtgcacaagaacaacctccaattacatcgacggattttacaatcaatggtattaagccatggcaaggaagtttgcctgataacatcggagggactgtctacatgtatgcaggctactattatccgctgaaggttgtttactccaatgccgtttcctggggcacgcttccaattagcgtggaattgcctgatggtactactgttagtgatgactttgaagggtacgtttactcttttgacgatgatttaagtcagtcaaattgtactatccctgatccttcaaaacatactactagcatcgtcacaactactaccgaactgtggactggtacttttacttctacatctactgaaatgaccaccgtcaccggtactaatggtcaaccaactgacgaaaccgttattgttgccaaagctccaaccactgccacctcatccagtttgtcatcatcttcttcagaacaaatcaccagctctatcacgtcttag

SEQ ID NO: 966 - DNA, 597 bp, Saccharomyces cerevisiae
atgaataaagaccaggcagaaaaatatcaagaacggagtctgcgacaaaaatacaacctactacatgtactgccaacactgaattccagagcgttatcgggactatactataaaaattttcataattctgtgaagcgatatcaaatcatgctgccagaacaactgaaaagtgggaaattttgctcccattgcgggtgtgtttacgttcctaattttaacgcaagtcttcagttaacgactaataccgagcaaggtgactccgacgaacttggcggcgagagtatggaaggaccaaaaaaatgtatccaggttaattgcttgaattgtgaaaagtctaaattgtttgagtggaaatctgagttcgttgttccaacatttggacaagatgttagtccgatgatcaatagtaccagcagcgggaaggtttcgtacgcggtaaagaagccccaaaagagtaaaactagtactggtaaggagagatccaagaagagaaagttgaactcacttacaaaccttttatcgaaaagaaatcaagagaaaaaaatggaaaagaagaaaagttcgtcactgtcattagaaagttttatgaaaagttga

SEQ ID NO: 967 - DNA, 597 bp, Saccharomyces cerevisiae
atgactttggcttttaatatgcaacggttggtgtttcgtaatttgaatgttgggaagcgcatgttcaagaacgtccccttatggaggtttaatgtcgccaataaattaggaaagcccttaactcgctctgtagggttaggcggtgctggcatagttgctggtggcttttacttgatgaatcgccagccttctaagttgatattcaatgattctttaggggcagctgtcaaacaacagggtcccttggaaccaactgtgggcaacagtacggcaattaccgaggaaaggaggaacaaaataagtagtcacaagcagatgtttttgggatcattattcggtgttgttttaggagttacggtggctaagatatcaattttgtttatgtatgtcggtattacaagcatgcttctttgtgaatggttacggtacaagggatggattcgcattaatttgaaaaatatcaaatctgtaattgttttgaaagatgtagacttgaagaaactgcttattgatgggttattgggtacagaatacatgggttttaaagtattctttacattgagtttcgtattagcaagtttaaatgctaacaaatga

SEQ ID NO: 968 - DNA, 597 bp, Saccharomyces cerevisiae
atgcaacaagatatcgtcaacgatcaccaggaggaggcccaagggtggaagtgggaacaaatcaaagagataattgaatcgggggagcttgcccgtttgaaacgaagtcgccagatgactgacaaataccacgagcataagaaaaggactgctggcctggacatgaaccagtacgttttgcaaaaactaggctggtcgctagacgaaccgcagctcgaaaatgctgccgcgaaggcttttagttcttctactctatatgctgtgcgtgccaacgatttcccgtataacttcgagcctggtgttgtacaccttgttctctggtccaaggttgccctgccagtacattccccagataaggccgtgcgcgaagcggcccgcgctcgcatgaatgcatttttgcaggcacagccgctactgcgtccacttctaagctcgggtcacgtggcctggtttgtcaactacccggaactacaaagtgttgcccggattttccacgctcacgtgctgcttttcttcccacgggaacgctattccgcggaacaggtaaaaacgaccgttgatgatatcctttcacacggtttcgagccacttgcctga

SEQ ID NO: 969 - DNA, 597 bp, Saccharomyces cerevisiae
atgccaagagtagctatcatcatttacacactatatggtcacgttgctgccaccgcagaggcagaaaagaagggaattgaagccgctggaggctctgcagacatttatcaagtcgaggaaacgttgtctccagaagttgttaaggcgcttggcggtgctccaaagccagattacccaattgccactcaagatacgttgacagaatatgatgcctttttgtttggtattccaactagatttggtaacttccctgctcaatggaaggctttctgggaccgtaccggtgggttgtgggctaagggtgctttgcatggtaaggtcgctggttgtttcgtctccaccggaactggtggtggtaatgaagccacaattatgaactctttgtctactttggctcatcacggtatcatttttgtcccattgggttacaagaatgttttcgctgaattgaccaatatggatgaagttcacggtggttcaccatggggtgcgggtaccattgcaggcagtgacggttcaagatctccttccgccttggaattacaagtacacgaaattcaaggcaagactttctacgaaaccgttgcaaagttttga

SEQ ID NO: 970 - DNA, 597 bp, Saccharomyces cerevisiae
atggatattattctgggcatccgtgtacaggattctgtcattctagcgtcttctaaggcagtcacaagaggtatttctgttttaaaagattctgatgataaaacgagacaattatcgccacatacattgatgagttttgccggtgaagctggtgacaccgttcaattcgccgagtacattcaagccaatatccaattatactccattagagaagattatgagctctctccacaagcagtatctagttttgttaggcaagaattagccaagtcaattaggtcgagaagaccataccaagtcaacgtattgattggaggctatgacaaaaagaagaacaaaccggaactatatcaaattgactacttgggtactaaagtcgaattaccctatggtgctcatggttactcggggttttacacattctctttactagatcatcattatagacctgatatgactactgaggagggtttagatttattaaaactatgtgtacaagagcttgaaaaaagaatgccaatggacttcaagggcgtcattgttaaaatcgtggataaagatggcataagacaagtagatgacttccaggcacagtga

SEQ ID NO: 971 - DNA, 597 bp, Saccharomyces cerevisiae
atggctattaaaccaaccaaaagttttcagaattgtctagaagctgaagtgcctggttataacgactgtccgacagttttgttttctatcgaccctaatagcggacctagatccaaatctaaacaaagaacgaaatcgaaaagatgtgttagcggcagacttgccacagaagtgttagatctttatgggaacactaaaacagctactacgccgccaccagttttgaggaggccatctgtaactgctgctcaacaagaatctgcctgtgaaggtgtgctcgtaaaagaccaaggcgatagacagctccagccgatattatgcagtaaagaagaattagtggctaagatcaacgacctctgtgtgtgtggctcgaagctctcttcgaaggagttggaattttacaagaaaaaattagattcaaacattaccaagattttacaaaacgagcacaccaaaacagtactatcccagattttcaatgaaaaagacaaaaatatggccgtgaaaaccattaaacattggatggttactgacacaacaatctcaaattggtgtcccgcattcttaaaaatttttgaaaatgcgatgcctaattaa

SEQ ID NO: 972 - DNA, 597 bp, Saccharomyces cerevisiae
atggtccggcctcagaatgttcactggtttatcgctacaattgtatttttcatcggatttgtacacgctaatacagaatcaatcttatataaggttcctcacaactttcccctcaaaaaaccaagagacagctctacttatgcaagagatgtaaacttgatatcttccatatcactatcgggagaagcaatgagtcagatcactatcgaggccaataccactgacttggagttgcataatactacgtatattgaactggcggacttacagcgagacgaaacatatcagattaaagtgtgttggtcagcaatacatccaatttccattaataatctccaaactatcacaataccacgtttcactgaatttcagggaactaagtcagactacgcgagaatactagtgactttccaggtcttgtctgactcgtatcctagtgagcatgccatggttccaatacaagtctcattaatcaccactcggctaggtatccccgtggatatttacccaacattaatcgttatggtgctattagtagcagggcttgttgttacccgggcaccacacgtattgaacgatcttttgctgaaattttag

SEQ ID NO: 973 - DNA, 597 bp, Saccharomyces cerevisiae
atggtcgaatctaagaatactgaattatcgcaaggaacatggctcaataagccaaaatctgtttttcaagaggcaggaaaagtcactctggaaacagatgaaaaaactgacttttggcgtgaaacattttacggatttacccgtgatagcggtcattttttgggagtagagacaggtagtgcttttactgcacaagtccgtgttcagggaagctacgagagtctttatgatcaggctggtatcatggttcgtatagatgatggacattggctcaaagctggcatagaaatttctgatggccacgcaatgctaagcagtgttttgacaaatggaaaatcagattggtcaactgctgtttatggcggaaatgctcgcgatttctggcttcgtgttactgttgaaaagggcgttttgaggattcaggtgtcctctgataaaaaaacatggccgttagtacgtttggctccatttccaacttctgaccattaccttgttggaccaatggcttgcacacctgagcgtggcggattgaaagttactttctcggaatggagtctcacagctcctttaggaaaagctttacatgatttgagttag

SEQ ID NO: 974 - DNA, 597 bp, Saccharomyces cerevisiae
atggtgagaaatcgttttataagaaaaatgaaaaaaaacttgtttaaatcaaatcacttatcatatttgaagagtaaatggaaagtaaagatcactggacaaataaaaatggattttgataatttactaaacctagaagaacagtattaccaagaaggttttctggagggccagaatgagaatataaagcagagctttctagaaggtaaacagtatggtttacaagtgggattccaaagatttacgctcctgggacaaatggaaggtttgtgtgatgttatagaatcgtatggattgcatagtccaacactagaaaagaatatacataccattcgtactttaatgaaaggtttgaaaatgaataacgatgatgaaagtgtgatggaatttgagagggtgttaataaaattgaaaaataagtttagaaccattctaataactcttcatcgattagttaaagataaaagaacccccaccgtgacatttgaagtctttgaagacgtttcaagggccattgccggagaaattagaggttttgtagaaaatgaagacatcgcaaagaataagacaaaacaaaatcaggctcaatcctggtaa

SEQ ID NO: 975 - DNA, 597 bp, Saccharomyces cerevisiae
atgtcaatttctctattaggtagaattgtttcacaacaattctccggcatacgggcggctgagccagggagatctctatatttaccgtttaccttactattgaaacagcccggtgcttacaaggtgagcctacacagatatgtacatagcacccaaacgaagagccacttgagctttttaatgaataataacgatataacaccttttcaaaaatttacagttaaagttctcaaagagcagtgcaaatcaagagggttaaaattatcaggtcgcaaatcagatttgctacaaagacttatcacgcacgattcatgttcaaataaaaaaagtagtgtgaagataaatgaacccaaaaaaaagaggatattaataaatgatccaatcaaaatcacgaagaaattggttagtgataaaacttttagaactattgaaaaaaatatttcttcactgcagaacacacctgttatcgaaactccctgcgacgttcattcacacttgcaaccaagggatagaatattcttattaggatttttcatgttatcgtgtctttggtggaacctcgaacctcaggaatctaaacctaccattgaccattag

SEQ ID NO: 976 - DNA, 597 bp, Saccharomyces cerevisiae
atgtctaaagacacgcatgatgatgaactgccgagctacgaggacgtaatcaaggaagaggagagattgcaatctcaaccgccacgaccaccaagaccagcagctaacttggcgcaagggcaccaatcaagaccccaccaaaggccctcgacaatgccagcaacgtcctcatcccaaacatatgctcactcacactcttatacgcctacaagttcccaaccacggcctccaccgaggccacaacagaatcctagcttgccctggacataccctcccaggttttactgttccaagtgtggaaatacgggttacaagttgaagaatggacgatcttgcaagtcgtgttggaggaggtttgcacctcaaaataacgttgtttctgcaccgacatattacacaaactatacaatgcccgtgtacaccaacgcatggcagggtaataggcccttgtacgttcaaccaggggatcctcgcctgggtggcgtgctatgtggtgaatgcagagggtccggacgcaccagattcctgttggacgaagatatatgtcctctttgtcatggtgtaggcagaattatcacccagcctcaacgctattag

SEQ ID NO: 977 - DNA, 597 bp, Saccharomyces cerevisiae
atgtctgaattcttttgggatgtacaaaaaatacaagagatttctaatgtcgaagaacattctgtggttaagtgtgttactgtgaatacgagcaggttaatttcgcagcttaacgaggagctacaagacgaagaaagtggcgtcaattttattgttacacagctgcaattactgataaataatgtctatgagaaaatacagaaaagccctggagttcccgcacatcgttctctgatgataaatttgaatttcacgcgcttgaaattctcaatagcttattgggatatcttattggagaggtcactagatctaataaatggaccatcgaaaacgggtgcccgctactttattacagaggttacaccagtagacagaagtcgatatgttgaaaacaatcaatattttctagcttttaaagctaaccagcgtttgacacggaacagcgtggatatggacgagtttattgattttgaaattctaatcaagcaaataattttcgacctcttcaaaaaaaacggaattccagatcaagattttgaagccattttatcaaggtttcataatttggaaagcttggtggttgcttttaatgaataa

SEQ ID NO: 978 - DNA, 597 bp, Saccharomyces cerevisiae
atgtctgcaatgatggtcaagttaggactgaataagtcggctctattactgaaaccctccgccttttcaagagcagctgccttgagctcctcgaggaggctgctttttaatacagctagaacaaacttcctttctacctcaccattgaagaatgtggccagtgaaatgaacaccaaagcggcaattgctgaagaacaaatattaaacaagcaaagagcaaagagacctatttctccacatctgaccatttaccagccacaattaacttggtacctgtcttctcttcaccgtatttcgttggtgcttatgggactaggtttctacttgtttactatactcttcggagtctctggtttattaggtcttggattgactaccgaaaaggtttctaattggtaccatcagaagttttccaagattaccgaatggtccatcaagggttcctttgcttacttatttgcaattcactatggtggcgccattagacacttgatctgggataccgctaaggaattgacattgaaaggcgtttacagaactggttacgctctcattggtttcaccgccgttctcggtacttatttattaactttatga

SEQ ID NO: 979 - DNA, 597 bp, Saccharomyces cerevisiae
atgttaagagaagtcatctattgtggaatttgctcctacccaccagagtactgcgagttttcaggaaaattaaagcgttgtaaagtttggttatctgaaaaccacgcagacctttatgcaaagctatacggtactgacgataatacgcaagaggtggaagccgtgaccaacaaactggctgaatccagtattggcgaagctagagaggaaaagttggaaaaggacttgctgaaaattcaaaaaaaacaggaaaacagggaacaaagagaattagctaagaagctgtcatcgaaagtgatcattaaaagagaagctaggaccaagagaaagtttatcgtcgctatctctgggctggaagttttcgacatcgacatgaaaaagctagccaagacatttgcgtctaggttcgccacagggtgctcagtctcgaaaaatgcagagaaaaaagaagaagttgtcattcaaggtgacgtgatggatgaagtggaaacttacatacattccttgctggaagaaaaaggcctaaaggacgtcaaagtggaaaccatcgatgctaagaagaagaaaaagcctgctgcagaaggagctgccaagtaa

SEQ ID NO: 980 - DNA, 597 bp, Saccharomyces cerevisiae
atgtttcatttagtcaagggactttacaataattggaataaaaaggaacaatattcaattctaatattaggtctagacaatgcaggcaaaacgacgttcttggagacattgaaaaaggaatactctctggcgttcaaagccttggaaaagatacagcctacggtaggacaaaatgtggcgacaatacccgttgacagtaaacagatcttgaagttttgggatgtaggtggtcaagaatcactgagatcaatgtggtccgaatactattccctatgtcatggtataattttcattgtggatagttcagatagagaacgattagacgaatgttccacgaccctacagtcagttgtaatggatgaagaaattgaaggtgtacccatcttgatgctggccaataaacaagatagacaagatagaatggaagtacaagatataaaagaagtatttaataagattgcggaacatataagcgctagagatagtagggttttaccaataagcgcattgactggagaaggtgttaaagacgctatagaatggatgattgttagactagaaaggaataaaaagtcaagaccaccgatttataaatga

SEQ ID NO: 981 - DNA, 600 bp, Saccharomyces cerevisiae
atgacatcgattaacagttttcccaggaatattgactggccttccaacataggcattaaaaaaatagagggaactaatccaacggtgaatgccatcaagggcttgttatataatggtggatcaatttatgcatttctatattttgttattgctatgtttgttgaaccaacgctacaaaagcagtaccagcagagaaatgatttttccttgtttgttttgttgcgtttgagaagaatcatagcgcaattgcaaaaacgactggtgatgaccccagtatcgtcgttggggttcaacgaacagaataactttgtggagaggtccactcaaacttcagacgacaatataatacgagaagataatagccattgggctgaaatgatttatcaactgcaaaatatgaaacaagaattacagtattttaacagatcctcaggccaaccatctgaaagtatagacgattttgtctttcaaattaagatggtgactgaccaggttgagttaacagataggtcccgagctttctcaaataaatcaagaaatattatacagggaatccgagaaatcaaaggttggtttgtgaatggccaagtgccaaggtaa

SEQ ID NO: 982 - DNA, 600 bp, Saccharomyces cerevisiae
atgagaatttatcaatgccatttttgctcatccccatgttatccaggtcatgggatcatgtttgtgcgtaacgatgctaaagagtttaggttctgccgttctaagtgtcacaaggcattcaagcaacgtcgtaacccaagaaaactaaaatggaccaaagctttcagaaaggctgccggaaaagaattggctgtggattctaccttgacttttgcccaaagaagaaatgtccctgttagatacaatagagagttagttgccacaactttgaaggctatggctagaatcgaagaaattagacaaaaacgtgaaagagccttctacaagaatagaatgagaggtaacaaagaaaaggacttcttaagagataagaaattggtcgaatctaacccagaattattgagaatcagagaagttgaaattgccagaaagttggctaaagaacaagaaagagctgaatcagtatccgaacaagaggaatctgaagaagaagaggaggatatggaaatcgacagtgacgaggaagaggaagaacaattggaaaagcaaaagattctgctaaagaacagaagaagaaatacaaagaaaattgctttttag

SEQ ID NO: 983 - DNA, 600 bp, Saccharomyces cerevisiae
atggaagcaaccatcaaagtggtactgctaggagattcatcagtggggaaaaccagtatagtgactaggctcaaatcaggtaagtttctagcaaaacatgcggctacgataggtgcggcgttcatcaccaagacaatcgaggttccttctaacgactcctctacggagaaacgtatccatatggagatatgggacacggcgggtcaggaacggtataaatcactggtgccaatgtattatcgagatgcgaatattgctttgattgtattcgaattgggagacgtatccagtctgcaatgtgcaaagacatggtttcaagatttacaggaccgtgctcagggaacgcaggtaattatcgtgggcaataagtacgatttagtctgcgaagagcattcaggggaagtgactataccggcggagttacagggtctgccgtatgtggccgtaagtgcaaagacagggtacaatttcgatacattgaataaaataataatcagtttggttcccgaaagtcaattcaagacattgtcaaagaacaatgaacagggaaatatactggaaataaataaaaaaaaaagcggcagtggctgtatatgttaa

SEQ ID NO: 984 - DNA, 600 bp, Saccharomyces cerevisiae
atggacaaaatcagagaaaagctaagcaacttgaagttggaagccgaatcatggcaggagaagtacgaggagttgaaagagaagaacaaggacttggagcaagagaacgtcgaaaaggagaatcagatcaagtctttaaccgtcaaaaaccagcaattggaggatgagatcgagaagctggaagcgggactttctgactctaagcaaacagaacaggataacgttgaaaaagaaaatcagatcaagtccttgacggtgaagaaccaccaattggaggaagagatcgagaagttggaagcagaattggctgaatccaagcaattgtccgaggactctcaccacttgcagtccaacaacgacaatttctccaagaagaaccagcaattggaagaagacttggaggaaagcgacaccaagctaaaggaaaccactgagaaattgagagagtccgacttgaaggcagatcaattggaaagaagagtagctgccttggaagaacaaagagaagaatgggaaagaaagaacgaggaattgaccgtcaagtacgaagacgcaaagaaggaactggacgaaattgctgcatctctggaaaacttgtga

SEQ ID NO: 985 - DNA, 600 bp, Saccharomyces cerevisiae
atggacacactgttcaactccacggaaaagaatgccagaggcataccgcaggctccattcatcgaaaatgtcaacgaaataattaaggacccaagcgacttcgaattgtgcttcaataagttccaagaacggctttctaagtacaaatttatgcaggaatctaaattggctacgataaagcagctgaagactagaatcccggacttggaaaacacattaaaaatatgccaaagtctgcgcaatcacagcgacgagggcgatgagagcgatgaacctatcctgttgcactaccaattgaacgacacgctctacacaaaggctcaggttgatataccggaagatcgggcggatttgaaagttgggttgtggcttggcgcagacgtgatgctggaatatcccatcgacgaggccatagagttgttaaagaagaaactcgcggattccgaacagtctttaacggtgtccaccgaggacgtagagtttttgagggaaaatatcacgacaatggaggtcaattgcgcgcgattgtataactgggacgttcagagaaggcaagacttgaagcaggctcaagaagggactaaaaacctcaagatataa

SEQ ID NO: 986 - DNA, 600 bp, Saccharomyces cerevisiae
atggaccaggcaagaaatttctacaacacaattttaaaatcgtcgcacccgttgctactatcatttcatctggcaggtaaggcagttcccattgtattttatatcataggatcaatgtttttgaatttcacacctcaattcatcactgtcgttcttttactttcttttgacttttacttaacaaaaaacattacaggtcggaaactggtccaattacgctggtggtatgattctacagatgtgaacaaagattctaattttactttcgaatcatataagcaatatgcgccgggcccaccaataaatgccatcgattctaagttattctggtggtcgatgtatgtgacacccgtaatctggggtgtcttcgctgtgttgtgtcttttaagactgaaaatattctacctgattttggtcattgttgcaatgtgtctgaccgcctggaacacgtatggatttcgttgttgcgatagatgggagcccaatagtggacaatctgacggtcaagatactaataattggttcgctcttccttctgttccgggctttgaaaatctttcaaggctggctaatatccaatcgtttttccagagacaataa

SEQ ID NO: 987 - DNA, 600 bp, Saccharomyces cerevisiae
atggcgaaacacattgttgctgcccttcaaatcggctcttgtccgggctctactaaggataccttgaaaaaaattttgtcatatgagaaggagatcaaggaatctggtgccaagttggtcgttatcccagaagccactcttggtggttatccaaagggatcgaactttggggtttatctaggctaccgtcttcaagaaggaagggaggagtatgctaagtatcttgccgaagcaattgagatcggaaacggagagaaatatccagaaattagtcagttgtgcgcactatcgaaggccaccgacgcatccttatgtgtggggtgtatagagcgcgatgggacgacattatattgtaccatggtttatatagatcctaaagatggctacgttgggaagcatcgaaaactgatgccgacagctggcgaaagactgatatggggtcaaggcgatggttcgactctgcctgtcgtggataccgctgctgggaagattggcggtgctatctgctgggagaacatgatgcctctactgagatacgccatgtataaaaaaggggttgagatctggtgtgccccaacggtggatgctaggcctatttag

SEQ ID NO: 988 - DNA, 600 bp, Saccharomyces cerevisiae
atggtatgttagtatccaataaatgcagcgcaactggaccagtgaatagaacaatacatatagataagtcgcaaaaagaaaagaatacatgtggtggaaaattttgcaccaagagaggcaagaactatgaagaaagacttttgaaatatttcaagcggttgctacatatagtggataagattcaggatggacgtatgagcttacagttcattgtaggggaatataaaattctgatgatggcgaacttcattcccagcaactcaagctattgttatttttctattctgcaccgagatgaggagaaaaaaggaagtttactaacagttagatttatttcttattcgtctacaacaggttttagttcaagatttattgcacccaactgcagcttctgaagcaagaaagcacaaattaaagacattagtccaaggtccaagatcgtacttcctagacgttaagtgcccaggttgtttgaacatcactacagttttctcacacgcccaaactgcagttacctgcgaatcctgctcaacaattttgtgcaccccaactggtggtaaggcaaagctttctgagggtacatctttcagaagaaagtaa

SEQ ID NO: 989 - DNA, 600 bp, Saccharomyces cerevisiae
atgtctgcaaacgaattctactcaagtggccaacaaggtcaatataaccagcaaaacaaccaagaaagaactggtgctccaaacaacggtcaatatggtgccgacaatggtaaccccaacggtgaacgtggtttattttccactattgtaggtggcagtgccggtgcgtacgctggatctaaggtgtcgaacaaccattctaagttgagtggtgtgctgggcgccataggtggtgcattccttgccaacaagatatctgatgagcgtaaagagcataagcaacaagagcaatacggcaactcaaacttcggaggtgctcctcaaggtggacacaacaaccatcaccgtcaggacaataacaacaataacggtggatttggcggtccaggcggccctggcggtcaaggtttcggaagacaaggcccacaaggatttggaggtcctggtccacaagagtttggtggtccaggtggccaaggattcggtggtccaaatcctcaagaattcggcgggccaggtggccaaggattcggtggtccaaaccctcaggaattcgggggccaaggtcgtcaaggattcaatggcggttcacgttggtga

SEQ ID NO: 990 - DNA, 603 bp, Saccharomyces cerevisiae
atgggtatttctcgtgattctcgtcacaaaagatcagccactggtgctaaacgtgctcaattcagaaagaagagaaagttcgaattaggtcgtcaaccagccaacacaaaaattggtgctaagagaatccactctgtcagaactagaggtggtaacaagaaatacagagctctaagaattgaaaccggtaacttttcttgggcttctgaaggtatctccaagaagaccagaattgctggtgttgtttaccatccatccaacaatgaattggttagaactaacactttgaccaaggctgccattgtccaaattgatgctactccattcagacaatggttcgaagctcactacggtcaaaccttgggtaagaagaagaacgtcaaggaagaagaaactgttgccaagagcaagaacgctgaaagaaagtgggctgctagagctgcttctgccaagatcgaatcttccgttgaatctcaattcagcgccggtagattatacgcttgtatctcttccagaccaggtcaatccggtagatgtgatggttacatcttggaaggtgaagaattagctttctacctaagaagattgactgctaagaaatag

SEQ ID NO: 991 - DNA, 603 bp, Saccharomyces cerevisiae
atgaagtctagtaagcaattggttcaggacgctaaggattatcgcttcaatccggcgataccattgagaatttacctgaaaacatgcatcggcatattggaaaaggcacagtgtgcgttccaggccaacgacttgtcgctgtcgtttatttattattttagatatgtggatttattgactaacaaactatctagacaccctgagcttttgcgcatggatgcgtcgtcgtcatcgtcgtcatcgtatattcataaaagagaatacctgcaactcataaagttggaagtgcctgcggtctgcaaaattattgaaagcttacgcacccaaattgattctcaatacagcaaattgcaaacatcactcgctaataatatagccaagccgaacataaacgcaaacacaactcccgtgcaggtggagcaacaaccactgccgaagaaatctttcgacgagtatagcttcaaccaatcaatttcttttttccagaaaatttcaaacgcacaacttaataccggagcaagctctcagagtcaggccactgcccgtgatgaagcctacagactgaattatccggagctaccacgccttacattctccacatag

SEQ ID NO: 992 - DNA, 603 bp, Saccharomyces cerevisiae
atgagaatctactacatcggtgtatttcgctctggaggagaaaaggctctagagttgagtgaagttaaagacttgtcacaatttggtttctttgaaaggtctagtgttggccagtttatgactttttttgctgaaacggtcgcttctagaactggtgcaggacaaagacaaagtatagaagaaggcaactatattggccacgtttatgccaggagtgagggcatatgtggtgttttgatcaccgacaaagaatatcctgtcagaccagcatacacactattaaacaaaatattggatgaatatttagtcgcacatcctaaggaagagtgggcagatgtgactgagaccaatgatgcattgaaaatgaagcaactggacacttacattagcaaatatcaagatccttcacaggctgacgctatcatgaaagttcaacaagaactggatgagacgaaaatcgttttgcacaaaacgattgagaatgttttacaaagaggtgaaaagttggataatttggtggacaaatcggagtcattaacggcaagttccaaaatgttttataagcaagctaaaaaatccaattcgtgttgcatcatcatgtag

SEQ ID NO: 993 - DNA, 603 bp, Saccharomyces cerevisiae
atgagttacgataagaaggcagatgtcacatccttagatgaagatttgagacaactaagagaaagcaaattttcaccggaagcaattcaaaatatcaaaatatgggtatataaatctgtcctaaaagagatagctcctcctggagacttattggaatgcttgaaagatggaacagtcctatgtaagctggcaaatattttatatgaagcagacacaggagaagctaaccatattagttggaagagctctaaaatgccatttgttcaaatggatcaaatttcccaatttttatcattttcgagaaaatatggtgtgcctgaagatgaactgtttcagacaattgatctttttgagaaaaaggatcctgccattgttttccaaacgttgaagtcactatctcgttacgccaacaaaaaacatacagatagatttccagttctaggaccacaactgtcaacaaagaagccaagacccccggttaagtctaaaccaaaacatctacaagatggtactggatggagcacttttgaatacggttatatgaaaggtgcatctcaggctactgaaggagtggtgttaggacaacggagagatatagtttag

SEQ ID NO: 994 - DNA, 603 bp, Saccharomyces cerevisiae
atggagcaaatattatataatcaaagccttaaaatttctaccctttctacttttcaaggtttaaagtttctaaaggtcctcattttttctattttccaacaactattttataacccagttatacaattattcggaacgaaagcctcaataatggaatctgattccactactctgctcgaaagtagttggagtactgagcgaaactttctcaatatgaattcagattccatatctgctaccaagaatgtttttatattattttttaccattttcagattagcggagtatattgtatacaaactctctgaccagaagtatcggttacacacatccctgaatgtccaacatttcaggtggaattcgaagaagaatacaaacagaaaaaggacactttcctttagcaaagcttacttaccaagaacaaatatactaccgatttttgtagccgatggactaaaaaatagattctcaggcccgctacctggtaagtccttggaaagcttccagaaactaaatttattgagcgataacaatattaagcggtatgcagtaccaggaaacaaagcagtgaacacacttttatggcaagagcaatactcataa

SEQ ID NO: 995 - DNA, 603 bp, Saccharomyces cerevisiae
atggcaggtatcaagttgacgcataagctttatcagtattatcaattagccacaagctttttgtatgctgcattattgatacggtggctgatattaatgccactggtagggtctcggtttttaccgggaggaatccacgaattcttgatatatttgatgttttattccagcatcatggaagttatttggttgcttagattccacgggttcaaatatggtttgctttcaagaacgtttttgaaagacctaaattttatctatttagtcagcgtgatccatttttatgacgattatgagcatgcattgatcctcaagaatgcatcatattctagtttcattatttccttatctttatcacaggcatattgccattggtgcaaactttttaaacgtaagggcgtaaaggaaagaacacttgtatggaaggttaacacatttgttacattgccaattctctacctgagtgaatttgcattgctactattaaatatccaggttaagaactatcattctaccccgactttggacataatcaacagggtggttttactagcatacttccctgtactactaacagcatacaaaaaactattaacaaaatga

SEQ ID NO: 996 - DNA, 603 bp, Saccharomyces cerevisiae
atggcttggactagtacattaccagcgcatctactgaacctgatcaaaaactccaaatatgttcacgtggccacctgttctaaagactgcatcccttcagtggcattgatgaactatatctatgtgccaggtgaaaaactgttcggtcaaacagataataagaatgactacattatatttgtttctcctcaggacacacaaaagttttacaacatcaaggagaaccctaaggtcgccctgttgtttcacgattggatcatcgcgaataatttgtcagtgggcaaggaaagcatctctgggactccgacgccgacttctattcctcatgaagagcaacgtcaaagcgagcttttaaatttgttacaggagttaaatcaagccgaattgaaccaaatgagcgcatctattggtggcgaaaccgaaattgtcaatcctgaaagtgaagaatccaagtactataaagatttaatactaaaggctaatcctgatgcgaaagcttttatatttgaaaagaacaccgccgttgttaaagttagaattgataatgctagggtatccaataatgagaacagaacaatgtttctaagtaaagggaagagttaa

SEQ ID NO: 997 - DNA, 603 bp, Saccharomyces cerevisiae
atgggcctacacagtgaaccgttagatcaagaggaccaagacaccataatactcgatgcaagagctggcgatttggattctctgaaagatatatttacaactttagtcagtcccgagttactttcgacttgtaaggaaagtgaatctgattctacggctttacatatggctgctgccaacggtcatatagagaccgttcggtatatactggagacggtttctcgcgcaaatagtgccgaagacttgaaagcttttgttaatgaggtgaacaaaacaggcaacacggctttacattgggcgtcgttgaatggcaaattagacgtggtcaagctactgtgtgatgaatatgaggcagacccctttattagaaacaaattcggccacgatgctatctttgaggccgagaacagcgggaaggaagaagtggaaacatactttttgaagaagtatgatgtcgaacctgaagatgatgaagaagacacacaaactgagggcaagaattcggtccaaatcacaaagggtacagaaattgaacaagtcaccaaggaagccaccgaggctttaagagaagaaaccgagaaactgaatataaataaagactaa

SEQ ID NO: 998 - DNA, 603 bp, Saccharomyces cerevisiae
atggtacgttaatattgtgttaaaatgctccacgaaacgctttttttaggaaacttgtccccatacaggaagaaggtgtattaaaagggaaaactacgatcaaagtaatattttgaataggaaagattgccccatgataatattaataatccatcaaatgcctgtagataatgactgaaaaatgaaaagaaaataaaatattgtatcattattatgttgagatgtaaatgtacaaaaaaggaagaaagacgagaatttcaaaggacgattattctcgttaatattcacaacatgttgaatatagacctttcctaaaaaattagcgtctgcgttgcagtaactccataacacaagtctgaatatctcattactaacattaaatgaaaaattttttttttttcaaattctccttaggctaaagttcacggttctctagctcgtgctggtaaagttaagtctcaaactccaaaggttgaaaaaactgaaaagccaaagaaaccaaagggtcgtgcttacaagagattattgtacaccagaagattcgttaacgttaccttggttaacggtaagagaagaatgaacccaggtccatctgtccaatag

SEQ ID NO: 999 - DNA, 604 bp, Saccharomyces cerevisiae
atgggtgctgctccttccaaaattgtggatggtcttttagaagatacaaattgtatgtacacttcggagtgaggaaaagaaagaaaggggaaattaaccgattttactaacactgacactttgaacagttgatagagatgaaattgaaaggttaaggaagagattcatgaaattagatagagatagctcagggtctattgataaaaatgaatttatgagcattcctggcgtttcgtcaaaccctcttgctggacgtataatggaggttttcgatgctgataatagtggggacgtggattttcaagagttcatcacaggattatccattttcagtgggcgtgggtccaaggacgaaaagttaagattcgccttcaaaatctacgacattgacaaggacggtttcatatccaatggtgagttgttcatcgtgttgaagattatggtaggttctaatctggacgatgaacagctgcaacagatagtagataggacgatagtggaaaacgatagcgacggcgacggacgtttaagtttcgaggagtttaagaatgctatcgaaaccacagaagtggccaagagtctgacattgcaatacgatgtgtaa

SEQ ID NO: 1000 - DNA, 606 bp, Saccharomyces cerevisiae
atgaaaccagtaacatgttgcaaccaaaagaataacataatgccatccttagtccccgtttgctgttcagaaaagaaaatagaatccgatgctaagaaatcaatatcgaaatgctgtggagacaaagaaatctacgatagcgagaatagaccgatcactaaagaggatgggtcatggatacctggaagctgcaagcaatgtagatcagacccccatagtaggaatttttgtcaatcactttcgaataaatgtagttcaagctctttctcttccaacagtgcgttgtcaccggatctaaatgaacaacaaactgacgtaaattacaattcaatcaagctacccgaaatatgttcctgcaagaatgcacaaatgaatgcggcttccgatgcaaagaggtatctgccgatcagttacacatatcaaaaaatccgtcaacatatgcaaaaaaataaaagtatccaagaacaactaaatcctgaggattcaacttcgatctcatcagcgttagagaacattgcatctggattgcacgttcgtggacagaaagtagaattgcaaagcatcaaggatgcattacataagatggacaaaaacgtcttggaatga

SEQ ID NO: 1001 - DNA, 606 bp, Saccharomyces cerevisiae
atgagtagtgacggcatgaacagagatgtttcaaactcgaaaccaaatgtcagattcgctgctcctcagcgactaagcgttgctcatcctgccatatcatccccgctgcatatgcccatgtcgaagtcgtcaagaaagcctcttgtaagaaccaaaataagactagatcctgggcacagtgctctggactggcactctctaacctccaatccagcgaattattatacaaaattcgtttcgctacagcttatccaggatttactcgatgatccggtatttcaaaaagataacttcaagttttcaccttcacaactgaagaaccaattgcttgtccaaaagatacccctttataaaataatgccacccttaagaataaacagaaaaatcgtaaagaagcattgtaaaggtgaggacgagttatggtgcgttataaacggcaaagtctatgacatttctagttatttgaagttccatccaggtggtacggacatcttaataaagcaccgtaatagtgacgatttgattacatattttaataagtatcatcaatgggttaactatgaaaaattattacaggtttgtttcattggcgttgtatgcgaataa

SEQ ID NO: 1002 - DNA, 606 bp, Saccharomyces cerevisiae
atggatgagatggataatgtgatacgatctctggagcaagaatatcggttaatattgctcttgaaccataggaacaaaaatcaacatagagcggctagctggtatggatcgttcaatgagatgaaaagaaattgtggacaaataataacgctttttagctcgagaagattacaagccaaacgccttaaagatgttgaatgggtcaagttgcacaggctattacagagagcactttttagacagttaaagagatggtactggcagttcaatggcgtaattgcgctgggacaatttgtaacgttgggttgtacactagtaacattgctggcaaatgtgagggcactgtatatgagattatgggagattaatgaaactgagtttataagatgtggatgcttaataaagaacttaccgagaacaaaagcaaaatcggttgtgaacgatgtcgaagaacttggagaaattatagatgaagatattggcaacaacgttcaagaaaacgaactagtgataacgtctataccaaagcctctgacagagaactgtaagaagaaaaagaaaaggaaaaagaagaacaaatcagccattgatggcatattcggataa

SEQ ID NO: 1003 - DNA, 606 bp, Saccharomyces cerevisiae
atggctaggccagttaatacaaacgctgaaacggaatcgagaggcagacccactcagggtggtggttacgcaagtaacaacaatggcagctgtaacaacaacaatggcagcaataataacaataataacaataataataataataataacagcaataacagcaataacaataacgggcctacctccagcgggagaaccaatgggaagcaaagactcacagctgcacaacagcagtacattaagaatctcatagagacacatatcaccgacaaccaccctgatctgcgccccaagagtcacccaatggatttcgaagagtatacggatgcgttcctgagaaggtataaagaccactttcaattggacgtaccggacaacctgacgctgcagggatacttattgggttccaaattgggcgcgaagacttattcatacaagaggaacacacaggggcagcacgataaaaggatacataagagagacctggccaacgtggtgagaaggcatttcgatgagcattccattaaagagacagattgcataccgcaatttatatacaaggtaaaaaaccagaagaagaaattcaagatggaatttcggggttga

SEQ ID NO: 1004 - DNA, 606 bp, Saccharomyces cerevisiae
atggttaactcacatggaatacggtatattcggttgaagcaggtctttaatcgtgcattggaccaatcgatttcgaaattacagagttgggacaaggtcagttcatgcttcccgcaatatgtgaatagcaagcagggcgctataaacgtcgccaattgtcagcgccaattaacggaattctggacggagctttgtcaacgagagtttaaagaaattatggaagaacgaaacgtcgagcagaaactaaatgagttggacgaactgattttggaggctaaagaacgttacacggatcgtgatcaagatgaagtaaacaaagggcccgcgatcgatgagctctccagcaaagagcttgtggaatgccatttatacagccaacggatgcatgccatacacgagatagacgagcggcttgcgaaagtgaatgagatgaacgaccagttagcccaggagttgaaagacttagagacgcaagtagaggtagagaaaaacgaaattggcaagatgtacgatgagtacctgggctcccacacggaccaaccggccaacgtgctgctggtacagagcctcaatgatatggtcttggaattgaaggaaaactattga

SEQ ID NO: 1005 - DNA, 606 bp, Saccharomyces cerevisiae
atgtcagccaatgtacaagaagctgcaaatgcagctatagagccggccagtttcgttaaagtcccaatgcctgagccaccaagtagtttgcaacaattgatcaatgattggcaattaatcaagcatagagaaggtgggtattttaaggaaacagataggtctccctacaccatggaagtagaaaaaccagtaaatggaggctcaggtaatactgaaatggtaacaagaaatcaatctacgttgatctattatctactaacccccgacagcccaattgggaaatttcataagaatattaacaggatcatacatatcttacaaagaggcaagggtcaatacgttctagtatatcctgatggtcaagtgaagtcatttaaagttggttttgactataagaatggagaagtctcgcaatgggttgtccccggaggtgtgtttaaggcaagtttccttctgccaaacgaagaatttgacaacggtttcttgattagtgaagtagtggtaccaggttttgactttgaggaccataccttcttgaagggtgaagatgaactgaaacatcttgtgggacctgaaaaggcagctgagttagcttttttagcttga

SEQ ID NO: 1006 - DNA, 606 bp, Saccharomyces cerevisiae
atgtccaacttagttaaagaaaaagcacctgtctttcctatatctaaagtaaagaagattgccaaatgcgaccccgaatacgtaattacatctaatgtagctatatcagcgaccgcattcgctgctgagttatttgtacagaatctcgtcgaagaatcgctggtcttagcacaactgaattcgaaaggaaagacaagcctacgattaagcctaaattctatagaagaatgtgtcgaaaaaagagataatttcaggtttctagaggatgccattaaacaactgaagaagaatagcgcactcgacaagaagagagaactaaacatgcaaccgggtcggagcgatcaagaggttgttatagaagagcctgaattgcatgaggatgatggtgtagaggaagaagaagaagaagacgaggtatccgaagaagaagagcccgtacacaatgaagaacttcttgatgatagtaaagatcaacaaaatgataaatccacgcgcagtgtggcaagcttgctgtcgagattccagtataaatccgcactagacgtaggagaacactccgactcttctgatatcgaagttgaccatacgaaaagcaccgatccttag

SEQ ID NO: 1007 - DNA, 606 bp, Saccharomyces cerevisiae
atgtctagcgaagataagaaacctgtcgtcgacaagaaggaagaggctgctccaaagccaccatcctctgctgtcttctccatgtttggtggtaagaaggccgaaaagccagaaaccaagaaagacgaagaagataccaaggaggaaaccaagaaggaaggtgatgatgctccagaatcaccagatatccattttgaaccagtggttcacctggaaaaggtagatgttaagacaatggaagaagacgaagaagttctttacaaggtcagagccaagcttttcagattcgatgccgatgccaaggaatggaaagaaagaggtactggtgactgtaagttcttgaagaacaaaaagactaacaaggttagaatattgatgagaagagacaagaccttaaagatttgtgctaaccacatcattgctccagaatacactttgaagcctaacgttggttctgatagatcttgggtgtatgcttgtacagcagatattgcagaaggtgaagcagaagccttcacttttgctatcagatttggcagtaaggaaaatgctgataaatttaaagaagaatttgaaaaagctcaagaaatcaacaaaaaggcttag

SEQ ID NO: 1008 - DNA, 606 bp, Saccharomyces cerevisiae
atgtctagtgccatcgttgctaaactgaacaaagaggacatcattaaggacaccgtcaaggacttggcgttcgagattcttggtgagttgtcggtttcgtacgttgattctgacgacatcaaattgggcaatcccatgccaatggaagctacgcaagccgctcctaccatcaagttcacgcccttcgataaaagccaattgtcagccgaggataaactcgctttgttgatgactgacccggacgcgccctctagaacagaacataagtggtcggaggtttgtcactacatcatcactgatattcctgtcgagtacggacctgggggagatattgccatttcggggaagggtgtcgtgagaaataactatattgggcctggtccaccaaagaactccggttatcacagatacgtgttcttcctgtgcaagcaacccaagggagcggattcgtccacttttaccaaggttgagaacattatctcctgggggtacggtactcctggtgcgggtgcctatgactatatcaaggagaacaatctgcaactggtcggtgccaattattacatggtcgaaaacacgaccgttgatttcaactatgacatgtaa

SEQ ID NO: 1009 - DNA, 609 bp, Saccharomyces cerevisiae
atgaaagtttccgataggcgtaagtttgaaaaagcaaactttgacgagtttgagtcggctctaaataacaaaaacgacttggtacattgtccctcaataactttatttgaatcgatccccacggaagtgcggtcattctacgaagacgaaaagtctggcctaatcaaagtggtaaaattcagaactggtgcaatggataggaaaaggtcttttgaaaaagttgtcatttccgtcatggtcgggaaaaatgtaaaaaagttcctgacgtttgttgaagacgaaccagatttccagggcggaccaatcccttcaaagtatcttgttcccaagaaaatcaacttgatggtctacacgttgtttcaagtgcatactttgaaattcaatagaaaggattacgataccctttctcttttttacctcaacagaggatactataatgagttgagtttccgtgtcctggaacgttgtcacgaaatagcgagtgctaggccgaacgacagctctacgatgcgtactttcactgactttgtttccggcgcacctattgtaaggagtcttcagaaaagcaccataaggaaatatgggtacaatttggcagcctacacgtag

SEQ ID NO: 1010 - DNA, 609 bp, Saccharomyces cerevisiae
atgacaacattgatgggaaagtttaaacttactgggcgctcccctctgtttgtacttcaaccaatgttgcactgcaagaaacaacagttcgttgaagaggcagtcagattgattagtaataaaaagatcggaaagaaatctgacttcgtccaggcaagaaactgggtaggagcacttaacgtaacgggcttgcccttaaatcaatttattttacgttacgatagagccagcgggccaggaggccaaaacgttaataaggtaaatagtaaatgtactttgacactttctggtttatcaaactgtgcttggattcctcaggaagtgagaaacatcttaagtagcggcaggtttcgatactacgctaagggcagcgattctatagtaattcaatctgatgaaactaggtcaagggaaaccaacaaattaaaatgcttcgagaagttggttcaagaaattcggcaaacgtgccaatttcctaatgataccactgctgagacctcaaagaaatggaataaaataaaagagaaagccaacaaagagcgacttcttgacaaaaaagttcacagcgataaaaagaaaaacagaagtaaaattaaattcaattattaa

SEQ ID NO: 1011 - DNA, 609 bp, Saccharomyces cerevisiae
atgctaaattataaattgattttattgttttcctctttcctacaattaatctctttttctggctttatgatatgttgtttaacttcaccaataattagaaactgggggctggctcaagctgctggagtttcatatggtacctttggttactgtaaaactttgaattctttttcctgctctcgagtacgtttaatatataacacctcgaaagaaatattacctggcccttctcttgaacgttggtggctgagtcctaaggcaagacatacaataggaggacttttgatttcgataccggttgctacatgtttgactttcatttcttttgcacttcccttggttattatttttctttttcagactggaggaactaatgtctcacttattacttccaacgctatattacacatattgacacttttatcaactatttttgcatgcaccgtgatcctgttactttgcatgcaccgtgatcctgttacaatttcatccttatacgacttggtgtggctggctaactgttccctgttccctctgctcgttattggcgtgcattttctcagttttaggtttgatacgtctgcgcagtcagacagaaaacatagctaa

SEQ ID NO: 1012 - DNA, 609 bp, Saccharomyces cerevisiae
atggccgaagaaagtaccgactttagtcaattcgaagaggagagaaacaacgatcagtataaagtttcagccaaaaaaactgttgacgaatacaaaaatctggatgctgaagacgaatccttggcgaaatggaaagagtctttgggtctaagttcagacgtcttgccattggaatttcccggtgacaaaaggaaggtggttgttcaaaaaattcaattactagtcaatacagaaccaaatcctatcacatttgatcttaccaacgaaaagacaatcaaagaactggcatctaaaagatacaaaattaaagaaaattctatttataagttgaagattgtgttcaaagttcaacatgaaattatcacagggttgcgatatgtccagtatatcaaaaaagcgggtattgccgttgacaagatagacgatcatttgggatcgtatgctcctaataccaagaccaaaccattttatgaggtggaactaccggaaagtgaagcacctagtgggtttttagcaagaggtaactacagtgccgtatcaaaattcattgatgatgataaaactaaccacttgactttaaattggggggtcgaaattgtcaaaaaataa

SEQ ID NO: 1013 - DNA, 609 bp, Saccharomyces cerevisiae
atggctactaatattacttggcatccaaatcttacttacgacgaacgcaaggcattgagaaaacaggacggttgtactatttggttaacaggtctaagtgcgtcaggtaaaagtacaatcgcctgtgcgctagaacagttactgctccaaaaaaacttgtctgcatatagattggatggtgacaacattcgttttggattgaacaaggatttgggtttctcagaaaaggacagaaatgaaaacattcgtagaattagcgaagtttctaagctatttgctgattcatgtgctatttcaatcacctcatttatctctccatacagagttgacagagatagagctcgtgaactacataaggaggctggtttgaagttcattgaaatatttgttgatgttccattagaagtcgctgagcaaagggaccctaagggtttatacaagaaagctagggagggtgtaatcaaggagtttacaggtatttctgccccatatgaagcgccaaaagctccagagctacatttgagaaccgaccagaagacggttgaagaatgtgctaccattatttatgagtacttaatcagtgaaaaaatcatccgtaagcatttgtaa

SEQ ID NO: 1014 - DNA, 609 bp, Saccharomyces cerevisiae
atgggtattattgaagaaaaggctctttttgttacgtgtggggcaacggtgccatttccaaagctcgtctcatgtgtgctaagcgacgaattctgccaagaattgattcaatatggattcgtacgtctaatcattcagtttgggagaaactacagttctgaatttgagcatttagtgcaagaacgcgggggccaaagagaaagccaaaaaattccaattgaccagtttggctgtggcgacaccgcaagacagtatgtcctgatgaacgggaaattaaaggtgatcgggtttgacttttcgaccaagatgcaaagtattatacgtgattattcagatttggtcatatcacacgctggaacgggctctatactagattctctacggttgaataaaccgttgatagtttgcgtaaacgattctttgatggataaccaccagcagcagatagcagacaagtttgtagagttgggctacgtatggtcttgtgcacccactgaaacaggtttgatagctggtttacgtgcatctcaaacagagaaactcaaaccattcccagtttctcataacccgtcatttgagcgattgctagttgaaactatatacagctag

SEQ ID NO: 1015 - DNA, 609 bp, Saccharomyces cerevisiae
atgtctgcattacctccagtatactcattccctccactatatacccgtcaacccaattctttaacaaggagacaacagataagtacgtggatagacatcatatcacaatattgcaagaccaagaaaatttggtacatgtctgttgacgggactgtaatcaatgacaacgaactagatagtggaagtacagataatgacgattcaaaaaaaatctcgaaaaatctttttaataatgaggacatccaaagatctgtatcacaggtatttattgatgaaatttggtcgcaaatgaccaaagaaggcaaatgcttaccgattgaccaaagtggtaggagaagcagcaataccaccactacgagatattttatattatggaagagcttagacagttgggcttctttgatactacagtggttcgaagactctggaaaactgaatcaagtcattacgttatacgaattgagtgaaggtgatgaaacagtcaattgggagttccatagaatgcccgaaagcttgctctattattgtttgaagcccctatgcgatagaaatagggccacaatgctgaaagatgaaaatgataaagtaattgccattaaggttgtttaa

SEQ ID NO: 1016 - DNA, 610 bp, Saccharomyces cerevisiae
atgaatcagttaggagctttagccgtaagttctaaattgtaaacacatttgcatcattgaaaaactatactaacgcgttaaccttttttctatatttctatagcaagtttcacgtttcactcaaaacttctccatggaaaatattaagagcgagttccaatccttgcaatctaaattagcaacccttcgcaccccgcaagaatttttcaatttcaagaaaatttccaaacctcaaaactttggggaagttcaatccagagtggcgtataacctgaagtacttttccagtaactatggtttgattattggttgtttgagcatttacacattattaacaaacttgttgctactctttgttattgttctagtcgtagctggtattgttggtataaacaaactaaagggtgaggagctcgtaactccatttggttctttcaagaccaaccaactatacaccggactggtttgtgttgctgtgccaataggtttcttagcttcgccaatctcaactttgctatggttgatcggtgcttctgccgtcagcgttttcggacatgcatcattgatggaaaaacccatcgaaactgtatttgatgaagaaactgtttga

SEQ ID NO: 1017 - DNA, 611 bp, Saccharomyces cerevisiae
atgtctagatctgggtatgctaaatttcatttgtactcctgtgtaaactatcaattactaactaattgacatgatgctgttttatctcgctctcttatgtcctttctttcctccctttttaacatggaactttaaaaggaatgtgggggaaaaaattcataagaagccaggaaaatgtgaagtttctgtgtagtgttgctgttgctgatgaatcccttaccgctttcaatgacttgaaattgggtaaaaaatacaaatttattttattcggattgaacgatgctaaaaccgaaatcgttgtcaaggaaacctctactgacccatcttacgatgccttcttagagaaattgccagaaaacgactgtctttacgccatttacgattttgaatacgaaattaatggtaatgaaggtaagagatccaagattgttttcttcacttggtctccagacactgctccagtcagatctaagatggtctatgcatcctccaaggatgccttaagaagagccttaaacggtgtctctaccgatgttcaaggtactgatttttccgaagtttcttacgattctgttttggaaagagtcagcagaggcgctggttctcattaa

SEQ ID NO: 1018 - DNA, 612 bp, Saccharomyces cerevisiae
atgttcaatcgttttaacaaattccaagctgctgtcgctttggccctactctctcgcggcgctctcggtgactcttacaccaatagcacctcctccgcagacttgagttctatcacttccgtctcgtcagctagtgcaagtgccaccgcttccgactcactttcttccagtgacggtaccgtttatttgccatccacaacaattagcggtgatctcacagttactggtaaagtaattgcaaccgaggccgtggaagtcgctgccggtggtaagttgactttacttgacggtgaaaaatacgtcttctcatctgatctaaaagttcacggtgatttggttgtcgaaaagtctgaagcaagctacgaaggtaccgccttcgacgtttctggtgagacttttgaagtttccggtaacttcagtgctgaagaaactggcgctgtctccgcatctatctattcattcacacctagctcgttcaagagcagcggtgacatttctttgagtttgtcaaaggccaagaagggtgaagtcaccttttctccatactctaacgctggtaccttttctttgtcaaatgctattctcaacggtggttctgtttccggtttgtaa

SEQ ID NO: 1019 - DNA, 612 bp, Saccharomyces cerevisiae
atgaaagaggcagaacttagtgcgacagaaagccaagatgagatcccaaagtctaattccttattaattatagaaaaattaacaaaggccgtttgtagcctttattttataaattgttttatggtgccatcagtagataatttgattgaaaagtacccaaaagcaatcatcattaagatcatagatatgattctgggggcggtaacaatttccctcgttattatagttttctttttatatcgaaagaacggtcattttaaaaatgaaaataaaacaaagccaaagagatgttcgaaggtagtatgtcccagctgtgctgccagaaaaaagtatcctaaatggtttcagctaaagtatttgttattggtatcaatgactgctttcagcttctacttttgtaccaaaattaggtttttttttaaaactgaccaaactattaatttacaccgactatcacagctatttagattgcagctaggctggatatgtactactgcattattattctatttttacgatgcgttgatattacatagcgggttcattgaagggtatagatgtgtcaatggaaagggagcgatgtctgaaggtaaaaccgggcaattaaattga

SEQ ID NO: 1020 - DNA, 612 bp, Saccharomyces cerevisiae
atgataaatgagtacgttgccagaaaggtcgctctaaaggacatgcaaccatgtgcgatctgtagcaaaccatccactaccgtcctttacaacgcatctggtccagattggctatatacatgcgaaatacatttacaagataatccacaatttgtcattcccctctatagtacagagtataatgaagccgtggctcaattaaaactagtaaaggggaaaatggatagtctgacatcagctcaaacccaattagggtcctgggatggttgggttactaaaatattctccaagaaagaaaaggagacaaataactctaaagaccctgatccaactacaaccgactctactgatacatctccacaggctaagaacgatgcagaaatcttgtcagaaacaaagaaacagtacagcaaaatacttgacaaagttacagaactgcaaaggaaaaacagaaaatacgaactagcaaaaatcatgtttgaaagcagactcctaagaaaaagaacagaacaagtaaatcgcgaacgatacctcaaggagcaagagaattactctaatacggatcctgaagaactgcttcgaaaacacgtgttcccctccgttccaaaataa

SEQ ID NO: 1021 - DNA, 612 bp, Saccharomyces cerevisiae
atgcttagaaataccattgcattaagatcatttatcagaacacagtcgacgcgcccatatcctgtaaatgtagaggcagtctactatgctcctttaaagttacctatcaaatatggtgatttagttgcagacattcagttaagatcgtatgacaatgaaaacctcgatttttattcagacttcatacttagaacaggttactatttgggtatcccattgacaggtcctaaacctttgcccacgagaagagaaaggtggactgtaataaaatcacctttcgtgcacgctaaatccaaagagaattttgaaagacatacacataagaggctcattagggcctgggatacgaaccccgaagtgctacagatgttgatagcttacattacgaagcactctatggcaggcgtcggaatgaaatgtaacttctttcaaaggtccgaaatatcgctggacttgggttcggacgccaatggcctcgaaaaatcactaagcaatatcgatgaattgtattctctgagaaacgatgataaagctcaaactagtgctgtcggacaaaaagtattggaactattggatagccccgattttaaaaaacatttggaaaagaagtaa

SEQ ID NO: 1022 - DNA, 612 bp, Saccharomyces cerevisiae
atggacaaagcatttgacgaaattattggaaatagtcacacagacagctcatctaatcataaggtaacgagataccgcagaagggatttaagaaatgaattaggacctagactgggatttgcgccttcggatgctgcatcaaggtcgaaagatcgcctttatagagagagggaagagcctcctttgcctaagagaattagaatatccaaaatcccactagacgtttctgactacaccctcgatgatatgattaaagagtttggctcgccaatattttcgaaaatttttgacaataaagaggatcgtacatgtatttacgaatttgaagacccagaagttttggaaaagattgtcgagcgttataatggacatgagttacataatgcaaaaattgaagtggagatttaccaaccacagagaaagcattctagaatgaatgcccacaaccgtcgcaaacagacggctcaagaacacggaagaggcaggccagggagccattatcgccaaaagcctaacagagtctccaaaaagaacaagggccgtgagaagaataacactcctacttctgtcgaagctcttgacgctgaattagatgcttacatgaaaggttaa

SEQ ID NO: 1023 - DNA, 612 bp, Saccharomyces cerevisiae
atggaggattcgagattgcttatcactttgattcttgtgtttggagttatatttctgaaaaaattcttccaaagtaatcagcatccctcagcacaacgcttatccgctacaggtgtaaacgcacacggacgtcctcagggctccacgcagaatgccttgagaaggactggtagagtcaatggaggtcaccccgtgactactcagatggtggaaacagtgcaaaatctagcccctaacttacatcctgagcaaattaggtatagtttggaaaacacaggctcagtcgaggaaacagtggaaaggtacttgcgtggtgatgaattcagctttccacctgggtttgagccctccagggcgccaatgggggccaatgcggctgttgataataacgctgctggtggcggagagtttaacgatcccagaaagaagaacatgatttgcgctgagaatctactcgataaattccatgtggatctcaatgaagatatgagtaacttaagctttaaggacttagacattgaagagagaaagagattgttggtttggcaagccagaaagaatttggagacaaaattgcaaagtgataaagatttgcaaagtttgctgacttga

SEQ ID NO: 1024 - DNA, 612 bp, Saccharomyces cerevisiae
atggcctcatttgctactaagtttgtcattgcttgcttcctgttcttctcggcgtccgcccataatgtccttcttccagcttatggccgtagatgcttcttcgaagacttgagtaagggtgacgagctctccatttcgttccagttcggtgatagaaaccctcaatccagtagccagctgactggtgactttatcatctacgggccggaaagacatgaagttttgaaaacggttagggacacgtcgcacggtgaaatcacattgtctgctccatacaagggacatttccaatactgtttcttgaacgagaacaccggtatcgagacaaaagacgtgactttcaacattcatggggtggtatatgtggatttggacgacccaaacaccaatacattggatagtgctgtcagaaagttgtccaaattaaccagggaagtcaaggacgaacaaagttatattgttattagagaaaggacgcatagaaatactgcagagtcgaccaacgatcgtgttaaatggtggtccatcttccaattgggcgtcgttattgcaaactctcttttccagatatactacttgagaagattctttgaggtcacatctctagtctaa

SEQ ID NO: 1025 - DNA, 612 bp, Saccharomyces cerevisiae
atggctattgttataaacaaaagaaacgtgagagtcttggtaataactaatttactgctcattgttgtgttttttgtgttaaggaattcgaatgctagcgtcaacgaaagtattactactcaccatcctgattcattggtgacgtttgacaattcaggaaatgcacctggcactcaccaatctgtccatgatacagtaaatacacaagataaggaagccgaagaagttgataaaaatagtggggacgctgaatttgatgccgctgcagaatacaacaaaataatggaacagtcacccatgattgtatttagcaagactggctgcccatatagcaaaaaactgaaagctttgttgactaattcgtacacgttttctccatcttactacgttgtagaattggataggcacgaacacacaaaagaactacaagaccagattgaaaaagtcactggtaggagaacagtcccaaacgttatcatcggtggtacttccagaggtggttatactgagatagcagagttacataaaaatgatgaacttctagactctttcaaaaaatggagcgatggggcgtttactgtaaaagctaattcgcaatctgagagtgcctag

SEQ ID NO: 1026 - DNA, 612 bp, Saccharomyces cerevisiae
atggctcaagccttgaactccaccaatattgcttttttcagagtagcatttttattcacgatcgccttcttttgtttaaagaacgttaattctattttgcaaaatacatatttcatagtcttaacgcaagcgatgaatttaccgcagttaacactgtcacgttatagtggtcaattgggtcttttcgctcttctgtttactcttaacggtgttcatgatctaattcccctgttagaaaacaatgttaaatacttccaatctgttgtgccagttagattactaattttttttattttgacaagtatctcgtacctttgggagtcaaacttttacgttcacaataactctgtttttatttactgttttgcagaagtttggataaattttcttttgtataatgccattagggaggagaaaaatgaagagttcaaaagattgaaccaattcatggttaatgatgaggatattgaagaaccccaaccatttaccgtgaagactgaaaccacagaaatcattgaaataatcaatgatgaagaaaatgacgatgaagatgggaaagataatgatgataacaatgagaaaggtaatgatgatagcgatgcaaaaaaataa

SEQ ID NO: 1027 - DNA, 612 bp, Saccharomyces cerevisiae
atggtttcgataagaaggtatttgcgagtgccgaatgagttgaaaccttcccagatcttcaaacaagattctctctctccaagtaagattggacttcaaattgttcttttacagattttttattacaccacagcgatcgttcttttttattgttgggcgaagctagcgggatatgatctcaatatcaaggaatggctgttttcttgggagaatatcgactttacgaacgcatacggtttatcaatctcactgttatggcttctggattcattaatatgtgtttttttcttaactgttatcgttggacggagtaaactcgcatgggattttgctatcactatacatgccatcaattttattgtggtgttcctctatactcggaaatttccttctttttcttggttttttcttcaaattttatcatctttaatactaatatttttggggacatggacaacaagatggagagagcttagagacaccttttttgagggcttggttgatcctaatgaaggagaagttggattggttacgcctagtcagcagcatagtaatcattcagaattggagcaatcaccaatacaactaaaagacttagaaagccaaatatga

SEQ ID NO: 1028 - DNA, 612 bp, Saccharomyces cerevisiae
atgtcagcagaagattacaagaacttaccagtcaccgttgaaaagcctatcccagtggtatacgatttgggtaacctggcagcattcgatagtaatgtcttggataaaaacgatttagattcttcgaatgctaggcgtgaagaaaagataaagagtcttactcgtgataatgttcagttactaatcaatcaactattatcactacctatgaaaacaacaacggagtctgtaggtggcaccggcggtcaaagttccgtgatgaccttgttgcagcttcctgaccctaccactgacttaccaagagaaaagccactgccaaaggctaaggctatgaccaaatgggagaagtttgcagctaagaagggtattaaaccaaaggaaagggcaggaaagatgatttatgatgaggcatccggtgaatgggttccaaagtggggctacaagggcgcaaataagaagttagatgatcaatggttggtggaagttgatgataaagtaaaaggcactgacaatgaattgatcgatccaagaactttgaatagggcagaaagaaaacgtttagtcaagaagaacgaaaaacaacaaaggagaaatatgaagaatgccttatga

SEQ ID NO: 1029 - DNA, 612 bp, Saccharomyces cerevisiae
atgtcagttgaagaaaaaaagcgcagacttgaagaattgaaagatcagaatgtggtgcttggacttgcaatccaaaggtcacgactttcggtgaaaagactcaaattagaatacggtgttttactggagaggttggaatccaggatagaacttgatcctgagttaaactgtgaggatccattgccgactctggcctccttcaaacaggaactattgacgaagccatttcgaaaatctaaaactaaaagacacaaagtaaaggaaagagatccgaatatgcccaagaggcccacaaatgcatacttattgtactgtgaaatgaataaggaaaggattaggcagaatggctctctggacgtgacaagagatctggcagaaggttggaaaaatcttaacgaacaagataggaaaccgtactataagctttatagtgaggacagagaaagataccagatggaaatggaaatatataataaaaagatatctaatatagatgcggatgatgataaagaagagaatgaacagaagataaaaaataacgaggaaggatcatctacaaaagtagctgattctaaaggaggtgaagatggaagtttagtttcctctaactaa

SEQ ID NO: 1030 - DNA, 612 bp, Saccharomyces cerevisiae
atgtcattatattacaccttggtttttgccattctagtggtggagattttcatgttctccattctagccctaccaatcccttctagataccgtaggcctctcaccttactgttattaaagccgttcaaatcctccacagtgcaagttgcgatcaagtgtgtacttgggttcattcttttgcttttcatcgattgtatcaacagagtgtacagcatcgacaaagagctgcagttaagtagcgcctctcaaaataatggcgctataatcgctcaagatagaattgaggttctttctaggaaattctttgcccaaaggaatatgtatttgacaggtataactttgtttttgacctttgtcgtcgttaggacttttgggctagtcatagaacttttaaccatgaaagacatatacagagcatcgcctccagtagcctccagcgatgtcaagaagaacgactctgttactgccgaagctgctgctcaatccggcgcttccaaggatgaccacggcgatgagaaaaattttgaactattgaagaaaattcaggacatcgatgacgaaattgcacgtttaaaggagaagtcggaatcgttgcaagaagaaataaattag

SEQ ID NO: 1031 - DNA, 615 bp, Saccharomyces cerevisiae
atgaaactcaatgaacaaataccaaaagacctgttacgcctgattaaaagttccaagtatgttcatgtggcgacatgctcgtcaaattgtataccatctgtttcgttgatgcattacatatttgtttcatccgcggaaactttccataaacatgagtatagtatagaaatagattgtaatgactatattatattcacagtgttcgagaaatcagtaacctttcgtaatgtcatgagcaacccaaacgttgcattgctatttcacgattggatcacagctaaaaatttaactcttcgaaaaaaaagcgtccatagtaaagatgatttttcatttgttgagtcagagtctacaaaatttaacaactttttacgagatttgaaccaaagtgaattgaatcaagtgagcgctactatcaatggtattgctgatattgtgaaccctaatagtgaagaatctacttattataggcggttgttattaacagtcaatccagacgcagatatttttatactaggagaagatacagccataataaaggtaaatatacaaaaaataaaagtctctgacatggaaaataatacttctacatacggccaaacagtacaaccagtttaa

SEQ ID NO: 1032 - DNA, 615 bp, Saccharomyces cerevisiae
atgaaattctcttccgctttggttctatctgctgttgccgctactgctcttgctgagagtatcaccaccaccatcactgccaccaagaacggtcatgtctacactaagactgtcacccaagatgctacttttgtttggggtggtgaagactcttacgccagcagcacttctgccgctgaatcttctgccgccgaaacttctgccgccgaaacctctgctgccgctaccacttctgctgccgctaccacttctgctgctgagacttcttctgctgctgagacttcttctgctgatgaaggttctggttctagtatcactaccactatcactgccaccaagaacggtcacgtctacactaagactgtcacccaagatgctacttttgtctggactggtgaaggcagcagcaacacctggtctccaagtagtacttctaccagctcagaagctgctacctcttctgcttcaaccactgcaaccaccactgctgaaacttcttcctctgctacatcctctagcaccgctgaattatctagttacaccggtgctgctgatgccatcaccgctggtactggtttgatgggtgctgcccttgctgccgtcatgttattgtaa

SEQ ID NO: 1033 - DNA, 615 bp, Saccharomyces cerevisiae
atgaagttctcttctgttactgctattactctagccaccgttgccaccgttgccactgctaagaagggtgaacatgatttcactaccactttaactttgtcatcggacggtagtttaactactaccacctctactcataccactcacaagtatggtaagttcaacaagacttccaagtccaagaccccaaaccacactggtactcacaagtacggtaagttcaacaagacctccaagtctaagaccccaaaccataccggtactcacaagtatggtaagttcaacaagacttccaagtccaagactccaaaccataccggtactcacaagtacggtaagttcaacaagacctccaaatccaagactccaaaccacactggtactcacaagtacggtaagttcaacaagacctccaagtctaagaccccaaaccataccggtactcacaagtatggtaagttcaacaaaaccaaacatgacactaccacttatggtcctggtgaaaaggcccgtaagaacaatgccgcccctggtccatctaatttcaactccataaaattgtttggtgttaccgctggtagtgctgccgtagccggtgccttattactattataa

SEQ ID NO: 1034 - DNA, 615 bp, Saccharomyces cerevisiae
atgaatagcggtggtagtgatagtttcgattatcttcttcaattaacaaaagctttaagtgcagagtgtcgggctaacagacaagagaccgatcgaatagaactattgttaaagcgccttgccaaacagtcaggaatatcttatgataatttgagcaaaaacataattccagattcatggaaagataatgcatctcaaaaagcatctccccccactgaggcacagaagcttatcagcgaaaattttaaactcatatacgagattgaaaaacaagagtacttcaatacaaaggctgttgcgctaattaacaacataaatgagcatttctcatatattaaaaattttatcgacgaacagaatgcaataagagaacgaaatattgccacattttcatcagagaagcttgatgaaaggaacaaaagtcttcaacaaaattacgagtcattgaagacagaaaatgaagaaacaaaaaaaaaattgcattcaattatcaaacagtttgaaaaacttttgaaggaagtggattgggatcgtatatctaaagattccagagattacagccgctttaaaaaacagttggaatacctgcaagacacgtaccaggtactgaaatag

SEQ ID NO: 1035 - DNA, 615 bp, Saccharomyces cerevisiae
atgacagctgccactacatcacagccagctttctcgcctgaccaagtttccgtgatcttcgttctaggaggacccggtgcaggcaagggtactcagtgtgaaaaactagttaaggactattcatttgtccatttgtcagccggagaccttctacgtgctgagcagggcagagcaggttcccaatatggggaattgatcaagaactgcatcaaagagggccagattgtccctcaagagattactttggcgcttttacgcaacgctatttccgataacgtcaaggcgaacaagcataagttcttaattgacggatttcctaggaagatggatcaagccatttcctttgaaagagacatcgttgaaagcaaattcatcctgttctttgactgccctgaagatatcatgttagagagactattggagcgtggcaagaccagtggtagaagcgatgacaacattgagtccattaagaagagatttaacactttcaaggagactagtatgcccgtcatcgagtactttgaaaccaaatcgaaagtcgtccgtgttcgttgcgacagatccgtcgaagatgtgtacaaagacgtccaagacgctatccgtgatagcttatag

SEQ ID NO: 1036 - DNA, 615 bp, Saccharomyces cerevisiae
atggcaccaaagaaaccttctaagagacaaaatctgagaagagaagtcgcaccagaggtgtttcaagattcacaagctaggaatcaactagcgaatgttcctcatcttaccgaaaaatctgcccagcgtaagccttctaaaaccaaggttaaaaaagaacagtctttggctagactttatggtgcgaagaaggacaagaaggggaaatattctgagaaagacttgaatattccaacactcaatagagctatcgttccgggtgttaaaataaggaggggaaagaaaggtaagaaattcattgctgataacgacactctgactttaaaccgtttaataacaactattggtgacaagtacgacgatatagctgagagtaagcttgaaaaggctagaagattagaagagatacgagaattgaaaagaaaggaaattgaaagaaaggaagcgcttaaacaagataaactagaagaaaaaaaagacgagattaaaaagaagtcttctgtcgcaaggactatacgtagaaagaataaacgtgatatgttgaaaagtgaagcaaaagctagtgaaagtaaaactgaaggaaggaaggtaaaaaaagtctcatttgctcaatag

SEQ ID NO: 1037 - DNA, 615 bp, Saccharomyces cerevisiae
atgggagcctacaaatatttagaagaattagaaagaaagaagcaatctgatgttttgagattcttgcaaagagtcagggtctgggaatacagacaaaaaaatgtcattcacagagccgctagaccaactagaccagacaaggctaggagactaggctacaaagccaagcaaggtttcgttatctaccgtgtcagggttagacgcggtaacagaaagagacctgttccaaagggtgctacttacggtaagccaactaaccaaggtgtcaatgaattgaaataccaaagatccttgagagctaccgctgaagaaagagttggccgtcgtgctgctaacttgagagtcttgaactcctactgggtcaaccaagactctacttacaagtacttcgaagttatattggttgatcctcaacacaaggctatcagaagagatgctcggtacaactggatctgcaatcccgtccataagcatcgtgaagctagaggcttgactgccaccggtaagaaatccaggggtatcaacaagggacacaaattcaacaacaccaaggccggcagaagaaagacctggaaaagacaaaatactctgtcgttatggaggtatagaaaatga

SEQ ID NO: 1038 - DNA, 615 bp, Saccharomyces cerevisiae
atgggcaatgtgtctgtggcagtgggaacggcagttgggattccaattgctgtgggcgtaataatagccctgatattttggtgtaaattacaacgacgttacaaaaaagaagagattagagatgctgatttggagaagatggtaatggaagaagtggcagtgtcggtatatgatggttttaaagccgaaattaacagctcaagtgaagcttccacgataaacgaaaaggaagcaaaccaggatcttaaaccctgccaagaaaaaaccgccaaggcagggtacacaccagcatacagaaggcaattgaacgctagtatggggactttgcgtccaaaaaagcagagcactgcatataccaatgtccccgtcattttcagcggcgaaaaggtgaattatgggatggtcagagatccttcctatagttttatgtatccactgacgctatcgcgcaaagaaacgagtagtttgagatcagcttctacgtcaaacttgtcatcgagcacagaaaatactgcgttacacgaagaaataaaactggatgacccatatgaaaacgattttacgaattatactgtcaacaagagagaatttattgacagcttacggccacactaa

SEQ ID NO: 1039 - DNA, 615 bp, Saccharomyces cerevisiae
atgggtgcctacaaatatttggaagaattgcaaagaaagaagcaatctgatgttttgagattcttgcaaagagtcagagtctgggaatacagacaaaagaatgtcattcacagagccgctagaccaactagaccagacaaggctagaagattgggttacaaagctaagcaaggtttcgttatctaccgtgtcagagttagacgtggtaacagaaagagacctgttccaaagggtgctacttacggtaagccaactaaccaaggtgtcaatgaattgaaataccaaagatccttgagagctaccgctgaagaaagagttggtcgtcgtgccgctaacttgagagtcttgaactcctactgggttaaccaagattctacttacaagtacttcgaagttatcttggtcgaccctcaacacaaggctatcagaagagatgctcgttacaactggatctgtgacccagttcacaagcaccgtgaagctagaggtttgactgccactggtaagaaatccagaggtatcaacaagggtcacaaattcaacaacaccaaggctggtagaagaaagacctggaagagacaaaacactttgtccttgtggagatacagaaaataa

SEQ ID NO: 1040 - DNA, 615 bp, Saccharomyces cerevisiae
atgtcacgtaattctgcagcaggtttggaaaacactcttttccaactaaagtttacatcaaaacaattacaaaagcaagccaataaagcctcaaaggaagaaaaacaggaaactaataagctcaaacgtgctcttaatgaaaatgaagatatatctcgtatatatgcatccaatgctataagaaagaaaaatgaaagattacaactgttgaagttggcatcacgggtggattcggtcgcatcaagggtacaaaccgccgtcacgatgaggcaggtgtcagcatcaatggggcaagtttgcaaaggcatggataaggcgttacagaatatgaacctccaacagataaccatgataatggacaagttcgaacagcaattcgaagatttggacaccagtgttaacgtatatgaagatatgggtgtgaattcggatgccatgctggtggacaacgataaggtggatgaactaatgagcaaagttgctgacgaaaatggcatggaattgaagcaaagtgcaaaactggacaatgttccggagataaaggcgaaagaggttaatgttgacgacgaaaaggaagacaaacttgcacaaagactaagagcattgaggggctga

SEQ ID NO: 1041 - DNA, 615 bp, Saccharomyces cerevisiae
atgtttcacagacgcaaaagaccttataacaccagaaattatggccatgatgacaagaaattcaaatcgcagtacatcgatattatgccagacttcagcccttccggtctgttagagctggagtcgaataacaaagaaggtatagctttaaaacatgtggagccgcaggacgctatttctccagataactacatggatatgctaggactggaggcgcgagataggactatgtatgaactagtgatatacagaaagaatgacaaggataaaggaccgtggaaaagatacgatttgaacggcaggagctgttatttagtcggtcgtgaactgggccacagtctggatacagatctcgacgatagaacggagatcgttgtcgcagacattggtatacccgaagaaacatcctcaaagcagcactgcgtcatccagttcaggaacgttcgtggcattttgaaatgttatgtaatggatttggattcgtccaatgggacatgtttgaacaacgttgtaattcctggagcgagatatatagagctacgaagtggtgacgtccttacactttcagaatttgaagaagataacgattacgaactcatcttcatgaatgtataa

SEQ ID NO: 1042 - DNA, 616 bp, Saccharomyces cerevisiae
atgagaatagtgccagaaaagctggtgttcaagggtatgtttgacgagaattgctagtgtgcgggaaactttgctaccttttttggtgcgatgcaacaggttactaatatgtaatacttcagctccccttaataaacaatcaacagagtatataaagctcgagaacgatggtgaaaagagagttatatttaaagtgaggactagtgctcccacaaagtattgtgtgaggcccaatgtggccatcataggtgctcatgaaagtgtaaatgtccaaattgttttccttggattacccaagtcaaccgctgacgatgaaatggaccaaaaacgagacaaattcttgatcgttacacttcctatcccggcagcttaccaaaacgtggaggatggcgagctgttgtccgattggcctaatctggaagagcagtacaaagatgacatagtcttcaagaagatcaaaatatttcactccgtgttaccgaaaagaaaaccgtctggaaaccacgatgcagaatcagcaagagcgccatcagcaggtaacgggcaaagtctgagttccagagcattgcttatcatcaccgttatcgcattgctcgtcggctggatatactactga

SEQ ID NO: 1043 - DNA, 618 bp, Saccharomyces cerevisiae
atgaaattcagtggcttgtggtgttggttgttattattccttagcgttaatgttattgcatctgatgtgggtgagttgattgatcaggacgacgaagtaattacacaaaaggtgtttttcgatattgaacatggtgaagagaaagttggcagaatcgttattgggttgtacggaaaggtatgtcctaagacggcgaagaacttctacaagttaagcaccaccactaattccaaaaaggggttcatcgggtccactttccatagggtgattcccaacttcatggtacagggaggggacttcacagacggcactggcgttggtggcaaatccatctatggagatactttccctgacgaaaactttactttgaagcatgatcgcaagggcagactatcgatggctaatcgtggtaaagataccaatggatctcagttcttcatcaccactacggaagaagcgtcgtggctcgatggaaagcatgtggtatttggacaggttgtggacggcatggatgtggtgaactacatacagcacgtgtccagagatgcgaatgacaaacctctcgaggcggtcaagatcgcaaaatgcggtgagtggacgcctgagctctcttcttga

SEQ ID NO: 1044 - DNA, 618 bp, Saccharomyces cerevisiae
atgagcacacaatatattgatgagacagcatttgttcaggctgagcaaggtaaaaccaatctaatgttctctgacgaaaagcaacaggcacgttttgagctcggtgtttccatggttatttataagtgggatgcgttggatgttgccgtagaaaacagttggggtggtccagactcagctgagaagagagactggattacagggattgtagtagaccttttcaaaaatgaaaaagttgttgacgccgctttaatcgaagaaacgttactttatgcaatgatagatgaatttgaaactaatgttgaagacgactcggctttaccgattgccgtggaggtcatcaacatatataacgactgtttcaatttaaattataataaggtagaaaaattgtatttggaatggcaagaaaagcagagaactaaaaaatcaaaaagagttgtgcatattgagggtgatgatgatgaagacgatgaagatgtagaggactatgatgacgaagatgaagatgaagagatggacgaggttgtacctgacttagtatcgtctaaacctgaaccaattgttgacgaagacggttttgaattggttcaaccaaaaggaagaagaaagcactag

SEQ ID NO: 1045 - DNA, 618 bp, Saccharomyces cerevisiae
atgagtttcagaggaggtaatagaggtggccgtggcggcttccgtggcggctttcgtggtggacgtacaggcagtgctagatcatttcaacaaggaccaccagacactgttctagaaatgggagcttttctacatccatgtgagggtgatattgtttgccgttctatcaacactaagattccatatttcaatgcgccaatatatttggaaaacaagactcaagtcggtaaagttgacgaaatattgggtccattaaacgaagtatttttcactatcaagtgtggtgacggtgtccaagcaaccagttttaaagaaggtgataaattctacattgccgctgacaaactattgcctattgaaagatttttacctaagcctaaggtggtaggcccaccaaaaccaaaaaacaagaagaagagaagtggtgccccaggtggccgtggtggtgcttcaatgggtcgcggtggtagcagaggaggtttcagaggaggccgtggtggtagttctttcagaggaggccgtggtggcagttctttcagaggtggatctcgtggcggatcatttagaggaggatctcgtggcggatctcgtggtggtttcagaggaggtagaagataa

SEQ ID NO: 1046 - DNA, 618 bp, Saccharomyces cerevisiae
atgcaacgtacgagggaattggaatcgagtgtcgcaatagaccaaactgaagtaccccgatctagattttttataatggttaaaaaattatcaagagttgccgatatcgtctatatagttgacacatttctaattccgccattgcatcctttaaagaagcagcatccaaaagttgcaaagtttttgaaggtacaacttgtctttgatttgatatcactgtttatttttgctacgcaccaactcctactgctagaagatggtaactttgggaagcactacttcaaaaggaaaacaaaacggtgctcgaaattttcgtgctctcgctgtaatgcaaacgctcaccaccccaagtggttcaaattcaaacattcactcctatgtctaggaacgttctgttttggggtttattcgttggtaaagattaataagttctttaaaactgatcagactgttgatctaaacagactcttagagctattcttttggcaacttaatgcaattcttaatatgaagttattcgccttttacggggaccatttagaatcacatagtgcgcctcttgatgtgtatgaggattcttttgcaaacaaatcatcgtcaggcggtgacgaggtttaa

SEQ ID NO: 1047 - DNA, 618 bp, Saccharomyces cerevisiae
atgcgttggtggccgtggtcaaatcagacagaagatcaaaagcagcagcaacaaccgcagggtaaagcagatggtgatcgcgtgctgacaaattactcgcggggtcaaaagatcctcttagaagacactccacccaagtttgccgatgacttgtccaattctcagttggccaagaagcaagaacgggctactttgaaagaggcttgggactcgatcagatggagtgattttagtttgcagaagctgacttcaatcccgtgcttcagagacgcgggcatgctcgggttttccagcatgttcttgatgggatctattatatttatataccataagagcccgactaaggccacgaattgggcgatgagctctctgatactgggctcgattgtcggatgggagcaatgtaggctaaagagacaaaaaagtttccagatcgcacaattggcaaaggaaaccgtggcgaaaaaggaaaaaccaatgctccataatgtccctcatgacccatctctgccggggcaatgggaggccgccaaaaatgaaaagcagagtcagtttgaacaaagtaaccagaatttatctcaggcctcctctgagaagaaatggtacaagttctggtga

SEQ ID NO: 1048 - DNA, 618 bp, Saccharomyces cerevisiae
atgcttgtgcggctgttgcgtgtgattttattggccagcatggttttctgtgctgatattttacaattaagctattcagatgatgcgaaagacgctatacccctaggaacatttgagattgatagtacatccgatgggaatgttacagtaacaaccgttaatatacaggatgttgaagtttctggagaatactgtttgaatgcccagattgaaggtaagctggatatgccatgttttagctacatgaagctgaggacaccactaaaatacgatttaattgtggatgtagatgaagataatgaggtcaaacaagtgtcgttatcatatgacgagactaacgatgctattactgctacagtcagatatccagaagcgggacctactgcaccagtcaccaaattaaagaagaaaaccaaaacttatgctgataaaaaagctagtaagaataaggatggaagcactgcacaattcgaagaagatgaagaggttaaggaggtgtcttggtttcaaaagaactggaaaatgttacttttaggcctattgatttacaattttgttgcgggctcagcaaagaagcaacaacaaggaggtgccggagctgatcaaaagactgagtaa

SEQ ID NO: 1049 - DNA, 618 bp, Saccharomyces cerevisiae
atgtcggatccaagttctattaacggtggtatcgtcgttgcgatgacaggtaaagactgtgtggccattgcctgtgatttgcgtctcggaagccagtcactaggtgtgtcgaacaagtttgaaaaaatcttccactatgggcatgtgttcttagggattaccggtctggctaccgacgtgactactctgaacgagatgttccgctacaagacgaacctatataagttgaaggaagaaagggccattgagcctgaaacgtttacccaattagtgtcaagttcactttatgaaagaagattcggtccatactttgtggggccggtggtagcaggtattaattccaagtccgggaagccctttattgcgggattcgacctaatcggctgtatcgacgaggccaaggattttatcgttagcggtactgcatccgaccaactgttcggtatgtgtgagtccctgtacgaacctaatctagagccagaagatcttttcgaaactataagtcaggccctactgaatgctgctgaccgtgacgctctatcaggctggggagctgtagtatacatcatcaagaaggatgaagtggtgaagagatacttgaagatgagacaagattga

SEQ ID NO: 1050 - DNA, 621 bp, Saccharomyces cerevisiae
atgaaggagtcagtccaagagatcatccagcaactcatccacagtgtcgatttacagtcttccaagttccagctggccattgtgtgcacgatgttcaatcctatcttttggaacatcgttgcaagaatggaataccacaagcattctctcaccaagatgtgtggtggggccagaaagggctgttacatgttggcggcgaccatattttcgctaggtatcgtcagagacatggtgtacgagtctgcattgcgtgaacagcctacgtgttctctgatcacgggcgagaactggaccaagctgggtgtggctctctttggtttggggcaagtgcttgttttgagttccatgtacaagctgggtatcacagggacgtacttgggtgactatttcggcatcctgatggatgagagagtcaccggcttccccttcaacgtttccaacaaccccatgtaccagggttccactttgtccttcttgggcatagccctttacaaaggaaagcctgcggggctggttgtttctgccgtagtttacttcatgtacaagatcgctcttcgttgggaagaaccttttactgccatgatctacgctaaccgtgataaggccaaaaagaatatgtaa

SEQ ID NO: 1051 - DNA, 621 bp, Saccharomyces cerevisiae
atgaatagcgagtacgattacctgttcaaactgctgttgatcgggaattccggtgtcgggaagtcctgtttacttttgaggttttcggacgacacatataccaacgactacatctccacaattggagtggacttcaagattaagactgtagaactggacggcaagactgtaaagctacagatttgggacactgcaggtcaagaacgtttccgtactatcacttcatcttactaccgtggttcgcatgggatcattatcgtgtatgatgtcactgaccaagaatccttcaacggcgtgaagatgtggctgcaagagattgatcggtatgcaacctcaacagtgttgaagctattggtaggtaacaagtgtgatttaaaggacaagcgtgtcgtggaatatgacgtggcaaaggaatttgcggacgcgaataagatgccgttcttagagactagtgctttggactccaccaacgtcgaggatgcgtttttaaccatggctagacaaatcaaggaaagtatgtcccaacaaaacctgaacgaaaccactcagaagaaggaagacaaagggaacgtcaacctgaagggacagagtttaaccaacaccggtgggggctgctgttga

SEQ ID NO: 1052 - DNA, 621 bp, Saccharomyces cerevisiae
atgagtttatactttacgacattatttttattgctcactgttgagatggtaatgctcttcatcttcgttttgcctttgccattccggatccgtaggggtatttttagcacctataaccaattgacagcgaagcagcaaataaaaactataatctttataacgggttgtcttgttggcctgttgtttattgattcatggaaaaggtctcaaattcgtgtttcattataccacaacgacaacagtggctcaatcgggtcatctgctgtaactccaatacaggcactagcatcaagagcgtacaatcaaagaaatatgtatatttccgggttcatattgtacttttctatctgtatcccaactgtcatgtctattgtcaagagactggtgaaataccaaggcttaatcaacgaacaagaaaagcaaaaattgaacaaaccttcctcaaacagcaagaaagactcaaatgaagctgattccaccaaacttcaagaggaactaaggaaaaagcaaatttctctggagggcctacaaaagcaagtcaaaaacctggagaaatattttgatgagaagaatcaacctggaaatgtagcagctgctgaagcttccaagaaaggaaactaa

SEQ ID NO: 1053 - DNA, 621 bp, Saccharomyces cerevisiae
atgagtttcctaaacatttttacttttttcagcgtccttgtgtctgttgcaacagccgtcagatttgatttgactaacgtcacttgtaataacctacatggacctcactgtggtacctacgttatggaagtcgttggccaaaatggtacatttttgggtcaatctacgtttgctggtgccgacgttttaactgaaagcgctggtgacgcttgggcaagatatttgggccaggaaacaagattcctcccaaagttgactactattgctagcaatgatacgaagaacttttctccactaatcttcaccaccaatatctacacttgtaaccctcaatccattggtgatgctatggttccttttgctaacactgttactggtgaaattgaatacaactcttgggcagacaccgctgataatgcttccttcataaccggtttagctaaccaattgtttaactctactcagtatggcgttcaagttgcttcctgttacccaaactttgcttctgttattttgagcaccccaactgtgaacattttcgctgcgaatgagacattaccagattattgtaccgccatccagttgaaggccgtttgtccaccagacgctggttttgcttga

SEQ ID NO: 1054 - DNA, 621 bp, Saccharomyces cerevisiae
atgagtttcctaagcatttttacttttttcagcgtccttatttctgttgcaacaaccgtcagatttgatttgactaacgttacctgtaagggcctacatggacctcattgtggtacctacgttatggaagtcgttggtcaaaacggtacatttttgggtcaatctacgtttgttggcgccgacgtcttgactgaaagcgctggtgatgcttgggcaagatatttgggccaggaaacaagattcctcccaaagttgactactattgctagtaacgagacaaagaacttttctccactcatcttcaccaccaatatcaacacttgtaaccctcaatccattggtgacgctatggttccttttgctaacactgttactggtgaaattgaatataactcttgggcagacactgctgataacgcttccttcataaccggtttagctaaccaattgttcaactctaccgattatggcgttcaagttgcttcctgttacccaaattttgcttctgttatcttaagcaccccagctgtgaatattttcggtaaggatgacacattaccagattattgtaccgccattcagctaaaggccgtttgtccaccagaagctggttttgattaa

SEQ ID NO: 1055 - DNA, 621 bp, Saccharomyces cerevisiae
atgatgccctacaacacccctccaaatatccaagaacctatgaacttcgcaagcagcaacccctttggtattattccagatgcgctcagtttccagaatttcaaatatgatcgtcttcagcagcagcaacagcagcagcaacagcagcaacaaaatcgcactgcgtcatcgttacagcagccgcaacagcaacaaccaataagcccgcctttgtttttagtaggggccggtaccagcgaaaactcaaaccttaacaagaatgccaacactagtactatccctcctttactctttagcagatcgtctcagcattatgttgtcccagatatagaccactcctccataatatacaagaacaacatctgcaaatctttcaaagatgacttatttttctgtccaagatctttactttctctcgaagaacaacaagcatgcgagaaaatggataggctgaccgctgaacaaatgtcattgtatcatcagaacacgcaatccagttctaatcctggttctatgtcttcttcacctccaaattctgcttcttctatattcaactctaggccgaagttcaatccttatacatctcaaagttttaatcctttggaaagtgttcaagaatga

SEQ ID NO: 1056 - DNA, 621 bp, Saccharomyces cerevisiae
atgattttattaaagaggacaaaaattaggggcgtcagcgtctcttttgtaagcttgcaaagaaggactcacagcagactggtgaaccccataaggcagcaacatcaacaaattaccaagcaaaggagttcaaagattttaaagaatgcgcatttctatgactttagatcgctgcccaaagtacctactacacagtatttggaagctagggagctcacccgcgatattctgtatagcggatacaggccagtaatgtacccagtgaaggaaaacccgctattcagagataagaagagaaagtccttgcaaacgttattaacaatgaacgagaaaacaaacgcagaggcgaagacgatcgatgagaaaaagcacaagaacatattgtttggtgaacgtggcactggtggtataatgtcaggtggcgtgaacggtacatggaagtacaatcccaccgtacccaatgagctgttgccattcaattggtggtctacgtccagtatgggtatggaatattttcctgaatggaaaaacgtgcccccatatatgatgagaaagttgaagccgtttgacaaggcactgcaaatgcggttgacacacaaaagcaaaaaaaagatgaaataa

SEQ ID NO: 1057 - DNA, 621 bp, Saccharomyces cerevisiae
atgcctagtcatcgcaattcaaacttgaagttttgcacagtttgtgcatcaaacaacaatcgttcaatggaatcgcataaagtcctgcaagaagcaggctataatgttagctcttacggaacaggttcagctgtgagactgcctggtctatcgatagataagcctaatgtgtactcatttggtacaccctataatgatatatataatgatcttttatcacaatcagcagaccgttacaagtcgaacggtttattgcaaatgctggatcgtaatagaagactcaaaaaagcacctgaaaaatggcaagaaagtacaaaagtcttcgacttcgttttcacttgtgaagagagatgttttgatgccgtttgtgaagatttgatgaatagaggtgggaaattaaacaaaatagtgcatgtaattaatgttgacattaaagatgatgatgaaaatgctaaaattggtagcaaagctatattggaattagctgatatgctcaatgataaaatagaacaatgtgaaaaagatgacattccctttgaagattgtataatggacattttaactgagtggcaaagctcacattctcaactaccgtcattatacgctccttcatattactaa

SEQ ID NO: 1058 - DNA, 621 bp, Saccharomyces cerevisiae
atggattttgaggaagattacgatgcggagtttgatgataatcaagaaggacaattagaaacaccttttccatcggttgcgggagccgatgatggggacaatgataatgatgactctgtcgcagaaaacatgaagaagaagcaaaagagagaggctgtagtggatgatgggagtgaaaatgcatttggtatacccgaatttacaagaaaagataagactctggaggagattctagagatgatggacagtactcctcctatcattcccgatgcagtaatagactactatttaaccaaaaacgggtttaacgtagcagatgtacgagtgaaacgacttttagcacttgctactcagaaatttgttagtgatatagctaaggatgcctacgaatattccaggatcaggtcttccgtagcggtatctaatgctaacaacagtcaggcgagagctaggcagctattgcaaggacagcaacagcctggcgtgcagcagatttcacaacaacaacatcaacagaatgagaagactacagcaagcaaagttgttctgacggtgaacgatctcagtagcgctgttgctgaatacgggctcaatataggtcgcccagacttttatcgttag

SEQ ID NO: 1059 - DNA, 621 bp, Saccharomyces cerevisiae
atgtcatcttcgctgagccaaacatctaaataccaggccacctcggttgttaatggactgctatcaaaccttttgcctggcgttcccaaaatcagagctaataatggcaaaacaagtgtaaacaatgggtcaaaagctcagttaatcgacaggaacttgaaaaagagagtacagttacaaaacagagacgttcacaaaattaaaaaaaaatgcaaactggtcaaaaaaaaaaaagttaagaaacataaattagataaagagcaacttgaacaactggcaaaacaccaggttttgaaaaaacatcaacatgagggcacattaacggaccatgagaggaagtatttgaataagttaatcaaaaggaattctcaaaatttgaggtcgtgggatttagaagaggaagtacgagatgagcttgaagacattcagcaatccatcttgaaggatacagtttccactgcgaacacagacaggagtaaaagaagaaggttcaaaagaaaacaattcaaggaagatatcaaagagagcgattttgttaaagatcatagatatcctggtctgacaccgggtttggcacctgtaggactaagcgacgaggaagactctagtgaagaagattaa

SEQ ID NO: 1060 - DNA, 621 bp, Saccharomyces cerevisiae
atgtccgaatttaatgaaacaaaattctccaacaacgggacgttttttgaaacggaagagccaattgtggagacgaaatcaatctccgtttataccccactcatatatgtctttattctggtggtgtcccttgtgatgtttgcttcaagctacagaaagaagcaggccaaaaaaattagtgagcaaccatccatatttgacgaaaacgatgcccatgatctgtatttccaaataaaggaaatgagtgaaaatgaaaaaattcacgagaaggtgttgaaggccgctttattgaacagaggagcagaatctgttagacgatcattaaagttaaaagagttggctcctcagataaaccttctatataaaaatggctctattggggaggattactggaagagatttgaaactgaagttaaattaattgaattggaatttaaagatactttacaagaagctgaaagattgcaaccgggctgggttcaattgttcgttatggtttgtaaagaaatttgctttaatcaagctctctctagacgttatcaatcaatcttgaaacggaaagaagtgtgtattaaagagtgggagctgaaaataaataatgatggaagattagtcaattag

SEQ ID NO: 1061 - DNA, 622 bp, Saccharomyces cerevisiae
atggtacgtaatgcctcattaggattttaaaatatgaaaaaaatggacgtttcagcgaggaatgaataacaagaaatagctaatttgaatatattactggtgtttcatatctatatataccgcagaaaaagaaataaaacgcaatatatctttaaactggctccaccctgagaatatgataggaaactttttaaatttgagttctgttacatcaaaaacgtaattgcttgacacagatttttcgagggcaacagcgtggacttaacataatgtcgagtttaataacaacattttttgacggagagttaaaaaggctttgagaaaatagcagagtgaagtttatttttagcatccttgctgatacgccaaataattcaaaaattcactatactaacatggtcattaatttttaatattaatattatttatttaggctaaagttcatggttctctagctcgtgctggtaaagtcaagtctcaaacaccaaaggttgaaaaaaccgaaaagccaaagaagcctaagggtcgtgcttacaaaagattattgtacaccagaagattcgttaacgttaccttggttaacggtaagagaagaatgaacccaggtccatccgtccaataa

SEQ ID NO: 1062 - DNA, 622 bp, Saccharomyces cerevisiae
atgtctgactctattatttcctttgctgctttcatcctagctgatgctggtttggaaatcacctctgacaacttattgactatcaccaaggccgctggtgctaatgtcgacaacgtatgtacaaaaatgcaacctaaaacgactttgtgtgactacgaagagaaagattagacaacaatcgtcccgagaaatgcgcaattttgaataatgggggacagaaaaattccatgtaacgtttccctctaacatgatgagatactagggggcaatacatgtagaaatatttctccattaacgtatttaacggaaagcacaagtcaggatcgaattacttcttcaaggatctcattttactaacaaactcaacgaataacgactcttcctatggagcttgttatatgtatcattgaattaggtctgggctgatgtttacgctaaggctttggaaggtaaggacttgaaggaaatcctatctggtttccataacgctggccctgttgctggtgctggtgctgcttctggcgctgccgctgctggtggtgacgctgctgctgaagaagaaaaagaagaagaagctgctgaagaatctgacgacgacatgggtttcggtttattcgactaa

SEQ ID NO: 1063 - DNA, 624 bp, Saccharomyces cerevisiae
atgacagtacagtcaagccccattcttcgccagtcatctttcaactttatcaccttttaccttgcttgtcagttgttgacttttttatgtatatatattgtgtttttttttgtcaagttcttaccaactattaaagtttcttttattattatcggagcctgtaaaagagctccacatgtttcggtttacctcttgaaaattgattgcgaacataacgagtcaagcatggcagcaggtggtgaacttagttatgaagagttgctggatcacattctgaataacaagcctatacctaatattgtggaggtgcccaatgttacgctggatgagggtttagctagtactccttcattgaggccaagacctaggccttgggaaggtcagctgcagcatcaatctcatcaaggatcattagacaaacccaatatatctctggacattgatcaagaaagcctagaaggcatgacctcattaacaaggctgtctgaatgttacgatatacagtctaagttacagattaatgacagtgacaacgataatgatgacaataacaatgataacaataaaggcgatggcaatgatgacgacaataatacagtaacagcaaatccaacagctaggtaa

SEQ ID NO: 1064 - DNA, 624 bp, Saccharomyces cerevisiae
atgactgtcatgaatcttttcttcaggccctgtcaactgcagatgggctctggaccgttggagctcatgcttaaaaggccaacgcaattgaccacgtttatgaacaccaggcccggcggatcaacccaaattagattcatatcgggaaatttagatccagtgaaaagaagggaggatagactacgtaaaatattttccaagtcacgacttttaacaaggttaaacaagaatcctaaattttcacactatttcgaccgcctcagtgaggccggcacggttccaacacttacatcattcttcatcttgcatgaggtaactgccatactaccactgtttctactatggtggttactttataacctcgatctttctgatgattttaagctcccaaacttcttaaatggcctaatggatagctgtcatacagctatggagaaatttgttggtaagagatatcaggaatgcctcaacaaaaacaagttgattttatctggcacagtagcctacgttacagtaaaattactatatccggtacgcattttcattagtatctggggagcaccatattttgggaaatggttgcttcttccctttcaaaaattaaagcaccttattaagaaataa

SEQ ID NO: 1065 - DNA, 624 bp, Saccharomyces cerevisiae
atgcgcgtttttactttgattgcgattttgtttagttcatctttgttaacacatgcattctcctctaattatgctcctgtaggcatatcattacctgcttttaccaaagaatgtctttactatgatttatcctctgataaagatgtccttgtggtcagttaccaagttttgacaggtgggaatttcgagatagacttcgatattaccgcccctgatggctctgttatcgtcactgaaagacaaaagaagcattctgattttctactgaagtcgtttggtataggtaagtacactttctgtttgagtaataactacggcacttccccaaagaaagttgaaatcaccctcgaaaaggaaaaggaaattgtttcttcccatgaaagcaaagaggacataatcgcaaacaacgccatcgaggaaattgataggaacctgaataagatcaccaaaacaatggattatttaagggctagagaatggagaaacatgtatactgtgagttctactgagtcaagattaacatggctctcattactaattatgggggtaatggttggtatcagtatagtgcaggcattaattattcagttcttttttaccagtcgccaaaaaaactacgtatag

SEQ ID NO: 1066 - DNA, 624 bp, Saccharomyces cerevisiae
atgctcaagcgtattgttggattgcctgcaaggcgttgctttcatagaacgtcctttttgctgggcagtgactttgaaactgtgcatattcccaatacgaaccactttaaagatttacttatagagaacggtaaatttcaagaggatcaagcaactacaatagtagagataatgacagatgcaattaggggcggggttaatcatgtttcacaggatctggcaaagagagaaaaattgacccaacttagctatcaacaacgtgttgattttgcaaagttaagagatcagctattgagtgctgatagaagtgaatttcacaatattcaaaacgagtacgaaagtgtgaaaaacgatctggagaaactaagaaacaaactaagggaagaaattaccaaaacaaacgccggtttcaaacttgatctgtccttagaaaaaggcagaattagggaagaaagtagtcatcacgatctgcaaataaaagaaatcgacaccaaaattgagcaagaagtgaccaatatgaagatgcagattgattctgtcaagactcaagtcatgcaatggctgataggtgtctgtacaggtacatttgcacttgtattagcatatatgaggttattaacatag

SEQ ID NO: 1067 - DNA, 624 bp, Saccharomyces cerevisiae
atggtgtacacaggatttggtttggagcagataagtccagctcaaaagaaaccttataatgaactaactccggaagaacagggtgaacggggtgctgaaatgatcatgaacttcatgacttcctgtcctggaaaatcagttgtgagtggtgtaacagggtttgcactgggtggtgttttaggcctgttcatggcgtcaatggcatatgatacacctcttcatacacctacacctgcaaatacagcagcaactgcaactgcgggaaatataggtgtgggtggaatatcaagaacagttcagcaaatatctgatttacctttccggcagcaaatgaaacttcaatttaccgatatgggtaaaaaatcctactctagtgctaagaattttggctacattggtatgatatatgctggggtggagtgtgtcatagagtcacttagagctaaaaatgatatttacaacggagtaaccgcagggttttttaccggtgctgggctggcatacaaagctggaccacaagctgccttaatgggtggtgccgggtttgctgccttttcagctgcaattgatttgtatatgaaaagtgaggatggtagaccacctcaaaacgattttaaagaatga

SEQ ID NO: 1068 - DNA, 624 bp, Saccharomyces cerevisiae
atggttttgataataaggccctcacagacattgatattattcaggaaagcgatgctcaagccaattgggagatatcctcttaaaagaaatttttttggtttgagcggtaccaatcacactattagggaacagcgatatgttttgcgcaaggccataaacgcccctccaagcacagtctacgctgcagtgtcagaagttgcccaatataaggaatttattccttattgtgttgattcgtttgtagataaacgaaatcctgtggataacaagcctctcattgcggggcttcgagttggtttcaaacaatacgatgaggaatttatatgcaatgttacctgtaaagatactgatcatacgtataccgttgttgcagaaacaatatctcataatttgtttcaccttttgatttcgaaatggaccataatgcctcacccaaatagaccaaatgcggccatggtagaacttctattaagatttaaattcaaatctcggatatataacagtgtctctctaatatttgcgaaaactgtgactgaattggtgatgaacgcatttgccaaaagagcataccatttagtaagattagcaatgctaaaaccttcttctaaagaaggctctccgtga

SEQ ID NO: 1069 - DNA, 625 bp, Saccharomyces cerevisiae
atgtctacatatgaaggtatgtaatgatatattatgaagtaagttccccaaagccaattaactaaccgaattttaatctgcactcatcattagattagaggaacatggaatacaacaaaactcaagggattaccaagaagtaggaggaacttcacaggaggagcagagaagacaggtcagatcccaactgcaaggtctatttcaaaactttggtaacaccagtggtgagggtgatgcacattcagattcaacactacttttacgattattatcgcaaatgcttccagaatcattacaggaagaatggttgcaagaaatggataaaggcaagagtgcgggctgtcctgatacttttgcagcctctttaccacgaatcaataaaaaaaagctcaaagcaactgacaactgctccatttgttacactaattatttagaagatgagtaccccttagtagttgaattacctcattgccatcataagttcgacttagagtgtttgtctgtctggctatctcgaagtacaacatgtccattatgcagagataatgttatgggccaccgaatcattaatgagattgatacaactgaagcagaactggaagaagattggggtatgtacggttaa

SEQ ID NO: 1070 - DNA, 626 bp, Saccharomyces cerevisiae
atgggtagtatgtagtaggacattgagaataaaactgtgaacctgttattgacgaccgtggagaaatgttatgattatctgaagagaaatatcggaacgcatgcacaccaaatttatacttagcaagactggacgatacgagactggtatacttgtatgaagacagaatagtgaacgaaagacatgcgcatgacaacaaatttaccgtatagaagaaatattctgcttgtatgcctgagggaactcgaaaggatcaatttcaatggcgttgtaacagtcacgaaaaaagtgtaactataagataaagcaaattgtactaacaaacttaaccaaattgcacaacaatttgattttctttttaaatagagggtactccttcattcggtaaacgtcacaacaagtcccacactttgtgtaacagatgtggtcgtcgttctttccatgttcaaaagaagacctgttcctcctgtggttatccagctgctaagaccagatcttacaactggggtgccaaggctaagagaagacacactactggtactggtagaatgagatacttgaaacacgtttcaagaagattcaagaacggtttccaaaccggctctgcttctaaggcttctgcttaa

SEQ ID NO: 1071 - DNA, 627 bp, Saccharomyces cerevisiae
atgagcctaattcaccccgatacagcaaaatatccttttaaatttgaacctttcctcaggcaagagtattcgttttcactcgatcctgacagacctatttgtgaattttacaattctagagaaggccctaaatcatgtccgaggggaccgttatgtccaaaaaagcatgtgttaccaatatttcagaataaaattgtttgtagacattggcttcgagggttgtgcaaaaagaatgaccaatgtgaatacttacatgaatacaatcttcgaaaaatgcctgaatgtgtcttcttcagcaaaaacgggtactgtacacaaagtccagattgtcaatatctacacatagatcccgctagcaagataccaaaatgtgaaaattacgaaatgggattctgtcctctggggagttcttgtcctagacggcatattaagaaggttttctgtcaaagatacatgaccggattttgtcctttagggaaggatgaatgtgatatggaacatccacagttcataatcccagatgaaggtagtaaattaagaattaagagagacgatgagataaataccaggaaaatggatgaagaaaaggaaaggcgtttaaacgcaattataaacggtgaagtttga

SEQ ID NO: 1072 - DNA, 627 bp, Saccharomyces cerevisiae
atggaaaagatgacagtttcttcgaattacaccatagctttatgggctactttcaccgcaatctcctttgccgtgggttaccagttgggtacgtcgaacgcatcatcaactaagaaatcctcagctactttactgcgttctaaagaaatgaaggaaggaaagctacacaatgacactgatgaggaggaaagtgaaagcgaagatgagagcgatgaggacgaagatattgagtccacttcattgaatgatatacctggagaagttaggatggcattggtgattcgtcaagatcttggcatgacaaagggcaaaatagcggcacaatgctgtcacgcagcattgtcatgttttagacatattgctacaaaccccgcgcgtgcttcatacaacccaattatgacacaaagatggctaaatgctggacaggctaaaataacgttgaaatgtccagataagtttacaatggacgagttgtatgcgaaggctatatcacttggggtgaatgcagcagttattcatgatgctggtagaacacagattgctgcgggaagtgccaccgtattgggtttaggacctgctccaaaagcagtattggatcaaataacaggtgatttgaaattgtattga

SEQ ID NO: 1073 - DNA, 627 bp, Saccharomyces cerevisiae
atggtgtatttctatgaatcaaaaccaactgagtattcaacaccttaccaaattgtgatgggcaaagataagtttgaaaacgatctacttatcaaatggagctatagggagttaaactatgtttggtttcacgcggataagtactcaagtggtcatgtttatttaaagttacgcccaaatgaaaaaacaatcgatgacataccgcaagaagtgatatgtgactgtctgcagctatgtaaatcagaatccattcaaggaaacaaaatgccacaatgcaccatcttgataacaccatggcataacttgagaaaaaacaggtatatgaatcccggtgaagtatcatttaagtctctaagacaatgtagaaaaatggaatgcggagcacgagataacaaaatactaaacagactggccaagacaagggtagaactatttaataatgtggaagctacacttaacgaagcaaagaagaccaaaaatggtgatttttttgtaaactatattgagtcgaatagatcaaatcttattgaagaagaaaagctaaggaaagtagcgaaaaaaaaccaaaagaagaagaacaaacagtctaaagatgaggttactgacgatatgcaactggaagtatga

SEQ ID NO: 1074 - DNA, 627 bp, Saccharomyces cerevisiae
atgtacagcaatcataatttaaattcggatgactgttgcttcgattggaatgaagagaaggccgcagaactacagcgtacaggtgtttcttttgaccggagtttaacacctcaatctttaagaacatctacacgtagactatcagaagagaacaaacaacaaagtggcactatgcacattgacacttccccttctgtggtttcagatataatatcaagtagacgagatcgttcacaggatttttttgggcctcattcttcatcccctattgccccttcagaacgacaacgagcggatcagagatcacggttggagtccatgagattaactagacgtcgagacaaaatgaccaaagtacgcggtggcctagaaaagatggaagaaatgatcatgcaaggtgaacaccttagagaaatgcaaaggctaaagcaggaagcacaaaagaacgctctaccctctgacatggctgaatatatggaatggcaaaacaacgaggatttggaagacgatgagttgcttgcctttattgaaaaacaggaaacttataaaaatgaattagaacactttttgaacaatgctaataaaaatgtttatgagaacaactcgtatccgaactctcatacgtga

SEQ ID NO: 1075 - DNA, 627 bp, Saccharomyces cerevisiae
atgtatggagatttaggtaataaattagtattagaagctaaaagaacaaaacagctgtacgcaagaagtaatcaagatgttaatttacccatgtatcatgaagatataatacgaaatattctgaaagaagtttcaaatttacgtaaaaatacggaatatcttaaagaacagcagcaactaggaatgctagatgataaggtggctaaatgccagtatttcgttaccttgttatgtatggaaaggaacaagagatgtctcttagcataccaaaggttgagaacagacatactagattctatggcttggaataataatggtctggacttgatgagtagcattacgtttagccaacaagacacaaataacctttctcatcaagagcaggaatatttgaaagaatactgcgatttaattactgatttaaaaagtggtgacttggtcgatattgatttatccggctctttagtgcctccgagcgatgtatttattgatgttagagtgctcaaagatgctggtgagattcaaactgaatacggcgtgtttaaccttattaaagactcccagtttttcgtaaggcagtctgatgtagagcgtttgattcaacaaggttatttgcagaagatatga

SEQ ID NO: 1076 - DNA, 627 bp, Saccharomyces cerevisiae
atgtccctggaagaatttgacgaagttaaatatgatcattcaactaaacgcctagatacaccatcaaggtacctgctgcgcaaggctagaagaaaccctaacgggctacaagaactgcgtgagtcgatgaagtcatccacaatttatgtaggaaatctttccttttatacatcagaagaacaaatttacgaattattcagtaaatgtggcacaataaaaagaataattatgggtttggaccgttttaagttcacgccatgtggcttctgttttattatatatagttgtccagatgaagcattgaatgccttaaaatatttgtccgatacaaagttagacgaaaagacaattaccattgatctagatcctggttttgaagatggaagacagtttggtcgtggtaagagcggtggtcaagtcagcgatgaattgaggttcgattttgatgcatccagaggtggcttcgccattccatttgcagagcgtgtcggcgtaccacattccagatttgataacagtagctcacaatctaatacgaataattatatccctcctcctgatgcaatgggtactttcagaccaggtttcgatgaagaaagagaagatgataactacgtacctcagtag

SEQ ID NO: 1077 - DNA, 627 bp, Saccharomyces cerevisiae
atgtcttctagaaaaaaaaatattttgaaagtaatcatcctaggtgactctggtgttgggaagacctccttgatgcaccgttatgtcaatgataagtattctcaacagtataaagcaacaattggggctgactttttaacaaaagaggtgacagttgacggtgataaagttgccaccatgcaagtttgggatactgctggacaggaacgtttccaatcactgggtgttgctttctatagaggtgcagattgttgcgttttggtctacgatgtgaccaatgccagttcctttgagaatattaagtcttggcgagatgaatttctagtgcatgcgaacgtaaactcaccagaaacatttccatttgttatactgggaaataaaattgatgccgaagaatctaaaaaaattgtatcagaaaagtccgctcaggagcttgctaaatcattaggcgatattcctttgtttttaacaagtgccaaaaacgccataaacgttgataccgcatttgaagaaattgcaaggagtgctttacaacagaatcaagctgatacagaagcctttgaagatgactataatgatgccatcaatattcgcctagatggagaaaataattcttgtagctgttga

SEQ ID NO: 1078 - DNA, 627 bp, Saccharomyces cerevisiae
atgtttacaccaattgatcaagctatagaacacttcaagcagaataagtttgtaattgttatggacgatgccggtcgtgaaaatgaaggtgatcttatttgcgctgctgaaaatgtcagcactgaacaaatggcctttcttgtacgccattcctcaggctacgtctgtgcacctatgacgaatgccattgctgataagttggaccttccactactgagaacaggcatgaagtttgaatccaatgatgacgacaggcatggaactgcatacacaataactgtagatgtagcccaaggcactaccacaggtatttctgctcacgacaggtcgatgacttgtagggctcttgcagactcttcctctacgccaaaatcatttttaaaaccagggcacatctgtcccttgagagccgctgatggcggtgttttgcagagaagaggccacactgaggccggtgtcgatttgtgtaaactaagtggactaagtcccgtcgctgttattggcgaattggttaacgatgacgaacaaggaactatgatgagattaaatgactgccaagcgtttggtaagaaacatggcattcctttgatctccatcgaagaattggcccaatatttgaagaaataa

SEQ ID NO: 1079 - DNA, 630 bp, Saccharomyces cerevisiae
atgaacatatacacatcacccacgcgaacaccgaacatcgcaccaaagagtggccaaagaccatctcttcctatgctggccacagatgagaggtctacggacaaagaaagcccgaatgaagaccgtgaattcgtgccttgttcgagtttggacgtgcgcagaatctacccaaaaggcccattacttgttctcccggaaaagatctacctttattcagagcccacggtaaaagagcttttaccctttgatgtggtcatcaacgttgctgaagaggcaaacgatttacgaatgcaggttcctgctgtcgagtaccatcactaccgatgggaacatgattcgcagattgcgttggacttgccatcattgactagcatcatacacgcagctacgactaagcgagagaagatactgatacattgccaatgtgggctgtcgagatccgcaacgctgattattgcatatataatgaaatatcataacttgagtctgaggcactcatatgatctgttgaaatcaagggcagacaagataaacccttccatagggcttattttccagttgatggaatgggaggttgctcttaacgcgaagactaacgtgcaagccaacagttatagaaaagtaccgtga

SEQ ID NO: 1080 - DNA, 630 bp, Saccharomyces cerevisiae
atgactactttagcatcaagtattgagcataaaacaaaacatctagccgcgcccttcgagaacgatgagaacccttggatgaaaaaatactgttgccaatgcaaatcatgtaaaatgagtgtgcctgtccaaccttggctgccaaggttttttgtttttggaatcttgtgccccgttttctggttggtgaatcttttagcctggtggttcttacagtattggcaaccacatgaattggaattccacgacttgcaagaagacgaatacccaggattttatgaatatgaagccataactaaaagaacggtgatacccataaaggaagaagtcctccaagagattcgcgtcatgcagaatttcagtgatagcaacagcgaagaatattacgagagcaaagacggtatgccgtcgtctttcctaaacgtgaacacggaacaagtcgaggacgagaatgacaccttgaaaaaatatcgttacgcgtttttgaagaaggtagcccacgatgtgctggagtcgcacgatttattacgtaagaccttccgcgactggaatttacggtctttgcttggcctcctcatcgattctatactcataatatttgtagttctcctatgtaagaaaagccgttag

SEQ ID NO: 1081 - DNA, 630 bp, Saccharomyces cerevisiae
atgatatcaccatcaaaaaagagaaccattttatcaagcaagaatataaaccaaaaaccacgagcagtggtaaaaggcaatgaacttcgttcaccatcaaagagaaggtcacaaatagacacagactatgcactaaggcgaagtccaataaagacaatccaaatttctaaagctgcacaatttatgctgtatgaggaaacggctgaagaaagaaacatagctgtccacagacataatgaaatatacaataataacaattctgtgagcaatgagaataatccttcccaagtaaaagaaaacctttcacccgctaaaatttgcccttatgaaagagcatttttaagggaaggaggaagaattgcattgaaggacttaagtgttgacgaattcaaaggttacatacaggatcctctcaccgatgagactataccactgacgttgccactgggtgataaaaaaatcagcctacccagttttataacgccgccaagaaattcgaagatatctattttcttcactagtaaacaccaaggacagaacccagagacaaagatatcccgttctaccgatgacgtcagtgaaaaaaaagtagtgagaaaactgtccttccacgtctatgaagatgagtaa

SEQ ID NO: 1082 - DNA, 630 bp, Saccharomyces cerevisiae
atggaatacgccactatgtcttcttcgaactccacacataactttcagagaaagattgctcttataggagctagaaatgtcggcaaaaccacattaacggttcgcttcgtagaatcgcggttcgttgaatcctattatcccactattgaaaatgaatttaccaggataattccttataaaagtcatgactgtactctggaaattctagatactgcaggccaagatgaagtttctctattaaacattaaatcgttgacgggcgtacgaggcataatactgtgctatagtataataaatcgtgctagctttgatcttattcccattctctgggacaagctggtagatcagctgggtaaggataacctcccggtaatacttgtgggtaccaaagctgatttgggaaggagtacaaaaggtgtaaaaaggtgtgtcacgaaagctgaaggagagaaactagcttcgacaattggcagtcaagataagaggaaccaggcagcatttatagaatgcagtgccgagttagattataatgttgaagaaacttttatgctccttttgaaacaaatggaacgtgtcgaaggaactctggggcttgatgccgaaaataataataaatgttctataatgtga

SEQ ID NO: 1083 - DNA, 630 bp, Saccharomyces cerevisiae
atggccgaaaatgagagaatgtacatctcctataataatattcacaagctttgtcagggagtggctaaacatatcttagctagaaacgaaagacctgatattattatcgccatcactggtggtggtatgatccccgcaagaattattaggtcctttttgaaaactaaaggacaaaagaatattccgattcaggccatcggcctatctttgtatgaagatttagggttggataatagcgtcgaaactatcggcaaagaggtcatcagaacacaatggctggacttcggtgctttgaaccaacatttcgattccttaattggtaaaaaggtcctaattgtggatgaagttgacgatactagaactaccctccactatgctgtttctgagctggaaaaagagattgctgaacaacaaaaggttttgaatagaatgagtgaggaaaccgttatttctatctttgttctacataataaggacaaaccaaagagagctggactacctgactccatgatgaattctggacgttacattgctgcgcaaactgtccctgataagtggttgtgctatccatgggacgctgaagatatcgaagaacataccatgctcgctaaggctcaaggtcatgactga

SEQ ID NO: 1084 - DNA, 630 bp, Saccharomyces cerevisiae
atgtcacaacaagttggtaacagtatcagaagaaagctggtaatcgttggtgatggtgcctgtggtaagacatgtttattaatcgtcttttccaagggccaatttccagaagtctacgtaccaactgtctttgaaaactatgtagcagatgttgaagttgatgggcgtcgtgtagagctagcgctatgggataccgctggtcaagaagattatgatagactaagaccattgtcatacccagactccaatgtcgtattaatttgtttctctatcgatcttccagattctttagagaatgtacaagaaaaatggattgccgaagtattacatttctgtcaaggtgtgccaattattcttgttggttgtaaagtggatttgagaaacgacccacaaaccattgaacaattaagacaagaaggtcaacaacccgttacatcacaggagggacaatctgtagcagaccagattggcgcaaccggatactacgaatgttcggccaagactggttatggtgtcagagaagtgtttgaggccgccactagagcttcattgatgggtaaatctaaaacgaatggtaaagctaagaagaacactactgaaaagaagaagaagaagtgtgtcttgttatag

SEQ ID NO: 1085 - DNA, 633 bp, Saccharomyces cerevisiae
atgaataaaatacccattaaagaccttttaaatccacaaatcacagatgagtttaaatccagcatactagacataaataaaaagctcttttctatttgctgtaatttacctaagttaccagagagtgtaacaacagaagaagaagttgaattaagggatatattaggattcttatctagggccaacaaaaaccgtaagattagtgatgaggagaagaagttgttgcaaacaacatctcaactcactactaccattactgtattactcaaagaaatgcgcagcatagaaaacgatagaagtaattatcaacttacacagaaaaataaatcggcggatgggttggtatttaatgtggtaactcaagatatgataaacaaaagtactaaaccttacagaggacaccggtttacaaaagaaaatgtccgaatactagaaagttggtttgcaaagaacatcgagaacccatatctagataccaagggcctagagaatctaatgaagaataccagtttatctcgcattcaaatcaaaaactgggtttcgaatagaagaagaaaagaaaaaacaataacaatcgctccagaattagcggacctcttgagcggtgagcctctggcaaagaagaaagaatga

SEQ ID NO: 1086 - DNA, 633 bp, Saccharomyces cerevisiae
atgaacaatactgatcctacttcatttgaaagtatattggctggtgtggccaaattgagaaaggaaaagagtggtgcagatactactggatctcaatcgttagaaatagatgcatcaaaactccagcagcaggaaccgcaaacatcaagacgcataaattcaaaccaggtcataaacgccttcaatcagcaaaaaccggaagaatggaccgactcaaaggctacagatgactataatcgaaagagacccttcaggagtactcgaccgggaaaaactgtactagtgaacactacccaaaaagaaaatccactcctgaaccacttaaagagcaccaattggagatatgtatcttcaacaggaattaatatgatatactacgactatctagttcgtggaagaagtgtactgttcttaactttgacttatcacaaattatatgtcgattatatctctaggagaatgcagcccttatctagaaacgaaaataatatactgatattcatagtagacgataacaactctgaagatacccttaatgacattacaaaactatgtatgttcaacggatttactctacttttagcatttaattttgaacaagctgcaaaatatattgaatatttgaatttatga

SEQ ID NO: 1087 - DNA, 633 bp, Saccharomyces cerevisiae
atgaacacatcagtcacttccataaagttggtactgttgggtgaggcagcagttggtaaatcgtcaatagtcctaaggtttgtatctaatgattttgccgaaaataaggagcccaccattggtgcagcattcctcactcaaagagttactataaatgaacatactgttaagtttgaaatatgggacactgctgggcaagagagatttgcatctttagcacctatgtactatagaaacgcacaagctgctcttgtagtatacgacgttacaaaaccacaatcctttattaaagcgcgccactgggttaaggaattacatgaacaggcatcaaaggatatcatcattgcgttagttggtaacaagatcgatatgctgcaagaaggtggggaaagaaaagtcgcaagggaagaaggtgaaaagctagcggaagaaaagggcttgttgttctttgaaacaagtgcaaagacaggagagaatgttaacgatgtatttttgggaatcggtgaaaagataccactgaagacggctgaagagcaaaatagtgcaagtaacgaacgtgagtcgaacaatcaaagagtggatttgaacgctgctaatgatgggaccagcgcaaacagtgcttgcagttgttag

SEQ ID NO: 1088 - DNA, 633 bp, Saccharomyces cerevisiae
atgatgagtcaagtatcgcattcccaagaaggatccgggcgattttggaacaagtttaagtcgtcaaccaaatcgttatctacatcgttggcacatttatccattaaagcagaaaaagatggtgatactgtaaatactacattggtccataaagggcttgtgaaattctatgaaaatcagcatcctttccaggggttcccaggatggttgggggagaaggaagatttaccgaacgaacgtaaaatattagatactcaagtgaagcatgatatgaagaagcaaaactcgcgtcatttctcgccatccttttctaacagaaggaaggcttcttcagaagatcctatgggtacaccttcttcaaacgggaacacaccggagtacacgcctgcgagtaaatcgtttcaagatatatacaataatcatacaagctcctctagcgcgacaccgagaagagcttcatcacggccgactagaccttcagcaggccaagaattcagggcaagtctcggtcgaagtaaaacgtcgaacagtttcaacacctccagcacgccaacgccgccaccagacgcaagtagtggagtaatggcaatgaaggacagactaaagagacgcaataacgattatggattttaa

SEQ ID NO: 1089 - DNA, 633 bp, Saccharomyces cerevisiae
atgattttacgggagcagatcgacttcctaatacataaaagacaggatgataataataacaatggtgaagcgattacagatgatgatccatttagctcttcctcatggagatggggaagatggattttttttatttttttcatagttgcactccttatacttctgttttcaactgcaaaagtgaataggagaagaagaattatgggtcaagctccgattaggggaaccgcttggttaaccccgcctacctacaggcagtccgagagagattacaatggcacacagcgttgcgttgaagactatgttcctgaatatacagagacagcaaatgagaatgatttggggttttacgacgaacgaggagagtttcatcctaatggcaaaacggaatatttagcgccaccgcctttatcagaagaacaagctagctcgactgataaagacttacagcgcccagtggctgccgtcgtacgaattcctagtgaaagtgaattcgacttcaatctgctaagacccactatgaataatttcgttaatggtcagagtaatcgcaacgagcagcattctccgactgttgaatcttcttcctttgatgttaataacgcgccggcaagagcgaaagtgagtaagtga

SEQ ID NO: 1090 - DNA, 633 bp, Saccharomyces cerevisiae
atgccgaaagtcgctattttgatttattcagtggacgatataattgccacattagcagaaaatgaaaaaaaaggtatagagatagctggtggtgaggctgagattttccaagtgccagacgtcagctataaaactgaatatgcgacagaagagggaaaagaggcagccaaagtcgccaaaactaatgcagatttttcctataaaatcctaacaagagaaacgttggttgagtacgattactacttattcggaatacctactaagtttggaaacttccccgcggagtggaaaagcttttgggactcgaatactggtgggctttgggcaaagggttctctccatggcaaaattgccggtttgtttgtttcaggcgcaataagcggcaagggtgatacagaaatgtgtatcatgaacgcaatgagtactctggtccatcatggtgtcatttatgtcccattggggtataagaacgcatacaaggaattgaccgacgttgaagatgtgaacgggtcttgcgcctggggcgcaggatgtgtttctggaatcgacggtggcagacctcccagtttatccgagctaagagttcaccaacttcaagggaaggccttttacgaccgtatcaaagatttgtaa

SEQ ID NO: 1091 - DNA, 633 bp, Saccharomyces cerevisiae
atgcctgattcatcacattcaataagctcaaaagatgttgcatctgccatctctctctatgatcagtccatttacactaataacaggtctactaacctggacttagatcagagatcaatgagcccttccaatattgcctctggtgaagataggataacgagaacgaactcaggttgctccatcacatcaggtgcctccatgattgccacgaaggatggtattcaggggattaatgtcaaaagagatgggattccgaaatattcacttaatttattgaattccatggttcgaaaacaatatgatcacaataatggaacaaagtctcctaccccgaagactagcaatatggtagaccctaagaacaaaaagaagaacaaaaaaaagaagaatgacaaggatgacaaatacaaggtatcgcatgatcaaaccgaaaagttttacaaactcaacaccacttccaactccaatctcacctctgattctactacttcgttatcggaccagttttatttccagaaaagtaacgctgattctgctccattagacaatgcaaattacccactctccgaccattccccctccctaaactctatggataatactacaaagcatagcagcaatgtgcacacttga

SEQ ID NO: 1092 - DNA, 633 bp, Saccharomyces cerevisiae
atgcttcaatccgttgtctttttcgctcttttaaccttcgcaagttctgtgtcagcgatttattcaaacaatactgtttctacaactaccactttagcgcccagctactccttggtgccccaagagactaccatatcgtacgccgacgacaccactaccttttttgtcacctcaacggtctactccacgagctggttcacctcaacttcagccaccattaccaatgcggcctcctcctccttgtccacctcttcggcctctggatctgtaaccccagaatccacccatgaaattacctccacctcgactatcacgtccactttgctgctaacccttcatgactccactactttgtctccatcatctactgcagcaagtgtcagtgacgaagattcaaacaacaaagatgcaaaggtcaagtcctttgaacaggcttcaacttccaatggttgcgtcccaatcacaaagtttgtcactgtcaccaatgagcccgttacccagtacgttacagtcaccccaaatacgactacacaatacgttactgtcaccggtgcaccttctgttaccactacctctccaggtaacgtacaatggtacaacaccacttcgattactaattcgaccagttggtga

SEQ ID NO: 1093 - DNA, 633 bp, Saccharomyces cerevisiae
atggttgctaagaagagaaacacgcttagaagcaaagtaagtgcaagaaatagtcaaaattttggaccagacgtagcgaacaatggcattctggacgagagttatgacatagaatctgatccaagggcctttctgcaccaacctaaagaaactaaaaaggaaaagctacttaacagacagaatactttcttatctaacttgaaggggaaatccacacttaacgatggcatagctgccaattttgatggtatttctaaatcttccattagacgtaggaaaagaaagctaagagaagaactaaaaccaagaatgcaagatctgctcacttctttggagcaagaaaaggatttacggggcattattgaaaatagtagcaaagacatgaataacgatgatgacatcgacatggattctaaaataaggtttgtggacacaaaggaaatgaacttgaaaaagatagaacctggttctgttaggataaaaaagaatcagccaaatatcaggaaccaaaagggtgcaaaggcattggctgctaacgaaactgcaagattcaatcaggtcctaaccaatcaagatttccaaaaaaatccatttggcgccttaagagaggttatcaagctgcaaaaacaatga

SEQ ID NO: 1094 - DNA, 633 bp, Saccharomyces cerevisiae
atgtccgtttccaagattgctttcgttttaagtgccattgcctctttggccgtcgctgacaccagcgccgccgaaactgctgaattgcaagctattatcggtgacatcaactctcatctttctgactacttgggtctagaaactggcaacagtggattccaaattccatctgatgtcttgagtgtgtatcaacaagtcatgacttacaccgatgacgcttacactaccttgtttagtgaattggactttgatgctatcactaagacaattgttaaattgccatggtacaccacaagattgagttctgaaatcgctgctgctcttgcctccgtttccccagcttcttccgaggctgcatcttcttccgaggctgcatcttcttccaaggctgcatcttcttccgaagctacatcctctgccgctccatcctcttctgctgccccatcttcttctgctgccccatcatcatctgccgaatcatcttctaaggccgtttcttcttctgtcgctccaactacctcttctgtcagcacttctacagtcgaaactgcttccaatgccggtcaaagagtcaatgcaggcgctgcctctttcggtgctgttgttgcaggtgcagctgctttattgttataa

SEQ ID NO: 1095 - DNA, 633 bp, Saccharomyces cerevisiae
atgttctcatattcagatttctgttctatcggtacggccatgatcttatcggccacaacgttcctaatgggtgttttcttcagtaacatgccatacgattatcatcttttatttaatcctaactctactcaagagcatttcgatttggcactgagacattaccaaattttacatgagactccattgccggtgattgttactttgtgcgttgttgccggtattggcttagttggtggtacaattaaggttttcaagccaaaccctgaactgcagatgtttgagtattgttcattggggttgtacgtgttggctatctgtgtgtttctcactaatgtgaaaacaggtatcgactgttctgtgagccataattggggagaagttacggaaaatcagggtttggcagttattgcttcctccaacataattttattagttatgtttgccggtgttatcatcctacaaattggtttgtggtacagtaactgggatttgcaaaaaagattaaaggagttttatgctcaagaagaaagagaagctgccaatgccggtaaaaagactgagaaagttgacaatgcgaaaaagaatgataacaaatctaaaggtgctcaaaagaggaagaacgccaaaaaatag

SEQ ID NO: 1096 - DNA, 636 bp, Saccharomyces cerevisiae
atgagaggaaaacaaccgaaaaggaacaaagacaacgcttctgtcaagagaaattatagatgcgtgggatatcctgattgtaacatgagtttcaataggaccgaacatttggctagacatatcaggaaacacacaggggagaaaccattccaatgcaatatctgccttaaattcttcagtagaatcgataacttaagacaacatcaatcttctgttcattcggacgttgatttgatgtccttacgtagactgcagcagtccgcaaatagcactgcgaacgaccctaacgcaacaagaatgttcccgcaattacgcccatatggaattgttgtccagcccgcgcctgttccatacaatctgcccatatcaactcctgctagcccacaagacactatatctctttacgcaccaccatacttccctcatcctatgccatctgctcccataccattgccgcatcagcctcctccactaccaatatacagctatatgcaaccactcttcctgaaccacactcccatacaaaaccacaacattgtagagctccctccagatagcagtgacactccagcatcgccgtctaaggtgcaaagttttgaccaggccaaggacgcttcaccaaacgcaaaaaaataa

SEQ ID NO: 1097 - DNA, 636 bp, Saccharomyces cerevisiae
atgagcaccgcattcaacgattactgcactgtttgtgatcgtctcattccaacatctccacagaaaacgaacattaataccaggaagatccaaagggacaatgaaaccaagagcagtttacaatcaaataagttatattgctccgaagattgtaagctgaaggattcgaaccctcttaatgagaaattattatcccacttgcataaaaaatcaaaaacttctcattcgcataatctcactccaccgctttcatattctaaaaatttaactgcatcaaacctcttcgagccgactacctcactatcttcatctccgacatcttcaactatcccctttgacgagttggagaagctagagtccttattaatttcaccattgctgctacctcaggatggtatagtcaatcctaagcaggagtctaatccttctcgtgttgacgaatatgatgaaaatgaacattatttgaacttagccgactctcttagactcgattctagttaccaattgcattcaaaggcacatttgggttacgaaaacaacttgccacgatcaaacgatctaattgatgatcatttgatctcagatcagatcattgagaataactacaacctatggtttagactatcctccagttaa

SEQ ID NO: 1098 - DNA, 636 bp, Saccharomyces cerevisiae
atgcaaaacggcacagaagacaaaagcaatattcctgctcgtagtaatgatgatgtattgccgccgttagccgtcagacttactatgaaagtaatgcgattaattttcatcggaaaaatgtttgcatattcatttgtaccctttcccccatttaaacttttgacatttgataatactgtgggctggttcgtagcatattcagcgatcgtttctatttgggggtttgctgtgtggatggaaagaggatatagacataagattaatctactgcctccaagatgtacgaagataagatgctctcgctgcaatacaagaataagatcccccaattggttcaaatataagaattggttatattttttcctattatacgtttctctaaccacttctaacttaataattcaactggcctcttttatgacagaaatgagtcgtcggggtataagcgttcctggaacgaaggatccaggcaagagagattatttagggcttatcataccaatgcgattcattggtgcatttatccattacatgacggctaatttattcaaagagtattatttacataacggcccactagaaaagaatgatagaccttctaccgatgagaagacatcagagaatgaaacgctatag

SEQ ID NO: 1099 - DNA, 636 bp, Saccharomyces cerevisiae
atgcaggtgttacagttatggttgacaactttgatctctttggtggtggcagtgcagggattacatttcgacattgcagcatctacagatccagaacaggtttgtattcgtgattttgtcactgaaggtcaattggttgtcgcggatattcactcagatggttctgttggtgatggacagaaactaaacctcttcgtgcgtgattcagttggaaacgagtatcgtagaaagagggactttgcaggcgacgttcgtgttgcgtttactgctccatcctccacggcattcgacgtttgttttgaaaatcaggctcagtatcgtggccgttctttaagcagggccattgaattggacattgagagtggtgctgaagctcgtgactggaacaagatcagtgccaacgaaaaattgaaacctatagaagtggagttgcgtagagtggaggaaattaccgacgaaattgtcgacgaattgacttacttgaaaaacagagaggagagattaagagacaccaatgaatctaccaacagaagggtaagaaatttctcaattttggttattattgtcttgtcctcgctgggtgtttggcaagtcaactatttgaagaactacttcaaaacgaaacatatcatttaa

SEQ ID NO: 1100 - DNA, 636 bp, Saccharomyces cerevisiae
atgctaagacgctctaaaaattccagcactaacacaaacgcagacaccaagaaaagacaatccatgcatttaggatccaaaagttcgctaatctcgctgactagcgaatttggccatggacactccaagacgaagcagaaaaaggaggagggcacagctccttctcaattcctgtctcctacgaataagagaagcacatctagtcagtcaaagttaaaaaggagcagcttgttactggacgaaacactgcttaaagactaccactcggccatgaggcacatgcaaacaaacgctgcaaaggaagaaaagctgcggatggctccatcaccaacgcagtcaacgaggagcgaatcagacgccagtctttcctccaccaagagctcgatctcttccatattttcccaagataatgactattccattcacgatttgttgtacgaagatattgaagagatggataaaacagacgctttcaaaattaacaacacaatagcaatcgatgattctaaagctctctttgtcttctgttcaaacgactcctcctcaaggacagcgtctatcgaaacattgcacgaatcaaatttggacaacctggatatgggttccagtagaaggacatcgttggactttttttaa

SEQ ID NO: 1101 - DNA, 636 bp, Saccharomyces cerevisiae
atggatagcaaagaatatctgatatcatatggttggaaagaaggagaagcgtttagagaaggtggtttgaaaagacccatactggtaaagcacaagagagataagaagggattgggtaatgctcctggcgggaatgatggcgaagcatggtgggaaaggctatttgatggacatctgaagaacctggatgtaagcactgattcgaataatggcagtattaaatttactcaaaatgaggcagttgctactgctgtatcgaaaagtagctcacctctatacaggtggtttgtaaagggagaagggctgaaaggaaccattactaatcttggtaaaaaggaggaagccagctttgttgtatctagtgcaagttcgagtaaagggaagaagagaagaaggcgtgatgaagatgataacaaggtcaagagaaaaaaattgaaaaaagataaaaagactagtaacgacagtgagagtaagaagaagaagaagaagaaaagcaagaaggagagtaaaaaaggaaagaaaagtaagcatagcagcgatgaaggtgataaatcgaagcataaaaaatccaaaaagtcaaaaaaacataaaaaggaagaaagttcagcaagaagagatagaaaggagcatatatga

SEQ ID NO: 1102 - DNA, 636 bp, Saccharomyces cerevisiae
atggatgctgtaatactgaatctcttaggcgacattcctttggtcacaagattatggacaattggctgtcttgtactatcaggtctcacaagtctccggattgtggatccagggaaggtagtgtacagttatgatttagtattcaaaaagggacaatatggaagactactttattcgatattcgattacggcgcatttaattggatatccatgataaacatctttgtcagcgctaatcacttatcaactttggaaaactcattcaatctgagaagaaaattctgttggataatatttttactgttggtgatactggtaaagatgaccagcattgaacaacctgcagcatcactcggtgtgttattgcatgagaatctcgtgtactacgaactgaaaaagaacggaaaccaaatgaacgtacgattcttcggtgccattgatgtttcaccatctatattcccaatctacatgaatgcagtaatgtattttgtatataagcgtagctggttagaaattgccatgaatttcatgccaggtcacgtaatttactacatggatgatataatagggaagatttatggcatcgatttgtgtaaatctccgtacgactggttccgcaacactgaaacaccctaa

SEQ ID NO: 1103 - DNA, 636 bp, Saccharomyces cerevisiae
atggccactaagcaattactgagacgtcaaatcaaaagggtaataaatgctcttgactacgatattatcgctgcagagtcgcatactatttctcaagcagtacgctcattgatcgcttccgccaattctaggcgtgtagcgtgttatatgagcatggataaaggagaagtaacgactggagaaatcattaagaatttatttcaagatggccaggaggtctttctgccaagatgtactcatacttctgaatcgaaacacttcaaattacgggaagatcatcatccacatttaatattccatcgaatgagtagtttgaaaatggttcgtgatttgaagcctcaaggtccatatcaactaaaagagcctgaaccgcatattgaggaatcagatattctagatgtcgtattggtgcctggagtggcgtttgatattaaaactggtgcaaggatgggtcacggtgctgggtattatgacgattttttccaacggtataagatactgcatgaaggccaaaagcccctcctagttggactatgtcttatggaacaggtggcctctccaattcctttagaaaaacatgattattccatggattgtatagtatgcggagatggatccatacattggtttcaataa

SEQ ID NO: 1104 - DNA, 636 bp, Saccharomyces cerevisiae
atggctcaaagtaaaagtaatcctcctcaagtgccttctggctggaaggctgtttttgatgatgaataccagacttggtattatgtagatttatctacgaacagctctcagtgggaaccaccaaggggaacaacatggccaagacccaaaggtcctccaccaggtgttaacaatgagaagagttctcgtcaacaggcagaccaggctcctccaccttattcttctcaatcaacaccgcaagtgcaagcaggggcccaagcacagcaacctcgttactatcagcctcaacagcctcagtaccctcaataccctcaacagcagcgttactatcctcaacaagcccctatgccagcagcagcaccacagcaagcatactatggaactgcgccaagcaccagtaaaggtagtggacacggcggtgccatgatgggtggtttacttggtgttggtgcgggtttgttaggtggagctatgctagaacacgcatttgacgaccacaactatgacggaccagacactgtcgttgtcgagaacaattactacggtgatgatgctggtgggtccgacggcggatttgatgatgctggtgggttcgacggcggatttgatgatggatttgacggtagtgacttttaa

SEQ ID NO: 1105 - DNA, 636 bp, Saccharomyces cerevisiae
atggctggaggaaagattcctattgtaggaattgtggcatgtttacagccggagatggggataggatttcgtggaggtctaccatggaggttgcccagtgaaatgaagtatttcagacaggtcacttcattgacgaaagatccaaacaaaaaaaatgctttgataatgggaaggaagacatgggaatccataccgcccaagtttcgcccactgcccaatagaatgaatgtcattatatcgagaagcttcaaggacgattttgtccacgataaagagagatcaatagtccaaagtaattcattggcaaacgcaataatgaacctagaaagcaattttaaggagcatctggaaagaatctacgtgattgggggtggcgaagtttatagtcaaatcttctccattacagatcattggctcatcacgaaaataaatccattagataaaaacgcaactcctgcaatggacactttccttgatgcgaagaaattggaagaagtatttagcgagcaagatccggcccagctgaaagaatttcttccccctaaagtagagttgcccgaaacagactgtgatcaacgctactcgctggaagaaaaaggttattgcttcgaattcactctatacaatcgtaaatga

SEQ ID NO: 1106 - DNA, 636 bp, Saccharomyces cerevisiae
atgggtaatattataacggatacgataattataacctcggataagtgcgacattgttgataatgataatgttgaaagaatccaggtttggctatccaagaatatcttaaggaagtttcaaatcaatgaaaatgaaccactacagttgattattttgaaaaggtttaaaagaatactgttgatctgccccagtcatgatatatctcagcatgttatggatgcgtctcgtgctttagaaatggaaaattttaacttcagctactccttgcaagacggacaaaggaatttaactaaacaatacttgaaggtaccagagagtgaaaaaatgttcctgatatcgcccccagcatcaccacctcccgaattcgatttcagcaaatgtgaggatgcgccacaaaggcatatacaaagtcatatacaacaggaccagcagcagcggttggaagctagccaactattgcctaataatccagacaaaaataacaatggtactttcacgttattgaaatcaaaggtgggcgcaattaccattgatagatgtcccacgaacgatggaaatggacagatgcaattagcggaccacgttaaaaccgctttcccaccaaaatctatattcgatactgatgacgatgattaa

SEQ ID NO: 1107 - DNA, 639 bp, Saccharomyces cerevisiae
atgaaatataatatagtgcatggaatttgcctattatttgctattacccaagctgtaggggctgtccatttttatgcgaagtccggggaaaccaaatgcttctatgaacacttatcccggggaaacctactgattggggatttagacctatatgtagaaaaggatggtctgtttgaagaggaccctgaatccagtctgacaataactgtcgatgaaacattcgataacgaccatcgtgtcctaaatcaaaaaaactcacacacaggtgatgttacttttacagctttagacacaggtgaacatagattttgcttcactccattctacagcaagaaatcagccacactaagagtattcatcgaactagaaattggcaatgttgaagcgcttgacagcaagaaaaaagaagatatgaattcacttaaggggagggtaggccagttgactcaaaggctatcttctattcgtaaggagcaagacgctatcagagaaaaagaggcagaattcagaaatcaaagtgaatcagctaacagcaagataatgacgtggtctgtgttccaacttctcatattgctgggcacctgtgccttccagctacgctatctcaagaatttctttgtcaaacagaaggtagtataa

SEQ ID NO: 1108 - DNA, 639 bp, Saccharomyces cerevisiae
atgagcacatccgccagcggtccagaacacgagttcgttagtaaattcttgaccttagccactttaactgaaccgaagctaccaaaaagctatactaaacctctgaaggatgttaccaatttgggtgtcccgttgcctactttgaagtataaatataagcagaatcgtgccaagaagttaaaactgcaccaagatcagcaaggtcaagacaacgccgccgtccacttaaccttaaagaaaattcaagctcccaagttctccatcgagcatgatttcagcccatcagatactatcttacaaataaaacagcacttgatcagcgaggaaaaggcctcccacataagcgagataaaactgcttttgaagggcaaagtcctccacgataacctgttcttatcggatttgaaggtcacgcctgccaattccacaatcacagtcatgattaagccgaatccgactatatctaaggaacccgaagccgagaaatccactaactcccctgctcctgctcctccacaggaactcactgtgccctgggatgatatcgaggctcttctgaagaacaatttcgagaacgatcaggctgcggttaggcaagtcatggagcgtctacaaaaaggctggtctctggccaaataa

SEQ ID NO: 1109 - DNA, 639 bp, Saccharomyces cerevisiae
atgctctcatactatgaacacaatactgcgttccaaacaaacaattgcaattccggtagcaatgccgccactacatacaacagcgacgccaataatgatacgatcatgaataaaagaaaaaatgaccatttcgagtttgatacacacactttctaccaaagatcgaagagaacaaaacgagattctgtaagtacaaagttttcggtcggttccgggtgtgctaatcttaataacaacaacaacaacatcatcatcaacaacaacaacaacaacaataataataataataaccataatcataataacagcaataatactgcaacctacaataatattcattataaaaaaaatatcgaaatatgtcccctgaaaccggttagtatgcaccacactatgaacagccgcttactgaacgaatctgaattttattctgaaacagaagagtacatgattcatggttatttcggtaacactaatcgcgacataacaggcacgagtcctactggaagtgctagtattatacaacaccagtatcatcttctaccatcccaaagtataattgcatcacaagcacccggtactgccatggccgcgttgactaacaacaatatcgctaacgattacatggatatagattaa

SEQ ID NO: 1110 - DNA, 639 bp, Saccharomyces cerevisiae
atggctgatttatttgctcctgctcctgaaccatctacagagttaggacgtctcagagttctttctaaaagtgctggtattagagtttcccctctcattttgggaggaatgtcaattggcgacgcttggtctgaaatcctaggatcaatgagcaaggagcgagcttttgagttgctcgatgctttttatgaggcaggtggaaatttcattgatactgcaaataattatcaaaacgaacagtcagaagcttggatcggtgaatggatggtttcaagaaaattacgcgaccagattgtaatcgccaccaagtttaccactgactataagaaatacgacgttggtggtggtaaaagcgcaaactactgtggcaatcacaagcgtagtttgcatgtgagtgtgagggattctctccgcaaattgcaaactgattggattgatatactttacgttcactggtgggattatatgagttctatcgaagaagttatggatagtttacacattctagtgcagcaggcaaggtcctctatttgggtgtgtctgatacgcctgcctgggttgtttctgcggcaaattactacgctaaatctcatggtaaaaccccttttagcatctatcaaggtaaatggaacctgttga

SEQ ID NO: 1111 - DNA, 639 bp, Saccharomyces cerevisiae
atgtcgtccacggatatcaagccttgtgccgtgaacatccctgtttccgctcacatcaccttccactacaagtcgatcgcggacagaagcagcagcaggagcagcagcagcagctcctgctcctctgctacatctaaagcctgctcccccagaggcagctccgtcggcttaccgcctgctttatcaactgacaatgaaatcgtcgagactgtacttaatgtttccgctcccgttgtagcagaccctacgcggccctcattgttcaagagtaactacaccgcagcctcgtgcttgacttctgacccaacctcgccgtcactactgccctcttctaggcgcaactctgtattgccggcaagcgacttccaccaatgcgcgcatcacaaaaactttcaaagaagggccagtgagccacaactgccctccttcgataatcgctcgtcgtccgagatgaaaaggtccgtctcgtacgcccagcatagcatgatgttccccatcagtgaccaacaggagccgcaaacatccgcgtctcctaacgaccactcagacccgtcttgtccttgcaacagacatcaccacagaagaaactcggtcgccgtcaagtttgacaaaccattgtatgagagactagagacgtag

SEQ ID NO: 1112 - DNA, 639 bp, Saccharomyces cerevisiae
atgtgggaacaaagacgacaaaaggtagttttttccttgactatactggtaagatatcgtctaaaacaaagcatggccaagaaaatatcaaagaattcaagagctgctagacaatcggatgctcttgaaccagaggtaaaggatttaagtgaactacctagagctgaaaaaaccgatttgactaatattttgattagaacagcagccaagaatgaggcattgctggaagcaaagatatctaagaaagccaataaaagtaagaggggcaagaagttaaataaaaaggctctggaagacaaactggccaactctatttcatccatggacagggatcgtttagtgaaggccttgaattttaccaatcgtctggacggtaaaattgccaagtccatttctcgtgccaagtacattcaaaatacaagaaaggctggctgggatagcaccaatgagactataaaaaaagagctggcttttttgaacggagggttgtctgtgcaggcaaaaagtgctagtgaaggtaatgctgaaaaggaagatgaggagatcccagaagtttttgactctttagcagaggataacacagtgcagaagactcctacaaatagattcggtgtcctgccagacgatgttgaagaatag

SEQ ID NO: 1113 - DNA, 639 bp, Saccharomyces cerevisiae
atgtttaatagagtctttaccaggtcatttgcatcaagcttaagagctgctgcttccaaagctgctgctcccccaccggtgagattgttcggtgttgagggcacttacgcaacagctttatatcaggccgctgcaaagaactcctctattgatgctgcctttcaatctttgcaaaaagttgaaagcacagtcaaaaagaatccaaaattaggtcacttattactgaatcctgcattgtcattgaaggacagaaattctgtcattgatgccatcgtggagactcacaagaatttggatggttatgtcgttaacctattgaaggttctttccgaaaataacagactgggatgttttgaaaaaattgcgtctgactttggcgttttaaacgatgctcacaacgggttacttaaaggtacagtgactagtgctgaaccattggatcctaaatctttcaagaggattgaaaaagctttgagcgcctccaaattggtggggcaaggtaaatctttgaagctggaaaacgtggttaagccagagattaagggtggtttgattgtagaacttggtgacaagactgttgacttaagcatttctacaaagattcaaaaactgaataaggtcttagaggacagcatttaa

SEQ ID NO: 1114 - DNA, 639 bp, Saccharomyces cerevisiae
atgtttatcctttcaaaaatcgctgacttggtacgaatcccgcccgatcaattccatcgcgatacaatatcggcaatcacacatcagttaaataataagttcgccaacaagattattcccaatgtcggtctatgtattacgatttacgacttattaaccgtcgaggaaggccaattgaagccaggcgatggatcatcctatattaacgttacatttcgagccgttgttttcaaaccgtttctaggtgagatagtaactggatggatttctaaatgtacagcagaaggcataaaagtttcactgttaggtatatttgatgacatttttatcccacaaaatatgttattcgaagggtgctattatacccctgaagaaagtgcatggatttggcccatggatgaagagacgaaactatatttcgatgtaaatgaaaaaattagattcagaatcgaaagagaagtttttgttgatgtgaagccaaaatcacccaaagaacgagaattggaggaaagagctcaattagagaatgagattgagggtaagaatgaagaaactcctcaaaacgaaaaacctccagcatatgccctattaggtagttgtcaaactgatggcatgggactcgttagttggtgggaatga

SEQ ID NO: 1115 - DNA, 642 bp, Saccharomyces cerevisiae
atgaaagtaaaggctacaaaactaaggataaaacaacgaaggaaaaataaggggctcaatataagcagattagatattatcagagcagaaatggatgtggtaccatctccgggtttaccagaaaaagtaaacgaaaaaagcaaaaatattcccttacctgaaggaattaaccttttatcatcaaaggagataatcgatctaattcaaacccacagacaccaattagagttatacgtcacaaaattcaatcccttaacggactttgctggaaagattcatgcattcagagatcaatttaaacaattggaagaaaattttgaagatttacatgagcaaaaagataaggtccaagccttattagaaaactgtaggattttagaatccaaatatgtagctagctggcaagattaccattccgaattttcaaaaaaatatggtgacatagcattaaaaaagaaattagaacaaaacacaaagaaacttgatgaggagagttcacagctagaaactaccacaaggtccattgactcagccgatgacctggatcagttcatcaaaaattatctggacatacgaacacaatatcacttgaggagagagaaactggcgacctgggataaacaaggtaatttgaaatactag

SEQ ID NO: 1116 - DNA, 642 bp, Saccharomyces cerevisiae
atgaacaaggaatctaaagatgatgatatgtccttggggaagttttccttctcccacttcctatattacttggtgctaatagtagtaatagtgtacggtttgtacaagcttttcactggacatggatccgacattaatttcgggaagttcttgttaaggacatccccttatatgtgggccaatcttggtattgccctttgtgtaggcttaagtgtcgtgggggcagcatggggtattttcattactggttcatccatgattggtgccggtgtgcgtgctccaaggattaccaccaagaatttaatttccattattttctgtgaagtggttgccatttacggtctgattattgccattgtcttttcttcgaaattgactgtggctactgctgagaacatgtactcgaaatcaaacctgtacactggttattctcttttctgggcaggtatcactgtcggtgcttccaatttgatttgtggtatcgctgtcggtatcaccggtgcgactgctgccatttccgatgctgctgattccgcattgtttgttaaaattttggtcattgaaattttcgggtccattttaggtttattaggtttgattgttggtttattgatggccggtaaagcttctgaatttcagtaa

SEQ ID NO: 1117 - DNA, 642 bp, Saccharomyces cerevisiae
atgaactacagcgcagactctggtaatacagtttatgtggggaatatagatccaaggataacgaaagaacaactttatgaactcttcattcagatcaaccctgttttaaggattaagtatccgaaagataaagttctacaagcttaccaaggctacgcattcatcgaattttataatcaaggagatgctcaatatgcaataaaaataatgaataataccgttagattatacgaccgactgataaaggttcgtcaagtaaccaattctacaggaacaactaatttaccttcaaatatttctaaggacatgattctacctattgctaagttgttcataaaaaaccttgcagattcgatagatagcgaccaattagtgaaaattttcaataaatttggtaagctcataagggaacccgaaattttctacctatcaaacggaaaattaaagtgtgcttatgtttattttgaggactttgaaaaagcagatttggcaataaaatctttgaacaatcagttagtcgccaacaacagaattactgttgattatgccttcaaagaaaatggaaaaggtaacgcaaaatacggtgatgacgttgacaggctgttgaataaagaagcattaaagcacaacatgttgaaataa

SEQ ID NO: 1118 - DNA, 642 bp, Saccharomyces cerevisiae
atgaagtacattattgagcatatggaggaagggtttagtgaatgggtcattttagagtatagccaaatcctgagagaagtaggagctgaaaacttgattttatcatcgttaccagagagtaccacggaaaaggacatccctcaaaggctactaaaacttggtttaagatggactacaaaggatttgaagggcattaacgaagatttcaaggatttggaactgttaaaagatggcagagtctgtctattggaccctagggctacaatcgatttacagccggaggatgctacgaaattcgactatttcgtatttggtggcatattgggtgatcatcctccaagagatcgtaccaaagaactaaagactgcctatccgaatcttttaattagcagaagactaggtgataaacaaatgactacggatactgccataagaacaacacagttgattatcaaagacaggattgcatttgaagacatcaagttcattgactaccctgaatttaggttcaataaaaatgaggccacggaaatgccatttagatacgttttagataaagaaggtaaacctattttgcctgaagggatgttggatttgatcaagaaggattctgctcaaagtttggacgatctgttgatgtag

SEQ ID NO: 1119 - DNA, 642 bp, Saccharomyces cerevisiae
atgattatgaatagtacaaacacagttgtatatatcaaagttaagggtaggagaccacagggattcttggatcctcccaaatttgagtggaatggaacaaaggagcgacagctttggacaatggtatcaaatttgaattattcacaagatcaaatagattggcagaatttatcaaaaatatttgaaacgcctgaattttttcttaaaaagagaacatataaattatttgctgaacacttagagcttttacaactacaattggagaaaaaaagagatcttgagaagtattcaaatgatcaagtgaatgaagggatgtctgatttaatacataaatatacccctactttacaaaatgataatctattaaatgtatccgcaagcccactgaccacggaaagacaggattctgaagaagttgagacagaagtaacaaatgaggcgttacaacatttgcaaacttccaaaattttgaacattcacaagaaaacatcggatagtgagaataagcctaatgacaaattggataaggatggtattaataaagaaatggagtgcggtagttcagatgacgatttatcttcgagcttaagtgttagtaaatctgcgttggaagaagcgctaatggacagattgcaattctga

SEQ ID NO: 1120 - DNA, 642 bp, Saccharomyces cerevisiae
atggaatatgaagatttggaactgattaccatttggccttccccgacaaagaacaaactttgccaatttatcaagcagaatctttcaaaggagcatgttgttacccagttattttttattgatgccacaagctcattcccgctaagtcaattccaaaaacttgtaccgccaacccttccagaaaacgtcagaatatacgagaatattagaatcaacacttgccttgatctcgaagaactcagtgccataacggtgaaactactacaaatcttatctatgaataaaataaacgcccaaagaggcactgaagacgctgtgacagaacccctaaagatcatcttatacattaatggattagaagtcatgtttagaaactcccagttcaaatcctcccctcaaaggtcacacgaactgttaagggatacattgctcaagttacgtgtaatggggaatgacgagaatgagaatgcatctataagaacactgctagaattccctaaggaacagcttttagattattatttaaaaaaaaacaacaatacaagaacgtcatctgtgcgtagcaagagaaggcggattaaaaatggagattcccttgctgaatatatctggaagtattatgcagattcattattcgaatga

SEQ ID NO: 1121 - DNA, 642 bp, Saccharomyces cerevisiae
atgggacttatttcatacgaaaatgaggcgataaacgaggtgaaaaaggcagataaccatcacgttagcaaatttgtgactagttactatgggccatcatcgtcgtcatggcagtcaggaatatggattttgtttgtgctgtttgttgccgcagtaatccttataatactgttcacttttgtagcgaacagaaggagacgaaggatggggcgtgctcccattagaggtacggcatggttgacaccgccttcatacagacagtctcagcaacaatatactgggaccgttcagcaacggacagatgattatgttcctgagtatacagaaacagcgaacgaacatgatcttggatactatgaccagcggggcgagtttcaccccaacgataaggctgcatacgtggcccccccgccattggtacaagaatgttcatcagaatctgttaattctttagaaagacctcccgctgctgtagttcaccaagctaactctttagatacggattacggtttaacaaggcctagcaatgggcgcgttccagctgtaagtgatacggtggagcaattggaaaggcttccgggcgggactacaacgcaggaaattaacccaccggagagggcaaaggtaaatgcaaggtcatga

SEQ ID NO: 1122 - DNA, 642 bp, Saccharomyces cerevisiae
atgtcacaaaaggataacctactcgacaatccggttgaatttttaaaagaggtcagagaaagttttgatattcagcaagatgttgatgccatgaaaagaatccgacacgatcttgatgttataaaagaggaaagcgaagcaagaattagtaaagagcattcaaaggtttctgagtcgaacaagaaattgaatgcggaaagaataaatgttgctaaattggagggagacttagaatatactaacgaagagagcaatgagtttggtagtaaagacgaactagttaaacttctgaaagatttggacggattggaacgtaatattgtgtcacttcgaagtgaattggacgaaaagatgaaattgtacctcaaagatagtgaaataatatccacaccgaacggttccaaaataaaagcaaaagtaattgaacctgagctggaagaacaaagtgcggtcaccccggaagcaaacgaaaatattctaaaattgaagctatacagatctttaggagttattttggatttagaaaatgatcaagtccttattaacagaaaaaatgatgggaatattgatattttacccttggacaataacctcagcgatttctataagaccaaatacatctgggaaagattaggaaagtga

SEQ ID NO: 1123 - DNA, 642 bp, Saccharomyces cerevisiae
atgtcactaccggcacatttgcagcagactttctcaccagaagaaatacagttcattgtggaaaacgagccaataaagatttttcccagaataacaacacgccaaaaaattcgtggcgatgatagaggaactggaaaccacacccgctggcaacttattactacagatgacaaagctttaaataatatggtagccatgcgttctacagaagtggttctttggatcgctctattactgaagcaacaatccaagtgcagtattgtagcaccacagtggttaacgacgaaagagcttgatagaaaaatacaatatgagaaaactcatccggataggtttagtgagttgccgtggaactggcttgtcttggcacgtatacttttcaataaagctaaggatgattttcatgaccccattcacgaattacgtggtaaaatacaagacttaagggaaataaggcagatcaaagtgttaaaaggccttaagtatttgaatgaatctcatttacaattggataatttaagtctattagaaatcaatgagttgaggccgttcattactgaaatcatggataaactgcgagaaattcacacagcatctcttaccgctggtactgaaaatgatgaagaagaattcaatatttaa

SEQ ID NO: 1124 - DNA, 642 bp, Saccharomyces cerevisiae
atgtccgttgaagaagttagcaagaagtttgaagaaaacgtttcagtcgatgataccacagctactccaaagactgttttaagtgacagtgctcacttcgatgtcaagcacccattgaacaccaaatggactttatggtacacaaagccagccgtcgataaatctgagtcgtggtctgatctattacgtcccgtcacttcattccaaactgttgaagaattttgggctatcattcaaaatattcctgagccacacgaactaccattgaaatcagattaccacgtcttccgtaatgacgttagacctgaatgggaagatgaagccaatgctaaaggtggtaaatggtctttccaacttagaggaaaaggtgctgatattgatgaattatggctaagaactttactagcagttattggtgaaacaattgatgaagacgactcccaaattaacggtgtcgttttaagcattagaaaaggtggtaacaagtttgccttatggactaaatctgaagacaaagaaccactattgagaattggtggtaaattcaagcaagttttaaaattaaccgatgacgggcatttggaattctttccacattccagtgccaatggtagacaccctcaaccatcaatcaccttgtaa

SEQ ID NO: 1125 - DNA, 645 bp, Saccharomyces cerevisiae
atgaacattctgcgaatagcatgtcgttcttttcattgcctgcgctgcggtccattactcaatgagaacaggggatggtcatccaaaaagattattaaattagtcaataaatcgagtttgtccaataaagagtttacagaaaaagtacgagatggtacgaaagacattcctgagtggaagaagcagaaaatggcagttagaaaaaaattgcaaggccagaggtggaacccaccaaaaaagatatcacaggaacaaatggaggctctaagactattgaaattcaactttcctgaactgacagcatctgatcttgcagaccggttcaaaatttctcccgaggctgttcgaagaattttgaagtccaactggaagcgtactgatgaggaaaacaataacacctacgagagatggaaaagaagaggagaacggataaaagaaatgtatcaaagaaaagaggatgccgattttgtatccaatcaaattgttactagcagaaagattatacttgggtccaactcaaattcacctgaattaatagcaaggaatgttcgcacttttaaacctttcaagcctaacaacagtacacctgaaaagaaaaacaccaacaaactatacattttgaagcatttgggctcgaaacaataa

SEQ ID NO: 1126 - DNA, 645 bp, Saccharomyces cerevisiae
atgagcgacaagatatcctttctacctcccgaacccatccaactacttgacgaagactccacggagcctgaactcgacattgactcacaacaagaaaatgagggacccatcagtgcgtcaaacagcaatgatagcactagccatagtaatgattgcggtgccacaattaccagaacaagacctagacgaagcagttctatcaatgcaaactttagttttcaaaaggctcatgtcagcgattgcaccatagtcaatggcgaccatggaacaaagtttgctgtctggagaattaccgtatttcttgaacccaacttgaaggcttttgcggccaagagggaaagctataaaatccaaacctataaacgatactccgatttcgtcagattacgagagaatttgctcacaagaatcaagacagcgaaacctgagaaacttaactgtttgcagattccacaccttcccccttcagtgcagtggtacagttcttggaaatatcaagaagtgaatctgaacaaggactggctggcaaaaagacagagagggctcgagtacttcctcaatcacatcatccttaacagcagcctcgtagaaatgaccaaagatatactcatacagtttctagagccttcaaaacgagttgcatag

SEQ ID NO: 1127 - DNA, 645 bp, Saccharomyces cerevisiae
atgagtaatggacacgtcaagtttgatgccgatgaaagtcaagccagcgcaagtgctgtcacggatagacaagatgatgtgctggtaatatcaaaaaaggacaaggaagtgcattcaagtagtgatgaggaaagtgatgatgatgatgctccacaagaagaagggcttcactctgggaaaagtgaggtagaatcacagatcactcagagggaggaggctataaggctggaacaatcacaattgcggtccaagagaaggaagcaaaatgaattatacgccaagcaaaagaaatcagtgaatgagacagaggtcactgatgaagtaattgcggagcttcctgaggaattgctaaaaaatatagatcagaaggacgaaggtagtacgcagtactcatcttcaagacatgtaactttcgataaattggatgagtcagatgaaaatgaagaggcattggctaaagctataaaaactaagaaaaggaagacattaaaaaatttaaggaaagattcggtgaaaagaggaaaatttagagttcaattgttatccaccacacaagattctaaaacattaccaccaaagaaagaatcatccatcatacgttcaaaagaccgttggctaaatagaaaggctttgaataaagggtaa

SEQ ID NO: 1128 - DNA, 645 bp, Saccharomyces cerevisiae
atgataaagtcaacactaatctacagagaagatgggctgcctctttgtacgtctgtggacaacgaaaatgatccctcattatttgaacaaaagcaaaaggtgaaaatcgtcgtttccagattgacaccacagtctgccacggaggctactttggaaagtggctcctttgagatccattatttgaagaaatccatggtgtactacttcgtcatttgcgaatctggatacccaagaaacttagcattctcataccttaacgatatagcgcaagaatttgaacactcatttgctaatgagtaccccaagcctaccgtaagaccataccagtttgtaaactttgataactttctacagatgacaaaaaagtcatacagtgataagaaagttcaggacaatttggaccaactaaaccaagagcttgtaggtgtcaagcaaatcatgtccaagaacatcgaagacctactttacaggggagattctctcgataaaatgagtgacatgagttcttctttgaaagaaacatccaaaaggtacagaaagtccgcgcaaaagatcaacttcgatctcttgatcagtcaatatgctcctattgtcattgtcgctttctttttcgtctttctcttctggtggatcttcctcaaatag

SEQ ID NO: 1129 - DNA, 645 bp, Saccharomyces cerevisiae
atggccagaattgtcgtattaatttcgggctcaggttccaacttgcaagccttgatcgatgcccaaaagcagggccaattaggcgaggatgctcatattgtctctgtcatatcttccagcaagaaggcatacgggttaactagggcagcggacaataatatccccacaaaggtttgttcgctatacccatatacaaagggtattgcgaaggaggacaaagccgcaagggccaaggcaagatcccagtttgagaacgacctcgcaaaactagtgctcgaggaaaagcctgacgttatcatctgcgcgggctggttattgatccttggatctactttcttgagccaactgcaatctgtgccgatattaaatctgcatccagcgctaccaggttgtttcgatggtaccacacacgcaattgaaatggcatggcgcaaatgtcaggacgagaacaagcctctgacggccggatgcatggtgcactatgtcatcgaggaggtcgacaagggtgagccattggtggtaaaaaagctagaaatcatacctggcgaagaaacactagagcagtacgagcaaagggtacacgatgctgagcacatcgcgattgtagaagctacatataaggttttacagcagcttcacaaataa

SEQ ID NO: 1130 - DNA, 645 bp, Saccharomyces cerevisiae
atgtcatttaacagtccattttttgatttctttgacaacatcaacaacgaagttgatgcctttaacagattgctgggtgaaggcggcttaagaggctacgcaccaagacgtcagttagcaaacacacccgcaaaggattctactggcaaggaagttgctagaccaaataactatgctggcgctctttatgatcccagagatgaaaccttagatgattggttcgacaatgacttgtccctgttcccatctggtttcggtttccctagaagtgtcgcagttccagttgatattttggaccatgacaacaactacgagttgaaagtcgtggttcctggtgtcaaaagcaagaaggacattgatattgagtaccatcaaaacaagaaccaaattttggtttctggtgaaattccatctaccttgaatgaagagagtaaagacaaggtcaaggtcaaggagagcagctctggtaagttcaagagagtcatcactttgccagactacccaggtgtggatgcagacaacattaaagcagactacgcaaatggtgttttgacattaacagttccaaaattgaagcctcagaaggatggtaagaaccacgtcaagaagattgaggtttcttctcaagaatcgtggggtaactaa

SEQ ID NO: 1131 - DNA, 645 bp, Saccharomyces cerevisiae
atgtcatttattcagaggaggttattgtcgcaaacactttttctgcgctctcaagtggggtctttaccactttatatatctcctgaagttcaggtttccataaatgcattatccatgcccaggattatcagaaaaggtagaacttcaatgaatatatcacagaatatcacagtaaagggacccaagggtgaattgtccgtggaggtccctgattttttgcacttggacaaggatgaaaagcacggtaaaataaatgttacagttcagaattcagaagataaacatcaacgttcgatgtggggtacagtaagatcacttataaataatcacattataggtgttactgaggggcatcttgctgtccttagatttgtagggacaggttatagagctcaattagaaaatgatggtaaatttgtcaacgttaaggtgggtgcatctatcaaacaaggattggacgttcctgaaggtattgttgtcaaaacacctgctcccacgtctctgattattgaagggtgcaataagcagcaggtccttctttttgctgccaaattgagaaaattccatccaccagagccgtataaaggcaaaggaatatacgttaacgatgaaacaataaagctaaaggacaagaaaatcaaataa

SEQ ID NO: 1132 - DNA, 648 bp, Saccharomyces cerevisiae
atgactgcagttaacatctggaagccagaagataatatacctagggagattttggcaattctttcgaaacctcacccaaattatcagttagcgtttttgaatattatacaacttttgaaaacgcaaagaagaactggttgggttgaccatggtattgacccatgcgaaagtatatctgaccatatgtacagaatgggtttaactaccatgctgattacggacaagaatgttgatcgtaacaaatgtatcagaatcgcacttgttcacgattttgcggagtcattagttggtgatattacacctaatgacccaatgacaaaggaagagaaacatcgcagagaatttgaaactgtcaagtatctctgtgaaagcataataaggccctgcagtgaaagcgcatctagggaaattcttgatgactggttagcatacgaaaagcagacctgtttggaaggaagatatgtcaaagatattgataagtatgaaatgttggttcaatgttttgagtacgaacaaaagtataatggcaagaaggatttgaaacaatttttgggagccatcaatgatataaaaactgatgaagttaaaaaatggacacaatctttactggaagatcgacaagcctttttcgacagtttgaaggagtaa

SEQ ID NO: 1133 - DNA, 648 bp, Saccharomyces cerevisiae
atgagcagatccgggaaatcattgacaaagtacaaaattgtttttttgggagaacagggtgttggaaaaacatcgctgatcactagatttatgtatgatacgttcgatgatcattaccaagccacgattggtatagattttctttccaagaccatgtatttggatgataagacaattagattacagttatgggatacagcaggtcaggaaagatttagatcattaataccttcatatatcagagattcgagagttgctattatcgtttacgacattacgaagagaaaatcatttgaatatattgataaatggatagaagacgttaaaaatgaaagaggtgacgaaaatgttatattgtgcattgttggtaacaaaagtgatttatcagatgaaaggcaaatctcaaccgaagagggagagaaaaaagcaaaactattgggtgctaaaatctttatggaaacgtccacaaaggcaggctataatgtcaaagctttattcaaaaagattgccaaatcgctgcctgaatttcaaaacagcgagtcaactcctttggatagcgaaaatgcaaatagtgcaaaccaaaataaaccgggagtcattgatatttctacagcagaggagcaggaacaaagcgcttgtcagtgttag

SEQ ID NO: 1134 - DNA, 648 bp, Saccharomyces cerevisiae
atgagcgaggaaccaccttctgaccaggtcaatagtctccgtgactcattgaatcgatggaatcaaacaagacagcagaactcgcagggttttaatgaatctgcgaagacattgttctcaagctgggcggattctctcaataccagggcccaggatatatatcagacgttgcctgtatctagacaggacttggtgcaagaccaggagccgtcgtggttccaattgtcaagaacggaaagaatggtactttttgtctgttttcttttgggtgcaacagcctgtttcactctttgtactttccttttccccgttctagccgctaaaccaagaaagtttggtttactatggacaatggggtccctactatttgttcttgcgtttggggtacttatgggaccactcgcgtacttaaaacatttgactgcaagggaaaggctgcctttttcgatgttctttttcgccacatgcttcatgacgatttatttcgcagccttttccaagaacacggtgctgactattacatgtgctcttcttgaattagttgccgtcatttattatgctatttcatatttcccattcggtgcaacaggtttgaggatgttaagctctgctggtgtcaattcggcaagaggtgttctgcgcatctga

SEQ ID NO: 1135 - DNA, 648 bp, Saccharomyces cerevisiae
atgagctgtaccactgataagttaatacaaaagtacgacgcccttgttaggaaaaccacagaacataaattcgctaaggaactatgtgccggaacattgaaggaccgtagtttgtacatctatttatcacaagatctgcaattttttgaaactagcttaaggttgatatgtaagacgacttctttagcaccaactactcacgctttaataaccttagccaaaaagattggatttttttctaatgatgaaaactcatactttcatgactgcttagaattattggcaccatccctcaccaaggaagaaagagataattttgacaataaagcgatccccggcgttgatgcgtatattaatttcttagatgagctgagaaaggacgcctcaattacatggccatccttagtaaccagcttatgggttgctgaggaactctattggagatgggctcgtgatactcctagagccccagggttgcattggaaatatcaaaaatggattgatttacatgatggtgagcattttcaaacttggtgtgaatttctaaaggctgaagttgacaagtttcccgtcgaagaagtggaaagcatatttgtgaaggtttcacagttcgagttcgaattttttgaatcttgttacaacgcctaa

SEQ ID NO: 1136 - DNA, 648 bp, Saccharomyces cerevisiae
atgatcaaatctacaattgctctaccctctttcttcattgttttaattttggcgttggtcaattcagtggctgcatcttccagttatgcaccagttgctatcagtttaccagcattcagcaaagaatgcctgtactacgatatggttactgaggatgattccctggctgtgggttaccaagttctaaccggtggtaattttgagattgattttgatattactgctcctgatggatctgtgattactagtgagaaacaaaagaagtactcagactttttattaaaatcgtttggagtggggaagtataccttttgtttttccaataactatggtacagcgttgaaaaaggtagaaattacactagaaaaggaaaaaactttgactgacgagcatgaagctgatgtcaataacgatgacattattgccaataacgccgtggaggaaatagatagaaacttgaacaaaatcacgaagactttgaactatttgagagccagagaatggagaaacatgtctaccgtcaattccaccgaatcaaggttgacttggttatctatattgattatcattatcattgccgttataagtattgcccaagttctacttattcaattcctcttcactggtcgtcaaaaaaattacgtttaa

SEQ ID NO: 1137 - DNA, 648 bp, Saccharomyces cerevisiae
atggaccaagaaaatgaaagaaacatctcaagattatggagagcattcagaacagtaaaagaaatggttaaggacaggggttattttatcactcaagaggaagtcgaattgccattggaagatttcaaggccaagtattgtgactccatgggcagaccacaacgtaaaatgatgtccttccaggcaaatccaacagaagaatctatatcaaagttcccagacatgggctccttatgggtagaattttgtgatgagccttccgttggtgtaaagacaatgaagacttttgttatacatattcaagaaaaaaatttccaaacaggtatctttgtttaccaaaataatattacaccaagtgcaatgaaattggtgccttctataccaccagccaccattgaaacttttaatgaagctgccttagtggttaatattactcaccacgaattggttccaaagcatatcagattgagtagtgatgagaaaagagagcttttaaaaaggtatagattgaaggaatcccaattgccaagaattcaaagagctgatcctgtagccttatacttgggattgaaaagaggcgaagtagttaaaatcataagaaaaagtgaaacctctggtcgttatgccagttacagaatctgtatgtag

SEQ ID NO: 1138 - DNA, 648 bp, Saccharomyces cerevisiae
atggatttttacaaattagacgagaagctgaaggagttgaaaaggaaaagagtagatgtatctataaagagtaggaagttggctgacagagagattcaggaagtaagcgcaaatcgaaaaccaagagtatacagtatggaagacgtaaatgatgcagatgaatcagtaggagatacagaaagtcctgaaaaagagaaagcatttcattacactgtccaagaatatgatgcgtgggaacgtaggcatcctcaagggaagactgggcaaagccaaagaggtggaatttcctatgatcaacttgcaaaattgagttatgagaagaccttgcggaatctcgctacgcaaacacagaattcgagcaaacaggatagttccgccgatgaagaagacaataaaaacgtacccaagaagggtagaatcggcaaggtacagaaggacactaagacgggtaagataacaattgcagatgacgacaagctagttaataagttggccgtttctttgcaatctgagtcgaaaaaaagatacgaagcaagaaaaagacaaatgcaaaatgcaaaaacactgtatggggttgaaagcttcattaatgacaaaaataaacaattcaatgaaaaattgagcagggaatcaaaaggatcagaataa

SEQ ID NO: 1139 - DNA, 648 bp, Saccharomyces cerevisiae
atgggccttttggcttatatccctacgaacgttttggccacatacctgactttggtattgagaagtatcggtttcacaacctttcaagccaacctgctagctattcctaactttgttcttcatattctcctgctgtttggtttaacatggtcgacagaaaaatgtaataacaggctaggtttgagtctgttacaaccgttgtacactgttcctcttcttgcagttcttcgcttttggaaaggtacaatgtttaataaatggggaacttatgcaattattaccttaatattagataatccgtatatccatgcaatttgtgtatccttgtgttctagaaactcccaatcagttaaaacaagaacagtatctacttgcttgtacaatatgttcgtgcaagcaggtctcatcatatcctcaaacatttatgcgaaaagcgatgccccactctatcgtaagggaaatggagttctttttggtttggcactttttatgtttccaatattaattggtagcaaattgatttatgtctatatcaacaagcagagggataagaggtggaatgcaatgtcagaagaggaaaaagaccactatctaagtactactagtgatgctggttcacgtagactcgattttagattctatcactga

SEQ ID NO: 1140 - DNA, 648 bp, Saccharomyces cerevisiae
atgggtgaagcactacgtagatcaaccaggattgcaatatccaaaagaatgttggaagaggaagagtccaaactggcccctatttcgacaccggaagtgcctaagaagaaaatcaagacgggtcctaaacataacgctaatcaagcagtagttcaagaggcaaataggtcatctgatgttaacgaattagagataggcgatcctattcctgatttgagtcttttaaatgaagataatgactctatctccttgaagaaaatcaccgaaaataacagagttgtggtgttttttgtgtatcccagggcaagcacgcctggttgtactagacaggcctgtggatttcgtgacaattaccaggaactcaagaaatatgctgctgtctttggactgagtgcagattctgtgacatcccagaaaaagtttcagagtaaacaaaatttgccatatcatttactaagcgatccaaagagagagtttattgggttgctaggagccaaaaaaacgccactttctggttctattagatcgcatttcatttttgttgatgggaagttaaaattcaaaagagttaagatatcaccagaagttagtgtaaatgacgccaaaaaggaggttttagaagtcgctgaaaagtttaaagaagaatga

SEQ ID NO: 1141 - DNA, 648 bp, Saccharomyces cerevisiae
atgtcaggcttgagaactgtttctgcttcatccggtaatggaaagagctatgactctattatgaaaattttattgattggtgattctggtgttgggaaatcatgtttattggttcgttttgttgaagacaaatttaacccgtcatttatcaccaccattggtattgatttcaaaataaagactgtcgatatcaacggtaagaaggtaaagctgcaactttgggataccgctggtcaagaacgtttccggacaatcaccacagcgtattatcgtggtgctatgggtatcattcttgtatatgatgtgacagacgagagaacatttactaatatcaagcaatggtttaaaaccgttaatgagcatgcgaacgatgaagcacagctactgttggttggtaacaagagcgatatggagacgagagtggtaacagctgatcaaggtgaagccttggctaaggagctgggtataccattcatcgagtccagtgctaagaacgatgacaatgtcaacgagatttttttcaccttggcgaagttaatccaagaaaaaatcgacagtaacaagcttgttggcgtcggtaacggtaaagagggcaatattagcatcaatagtgggagcggaaacagttctaaatcaaattgctgttga

SEQ ID NO: 1142 - DNA, 648 bp, Saccharomyces cerevisiae
atgtctagggctaagagaattatgaaagaaatccaagctgtgaaggatgatcctgcagctcacattactcttgaatttgtgagtgaatctgatatccaccatttaaaaggcacatttttgggcccacctggaacaccttacgagggtggcaaatttgtcgtggatatcgaagtacctatggagtatccattcaaaccaccaaagatgcagttcgacacaaaagtataccatccaaatatatcatcagtgacaggtgccatttgtttagatattcttaagaatgcatggtcgccagtgataacactaaagtctgcattgatttcgctacaggcgctactacaatctccagagcctaacgatcctcaagatgcagaagtagcacaacactatttacgggatagagaatcttttaataagactgctgcactatggacgaggttatacgccagtgaaacttccaatggtcaaaaaggcaatgtagaggagtctgatttatatgggattgaccacgatctgattgacgagtttgaatctcaaggttttgaaaaggacaagattgtggaagtgttgagacgattaggcgtcaagtccttagaccccaatgacaacaacacagccaaccgtatcatcgaggaattgttgaagtga

SEQ ID NO: 1143 - DNA, 648 bp, Saccharomyces cerevisiae
atgtctgcttcattgattaatcgttccttaacaaacattaggacagaactggattttctaaaagggtcaaatgtcatttcaaatgacgtttacgatcaaataaataagagcttgccggcaaaatgggatcctgccaatgcaccccgcaacgccagtccagcttccttggaatatgtcgaagctctttatcaatttgatcctcaacaagatggtgatttgggcttaaaaccaggtgacaaggtccaacttttagaaaaattatctccagagtggtacaagggtagctgtaatggccgtaccggtattttcccagcaaactatgtcaagccagctttctctgggtctaacggtccatccaatcttccaccacctccacagtataaagctcaagaattacaacaaatccccacgcaaaatagtgccgcatcatcttatcaacagcagccatttcctccaccttccacaaattattatcagcagcctcaacaacagccgcaacaagctcctcctccccaacaacaacaacaacaacaacaacatcagagctcacatagccacttgaagagctttggtagcaaattgggtaatgccgccatttttggggcaggcgctagtattgggtcagatattgttaataatatcttttaa

SEQ ID NO: 1144 - DNA, 648 bp, Saccharomyces cerevisiae
atgttaggaataagatcatctgtcaagacctgcttcaagccaatgtctttaacttccaaaagactgatttctcaatctttgctggctagcaaatccacgtacaggaccccaaattttgatgacgttttaaaggaaaataacgatgctgataaaggccgttcttatgcttactttatggtcggtgctatgggtcttttgtcatctgcaggtgccaaatcaaccgtagaaacctttatttcatctatgaccgctactgccgatgttttggctatggctaaagttgaagttaatttagcggctatcccattgggtaaaaacgtggttgtcaaatggcaaggtaagcctgtgttcattagacacagaactcctcatgaaattcaggaagccaacagtgtggatatgtccgctttgaaggacccacagaccgatgctgacagagtcaaagaccctcaatggttaattatgctgggtatttgtactcacttaggttgtgttccaattggtgaagccggtgattttggtggttggttctgtccttgccatggttcacattatgatatttccggtagaatcagaaagggacctgcccccttaaacttagaaattcctgcttatgaattcgatggtgataaggtcattgttggttag

SEQ ID NO: 1145 - DNA, 648 bp, Saccharomyces cerevisiae
atgttcgaaattaaactgaatgatagaataactgaatttctgcgaaagttcaagaatagcgcgaaatcaaacgaaggaattgatgaggacattgatttgttcctgaagcgacacgcaatacctatgcagtcacttcttttttatgtgaaagagtatagaaaagacagtgatctccaatgctctatcaaagaacttttgaaacctttggagttcgaattcaagcccaaggccgtcagaggtttacactattcagaggatttcaagaaaaaattagagtttttgaaatatcaggaacaagaacttgaatatcaaagtatggtcaagagaagcaagtctgtcttttcacttcaagaagacgatgaactcacgccttcacaaattaataaacagattaaggaacaagttaccactgttttcaacgttcttgtaagtgtcatatcggttgttgtggccatttggtactggaccggatcttcaacaaactttccggtccatgttcgtcttttgttgtgcttgttctttggaatattggtcttagtagcagatgtggttgtgtataacagctatctgaaaaaactcgaagaagcaaaagtaaaagaaaaaacaaaggttgagaaaaagaaagttctaagcaagattacactgtaa

SEQ ID NO: 1146 - DNA, 649 bp, Saccharomyces cerevisiae
atgagtgatactacggaagtccctaggcaatcatctgagaacgaccaggataataacttggaaagaaccaactcattaaaaagtccggacgtgaccaacaatataccaagtcttttcaaattagccgccgaatggcaaatcaacaatccacaggaaaccttccaaaaccatatcctggaaaatgatgtactcaagaaaattaatgaaatcactcatttgatccgggaatcgtacaaagacctctccagtcaagatgggatgatgtccaaacaacaacaggaaaagatggattgggatttgttttgtactgttcctgtaaacattattgagcaatatacaaaagacatggacgaaatatatgaaaaaatggaaaggctagcaaaagtaagtataggtcgaaactaggcatcctgtgccatctcaattttactacgttcttttactaataatgcaaatttaataacagcaacaacgtctttggtgtgaatccgcttttcaaatagacgtggaaagatgtggtgactccattctcaatgctgaaacgtggatgaagaagaaagagcgccatttagagtacaaaaatattgaaatggaaagatccgcaaatgaaattaaggaaactattcaaagactaacagatgatagatga

SEQ ID NO: 1147 - DNA, 649 bp, Saccharomyces cerevisiae
atgtttaagaagtatgtctaacatgagaatgaatattgcgtaattcactggttttaccaggggttagtgtacacttttgactcagtaagcaattactaacatcatcatcgatagattcacaagagaagatgtccattcacgttcaaaggtcaaatcttcaattcaaagaacgttaaaggccaaattggtcaagcagtaccccaaaatagaagatgttattgatgaattaattcctaagaagagtcaaatcgagttgattaaatgtgaagataagatccaattgtattccgtcgatggtgaagttcttttttttcaaaaattcgatgaactgattccaagcctgaaattagtacacaaatttccagaggcttatcccactgttcaggttgatagaggtgctattaaattcgttctctcaggtgctaatatcatgtgccctggcctaacttctgcgggtgccgacttaccacctgctcctggttacgagaaaggtacgattgtagtcatcaatgccgaaaataaagagaatgcattggctattggtgaattgatgatgggtactgaagaaattaaatcagtgaacaaaggtcattccatagaattgattcaccatttgggcgaccccttatggaacttcagcgttgagtaa

SEQ ID NO: 1148 - DNA, 651 bp, Saccharomyces cerevisiae
atgcaagcaagtttacctggcgaaaagaaagtcgacacagagcggctgaagcgtgatctatgcccacgtaaacccattgagataaagtacttttcacagatatgtaacgatatgatgaacaaaaaggaccgattgggtgatattttgcatattatcttgcgagcatgtgcactcaatttcggggcgggtccccgtggtggcgctggtgacgaagaggatcgatctattacgaatgaagaacccattattccctctgtggacgagcatggcctgaaagtatgtaagttgcgcagtcctaacactccacgaagactcagaaaaacactagatgccgtgaaagctttattggtgtcgtcttgtgcttgtaccgcaagggatttagatatatttgatgacaacaacggcgttgcaatgtggaaatggatcaaaattctgtaccacgaagtagcgcaggaaaccacgctgaaggactcttatagaataactttggtaccttcttctgatggtatatcagtatgtggaaaactttggggagagttgaacaactgcttccatatgccagcctcattttgcgtaatcgagaagttttgttcagagaaccgaagcgaggaattgacgagtatctggaaaacgattcttttcttcaaatga

SEQ ID NO: 1149 - DNA, 651 bp, Saccharomyces cerevisiae
atgaagactttaattgttgttgatatgcaaaatgattttatttcacctttaggttccttgactgttccaaaaggtgaggaattaatcaatcctatctcggatttgatgcaagatgctgatagagactggcacaggattgtggtcaccagagattggcacccttccagacatatttcgttcgcaaagaaccataaagataaagaaccctattcaacatacacctaccactctccaaggccaggcgatgattccacgcaagagggtattttgtggcccgtacactgtgtgaaaaacacctggggtagtcaattggttgaccaaataatggaccaagtggtcactaagcatattaagattgtcgacaagggtttcttgactgaccgtgaatactactccgccttccacgacatctggaacttccataagaccgacatgaacaagtacttagaaaagcatcatacagacgaggtttacattgtcggtgtagctttggagtattgtgtcaaagccaccgccatttccgctgcagaactaggttataagaccactgtcctgctggattacacaagacccatcagcgatgatcccgaagtcatcaataaggttaaggaagagttgaaggcccacaacatcaatgtcgtggataaataa

SEQ ID NO: 1150 - DNA, 651 bp, Saccharomyces cerevisiae
atgatgggtcgtggcaaattaatactgatagaaggattggataggactggtaaaaccacgcaatgtaatattctttacaaaaaattgcaaccaaactgtaaactattgaagttccccgaaaggtctacccgaatcggaggactcataaacgaatatttgacggatgatagtttccaattatcagatcaggcaattcacctcttgttttcggcaaatagatgggaaatagttgacaagataaagaaagatttactagaaggcaagaacattgtcatggacagatatgtttattctggagtggcatattctgccgctaaggggacaaatggaatggatttggattggtgcttgcaacccgatgtagggttgctgaaaccggatttgacattatttttaagcactcaagatgtcgacaataacgccgaaaaatctggatttggtgacgaaagatacgaaactgttaagtttcaagaaaaagtgaagcaaacttttatgaagctattggataaagagataaggaaaggcgatgagtcaatcacgattgtagacgttactaataagggcattcaggaagttgaagcgcttatttggcaaatcgttgagcctgttttgagtacgcatattgatcatgataaattttcgttcttctag

SEQ ID NO: 1151 - DNA, 651 bp, Saccharomyces cerevisiae
atgattgaccgcactaaaaacgaatctccagcttttgaagagtctccgcttacccccaatgtgtctaacctgaaaccattcccttctcaaagcaacaaaatatccactccagtgaccgaccataggagaagacggtcatccagcgtaatatcacatgtggaacaggaaaccttcgaagacgaaaatgaccagcagatgcttcccaacatgaacgctacgtgggtcgaccagcgaggcgcgtggttgattcatatcgtcgtaatagtactcttgaggctcttctactccttgttcgggtcgacgcccaaatggacgtggactttaacaaacatgacctacatcatcggattctatatcatgttccaccttgtcaaaggtacgcccttcgactttaacggtggtgcgtacgacaacctgaccatgtgggagcagattaacgatgagactttgtacacacccactagaaaatttctgctgattgtacccattgtgttgttcctgattagcaaccagtactaccgcaacgacatgacactattcctctccaacctcgccgtgacggtgcttattggtgtcgttcctaagctgggaattacgcatagactaagaatatccatccctggtattacgggccgtgctcaaattagttag

SEQ ID NO: 1152 - DNA, 651 bp, Saccharomyces cerevisiae
atgtcacaaggtcagtccaaaaaactggacgtaactgttgagcagcttcgaagtatataccaccagtttcatgatatcttggaagaaaaaactgatttgcatctaccgaagaaagaatacgacgatgacgctgttaggagagaggttcagatacagttacaagaatttcttttgagcgctatgacgatggcttcgaagtcactagaagttgtcaacgccgacacggtaggaaagacggtaaagcaattgatcatggaatcacaagagaagtacatggagccctttgaccttgacctgaatgagcaagttagaaagatgtaccaagagtgggaagacgaaaccgttaaggtggcccagttgaggcaaacggggcctgcaaaaatcaacgaagtttacaacaactcaaaggatgagtatttggcacaattggatgggagaatcggcgttcttcaagctagaatgatgcagcaacaatctgctgaccatgatgatagtaccgacgatgccgatgatcacatcaactgggagcacatcaagcaggattacgttgcctcactcaatgaattgtatcaaacacagcaagacctacccaaggtaagatataacgttgaaaaggtcaagcgcttaatggacttcctggaggaggattga

SEQ ID NO: 1153 - DNA, 651 bp, Saccharomyces cerevisiae
atgtccgataaagttattaaccctcaagttgcatgggctcaaaggtctagtactactgatccagaaagaaattatgtcttaataactgtgtcaattgcagactgtgatgcccctgagttaaccattaagccatcatacatcgaattaaaggctcaatcaaagcctcatgttggcgatgaaaatgtccatcattatcaattacacattgatctatacaaggaaattatacctgaaaaaacaatgcataaggttgctaatggccagcactactttttgaaattgtataaaaaggatttagaatctgaatactggccacgtttgacaaaggaaaaggtgaagtacccttacatcaaaactgatttcgataaatgggttgatgaagatgaacaagacgaagttgaagctgaaggtaatgatgccgctcaaggaatggatttcagccaaatgatgggaggtgctggaggtgctggaggtgctggaggcatggacttcagccaaatgatgggaggtgctggtggcgctggttctccagatatggctcaattgcagcaattattggctcaaagcggtggtaatttggacatgggagatttcaaagaaaacgatgaagaagatgaagaagaggaaatagagccggaagtgaaagcttaa

SEQ ID NO: 1154 - DNA, 651 bp, Saccharomyces cerevisiae
atgtcttcggaaccatttaagaacgtctacttgctacctcaaacaaaccaattgctgggtttgtacaccatcatcagaaataagaatacaactagacctgatttcattttctactccgatagaatcatcagattgttggttgaagaaggtttgaaccatctacctgtgcaaaagcaaattgtggaaactgacaccaacgaaaacttcgaaggtgtctcattcatgggtaaaatctgtggtgtttccattgtcagagctggtgaatcgatggagcaaggattaagagactgttgtaggtctgtgcgtatcggtaaaattttaattcaaagggacgaggagactgctttaccaaagttattctacgaaaaattaccagaggatatatctgaaaggtatgtcttcctattagacccaatgctggccaccggtggtagtgctatcatggctacagaagtcttgattaagagaggtgttaagccagagagaatttacttcttaaacctaatctgtagtaaggaagggattgaaaaataccatgccgccttcccagaggtcagaattgttactggtgccctcgacagaggtctagatgaaaacaagtatctagttccagggttgggtgactttggtgacagatactactgtgtttaa

SEQ ID NO: 1155 - DNA, 651 bp, Saccharomyces cerevisiae
atgttatcacactacatcttcctggcattcgttttattgccattcagagtttccgcgttttacttctatggttatggtggagacagaaaatgcttcctgaaggaactatccaaagacacccttttaaaaggttcttacaatttggaagtttacgatgataagttggcagattatgcgcttcccagttataatgactatggcattgtcatagatgtggaagaagtctttgataataatcatagggtagtccaccaacagggctctccttccggtgacttcagctttctagctttggaatctggagaatataagatctgtttacagtctagggtaaataactgggtagggaaaaccaaaacaaagttagaaatcgaatttgaagtcggttttgaagcaatgttggacatgcaaagaaaagaaaccttggaaagtttgcacggaaaagtcagtatattgaattctaagatcgtggatatcaggagagagcaacaactgatgagagaacgtgaagaatcctttagagacatatcagagtctgtgaattctcgcgcaatgtggtggacggtaactcaagttactcttctcattataatttgtgtatggcaaatgaaaagtttacgctcgttttttgttaagcagaaagtattatga

SEQ ID NO: 1156 - DNA, 651 bp, Saccharomyces cerevisiae
atgttattggacgcgcagcgattttttaataggtctttctctattaatgtaatatgcgaattgaaacataatgtaaacacaagaagaaaattcgaaataaaggactggccaacaataatgttagtgagcagaaacgacaagcccaaaatcagtagtgaggaagtcacacattttatagacgactataaaaagaggaggaaaactcagatgacacgattcttcggaatcactatttttacacttataacatgtagaattgccatgaagaaaatgataactgcaaaaggtatgcataggcaataacttcggcctcatactcaaagaacacgtttactaacataacttatttacatagtgccattgaacacttttcaagcaaactacgccagccggacgcagacaataacacacacacaaaagagtcttgcaggttctcttttagcggcaacgggcatgacactaggtatatttggtatgggcatcacagggacatgttggagctgggatgtttcatcatttcaggaactaaagcaacgtctggaaaggcgtgccaacaacgaatttgtagtgacaaacatgcctctggataaaagaagccagcaagtagtggacagcttagttaagacacacaattcatctctttgtaaatag

SEQ ID NO: 1157 - DNA, 651 bp, Saccharomyces cerevisiae
atgtttatggcaagacaagtgttaagaaatggtctatttttaaggagccttgctcccataaagataaccgctagaactgttgcatcagcaaatgcgggcattaagagaaagtcaagatttgataaaacaatgatcaaacctttacttttggtaatgatatttgggtcgatattaaacgcagtaatagccgagaaaaggaacattattgatatggaaaggaaatataagctaaaacttgataaattgaaagagctgatacggagggttcatgataataatggaaaggtagacttcgacgcagatgatgaattgaaacttgtgaatttgcgtttaggaatcgtcggcaagaacgcaactgggatgaaggaagatgagactgatattgtggttcctaaggaagagtcattggaagagatctggcaaagtataatagacgaggcaaaaaaagaagtaatcgaaaaaactccagatgctggcgttaagaacaaagaagggattgtcactgatttgaatgttctaaaagatttagaaaagtcgaaaaaagaagatgaaaaggtttacctaagtggtgatgtccatatgatgatgaaccaaccaggtgatttgaatgaaatcgccaaagaacatgataaaatcccaaaatttctatag

SEQ ID NO: 1158 - DNA, 652 bp, Saccharomyces cerevisiae
atggtagtatccatcataccgcaatttcctgatatcaaggtttcactagcattgtttgaacaggttaaaaatgctaaagaaatacgctctaaaatgagtgaattgtcgacatcctttgcctttattgacccccggttagtctgttcgggggagcagatgtattctgcaatttacaagaccttaatagaagtgaaatataacaagatgagaacaagaaatttgaattccgagtgcgtactatgtctttcacccacttccaatattagtgatgctttcctcaaattcggaatcaaagacgattcgtcacagttaatatgccttaagttccatactaatactgacgatgtagacaaagagcaattgaggacgattatgacttctatagtaaaaggacaagagatcgagtttaatgatgacaatttatcgagattttatgacgaagcgctcataagaaaagtatgttttaataataaattcgaggtaaaaacttcaacagcctcaccagaaacacattgtactaacttcacctttgttttccttttattttgtttttacctattagatctataaattaagtgatgatttcaagccccaagacgtaaatggtctctcaagagctttggtagacgctattcaattgaggggtgtgtag

SEQ ID NO: 1159 - DNA, 653 bp, Saccharomyces cerevisiae
atgaaagcaatagataaaatgacggataatccaccacaagaaggcttaagtgggaggaaaataatatatgacgaagatggcaaaccgtatgttggattacgcaaagcaattcaggatctactgatccaatcaagcttgtgattttttattaacaaattctctataatagttgccgatcatgtaacaccctacttgactttcagtacgtgaccgggaagatatctaatggcctgaagaacctctcatctaacggtaaactagcaggtacgggggctctcactggcgaagcttcagagttgatgcctggctcaagaacatacaggaaggttgaccctcctgacgtagagcaactaggtagatcttcatggacgctgttacactctgtagctgccagctatcctgctcaacctacagaccaacagaagggtgaaatgaaacagttcttgaatatcttctcacatatttatccttgcaactggtgtgctaaagactttgaaaaatatatcagagaaaatgcaccacaagttgagtcaagagaagaacttgggaggtggatgtgtgaagcccacaataaagtcaataagaaattgaggaagcccaaatttgactgtaatttctgggaaaaaagatggaaggacggctgggacgaataa

SEQ ID NO: 1160 - DNA, 654 bp, Saccharomyces cerevisiae
atgagttccctattaatatcatacgaatctgacttcaaaacaaccttagaacaagccaaagcgagcttagcagaggccccctcacaaccgttatcacagagaaatactacactgaagcacgtagaacagcaacaagatgagttgtttgacctgctagatcagatggatgtagaagttaataacagcataggcgatgcctcagaacgtgctacgtacaaggcgaagttaagagaatggaagaagactatacagagcgatatcaaacgaccactgcaatccttagtagactcaggcgatcgtgatagactttttggagatcttaacgcatctaatattgacgatgaccaaaggcaacagttgttgagcaaccatgcaatcttacagaaatcgggagatagactaaaagatgccagtagaatagcaaatgaaactgaaggaatagggtcacaaataatgatggatttaaggtcacagagagaaactttggaaaatgcaagacagaccttgtttcaagcggattcatatgtggataaaagtataaagacactaaaaacaatgactagaaggctagttgctaataaattcataagctatgccattatcgcagtccttatattattgattttgctagttttgttctcaaagtttaaataa

SEQ ID NO: 1161 - DNA, 654 bp, Saccharomyces cerevisiae
atgctgttacaacctgtttggaaaggctgccgatggacgcagtttgtcaggcctatcagaagatggaattctaccggcacgaatagaggagttcctttttcatttaaggatatttcaaatcaggaggatatcacgaatatctcgtatccttcgtcctctgactcagttttgacaaagtcaaatggtagtagtgaggtttacaagcccaaagaggaagtagttaagtacattctacatggcaagtttactaaaaataacacgcatttgacattttcaagcgttgtggaggacaagaactttcataagaataagggacttacgtataatgatacaatgctgtactatttgaacttaccccagaaagtgaagatttcgctatctacaggttgtttagggtttaggaaggcagcaagaggggagtatgaagctgcatttcaaaccagtggtagaatgtttgaattgattaaggaaaagaacatgctgaacaaagatatcgaagtggtgatggacgactttgggaagggcagagctgcttttatttccgctcttgttggtaaggaaggggccagtgtggtgaaaaaggttgtgaagatcagcgatgccaccaaattgaagtttggtggtgtaagatcaccaaagatgagaagactatga

SEQ ID NO: 1162 - DNA, 654 bp, Saccharomyces cerevisiae
atggatcaaagtgtggaagacttatttggagcactaagagatgctagtgccagtctagaagtaaaaaattcagcgaaggaacaagtttctcttcaacaagaggatgttttgcagataggcaataatgatgatgaagtagaaattgaaagtaaatttcaagagatcgaaactaatcttaagaagcttcctaagttagaaaccggatttgatgctttagcaaacaagaagaagaagaagaacgtcttgcctagtgtggagacagaagataaaagaaaacccaacaagagcgacaaaaacgataatgactggtttaccttaccaaagccagatgataacatgcgtcgtgaagttcaacgagatttattgctgattaaacatagagctgctcttgatccaaagagacattataagaagcaacgttgggaggtgccagagaggtttgctattggtaccataattgaagacaagagtgagttttatagtagtcgtatgaacaggaaggaaagaaagtcgactattttggaaacactcatgggtgatgaagcttctaataagtatttcaagcgtaaatacaacgaaattcaggagaaatctacgagcggtaggaaggcacattacaagaaaatgaaagagatgagaaagaagcggaggtga

SEQ ID NO: 1163 - DNA, 654 bp, Saccharomyces cerevisiae
atgggaaaggcctgtttgaataaagaagtcggcacttacgaatgtgagggggaaagagatacctactcattttttacctctctctcagatatacaggattcaagtagtaacgaggaacaatgcggtgtaggaagtatattgagtgaagatagtttcacgtttgaagggtccaacgtgagcatacggttattttccttggacttaaatgccttgaatgaaaatgagaatggatccaagaatcctgtgaaatttaccattccgccaaaaatagaacaaagaaaggaagcaagacaaagagagaaacgtttaaggagggtggcagtactacctgagaattcgagaaactaccttgttgaatcaagtatggattcaagtagggaatacagtcaaccattttttgactggaggcatgaaatggtagaacatggagaggagagtgtaaaaccgtgtggttgtcataaatcgagaaaagcaaaatgcttcaaagaactggagatggagaatatagaaaagggcgatataaagaagagtctcttttacagagacataattgaatggtgcagagactatgaagtcaataaaactagggaagtctgtgttccgtctatacacgagttttacctacatggaaatggaagtgacaacctcttttga

SEQ ID NO: 1164 - DNA, 654 bp, Saccharomyces cerevisiae
atgggagtgaagcaaaccccaccagtccaggtgaaagtaagcgacgcggattccaccaacagaaggaaatctagtagccaggaaggaaaccctcagctggttcaattaaaggcaaagagcgacaaagataaaagaaagggatcttcagattccactgcctctataatgggcagttccaacgcacttccgaccaaaaacctaaccacgcctccagcactaaaccccttaacgaccagcattagtaggggtaatactgcatacgaaagaagcgtaaatggtagccgtataacaatgcactcaaacctggcacctacggagacgcaagacgtatcatggtctgaaatcgatacactggatgatgtgaagaagatggcgaaagaacctatcgtcaacgacgggttcccacgagattttgagagcaatctcacgcaaatgcgcaagtcgcacgctcaactactgcgattaatgagggaaagaaatcagcgactaaagtatgccaagctgaggagccctcctcataaggatcagcataattctgccacgaataaagatcaagaaccagacgaggtattgcatgacccggaaatcgcacttgacggtgagaagtacgtgagccaagttgtcgatactattaaagatgttcaccgatgctga

SEQ ID NO: 1165 - DNA, 654 bp, Saccharomyces cerevisiae
atgtcaaaaaaacttgcgtcaccattgtccttcttacccctttataatttgctttctgctgttggttggtcttatttgctttacttggtcatctccttgtacccaaaagttggacagccagcattcttctaccaaactaaaaatgtcgctacccttgttcaatgtggtgctataatcgagatcataaactcatttttaggagttgtacgttccccattgctgaccactgttgcacaagtgtcttcaagactactagttgtcctcggcatcttccaattgttgccaaacacaagtggtgttcaatcagttgtttacatatcattattactggcatggtctataactgagatcgtcagatacttgtattattttttcatgttggtattcaagaatggcgcaccaaagatcttaattctattaagatataatttgttctggattttgtaccccactggtgttgccagcgaactacgcattatttactgtgctttaaatgcagctgaatctcagtattctttactttacaaaagaattttaatagcggccatgctcgcttatatcccaggcttcccaatgctcttcctacacatggtagcacagagaaagaaagtcatgaaaagtttaagatcctctttcgggaagaaactaatttga

SEQ ID NO: 1166 - DNA, 654 bp, Saccharomyces cerevisiae
atgtcatggaggtatgcgttaaaaaactacgttaccagcccagaaacggtaaacgatgatacagtcacatactttgatgataaagtgtccataattagagactcgtttcctaaatcagagtgccatttattgattctaccacgaactatgcagctgagtagaagtcatcctactaaagtgattgatgctaagtttaagaatgagtttgaatcatacgttaattctgcgattgaccacatctttaggcattttcaagaaaagttccgaataaagaagagtgatgatgacaaagacccctgctgggatgacatattaaaagacaaaaacaagtttgtaagaaattttgtacaagttgggatacacagcgtgccttcgatggccaacttacatatacacgtcatatccaaagatttccattcggtaagattgaagaacaaaaaacattataattcatttaatactggattcttcattagttgggacgatttaccattgaacggaaaaaatttgggcactgacaaggaaattgaaactacgtacctgaaagaacacgatttactttgctgctattgtcagcgaaattttagtaataaatttagcttattgaaaaagcatttagaactagagttcaatagccatttcgagcttaaataa

SEQ ID NO: 1167 - DNA, 654 bp, Saccharomyces cerevisiae
atgtccaagatcacttcttctcaagtcagagaacacgtcaaggaattgttgaagtattccaacgaaaccaagaagagaaacttcttggaaaccgtcgaactacaagtcggtttgaagaactatgaccctcaaagagacaagcgtttctctggttctttgaagttgccaaattgtccaagaccaaacatgtccatctgtatcttcggtgatgctttcgatgttgacagagctaagtcttgcggtgttgacgctatgtccgtcgatgacttgaagaagttgaacaagaacaagaagttaatcaagaagttgtctaagaagtacaacgctttcattgcttctgaagttttgatcaagcaagttccaagactattgggtcctcaattgtccaaggctggtaagttcccaaccccagtttctcacaacgatgacttgtacggtaaggtcactgatgtcagatctaccatcaagttccaattgaagaaggtcttgtgtttggctgttgccgttggtaacgttgaaatggaagaagacgttttggttaaccaaatcttgatgtctgttaacttctttgtttctttgttgaagaagaactggcaaaatgttggttccttggttgttaagtcctccatgggtccagctttcagattgtactaa

SEQ ID NO: 1168 - DNA, 654 bp, Saccharomyces cerevisiae
atgtctaagatcacctcttctcaagtcagagaacacgtcaaggaattgttgaagtattccaacgaaaccaagaagagaaacttcttggaaaccgtcgaactacaagtcggtttgaagaactatgaccctcaaagagacaagcgtttctctggttctttgaagttgccaaactgtccaagaccaaacatgtccatctgtatcttcggtgatgctttcgatgttgacagagctaagtcttgcggtgttgacgctatgtccgtcgatgacttgaagaagttgaacaagaacaagaagttaatcaagaagttgtctaagaagtacaacgctttcattgcttccgaagttttgatcaagcaagttccaagactattgggtcctcaattgtccaaggctggtaagttcccaaccccagtttctcacaacgatgacttgtacggtaaggtcactgatgtcagatctaccatcaagttccaattgaagaaggtcttgtgtttggctgttgccgttggtaacgttgaaatggaagaagacgttttggttaaccaaatcttgatgtctgttaacttctttgtttctttgttgaagaagaactggcaaaatgttggttccttggttgttaagtcctccatgggtccagctttcagattgtactaa

SEQ ID NO: 1169 - DNA, 656 bp, Saccharomyces cerevisiae
atgggtagtatgtacaggaattattaattgatgagtcaacgttcaatcacatccggtctgatttagaggattacatgagaaagaagcactgaaaaaattttccaccaggagaggccaggtaaactaagacctacgttattcactatgccaaaagatttaaaaatatagaatgatgaatgttgccagagccattgatgataagaaattgcacataacggatgcataaagagcgaataaaaagatttgagtgtcaatacaaaaaggtgagaagaaatagtgtaagacagcaacacacatctagaccgccaatgaagttgttctgaatccagcagtagagtttatttagttcaaagttttactaacgataattaacttttatgttttcattttaaacagagggtactccttcattcggtaagcgtcacaacaaatctcacaccttgtgtaacagatgtggtcgtcgttctttccatgttcaaaagaagacctgttcctcttgtggttacccatccgctaagactagatctcacaactgggctgccaaggcaaagagaagacacactactggtaccggtagaatgagatatttgaagcatgtctccagaagatttaagaacggtttccaaaccggttctgctaaggctacttctgcttaa

SEQ ID NO: 1170 - DNA, 657 bp, Saccharomyces cerevisiae
atgaagattgaaaaggcttctcatatttcacaaccggtgcaactttccacatgcactctcattgacacctaccctggtcatcaaggaagcatgaacaacaaggaagtcgaattatacggcggcgccatcactactgtcgtcccacctgggtttatagacgcttctactctaagagaagtccccgatacacaggaggtgtacgtcaattcccgtcgcgatgaagaagaattcgaagatggactagccaccaatgaaagcattatcgtggatctcttggagacggtcgacaagagcgatctgaaggaggcttggcagttccacgtggaagacctgacggagttgaacgggaccaccaaatgggaagctttacaagaagacactgttcagcaaggaaccaagttcaccggactcgttatggaagtagcaaataagtggggaaaaccagatctggcacagaccgttgtcatcggcgtagcgttgatcagattaacccagtttgacacggatgtggtcatctccattaatgtacctttgacaaaggaggaggcgtcgcaagcaagcaacaaagagttgcctgcaagatgtcatgctgtttaccaattgttgcaagaaatggtacggaagtttcacgttgtggacacgtcgctgtttgcttaa

SEQ ID NO: 1171 - DNA, 657 bp, Saccharomyces cerevisiae
atgacaaagctacaaggactacagggattaaaacacatcaaagcggttgtatttgatatggatggcacattatgcctaccccagccttggatgtttccagcaatgagaaacgccataggattggaggacaaatcgattgatatccttcatttcattgatacattgcccacagaaaaagaaaaaaaagaagcgcatgatagaatagaattagttgaggcaaaagccatgaaggagatgcaaccgcagcctggtctggttgacataatgaggtatttgacgaaaaatggtattagcaagaacatatgtactagaaatgtcggagccccggtagagacttttgttaaaagatttattccatccgagctttcgaggtttgactatattgtgacaagggagtttaggcctacaaaaccgcaaccagacccattattacacatcgcctcgaagctaaatataaggcccttggaaatgatcatggtaggagattcatttgacgacatgaaatccggtagatctgctggatgtttcacggtattactcaagaatcatgtgaatggacatttactgctcgaacataaagaactagtagacgtttcagtagaggatctttccgaaataattgaattgattcaaaatatgaataaagaaagtttctaa

SEQ ID NO: 1172 - DNA, 657 bp, Saccharomyces cerevisiae
atgacacaatataatttcattatagatgcttcagcttttgaaaagggtctaggcaacatcaagaggtggtgctcggactgtacagaagctgtgactttgaacttttatattccaacattcacattaaatgaattggatttccttcaacaaaggcgtaaaagttttgcagctcgagaatccttgaagtttatcgatagattagatgattctaaatttgctaatttgaaagtttttatcgaatttcccgaagttttagacattattttatggtcagatgtaatggaacataatgatagttctggaaagattaatattgcaaaattgcctaagagattaaagaatttgttgaaaagttgtatttacaaatgctacctagaaggaaatgaggggctacattggtttttaattagtgaagatcctcaaatccgggaaatggccatgcaatgcaatattccttcctgttcaattgttgatgtagattcaatcttgtccaaggacatgaatgataaatcatttagagaaagtgaaaaattcaataatatgatgctaaaaaatggcactaaggaagaaagcgaaaacggtagagaaattatcaggactaacttcaataaaacagtttacgcttctagaggtacaggcgaattgtggtccccataa

SEQ ID NO: 1173 - DNA, 657 bp, Saccharomyces cerevisiae
atggcagattattcttcccttactgttgttcaattgaaagatttactgaccaagagaaatctgtctgtaggcggattgaagaatgaactagttcaaagactgataaaggacgatgaagaatcaaagggtgaaagtgaagtttctccacaggaacaaaaccaggaacaagggtcagaacctgcggcgatagaagaaccagcctcccagaacattactgaaaaaaaggaagtttcaagcgagcctaaagaaacaaacgaacccaaggaggaaaataaggacgttcaaaagccctctgatggaccttctgctactgcttcagagaacgaacaagctgctgcttccactgctgctcccgctttgtcaccagaagaaattaaggccaaagcattggatcttttaaataagaaactgcaccgcgctaacaaattcggtcaagatcaagcggatattgactctttacaaagacagataaatcgtgtggagaagtttggtgttgacttgaatagcaagttggctgaagaactgggccttgtcagtaggaaaaatgaacctgaaagtggcaataacggtaaatttaaaaatagaaacaaaaatgcaaacaaccgctccagagtaagtaaaaacaggagaggcaaccgctctggttacagaagataa

SEQ ID NO: 1174 - DNA, 657 bp, Saccharomyces cerevisiae
atggtgaccggaatatcggaggaaaatgatgatgaagagactttttcggctgttcattcttcaacacccagtattaattctcaatcctacgcgattcctataacagaggaaatgtccagctctttccatgattcgatcagcaccactagcaactcaagtggtagcttcgatagtgatggaagtaacgtttcagatgttgtggagcaaaatgaaatggacaatgaatctaacgttgacgaagatttgttcctagataacgatatccctcagtcaagcaatttgctacccacggatgcccaggatcctggtccaatatttgacgtttctagatatatttttgattctctaaaacaatctattgattctgctgatttctcagaggcactttctctacagaccaaaacctccgctgttataaattcgaaaagcctagagcttaaacaatatattgatgaaatgaagagcaggctcactcaactgcaagagaagtttgaaaatggtgaggctacttcaaaaaaaataaaacgtgatttagaaacttcaagaaagaacatcgactatttaaacgctgctttgcgtgtcgatttccccatagagtttaatcaggcaagagaaaaaattcttgagcgcagattgaatgaagaccatgactgctga

SEQ ID NO: 1175 - DNA, 657 bp, Saccharomyces cerevisiae
atgtttacgtggactatttatgtttcgttattgctagtgttagcaggtactttcttaatgaaccgaaatacgaatacagatataattgatacttttaaacgagaagtcgatttgccaatacctgcgcaaccaggtccaccattcccgcttgttactgactattgtgacattgtatgtggatttggccgcggatccgccgaattgggtattcccactgccaatgtacctataaatcagttacctaaaggtatcaacgatttggatttaggggtttactttgggtttgctcacattaaaactgttgatggtcaagaactatcggtggaaacaaggcgggatggaagaactgtggtttataattacggtcaatatttaagtgaagcgaacgatgatttgtccgtacttcctatggtactttcagttgggaaaaatccattctacggaaatgatttcaaaaccatggaattacatattatacatgattttaaaaatgatttttatggggccagggtcaagttcaatattttaggtcatatcagacccgaattgaactacactactaaggaagctctgatcgaagacatcaatatcgatattaggactgcgcagactgtccttgccactccaccgtatcaagtattcaaacaacaattatag

SEQ ID NO: 1176 - DNA, 660 bp, Saccharomyces cerevisiae
atgaaccaagcaatagacttcgcacaagcaagcattgactcctacaagaagcacggcattctggaggatgtaattcatgacacaagctttcaaccctccgggatacttgccgtagagtactcatcaagtgcacctgttgccatgggtaacacgctgcccactgagaaggcacgttccaagccccaattccagttcacgttcaataagcaaatgcaaaaaagcgtaccacaggcgaatgcgtacgttccccaagacgacgatttgttcacactggtaatgaccgatccggatgctccctctaagacagatcacaagtggtctgaattctgccacttggtagaatgcgacttaaagctgttgaatgaggctactcacgagacctccggagcaaccgaattttttgcatcagagttcaatacgaagggctcgaacacactaatagaatatatgggaccagctccacccaagggatccggtccccacagatatgttttcttgttatataagcagcctaagggcgtggactcatctaagttctcgaaaattaaggatagaccgaactggggttacggcacccctgccaccggtgttggcaaatgggctaaggaaaacaacctgcaactagttgcctccaatttcttctatgcggaaacgaaatag

SEQ ID NO: 1177 - DNA, 660 bp, Saccharomyces cerevisiae
atgaggttccagcttttcatatatttttatttcaccattgttgtgattgcaggaactaacacaatacaacagttcagcgatgcgggcgataggttaatcacatcattgagaaatctggacaacaatggaacatacgaaacattgacagcagagaaggtgcctattatcgagggacaaattcaaaacattagtgcaaaatatgagcagcatacttttattttgaagggcttagaagcggtgctaaattataaagtgaaaagtttggataataatgagagagagtcgctcgaaatagaatatgaaaaggtggaaaaggcactagatgcggctttgaatgtttcaccatttgaatatatcaaaaagtttaaagaagtctccaggggcaaggtagttaatgctttagaaaacctcagtagagaacagaatcgaattactataaatggtggtagagaagacgaaaaagaaaaagaagcgagggaaaaaaagaaacgactagacagaataaagagaatcctaactgtaagtctgttagaattgggtctagctcaaggagtggccgatttatgtgcagtagcaccttttgcgtgtcttcttggggtgacagttggaagcatcggtttcatattttggttggcactaatatataatgctattcaataa

SEQ ID NO: 1178 - DNA, 660 bp, Saccharomyces cerevisiae
atgccagctaaaaaaaggactagaaagacagtgaaaaaaaccgtatcattctccgatgacacaacattaacaacgcaccaaaatcgtgagaaaaagaacgtagatcatgatcgtccacctgtgtatgtgaggaaaacccctctgatgacatttccataccatttagtagcactactttattactacgtttttgtatcttcaaatttcaatacggtgaagttgctaagttttttgattcctacacaagttgcttatttagttttacaattcaataaatgcacagtttacggtaacaaaatcattaagatcaattactcattgaccattatttgtctaggtgttacatttttgttgagctttcccacaatgttattaactatattatttggtgcgccattaatggacttattgtgggaaacctggctgttgtcactgcattttgcatttttagcataccctgcagtttattctgtatttaattgtgatttcaaagtgggattatggaagaagtattttatctttatcgttgtagggggttggattagttgtgttgtcattcctttggattgggatagagattggcagaattggccaattcctattgttgttggaggttatttgggcgctttggtgggctatactatcggtgcctatatataa

SEQ ID NO: 1179 - DNA, 660 bp, Saccharomyces cerevisiae
atgcttttaacctctcttttacaggtttttgcctgctgtctagttttaccagctcaagttactgcgttctattattatacttctggtgctgaacgtaagtgcttccacaaggaattgtctaaaggtactttgttccaagcaacttacaaggcacaaatttacgatgaccaattacaaaattacagagacgctggtgcgcaagattttggtgtcttgattgatattgaggaaacttttgatgataaccacctggttgttcatcagaaaggttcagcaagtggtgatttaactttccttgcgtctgattcgggtgaacataaaatctgtattcagcccgaagctggtggctggttgattaaggctaaaacgaagattgacgttgaattccaagtgggctctgatgaaaagttagattctaagggtaaagccactattgacattctacatgccaaggttaacgtcctaaactccaagatcggcgaaattagaagagagcaaaaattgatgagagatcgtgaagctacctttagagacgcctctgaagctgttaattctcgtgctatgtggtggattgtcattcaattaattgttctcgctgttacttgtggctggcaaatgaaacacctgggcaaattttttgttaagcaaaaaattttatga

SEQ ID NO: 1180 - DNA, 660 bp, Saccharomyces cerevisiae
atggaacatctcgccaacgaaaactcggattcggatatcaggtacagtttccttagcactttggatcatttaccatgtgaactaataagatctcttcgactgatgcaaacaatcgacttattcaagaatgaagaggatgagcctggtatggaaagggcctgtagggatctgttgctggtagcgacttatattaatgatctggtcgatgatcagattcatttcttaaagcagcataagaaggaactagagatacagaagtcagtgacaaaaaatttcaactcttcgctagagaatatcaagtcgaagttgacgttagaagaaccaggagcatataaggagccaaaactgcttttaaagattaacttgaaaaaggctaaatcgagggaaagaaaagagagcataactagccccacaattgggattaaccagggtgatgtaacagagggtaataataatcaagaggaggtttattgtttctgtaggaatgtatcttatgggccaatggtggcttgtgataatccggcttgtcccttcgagtggttccattatggttgcgtaggcctgaaacaagctcccaagggcaaatggtattgtagcaaagattgtaaggaaatagcaaaccagaggtccaagtcaaaacggcaaaaaagaagaaagtaa

SEQ ID NO: 1181 - DNA, 660 bp, Saccharomyces cerevisiae
atggccatcgaaacaatacttgtaataaacaaatcaggcggactaatctatcagcggaattttaccaacgacgaacagaaattgaacagcaatgaatacttaattcttgctagtacactgcacggtgtattcgccatcgcgagccagctgactccgaaggcattacagctaactcaacaaacgaacatcgaaaataccatcccatatataccttacgtgggcatgtccagcaataggagcgatacaagaaatggaggtggcaataacaacaaacacactaataatgaaaaactgggcagttttaaaggagatgattttttcaaagaaccatttacgaactggaacaagagcggattgagacaactatgcacggatcagttcacgatgttcatatatcagaccctaaccggcctgaagtttgtcgctatcagctccagcgtcatgccccagagacagccaactatagccaccaccgacaagcctgaccgacccaagagtacatccaatttggccatccaaatagccgacaacttcctaaggaaggtttactgtttgtatagtgactacgtcatgaaagacccatcttactcaatggaaatgcctataagatctaacctgttcgacgaaaaagtcaaaaaaatggtagaaaacctacaatag

SEQ ID NO: 1182 - DNA, 660 bp, Saccharomyces cerevisiae
atggcttcatgcttttcagtttcattattggcacgagtagcagtcgttgagcccatcagagtgcaactttggttaaatgtcgtaaattgtatgattgaatcatccatgcaccaatgtcctccacgggatcgccactttttttcttcatcacgccccattttgttgatccgacgttctgtatcaactgtatacagattcgttgcttctcgcaccacacaggttttacgtgcggccaagaccgttgtcaagtggttcattattgtcgacccactgataaattctattctaatcaattatctcattgataggctctgcactcttgggcatgctgtattgcgagtgaaaaagcgcaagaccgaggagagacaaccctgttctcccattatacaacacacacacgttaagagacgcaaacggcctcgtctgaggatcgtagccatcaagaggaagcggaggcgtcgaagaccacatcgcatcgagcgtccactctcaaatatgtacccaataatggaaatccagatggtggctgttccacttgctcttcccagtccaactgcactggtgcattatcagcagcagcaacagcagctcccgcaacatcatccctggtacgacctctcgctttctgaagaagccctctcgacctgctgttgtagttga

SEQ ID NO: 1183 - DNA, 660 bp, Saccharomyces cerevisiae
atgtctaacgaaattgaattactgcagaagcaagtctctgaattacaagacttagtgaagaagcaaagtctgattatctctaagacaggagagcgtgtgctggaattgcagttagataaacaaaagcacgacgtaactgattttgattcgaaattctctaaatctatctcgaagaaatcaggatccgctactcaattcgatgccactgattttgccacaaatgaagatctagtggaattagtcaaagaactacagggtgagctaaatttcatcgaggaaaggtctatcagaagacttgttaactctttgaaaaaagatgatgatgacgttatagcgccactgcctaatgcagatggtgatattcctgctatttcagacggagtgttccctaagtcgttgaaagaatttaaagacatcccagacttaaaactggtaagacttgctaaattctacgaaagattgccaccaactctaaaggaacaagaagattttgaaaacttcctggaaggtaaggtggaagcctttcacattaatgagaccactgatgaagagatttctaaggagttggaaaagttctccaaagatgagctagatgatgcatttaatgatgttgcccgctatctaggtctctcccttagaagaggaaccgaaatatggtaa

SEQ ID NO: 1184 - DNA, 660 bp, Saccharomyces cerevisiae
atgtctgccccagctgctaacggtgaagttccaacattcaaactagttcttgtcggtgatggtggtactggtaagaccacttttgtcaagagacatttgaccggtgaattcgaaaagaagtacatcgccaccattggtgtcgaagtgcatcctttatccttttacaccaacttcggtgaaattaaatttgatgtctgggatactgccggccaagaaaaattcggtggtttaagagacggttactacattaacgcccaatgtgccatcatcatgttcgatgttacttccagaattacttacaagaacgttccaaactggcacagggatttagtccgtgtttgtgaaaacatcccaattgtcttgtgtggtaacaaggtcgatgtcaaagaaagaaaggtcaaggccaagactatcactttccacagaaagaaaaacttgcaatactacgatatttctgccaagtccaactacaactttgaaaagcctttcttatggttggccagaaaattggctggtaacccacaattagaatttgttgcttctccagctttagccccaccagaagtccaagtcgatgaacaattgatgcaacaataccaacaagaaatggaacaagctactgctttgccattgcctgatgaagatgatgctgatttataa

SEQ ID NO: 1185 - DNA, 660 bp, Saccharomyces cerevisiae
atgttaaagttaacaacaacatccgttactttccacgtactaagatatttccaacttggcttatctgtaactaacttgttgttagctagttttgccataatcacaaactataaagtggatcgaatccttagattgagcttagctgtttcaatcatatcttcagtttattttgggattgtgagatttttgcctgttctgttaatattcgtgatggaaattgttcagaccgtcctgtggtttaccgctttcgtaactctagcttcaaaatttggttctatgtcctgctcaagtatgccacggggtataaactttgattattcaggttcttgtaagattgctaaaatagatattttaccagaagccgttttattcatactatttctcgctaccacatatgcttcttatatcacagtcctatctcaagctaaggaaaatgggtcaagcacaagatctgttttgaaggcttgtgtgaaggcattacgtgataccgtggaccgcttggagaccagtctggaagagagtgagcctcttttagatcttgaagttcaggaagatgcgaggactgaaaccgaaagcattgaggattcaactgatagtgaggataatgctaacatcgaacaagagaaagtgattgatggttcaattgagcattcttcatga

SEQ ID NO: 1186 - DNA, 662 bp, Saccharomyces cerevisiae
atgattcatgcagttctaatatgtatgtaagatttctcaagggtcttttcttctgccaaaattatacattactaacataattcatcatttttggtatagtcaataagaaatgccaaccaagattagtgaaattctacacgccggtcgaccttccaaagcaaaaactgctattagagcaagtatatgaattgatttctcaaaggaatagcgattttcaaagttcttttttagtcacgccaccatcgcttctgttaagcaatgaaaataataatgatgaggtaaacaatgaagatattcaaatcatctataaaaactacgctacactatatttcactttcatcgtggatgatcaagaatcagaactggccatattagatctgatccaaacttttgtggaatcattggaccgttgttttactgaagtcaatgaacttgatttgatttttaactggcaaactttggaaagtgtattagaagaaatcgtgcaggggggcatggtcattgaaacaaatgtgaacagaatagttgcttctgttgacgaactcaacaaagctgccgagtccacagatagtaaaattggaagactaacgtccactggatttggaagcgcactacaagcgtttgctcaaggcggatttgcacaatgggcaacggggcaataa

SEQ ID NO: 1187 - DNA, 663 bp, Saccharomyces cerevisiae
atgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtag

SEQ ID NO: 1188 - DNA, 663 bp, Saccharomyces cerevisiae
atgagttcgaattcaacaccagaaaaggttactgcagaacacgttctgtggtatattcccaataagatcggttatgttcgtgttatcaccgccgccctttcttttttcgttatgaagaatcatcctacggcctttacatggttgtatagtacatcatgtctactggatgcgctagacggaaccatggcaagaaagtacaatcaggtttccagtctgggtgccgttctggacatggttaccgacagatccagtaccgctggcttgatgtgtttcctttgtgtgcagtatccccaatggtgcgttttcttccaattaatgctgggcttggatattactagtcactacatgcatatgtatgccagtttaagtgctggtaagacttctcataaaagtgtgggcgagggtgagtccagattgttacacctgtactacacgagaagagacgtactgttcactatctgtgcgtttaacgaactattttatgctggattgtacttgcagttgttctcaaattctgcaacctttggtaaatggactacaatcataagtttccctggttacgtgttcaagcagaccgcaaacgttgtccagctaaaaagggcagccttgattttagcagacaacgatgccaagaatgccaacgagaagaacaagacttactga

SEQ ID NO: 1189 - DNA, 663 bp, Saccharomyces cerevisiae
atggaggaagaagaattaagtaaattgttggccaatgttaagatagatccgagcctaacatcaagaattagtcaaatagacagcttcaaactgtcggaattgatggttctaaagacagatattgagacacaactagaggcgtatttcagtgtgcttgagcagcaaggcatcggcatggactctgcgttggtgacgccagacgggtatcctcgttcggatgtcgatgtattgcaagtcactatgatcagaaagaatgttaatatgctgaagaatgatttaaatcaccttttgcaaagatcacacgtcttactaaaccagcactttgataatatgaacgttaagtcaaaccaagatgcaagaaggaataacgacgatcaagctattcagtataccatcccttttgcatttatcagtgaggtagtacccggtagcccttcagataaagcagacataaaggttgatgataagctgatttctattggtaatgtgcatgcggcaaaccactctaaacttcaaaacattcagatggttgtaatgaaaaatgaagacaggccacttcccgtccttctcttgagagaagggcaaatcctaaagacatcgctaacaccttcgagaaactggaatggtagaggtcttttgggttgtaggatacaagagctataa

SEQ ID NO: 1190 - DNA, 663 bp, Saccharomyces cerevisiae
atggataaacatacagcagctattccaacattaactatcaaagtagtcttactcggagaatctgctgtcgggaagtcctcaatagtcctcaggtttgtatctgacgattttaaagagagcaaagaacctactattggtgccgcatttttaacaaagagaattacaagggatggcaaggtcattaaatttgaaatatgggatacggcaggccaggagagatttgctcctttagcgcctatgtactacagaaatgctcaagctgctttggtagtttttgatgttactaatgaagggtctttttataaggctcaaaactgggtcgaagaactacacgagaaggtaggacatgatatcgttattgccttggtggggaacaaaatggatttgctgaataatgatgacgagaatgaaaatagggctatgaaagcaccagctgtacaaaatctctgtgaaagagagaacctcttatatttcgaagcaagcgctaagactggtgagaatatttaccagatatttcaaacattaggcgaaaaagtaccatgtcctgaacaaaatacacgacaaagctctactcatgatcgcacaattaccgataatcaacgaatcgatctcgaatcaacgactgtagaaagtactagggagactgggggttgtaactgctaa

SEQ ID NO: 1191 - DNA, 663 bp, Saccharomyces cerevisiae
atggcttctagagtggacgaaactacagtcccctcatactactattacgtggatccggaaactacatatacgtaccaacaaccaaatcctctacaggacttgatatcggtgtatggcttggatgacatctccaggcaagtggcaagaacaaatttggacggcactaaagccgtgaagctaagaaaatcttacaagaaccagatagcagatctttcaggtaaattctccaccataccgaccagagaaaatggtaaaggtggtcaaatagcacatattcttttccaaaataacccagacatgatgatacaaccacctcagcagggtcaaaacatgtcagagcaacaatggcgcgaacagctgcgcaatagagacatagcattgtttcagcctccaaatttcgattgggacctttgctcttcggtactatcgcagtttgaaaggtcatatccaagcgagttcgcaaaccagaaccaagggggagcccaagcgccgtttgatatagacgacttggcgtttgatctagacggtacaggaaaaagccaatccggctcaaattcaggtaacaatagtaagaaaaggaagaacaaatctagtggaagttcgatggctacaccaacacatagtgacagtcatgaggatatgaaaagaaggaggctggagtag

SEQ ID NO: 1192 - DNA, 663 bp, Saccharomyces cerevisiae
atggtaaagtcaacaagcaaaacttccaccaaggaaacagtaaccaaacaacccaccgaagaaaaacctatacaggagaaagaagagttggctctagaaacatcgtctagcagttcagatgaagaagacgaaaaagatgaagatgaaattgaaggtttagccgcttctgatgatgagcagagcggtacacacaagattaaaagattgaatcctaagaagcaggctaatgaaaaaaagtcgaaagataaaaagacacttgaagagtattctgggattatttatgtgagtagactgccacatgggttccacgaaaaggaattaagtaaatattttgctcaattcggtgatttaaaagaagtgagattagcacgtaataagaaaactggaaattccagacattatggcttcttagaattcgttaataaagaggatgcaatgatcgcccaagaatctatgaacaattacttgttgatgggtcatctactacaagtgcgtgtattaccaaaaggagctaaaatcgagaaattgtacaaatacaagaagagagttctagtagagaaaggtatcaccaaaccagtaaaacagctaaaggataacatgaagcaaaaacatgaagaaaggataaaaaaattagccaagtcaggtatcgaattcaaatggtga

SEQ ID NO: 1193 - DNA, 663 bp, Saccharomyces cerevisiae
atgtcagcacctgctcaaaacaatgccgaggttcccactttcaagttagttcttgttggtgatggaggtactggtaagactacctttgtgaagagacatctgaccggtgaatttgaaaaaaaatacattgcaactatcggagtagaagttcatcctctatctttttatactaatttcggtgaaattaagttcgatgtctgggataccgcaggccaagaaaaatttggcgggttaagggatggttattacatcaatgctcaatgtgcaattattatgttcgatgtcacatccagaatcacttacaagaacgtccctaattggcatagagacttagtccgtgtgtgtgaaaatattcccatagtgctatgtggcaataaagtcgatgtcaaagagagaaaggtcaaggccaagactatcactttccatagaaaaaagaacttacaatattatgacatttctgcaaaatccaattataattttgaaaagcctttcttgtggttggctagaaaacttgccggtaacccacaattggagtttgttgcgtctcctgcattggccccacctgaggtgcaagttgacgagcaactaatgcaccaataccagcaagaaatggaccaagccactgctttaccattacctgatgaagacgatgctgatttataa

SEQ ID NO: 1194 - DNA, 663 bp, Saccharomyces cerevisiae
atgtccataggttacaaagacaacttgatgtcaactattctagctaaagataggaaatgtgaatttcccatcaatttcgaatgttcgccctcccagataactcttatgcctgaaatgttctcttttaacaatgaaaggaaataccaaaccctgatacccttgatgaaaacatcacatctaattgatgatgacttgaaagataaattgaataagtgcgctttcgattttttctccggaaaacaagcgaacagaacgagtgacgggactatttcaagattaacagcaagtggaaaaacgtcaccgatactgccattgcaaaatattaatattgtaaaagcagagaataccggtaacggtaaatcagatccatatagctcaattaaaataagcaaaccgacaaaaaccgtgataaaattgaaatctacgaaaaccaatacagcaggacagaggactcgtcatttctgtaagatctgctctactgggttcaccacttctggtcatctttcaagacataacagaatccatacaggtgaaaaaaatcatatctgtccgcatgagggctgtggacagaggtttagtagacatgataactgtaatcagcattatcgaactcatgcaaacaagaagaaaagaaactggaagaggagggaggctagcagttga

SEQ ID NO: 1195 - DNA, 663 bp, Saccharomyces cerevisiae
atgtcggcaggtgatatatcagccataaatatcaagtctgtcaaaaaaaacagaaggaggaagaagagaagaacagctgatgtttcatcatcagattcttcatcatcggatccatcatcagaaagtgaaaaggaggaaatccaaaatggggccatcgaagaacacgttggagaaaatggtaaaagtgatcatgttttctcaaaaggtaatgacgaagacaaacaagaggacattgcaatagaagtttcggatgtcgagcttacagacgaagaaagcaaggatttgaagttaaattcaaaagaagtgatagacgatttaaccaaaatttctttgagcaagatcccagagcctacgaaatctcaaaacaaggagggttttatgaatgcatcgaaaattgccgaaaatatcaagcttgcgagagaagaatacaatgaattggcagaaaactttgtgcccaaagggaaagacaagacaaagttaagggaagaatacttaaatttactttttgaaaactacggtgatgatatcaatcgtcttagagctgccccggatttcacgaataaatcactatccattttggcagatgctctgcaggaaggcataggaatgtttgatattggtgaactagaattggtcttgaaaaataaagaaatggagaactga

SEQ ID NO: 1196 - DNA, 666 bp, Saccharomyces cerevisiae
atgaatgtttctacatcaacctttcaaacaagacggagaagattgaagaaagtggaggaagaagaaaatgcagctactctacaactgggccaggaattccagctgaaacagataaatcatcagggtgaagaggaggaattgattgccttgaacctaagtgaagccaggttagtaatcaaagaagctcttgtagaacgtaggagagcatttaaaagatcgcaaaaaaaacacaagaagaagcatttgaagcacgaaaacgccaatgatgaaactacggcagtagaggatgaagatgatgatctggatgaagatgacgtcaacgctgatgatgatgattttatgcattctgaaactagggagaaggagttggagtctatcgacgttctgttagaacagacaacgggaggaaataataaagatttgaaaaataccatgcagtatttaacaaatttctcccgatttagagaccaagaaaccgtcggggcagttatacagcttctgaaaagcactgggttacatccttttgaagtggcgcaactaggttctttggcctgtgacacagctgatgaagcaaagactttaattccaagcttaaacaataaaatatcagacgatgagttggaaaggatactaaaggaattgtcaaacctagaaacactctattaa

SEQ ID NO: 1197 - DNA, 666 bp, Saccharomyces cerevisiae
atgagcgctaccgaatcttcatctatattcacattgagtcacaactcaaacctacaagatatcttggccgccaatgccaaatgggcctcccagatgaacaacatacagccaactttgttcccagatcacaatgcgaagggccagtcccctcacactcttttcatcggctgctccgattcgcgttacaacgaaaactgtttaggtgtcttgcccggcgaagtgttcacttggaaaaatgttgctaacatatgtcactcagaggatttaactttgaaggccactttagagtttgccattatttgtctaaaagttaacaaagttattatttgtggccacactgattgtggtggtataaagacatgtttaactaaccaaagggaagccttaccaaaagttaactgttctcatctgtacaagtacttagacgatattgacaccatgtaccatgaagagtcacaaaatttgatccatttgaaaacgcaacgtgaaaaatctcattacctgtcgcactgtaacgtcaaaaggcagtttaataggattattgaaaaccctactgtgcaaactgctgtacaaaatggagaattacaggtatacggtctgctttacaacgtagaggacggtctactgcaaacagttagcacttacacaaaagttaccccaaaatag

SEQ ID NO: 1198 - DNA, 666 bp, Saccharomyces cerevisiae
atgagtgaccaaatcaacgttttgtcaatgcaacaacaacaacagcagcagcagcagcagcagcaagtatatatgtctcctcaagcagaaaacttgaatcatatgtacttgttagttaacaagctagtgaaacagttgagggaaaatcaagcagaaaaggcgaaaatactaaggaacatagacatattatccggaagcttaaacaagtatgagacatctgaagaacctcacgataccacggaaaatattgcattatttaatagatttctagaacaaagagggaaagctcctattactgagaaagagcaactaagcaacaatctggatgaaaatgcgaaagatgacgttatgctaggagtgttgaagcgccaaaattcaatgctccggaaaagtttacaggaatccaagcaggtaacccttgaatccatggatttattgtcttactccgaagactctttaaattacattgtcgcccaattaagaggaaacattctaatgcatcataaagagactatcaaattgattaggcagaaattccagacggagacaattcccctcgaagatgaagagttcaagatgtatttggaaaatgttaatggtctgcaaaaattgacagatatatctcacacttatagattactactgaggttacatgcacaagattga

SEQ ID NO: 1199 - DNA, 666 bp, Saccharomyces cerevisiae
atgcgatataataattatgacaactctggaagttccttcttaactagagtagttaaaaagtcagatatggagaaaacgttattattaaatagagaaattgatgactggaagtcaaacgataaaaagaaggcatataaggaacgcggaagagtttatgcaagttgctcatttattgaagtatccttttctcaaataagggctgttgatgttgaaaaaaaaattgagaatgccgaacaactaagagatcttacaagaaatattgttaagaacaaaaccagctctttgaacgaaattacaccctcaaagaatcgtgtaactagtgcatgcaattccgagagacgtacgactagccaagaagcaaacaatcttgaaggctaccatagttgtgcacaaggaactagtcggtctgccagtattacgaagaaatacagcaaaaagactactagtcgtcctaaaagagaaaagagacaaacaatcctcccaaatggtgagataaaggaatgctctaaatgtaaagacacttggacaattcaatggcgtagtggacccgaccaaaacagggaactttgtagtccctgtggactcgcctatggaaaaagactgaagaaggagaatgaaaaaaaaaggcaagcagcagataaaaggatagatcgaaacaatccatag

SEQ ID NO: 1200 - DNA, 666 bp, Saccharomyces cerevisiae
atgctaccgaccccttatgtaaaatgcgattacgataaagtatatgagcctgctgaggatagcttcctcatactggactgtttggaaaaagagcatgattttttgaaacagaaatttggtaatcgtttggccatcgtttgcgaaattggttcgggatcaggtatcgtcacaacatttctaatgcaaaacaaaataataccgcaggaaaattccatccacttagctgttgatatcaacccatgggcgctcgaagcaactttggatactgcgaagttaaattcatgtaaaagttcttttttagaagtgattcaagctgatttaaactccagtattcggaataatcaggttgatgtcctaatatttaacccaccatatgtgccagcagaatgtgtgccagatgtcccaggatcaagagaggaggcagaccaatggctagatttagcgttattgggtggaaaagacgggatggcgattactgataaactgctacgacaattagaacaaattctttctccagatggtgttgcatatatattattttgtgcaagaaataagcctaaagaagtcattaagaggtttgtcgatacttacaaatggaatgtgaaacttattgaaacgagaaaagcgggatgggaagtcctcagtgtgtacagctttacaaggtga

SEQ ID NO: 1201 - DNA, 666 bp, Saccharomyces cerevisiae
atggccagcatagacgcattttcggaccttgagcgccggatggacgggttccaaaaggacgtggcccaggtactggcacgtcagcaaaaccacgcgcgccaacagctgcaacagttccaagcggaaatgcgtcaattacataaccaacaccaacatctcatagatgaactgcaacggcttgccacccagcgcaccgctctgcagcaacaaatacatgcggcccaacaagctacaaataccaccagagagcagtggagaagctatcacgagcgtgaatctgagttatctagacggcagtcgaccttagcagcccaatcgcgcgagctggactcgctgctgcaacagcgtggtaaagagtgtgtccaattacgcgcacgttgggctgcgcagtcgggtaacgatgccgcagaggtcgcactgtacgaacggctgttgcagcttcgtgtactacccggagccagcgatgtgcatgacgtacgtttcgtattcggcgatgattcacgctgctggatcgaagtcgcgatgcacggagaccacgtgatcggaaactctcacccggcgctggaccccaagagtcgggcaacacttgagcacgtgcttaccgtccagggcgacctcgcggcatttttagtcgtggcccgcgatatgcttctggcatctttataa

SEQ ID NO: 1202 - DNA, 666 bp, Saccharomyces cerevisiae
atggctagaagaccagctagatgttacagataccaaaagaacaagccttacccaaagtctagatacaacagagctgttccagactccaagatcagaatctacgatttgggtaagaagaaggctaccgtcgatgaattcccattgtgtgtccatttggtttccaacgaattggaacaattgtcttctgaagctttggaagctgctcgtatctgtgccaacaagtacatgactactgtctccggtagagatgctttccacttaagagtcagagtccatcctttccatgtcttgagaatcaacaagatgttgtcttgtgccggtgcggatagattgcaacaaggtatgagaggtgcttggggtaagccacacggtttggccgctcgtgtcgacattggtcaaattatcttctctgtcagaaccaaggacagcaacaaggatgttgtcgttgaaggtttgagaagagccagatacaagttcccaggtcaacaaaagattattttgtctaagaagtggggtttcaccaacttggacagaccagaatacttgaagaagagagaagctggtgaagtcaaggacgacggtgctttcgttaagttcttgtccaagaagggttctttggaaaacaacatcagagaattcccagaatactttgctgctcaagcttaa

SEQ ID NO: 1203 - DNA, 666 bp, Saccharomyces cerevisiae
atgggaattcaggaaaagacattggggatacgaaaagagcgcaaattggtggttgtgcctcgcgaaagaaatcatgttagacacgcttcacaaaggacacgttctaaaaactacaagaatatctccaaaaagagggctcaacaacacgcgtttggattcaatattgctaagactcttgccaagatccaagcgtttgtatgggggtctcccgcagatgaggaagaagaaagcgttgtcccattgtctaaaaattctcaggattgtgtgcctctacaatggcaagcaaagtttgcgcaattgcggcagcagctgcactctacacaaaaggaactacaatttgtcaaggaaaagtgtcatctgttgcagtcggtgttggacgacgcaaacatcgatcaaagatacctggagtctcgtcgagacatgaaaaatattgagcgagacaacctcaaaccgacagaaaatttaccaccttcgccagtaagagcagtaaacccgttagtgacttcaagtccgattcacatgtcgccactccagtcgcgccaacgaccagtttcttccctacagcccccaaagggccccaacttctacgccaagtatcctaagcttcctcaaacgaacattctcagagaatctccgactgaggattcggttccgcacgctgaatag

SEQ ID NO: 1204 - DNA, 666 bp, Saccharomyces cerevisiae
atgggccaaaaaagtagtaaagtgcatataaccaaaacagatagggcgatcctagaagtaaaacgatctaaagatgaaattcataagtttacgaggaggacagataatttgattttggtagagaagagtcaactaaaagacctaatacgaaaaaatcctgaaaattataaatctaacatgaaggtacgatttctactaaaaagaattcattatcaggagcatttgttgcagcaggcttcggatcagcttattaatttggaaaatatggtgtcaacacttgagttcaaaatggtagaaaagcaatttattaatggactgaaaaatggaaatgaaatcttgaaaaaactaaacaaggaatttagcaatgttgatgaactgatggacgatgtacaagatcaaattgcgtatcaaaatgaaattaacgagacattatctagaagcttagtcggaacaagcaattatgaagacgatctagataaggaattggatgctctagaaagtgaactcaatccagagaagatgaataacgcaaaagtagctaacatgccatcaacagaaggtttgccatcattgcctcaaggagaacaaaccgagcaaaaagaaagagaggaattcgcgacggaggagagatcagacactaaggaacctttagcattactatcctga

SEQ ID NO: 1205 - DNA, 666 bp, Saccharomyces cerevisiae
atgtcggcaaacgataagcaatacatctcgtacaacaacgtacatcaactatgtcaagtatccgctgagagaattaagaatttcaagccggacttaatcattgccattggtggtggtggtttcattcctgctaggatcctacgtacgttcctaaaggagcccggcgtgccaaccatcagaatttttgctattattttgtctttgtacgaagatttgaacagtgtaggctcagaagttgaggaagttggtgttaaggttagcagaacacaatggattgattacgagcaatgtaaattagatctagtcggcaagaacgttcttatcgttgacgaagtcgatgacacccgtaccacacttcattacgctttgagtgaattggaaaaggatgcagctgaacaggcaaaggctaaaggtatcgatactgaaaagtctccagagatgaaaacaaacttcgggatttttgttctacacgataagcaaaaaccaaagaaagcagatttgcctgccgaaatgttgaatgacaagaaccgttattttgcagctaaaactgttccagacaagtggtatgcatatccatgggaatctactgacattgttttccatactagaatggctattgaacagggcaatgacatctttattcctgagcaggaacacaagcaatga

SEQ ID NO: 1206 - DNA, 669 bp, Saccharomyces cerevisiae
atgaccgtcgttatcggagtcttggcattacagggtgcgttcattgaacatgtgcgacacgtagaaaaatgcatcgtcgaaaacagggatttctatgaaaaaaaactatctgtgatgacagtgaaggataaaaatcaactagctcaatgtgatgcattgatcatacctgggggagagtcgactgcaatgtcccttattgcagaaagaacaggattttacgacgatctctacgcattcgtacacaacccaagcaaggtaacctggggtacttgtgcaggtatgatttatatttcacaacaattatctaacgaagaaaaactggtcaagacgctgaatttactaaaggttaaagtaaaaagaaatgcatttgggagacaagctcagtcttctacccggatttgcgacttttcaaactttattcctcactgcaatgattttcctgctacttttataagagccccagtaatagaagaggtgctggatcctgaacatgtgcaggtcctgtacaaattagatgggaaggataatggtggtcaagaactaattgttgccgctaagcaaaaaaacaatattcttgcgacatcatttcatccggaattggcagaaaacgatatacggtttcacgactggttcatcagagaatttgttcttaaaaactacagtaaataa

SEQ ID NO: 1207 - DNA, 669 bp, Saccharomyces cerevisiae
atgaacgctaatatatgggtggctgcttcagatggtaatttggaccgagtggaacatatcctccgcgagagtaaaggcgccatgaccccgcaatccaaggacattaacggctacactccaatgcatgctgccgccgcatacggccacctggatttgctgaagaaaatgtgcaatgagtacaatggagacattaatgtgttggacaacgacggcgataccccgttgcaccatgtggaggatgtggccactgccaggttgatcgtggaagagctgggtggagacttcactatcaggaatgtggagggccaaacgccatacgactcgttcgtcgagaacggtgaagatggtgagctaatcgagtacatgaggattaagtccggcgtggccgatgttcacggagtggacggcgtgcagggtgagggtgtcatcgacagcaaattgctggaagagttcaaggacaacgtgagatacaccttggaaaatgaccctgaggaaggagccgatgaggccactctgcaacgcaggaggcagttggaacagatcattacgggagacaacgctgaggaggagttggaaaggtacatccgtgctatggtcagagagcagatgctgggccagggctccatggcgggttccggggacgaaccagattccaagagaagaaaataa

SEQ ID NO: 1208 - DNA, 669 bp, Saccharomyces cerevisiae
atgaagtttttcccactccttttgttgattggtgttgtaggctacattatgaacgtattgttcactacctggttgccaaccaattacatgttcgatccaaaaactttgaacgaaatatgtaactcggtgattagcaaacacaacgcagcagaaggtttatccactgaagacctgttacaggatgtcagagacgcacttgcctctcattacggggacgaatacatcaacaggtacgtcaaagaagaatgggtcttcaacaatgctggtggtgcgatgggccaaatgatcatcctacacgcttccgtatccgagtacttaattctattcggaaccgctgttggtactgaagggcacacaggtgttcactttgctgacgactattttaccatcttacatggtacgcaaatcgcagcattgccatatgccactgaagccgaagtttacactcctggtatgactcatcacttgaagaagggatacgccaagcaatacagcatgccaggtggttcctttgcccttgaattggctcaaggctggattccatgtatgttgccattcgggtttttggacactttctccagtactcttgatttatacactctatatagaactgtctacctgactgccagggacatgggtaagaacttgttgcaaaacaaaaagttctaa

SEQ ID NO: 1209 - DNA, 669 bp, Saccharomyces cerevisiae
atgaccgaattagattatcaaggaactgctgaggcggcttctacctcgtatagtcgaaatcaaacggaccttaagccgtttccttctgcaggcagtgcatcttcatcaattaaaacgacggaacctgtgaaagatcatagaagaaggcgttcttccagcataatttcacatgtggaaccggagacttttgaagatgaaaatgaccagcaacttctaccaaatatgaatgctacttgggtagaccaacgcggcgcttggattattcatgtggtcattatcatactgctgaaactattttataatttatttcctggtgttaccacagaatggtcgtggactctgactaatatgacatatgttattgggtcctatgtcatgttccatctgattaagggtacccctttcgatttcaatggtggtgcttatgacaacttgacgatgtgggaacaaattgacgacgagactttatatactccttcaagaaaatttttgattagtgtcccgatcgccctattcttagttagtactcattatgctcactatgatttgaaattgttttcatggaattgttttttgacaacctttggtgctgttgtcccaaagttacctgttactcatagattaaggatttctatcccaggtatcacaggtcgcgcccaaattagttga

SEQ ID NO: 1210 - DNA, 669 bp, Saccharomyces cerevisiae
atgagcaacgaagattacggatacgactacgattatttatttaagatagttcttatcggcgactccggtgtgggtaaatctaatctgttgtcgagatttacaaccgatgaattcaacattgaatccaaatccacgattggcgtggaattcgctacaagaaccattgaagttgaaaacaagaagataaaagcacagatttgggacacggcaggtcaagaacgttacagggccatcacgtctgcgtactaccgtggtgctgtaggtgcacttatagtgtatgatataagcaaatcaagttcatacgaaaattgcaaccactggcttaccgaactgagagagaacgcagatgacaacgtggctgttgggttgatagggaacaaatcagatctggctcatttaagagcagtaccaaccgatgaagcgaaaaatttcgcaatggaaaaccaaatgttatttactgagacaagtgctttaaatagtgataatgtagataaagcatttagagaactgatcgtagccatcttccaaatggtaagcaaacatcaagtagacttaagcgggtcgggtaccaacaacatgggctctaatggcgctccaaagggtcctaccatcagcttaacaccggcaccaaaggaagacaagaagaaaaaatccagcaactgttgttaa

SEQ ID NO: 1211 - DNA, 669 bp, Saccharomyces cerevisiae
atgcacaatcaggaagagtggctagacaaggacaaaactttggtgaacgaagaagaaaatacttgcatcaaccattcttatacaaaaaaggacactaataactatcgggtcggtaaaagcggtattaaggacttgaagaagcctacgaaccagaaggaaattgcgataaaaaatagggagttaacgaaacaacttactcttctcaggcaagaaaataatcacttacagcaggcttgtaaaattctcagcgaaaacaagatcattgagaacagaaaatccatagaaaaatggaggacaatttgtgagatggaactgtcttttattttaaattccactttaatcaaaatcaatagaatgggcggctataaagattttctagaaaaagaaatggaggctaaaaagagaagattggaatatcagattgacaacggtatggaagatcaaatctgtgaaataaaggaaagtgatgactttagacaactttcagaagttgagaaacaagagtgggagagtcaaatgaatgaacagctgaaagagttggaaaaaaaaaaaatagcggagctggaaaaattgaataaggtgctgcatgatagcgaagggaaagattttggaatggctgaactatgcactaggttaaaacttgactacagcttaatctttccacaatga

SEQ ID NO: 1212 - DNA, 669 bp, Saccharomyces cerevisiae
atgtccaatgatcctggtaatgaggttagctccttgtacccacctccacccccatacgtgaagtttttcacacagtccaatctggaaaaattaccaaaatacaaagaaaagaaggccgcaagtgcgaagcagacggctccaaataacagtaacggcggcagtgaagaggagattacatgtgcgctagattacctaatcccaccccccatgcccaaaaatcagcagtaccgagcgtttgggagtatatggcaggtgaaggaccaactgcccgatttagagagcatgggactcacccaactttataagaaatccacagaaaacgaaagcacaaattatcaatacaaaatccaagagctacgcaaactattgaaatccctcctgctaaattacttggaactcatcggcgtattgagcataaatccggatatgtatgagcgcaaagtggagaacataaggaccattcttgtcaatattcaccacctacttaatgagtacagaccccatcagtcccgagagtcccttattatgctattggaagaacaattagaatacaagcgcggggaaattcgcgagatcgagcaagtatgcaaacaggtacacgacaaactcaccagcatacaggacaccttaagaaccggatcacaatctcctccatcgtcgtcccaatga

SEQ ID NO: 1213 - DNA, 669 bp, Saccharomyces cerevisiae
atgtcgtggctttttggagataagacacctaccgatgatgcgaatgctgccgtgggcggccaagatacaaccaagcctaaggaactatcgttgaagcagagtttaggtttcgagccaaacatcaataacataatatcaggtcctggtggaatgcatgtcgacaccgctaggctgcatcctttggctggtctagacaagggtgtggagtatttagatctggaagaagaacaactatcctcgttagaaggctcacagggtctgatcccttcccgtgggtggaccgatgacctatgttacggtaccggtgccgtctacctgctgggacttggtatcggagggttttctggtatgatgcagggtctgcagaatattccgcccaatagtcccggaaaattgcaattgaacaccgtcctgaatcacattactaagagaggtcccttcttaggtaataatgcggggattctcgcgttgagctacaatatcatcaattctacaatagatgcactaagaggcaaacatgacaccgcgggctccattggcgctggggccctcacgggcgctttgttcaagtcttcaaaaggtttgaaacccatgggttattcctcggcaatggtggccgctgcgtgcgccgtctggtgtagtgtcaagaaaagactacttgaaaaatga

SEQ ID NO: 1214 - DNA, 669 bp, Saccharomyces cerevisiae
atgtctagctcagaatccattagaatggtcctaattggcccacctggtgccggtaaaggtactcaagctccaaatttgcaagagcgtttccatgccgctcacttggccactggtgacatgttgagatctcaaatcgcaaagggcactcaattaggtttggaagcaaagaaaattatggaccaaggtggtttagtctctgatgacattatggttaacatgatcaaggatgaattgaccaacaatccagcttgtaagaatgggttcatcttggacggtttcccaagaaccattcctcaggctgaaaaattggaccaaatgttgaaagaacaaggaactcctttggaaaaagccatcgaattgaaggttgatgatgaattgttggttgccagaattaccggtagattaattcacccagcctctggcagatcctaccacaagatctttaacccaccaaaggaagacatgaaggatgacgtcaccggtgaagctttagttcaaagatctgatgacaatgcagacgccttgaagaagagattagctgcttaccatgctcaaaccgaaccaattgttgacttttacaaaaagaccggtatctgggctggtgttgatgcttcccaacctcctgctactgtttgggctgacatcttgaacaagctaggtaaggattaa

SEQ ID NO: 1215 - DNA, 672 bp, Saccharomyces cerevisiae
atgaaaaccaataagaaaatttctaaaagaagaagcctgaaaaatctccatggtgccttaaaaggactattgaaagagtccggcaagaagagtgagtccaaaatacgaaaacatagcgattgcaatcctgttcatcgagtatatccgccaaatatcgaaaaacggaagaccaaaaaggacgatggaatttcacggccaattgctgaaagaaatggtcatgtgtatataatgtccaaggaaaaccacatcatccctaaactaaccgatgatgaagtcatggagcgccacaaactagcagacgaaaacatgagaaaagtgtggtccaacatcataagcaaatacgagtctattgaagaacaaggagacctcgtagacctgaaaactggtgaaatagttgaagataatgggcatatcaagacgctgacggccaacaacagcacgaaagataaaagaacaaaatacacaagcgtgctcagagacattatcgacatcagcgacgaggaagatggtgataaaaatgatgaatatactctttgggctaacgatagcgaggcaagcgattcagaggtggatgctgacaacgacactgaagaggaaaaagacgagaaattgatagacgcagatttcaagaagtacgaggccaaactctcgaaaaggatattacgagattaa

SEQ ID NO: 1216 - DNA, 672 bp, Saccharomyces cerevisiae
atgaagaaacaaatattaatagttgctgcacaaagtattttatgttctactgtttttggcgagcgaagtaatgtaggcctttccactgaagagctaggaggtgactcaattttatacttcaatgaagaccctatagtgattgaaatcgataagaaagctattgacaagaagactttggaacagttggcaagcacaagagatgttgttcttactgatttaccggacactcttgagtttatagacttcaacgagtacgcgaaaatgaagtcaaaatcagatatgctactagagtatatcaacgaatacgaatttgatgattttgaaagaagttctgaaggcggtcttgaagaagaagaagaagaggatttaatttatgacttcaatgcccaagctgaagatttgggtaagcttggttcaaatatatatgaagtagtcgaagaaaagaatattgttaatacttacgatggaaaccttatcaatgcaagtacaactgaatcaacgactactattcggcctttcgtgacttctcactcctacgttgcttcttctacaccttattcgaatatttcatcattgaatgaggactacgataatgcgagcaactttttgactcctacaacagtggctcttgcggtacttttaaccattttattatttatacaggcgtattaa

SEQ ID NO: 1217 - DNA, 672 bp, Saccharomyces cerevisiae
atgacgaagaatgtattgatgttacatgggcttgcgcagtcaggtgactactttgcctctaagacaaaggggtttcgcgccgaaatggaaaagttaggatataaactctactatccaacagcacccaatgaatttcccccagctgatgttcctgatttcttgggtgaggtaattgctgatgcacctggggatggtgagaataccggtgtgcttgcgtggctagagaatgacccttccaccggtggctatttcataccgcagacgacaatcgactatttacacaattatgtccttgaaaatggtccatttgcaggtattgtaggatttagtcaaggagccggtgtagctggatacctagcaacggatttcaatggtttgttgggccttacaacagaagaacagccgccgctagaatttttcatggcggtcagtggtttcaggttccaaccacaacagtatcaagaacagtacgacctgcatccaatatcggtcccatctctacatgttcaaggagaacttgacactatcacagagccggccaaagtgcaaggcctatataactcttgtacggaagactctcgcactttactaatgcactctgggggccactttgtgccgaactcaagagggtttgtgagaaaagtggctcaatggctccagcagttgacctga

SEQ ID NO: 1218 - DNA, 672 bp, Saccharomyces cerevisiae
atgagcagcgaggactacgggtatgattacgacctactatttaaaattgtactgatcggtgattccggggtagggaaatccaatctattgtcaagatttacgaagaacgaattcaatatggattcaaagtctacaattggggttgagtttgccaccagaactttggaaattgatggcaagaggatcaaggcgcagatttgggatactgcgggccaggaacgttacagagccattacttctgcttattatagaggagctgtaggtgccttgatcgtttacgatatcagtaaatcaagctcatatgaaaattgtaatcattggttatcagaattaagagaaaatgcagatgacaacgtcgcagtggggcttatcggtaacaagtctgatttggcccatttacgtgctgtacctacggaggagtccaagacttttgcacaggaaaatcagttattattcacagaaacaagtgctttgaacagtgaaaacgtggataaggcttttgaagagttaatcaataccatctatcaaaaggtcagcaagcatcaaatggaccttggtgactccagtgccaacgggaatgccaatggtgcgtccgctcctaatggaccaacgattagtctgacaccaacaccaaacgaaaacaaaaaggcaaatggaaataactgttgttaa

SEQ ID NO: 1219 - DNA, 672 bp, Saccharomyces cerevisiae
atgagcgtccaagcagaaatagggatattagatcatgtagatggttcatctgaattcgtatcacaagacaccaaggttatttgttctgtaacaggccctattgaaccaaaagcaagacaagaactgcctacacaattagcattagaaattattgtacgtcccgcgaaaggggtggccacaacaagagagaaggtactcgaagataaattacgggcagttctgaccccactcatcactcgtcattgttacccaagacagctctgccagataacttgtcaaattctggaatctggtgaagatgaagccgaattctccctgagagagctaagttgttgtataaatgcggcatttttggctttagttgatgcaggaattgccttaaatagtatgtgcgcaagcatccctattgcaataatcaaagacactagtgatatcattgtcgatcccactgccgagcaattgaagatttcgctctctgtccacactttagctctggagttcgtcaatggcggtaaagtcgtgaaaaacgttttattgttagacagcaatggtgattttaatgaagatcaattgttcagtttactggagctgggtgagcaaaagtgtcaagaacttgtcacaaatataagaagaataatacaggacaatatatcacctcgtctagttgtatag

SEQ ID NO: 1220 - DNA, 672 bp, Saccharomyces cerevisiae
atgagctcacaaccgtctttcgtcaccataaggggcaaggccatttctctagaaacacaaacggagtcacttctttccaagtactccacattcgcgcagacaactagttcagaacaaactggccaagaaaagaagatagacaagcagttggagggaatcttaggccagagacaggatgtaatcgattcattaacacaaatctgcgattctaacccggcaatctccgcctcaaagctttcccaactgcaccgccacaaggagatcttacaagaccactggaagagcttccgcaatatcaggtcctccatccagcaagagcgcaacagactaaacttgttattcagcgtgaagaacgatattgctaattccacaacggacgcgccagctcctataggggatgctgacgagtacattcagaacgaaacaaggcgaatcgatcagtccaacaacgtagtcgaccgtctcatctcccaagcctgggagactcggtcgcagttccactcgcagagcaacgtgctgaacacggcaaacaacaaggtgttgcaaactttacaaagaataccaggtgtcaatcagcttattatgaagattaacacgagaaggaagaaaaacgcgtttgtattggccacgataaccaccctttgtatactgtttttgtttttcacatggtaa

SEQ ID NO: 1221 - DNA, 672 bp, Saccharomyces cerevisiae
atggaggataaggagaaacttattgtatactcaaataccagttcggtatttacatatagtgcagaaataaggccaaattttaaaatatctgtatctcaaagtcaaggttttgcctggaaccaggacttattcgccacacaataccaacaatcatataaggtggtatatgatgcacacgaggacaactttgatgagttaattttgaagatcaagggcaaattaaagacaaaatctaataaaagagctaaaatgaagtctaagactaaattaacaaggactgcaaagcagagaagggaaagccccgtttgtgaaagggacgagagtgacgaggataatgatagtgatcactaccaaagaatacaagtgctagatggccatgaatttccgagagcaaatcggtataaatctgtatgggctcatgacgtccactcgaatgaagatagtacaagcgacggggaaagcaatcatgatatagatatgattggcggcactggcacgtcgtatgcaggagcagccataatggataggccacgcaggaaatctgagagaagcataagctttgtggaggactccaagacaggcgattacaggtatcaaaccgggcaggtggatgttgtagaggtggactcggacacccctgaaaataatcacctaaaatggttaattaaataa

SEQ ID NO: 1222 - DNA, 672 bp, Saccharomyces cerevisiae
atggcagccaggaatcgtagaaagaataacaagaaaaagtcccttttggtaacgagtgccgctcaagaaaagaatgcgacgtatgtgctcgttgcagaggaattacataaaaaaacaatcgatctaaacatgggtactgaaacacctttaacggaaaaccacgagaatcctataccagcgaaagaattcaagcaccagcaaaaattagagccaatagacgaacatgatgatggcgaagacgaattatcgataaaatttaagtccatgacaaaaagctcggggcctattactgaggctgaagttcaaaagctgctcctaagctatgccttcacaagtgctgcaatacaggaggacgaaaacgagaaagaatcgcgtcactatcctattaaaccgccttcgccatcagcttcttctttgtccgcctattttcaatccttcgttgaaaaatgcaaacaggttttctacaacttcagtctgcaaacagtagaaaaattaaatgctctacaaaatagcttgtacgaagtattttggattatttttatttatttaaactactggttccccaatgtgggtgactatgtgaggtatgtctgtcgtagcttctcgcgccataacgaaattgcccaattactaacacgtatttttacttacaatatcaaccacctccactaa

SEQ ID NO: 1223 - DNA, 672 bp, Saccharomyces cerevisiae
atgtcacaatctactgcatcactggtaccagagggcaatcaaggctccctccaagaagatgttagttttgatttcaatggtgtacctggccaggctttagatgccgtgcgcatgcgtttggctcaattaactcattcattgaggagaatcagagacgaaatgtccaaagccgaactgccacaatggtatacactccaatcacaactgaatgtcacattatcccagctcgtttctgtaacctccactctacaacatttccaagaaactttagactctacagtggtttaccctttgcctaaattcccaaccacctctcatgaaagtttggtcactacccttttgaggaagaagaatattcctgaagtggacgaatggatgaaatatgttagggaaacatctggagtaactacagccttgctaaaggatgaagaaatagaaaagctgctgcaacaggacagagaaataacgaattgggcgcgcactacgtttagaaacgaatatggaaagcacgatttcaaaaatgaagaatccctaagcgaagaacacgcttcacttctagtacgagatagcaaaccttcgaaacctttcaatgtggatgatgttctaaagttcaccttcacaggggaaaagcccattattacgggatctacttcaacatcatctagtaattga

SEQ ID NO: 1224 - DNA, 672 bp, Saccharomyces cerevisiae
atgtcgaaggatgtaatagaatactctaaattatttgctaaactggttaacacaaacgatgatacaaaactggatgatacaatagcatccttcttatattatatgtttccaagggaactatttattcgagcaatttcattactagaatcttcagacatgtttatatacatattagatagagtccataacaaggaaggtaatgagcatacatcattgattgatgtgttagttgatgaattttataagggttcatctaattcgctcctggagtatcgcttaatagtgaaggatactaatgatggagcgccaccaatactcgtagatatcgcacactggttctgctcatgtgaagagttttgtaaatactttcatgaagcactagaaaaaactgacgaaaaagaagaattacacgatgtgctaataaatgaagttgatgatcatttgcaattttcggatgataggtttgcacagctggatcctcatagcttatcaaagcagtggtatttcaaatttgataaagtttgttgttcgcatctactggcgttctccattttgcttagatcttccataaatgtgctgaagtttttcactgtgaactcgaataaagttttcgttatagcaatagataatatcgacgagtggttaaacttgcacatcaacatagttgagtaa

SEQ ID NO: 1225 - DNA, 675 bp, Saccharomyces cerevisiae
atgaaagtacaaatgatagaaaggatttttctgatccagttgtgtttgcttaccgttgtattagcaagtagtagagcagtggttgaattcgaaagtaccggaaccaaactggtcaactcattaagggtcttggctgcttactcgcagagttctgtctgtgttgatgaaaaaatatctggaatcgagagacaaatagaggaagttaaagatatgtatggtaaccactcttttattctaaagggtttaaatggtatattgaataacaaggtgaatatgctaacaagggaaatccaaatggaaactgttggcaataacacatttgaaacagaaacagggaagctaactaagggcctaaaccgagcagtaaatatatctccgttcaagtacataaaaaaattcaagaccgtttcaacaaagaaatttgaaagcctcttgaataagtatgatctggttgccaagaagggcggggaattgacagaggaacaaaagaaaaagaaggaggtgctctcacggatcagtagagtagtcgctgcaacaacgatagaggctggtctggcacaaggtgtggttgatttatgtataacagtgacaactagtctatgcttagtctcggccagcattggaggcgtcggatttcttatttggctcaccattatataccaagctctgacttag

SEQ ID NO: 1226 - DNA, 675 bp, Saccharomyces cerevisiae
atgaacaacagtgaagatccgtttcaacaagttgttaaggacaccaaggagcaattgaaccgcataaacaattacataactcgtcacaatactgctggtgatgacgatcaagaggaggaaatacaagatattttaaaggatgttgaggaaacaatagttgatttggacagaagcataatcgtaatgaaaagggatgaaaacgaagacgtgagtggtagggaagcacaagttaaaaatataaaacagcaacttgatgctctgaagttgcgttttgatcgaagaatacaggaatctactcaaacaactattcctctagaagagacggtggaaaattcaacacttaacaccagcatggctgagaacaatgatggtggtatgtccaatccgtttcaggaacaaatgttaagagaacaagatgttcatttagatggtattcacaagacaatgcaaaatttgcatattcaagctcaaacaatgggggatgaattagagaaccagggacaattgttggataatatggacgagggtatggacggtgttgtaaataagctggctagaggtcgtaggcaattggaatgggtctacgaaaaaaataaagaaaaatacgacgattgttgtataggacttcttattgtcgtcttgatagttttattagttttggcattcattgcttga

SEQ ID NO: 1227 - DNA, 675 bp, Saccharomyces cerevisiae
atgaagattttaacccaagacgaaattgaagctcatcgctcacatacgctaaaaggtggtattgaaggtgcccttgccggatttgcaatctctgctataattttcaaagtcctaccaagaaggtacccaaaattcaagccttcgactctaacatggtccataaaaaccgccctttggatcacccctcccacggtcttgactgctatatgtgcggaggaggcctcgaacaatttcgacgctacaatgtacggatccggttcctcctcggaagacgcactagatgagcacagaagatggaagagtttgagtacaaaggacaagtttgtcgaaggtctatctaataacaagtataagatcatcaccggtgcctgggccgcttcgctgtatgggtcgtgggtaatcgtgaacaaagaccccatcatgaccaaagctcagaagatcgtgcaggcaagaatgtacgctcaattcattaccgtcgggctgctgctggcctccgttggtttgagcatgtacgagaataagttacatcctaacaaacaaaaggtcaacgaaatgcgccgctgggaaaacgcactgagggtcgccgaagaggaagagagactcgagaaagagggaagaaggaccggctacgtttctaacgaagaaagaataaactccaagatcttcaagtcgtaa

SEQ ID NO: 1228 - DNA, 675 bp, Saccharomyces cerevisiae
atgacactagtgactccgttacaattttcgactgtacagccaaatttatatagaggatcttacccacgagaaatcaatctcccattcctgagaacccttagattgaaatacatattatctttgacaccagaacctttgagcactgatcctctaatggtaaagttttgtgaagaaaataacattaagacaattcatataaaatgtcaaagtgaaagaaaggcagacaagaccaaacccaagattaaaaggaaaaagaaaacagttcctattgaatacgatgttgtagtacgatgcgttaaatttctgattgataaagggcattacccctgttatatgcactgtacgaatggtgaattgataatatctctcgtagtagcatgtatgagaaagttttcatattggagtacggtatccatactaaatgagtttttggtgtataattccagcatcaatattcatgaaagaaatttcattgaaaactttaactctgaaatcgaagttgacgatctggatataaaggataaagttccctggattaccgtgcgatatattgcaaggacagccacagaatcaaaagatgagttgcgtgttgatgatgctaatgcgtctgaaaaagttgcaagagtaagtagcgtgtcaaattctttgccaaaactaaaatttcatagtatgtaa

SEQ ID NO: 1229 - DNA, 675 bp, Saccharomyces cerevisiae
atgatatttgctccttctttctccctcattaaaaatattctcctggtaagctttctaatcagccacagttttgctgccaaaactttaacgtctagttccaatgacgatacacttgccaggtccgcagctgcagatgcagacatggcattcttcatggagtttttaaacgatttcgacaccgcttttccacagtatacctcatacatgatgcaaaaccatttaaccctacctcaacctgttgctgactactactatcacatggttgatttggcctcaacagcagatttacaatctgatattgctcagagttttccgttcactcaattccaaacattcattacggcctttccatggtatacctctttgctaaacaaagcctccgccaccaccatataccttccccaacacttcataacaggtgagacagaagctaccatgactaactcatcttatgccagccaaaaaaactccgtttccaattctgttcctttctcgacagcgaacgcaggccagtccatgatttccatggctaatgaagaaaacagtacaacagcacttatatccgcatcaaactcttcttcaacatccagaactagtcaatcacagaatggtgcccatgccaaaagcttatatttccccatggcgttgttcggaatctttgcagttgccctttaa

SEQ ID NO: 1230 - DNA, 675 bp, Saccharomyces cerevisiae
atgatgtcttcagaccaacaggggaaatgccccgtagatgaggaaaccaaaaagttatggctacgagaacatggcaacgaagcgcatcctggtgctactgccccaggcaatcaactagagtgctctgcaaacccacaagataacgataaaacgcctgaatatcacaccacggtggatctctctcagtccagagaggtttccaccataccaaggacgaattctgacagaaactggatatacccgtcggagaaacaattttacgaggcaatgatgaaaaaaaattgggatccgaactcagatgacatgaaggtggttgtgcctttacataactccatcaatgagcgggtttggaactacattaaaagctgggaagacaagcagggtggtgaagcgtgtggcggtatcaaattaacaaattttaaaggtgattccaaaaaactgacaccaagggcctggttcaggtcccgtatcttgcacctggccaaaccttttgatagacatgattggcagatagatagatgcggtaaaaccgtcgactacgtaatcgatttctattccaccgatctgaacgatgcaaactcgcagcaacaaccacttatttatctcgatgttagaccaaaattaaacagttttgagggctttagattacggttctggaaatctttaggcttttga

SEQ ID NO: 1231 - DNA, 675 bp, Saccharomyces cerevisiae
atgcacaaaacccacagtacaatgtccggaaagtcgatgaaagtaattggggttttggcgttgcaaggtgcctttttggagcataccaaccatttaaaaaggtgtttggctgaaaacgactacggaataaagatagaaatcaaaactgtaaaaactcctgaggatctagcccagtgcgacgccttaattattcccggaggagaatctacgtcgatgtccctcatcgctcaaagaacaggcttatatccttgtttatacgaatttgttcataatccggaaaaggtagtttggggtacttgtgctggtctcatctttttaagcgcgcaattagaaaacgaaagtgccctagtaaagactttaggtgtgttgaaggtcgacgtgagaagaaacgcatttggaagacaagctcaatcttttacacaaaagtgtgatttttccaatttcatacctggctgtgataattttcctgctacatttattcgcgcacccgtgatcgagagaattcttgatcctatcgcggttaaaagtttatatgaattgccagtgaatggaaaggatgtggttgtagctgcaacgcaaaatcataatatccttgtgacttcttttcatccagagcttgctgacagtgatacaagatttcatgattggtttatcagacagtttgtttctaattaa

SEQ ID NO: 1232 - DNA, 675 bp, Saccharomyces cerevisiae
atggattatataaaaaaagccatatgggggccagaccctaaggagcaacagaggagaatcagatcggtcctgaggaaaaatggtcgaaatatagagaaatcgttgcgggaactcacagttttgcaaaataaaacccagcagcttatcaagaaatctgcaaagaagaacgatgttaggacagttcgactatatgcaaaagaactgtaccaaatcaataaacaatatgatagaatgtacacttccagagcgcagttggattctgttcgaatgaagatagatgaagcaatcagaatgaacactttgtcaaatcaaatggctgacagtgcgggcttaatgagggaggtaaattcattggttagactacctcaattgagaaatacgatgattgaattagaaaaggaacttatgaaatctgggattataagtgaaatggtggatgataccatggagagtgttggggacgtaggggaagagatggacgaagctgttgatgaagaagttaataagatagttgaacaatacacaaacgagaaattcaagaatgttgaccaagtgccaaccgtagaattagcagccaatgaagaagagcaagaaattccggatgaaaaagttgatgaggaagcagataggatggtaaatgaaatgcgtgaaaggctgagagctttgcaaaactag

SEQ ID NO: 1233 - DNA, 675 bp, Saccharomyces cerevisiae
atgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagcaggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaatag

SEQ ID NO: 1234 - DNA, 675 bp, Saccharomyces cerevisiae
atgtctttcactgaggatcaagaaaaaatcgcgctagaaatactgtcaaaagacaagcatgagttttacgaaattttgaaggtagataggaaagccacagatagtgagatcaagaaggcatacagaaaactagcaatcaaattgcatcctgataaaaactctcatccaaaagcgggagaagctttcaaagtaattaatagggcatttgaagtactaagcaatgaggaaaagcgcagtatttatgacaggataggtagggatcctgacgatagacaaatgccatccagaggtgctgcttcagggttccgaggaagtgcaggtgggtctccaatgggtggcggatttgaagacatgtttttcaattcacgtttcggtggtcaaagagctggaccaccagaggacatattcgactttttgttcaacgcaggcggcagcccattcggcgcttcaccatttgggccttctgcttccactttttcatttggaggccccggtggtttcagagtttatactaataatcgtggtggctcaccgttcatgcgtcaacaaccccgctcaagacagcagcaacaacaagcagaagaaaatgcagtgaattcgcaattaaaaaatatgctcgttcttttcatcatctttattgttcttcctatgattaaagattacctgtttagttaa

SEQ ID NO: 1235 - DNA, 675 bp, Saccharomyces cerevisiae
atgtgggattcgttaattgtaagcatcaacgatacgcacaagttggggctggaggattgtctcgccgtttttggccacgttcccattaccaaggccgtcaagcatgtcagactgacagagatcgacacgcagacgtccacgtttacgctcaagttccttcacacagaaacgggtcagaacatcgagaagattatctacttcattgacaatgacacgggcaacgatacccgcactgctaccggaatcaagcaaatcttcaacaagatgttccgcatcgctgcggagaagaggaagctgtcgctcatccagatcgacactgttgagtacccctgcactctagtagacttgttgatcctggtaggcgtggcgctaccgccattgtgctacctctatcgtcctgcactgcacgctatctttttcctggtccctaatcctgtgggctccaccttagaggcgtggctggatagtgatcttgtgctgcgactcatcattgttgccgagttcctgactcacgccctcgagacgctcattttcgtcgtccctaggctcaagtactaccgtgttcctggcgagttcgtgcccgagtggcttcttctaggtctcctcgaaggttacggtcctgcgagacgtctagatactaaggctcgcactcttggcgaagggtcagttaattag

SEQ ID NO: 1236 - DNA, 676 bp, Saccharomyces cerevisiae
atgtccgaatatgcatctagtattcactctcaaatgaaacaattcgataccgtatgtaagatggttttattggttccatcgtcatcatggttcaaacagccaaatgacccgacacacgtaaccgaagcagttatactaacaagaaagctaattttcaccctccttgctacatttttttctacagaagtactctggtaatagaattttacagcaattagaaaataaaactaatttgcctaaatcttatttagttgctggtttaggtttcgcttatctccttttgatttttattaacgtcggaggtgtaggtgaaattctttccaattttgctgggtttgtgttgccagcatatttatcgttggttgctttgaagacaccaacgtccaccgatgacacacaactcttgacctactggattgtcttttcatttttgagtgtcattgaattctggtccaaggcaattctatatttgattccattctactggtttttgaaaaccgttttcttaatctacattgccttgcctcaaactggtggcgctagaatgatctatcaaaagatcgtagccccattgaccgacagatatatcctaagagatgttagcaagacagaaaaggatgaaattagagcttccgtcaatgaggcttctaaggctacaggtgcttctgttcattaa

SEQ ID NO: 1237 - DNA, 678 bp, Saccharomyces cerevisiae
atgtcacagtacggatttgtaagagttcctagagaggtagaaaaggccattccagtggtgaatgcacctagaccacgggccgttgttccgcctccaaacagtgaaactgctaggcttgttcgggaatatgccgctaaagaattgactgcccccgttctaaaccactctttgcgtgtttttcaatatagtgtagctatcataagagaccaatttccagcatgggacttggatcaggaagttttgtacgtcacctgcttacttcatgatattgcaacaacagataagaatatgagagccacgaagatgtcatttgagtattatggtggcatactttcaagggagcttgtatttaatgcgacaggtggaaatcaggactacgcagatgcagtaactgaggccatcattcgtcaccaggatttgactgggactggctacattaccaccttggggctcattctgcagattgctactacgcttgacaatgtcggatccaataccgatctgattcatatcgatacagttagtgccattaacgagcaatttccaagactgcactggttatcatgttttgctacggtggtggacactgaaaactcgagaaaaccgtggggccacaccagttctttgggtgatgatttttcaaagaaagtcatatgcaatacatttgggtataactaa

SEQ ID NO: 1238 - DNA, 678 bp, Saccharomyces cerevisiae
atgaaagcagacgcgaaacaaataacacatctactcaaacctcttcgacttttattattgggggctccagggtcaggtaaagggacacagacttcgagattactaaagcaaattccacaattatcttcaatttcgtcaggcgacattttacgtcaggaaataaaatctgaatctaccctaggccgagaggctactacctacattgctcaaggcaagttattaccggatgatctcataacgcgtctgataacttttcgtctttcggcattgggttggttaaaaccatctgccatgtggttgctcgatggatttcctcgaactactgcgcaagcttctgccttagacgagctgctgaaacagcatgacgccagcttgaatctagtggtagagctagatgtacccgaatccaccatattagaaaggatcgagaacagatatgttcacgttcctagtgggagagtgtataacttacaatataatcctcccaaagtgccaggattagacgatatcaccggagaaccattgaccaagaggcttgatgacacagcggaagtgtttaaaaaaaggctagaagagtacaagaaaacaaatgagcctttaaaagattattacaaaaaaagtgggatttttggtaccgtctctggggaaacatcagatattatcttccgaaattattga

SEQ ID NO: 1239 - DNA, 678 bp, Saccharomyces cerevisiae
atgaagcttcaatttttttcctttattaccttatttgcttgtctcttcacaacagccatttttgcgaaagaggacacggcagaagatcctgagatcacacacaaggtctactttgacattaatcacggtgataaacaaattggtagaattgttatgggattgtatggtctcaccacaccccaaaccgttgaaaacttttaccagttgaccatttccagggaccctaagatgggttatttgaactctatcttccatcgcgttattcctaacttcatgattcaaggtggcgatttcactcacagatcaggtattgggggtaagtctatcttcggaaacacgttcaaagatgagaattttgatgtcaaacatgacaaaccaggcagattgtctatggccaatcgtggtaaaaacaccaacggatcccaatttttcatcaccaccgtcccatgcccatggttggacggtaagcacgttgtctttggagaagtcttggatggtatggacgtagttcactacattgaaaacgttaagaccgacagtagaaatatgcctgtaaaggaagttattattgtggaaagtggtgaactggaaactgttcctttggacaataaagacgccgccaagctacaggaagagatcaaagcggaagctagcgaagcagcccacgatgaactctaa

SEQ ID NO: 1240 - DNA, 678 bp, Saccharomyces cerevisiae
atgaggttttctatgttaatcgggtttaatttattaactgccttgagcagcttctgtgctgccatatcagctaataatagcgacaatgtcgaacatgaacaggaagttgcggaggcggtagcgccaccttctattaatatagaggtgaaatatgatgtcgttgggaaggaatcagaaaatcatgattctttccttgagttttacgcggaggataccgctaccttagcctataatgttactaattgggaagatactaatatcacaatttttggtgtcaacggaacaattgttacatatccacatggttatcctgtggcggacattacaggtgcgagtattgggccttacgaaatggaggtcaacggaacttcaaaattcgggcaagacgttacgttaaatttaccggaaggacaatactttttaatcccatttttattagcttctaggttcgatgaaatcgtgagaattgcggcaccaccaaccctattcgaaattgttagcccacctatttcctttttcaacccacaatttttatcagttcaggtcatctttctagccatcatcggaggtgtaagttattactacatgaagtctaaaacaaatcaaagaccttccaagaagagtgccactgtcaaaaaagttgatgaatcatggttgccagaaacctataaaaaataa

SEQ ID NO: 1241 - DNA, 678 bp, Saccharomyces cerevisiae
atggggtccgaggaagataaaaagttgaccaagaagcagctcaaagctcagcagtttagaaaaagtaaggaggaaaaagatcaagagaaagacgtaaaaaaagagcaagcaccagaaggaaaaagacccaacagtgcagccggaaatgatggtgaagaacccgtgaagaaaaaaagaaaaacacgtagaggccgtggtggtaagggcaaaaatggtaaaaagggcaacagatttattgtctttgtcggtagcttacctagagacatcactgctgttgaattgcaaaaccattttaaaaatagttcacccgaccagatccgcctcagagctgacaaaggtattgcatttttggaattcgatgctgacaaagatcgcaccggcattcaaagacgtatggacattgccttattacaacatgggaccttactgaaagagaagaagatcaatgtcgagctaactgttggcggaggtggtaacagtcaagagcgtctagaaaaattgaaaaacaaaaacatcaagttggatgaagaacgtaaagagaggttgacaaagatgattaacgacggcaaccaaaagaaaatcgccaaaactaccgccactgcagctcaaacctctggaacagacaacaagcctgttcctgcaggaattcatcctgatagagccaaactacttaaatga

SEQ ID NO: 1242 - DNA, 678 bp, Saccharomyces cerevisiae
atggtcgtaattaacggggtcaaatatgcctgtgaaacgtgtatcaggggtcacagggcggcgcagtgtactcacactgatggtccgctacagatgatcagacgcaagggaagaccatcgaccacatgtggccattgtaaagagctgagaagaaccaagaacttcaacccatccggtgggtgcatgtgtgcctctgcacgacggccagctgttggcagcaaggaagatgaaacacgatgtcgttgtgatgagggtgaaccttgtaaatgtcataccaagaggaaaagcagccggaaatcaaagggagggtcatgccacagaagggcaaatgatgaagcagcgcatgtcaatggtctcggtattgcagatctggacgttcttttgggcctaaatggtcgctcgtcggatgtagacatgacaaccacattgccgagtttgaagccacctctgcaaaacggagaaattaaggccgacagcattgacaatcttgatttggcttccctcgatccgcttgagcaaagccctagtatatctatggaacctgttagtatcaatgaaacaggaagcgcatatacaactacgaacacagcactaaacgatattgacattccattctccatcaatgagttgaacgagctatacaaacaagtatcttcgcataactcacattcacaataa

SEQ ID NO: 1243 - DNA, 678 bp, Saccharomyces cerevisiae
atgtccaatttatgtgtacttttcttccagtttttttttttagcacaattttttgctgaggcatcaccgttgacatttgaactgaataaaggtcgaaaggagtgcttatatacgctaactccggaaattgactgtacaatctcatattattttgcagtacagcaaggagagagcaatgactttgatgttaactacgaaatatttgctcctgatgacaaaaacaagccaataatcgagagatctggtgaacgtcaaggtgaatggtcatttataggccaacataagggagaatatgctatctgcttttatggtggtaaagcacacgacaagattgttgatctggacttcaagtacaattgtgaacgccaagatgatattcgaaatgaaagacgcaaggcgagaaaggcgcagagaaacctgagagactctaaaaccgatcccttgcaagacagtgtggaaaattctatagacaccatagaaaggcagctccacgttttggaacgtaatatacagtactataaaagcagaaacaccagaaatcatcacaccgtttgttcaacagagcatagaattgtaatgttttctatttacggcatattattaatcatcggaatgagctgcgctcaaattgccatactggagttcattttcagagaatcgagaaagcataatgtgtaa

SEQ ID NO: 1244 - DNA, 678 bp, Saccharomyces cerevisiae
atgtctgacaccgaagctccagttgaagttcaagaagatttcgaagttgttgaagaattcaccccagtcgtcttggctactccaattccagaagaagtccaacaagctcaaaccgagattaagttgttcaacaaatggtcttttgaagaagttgaagttaaggatgcttctttggttgactacgttcaagttagacaaccaatctttgttgctcacaccgctggtcgttacgccaacaagagattcagaaaggctcaatgtccaatcattgaaagattgaccaactccttgatgatgaacggtagaaacaacggtaagaaattaaaggctgttagaatcatcaagcacactttggacatcatcaatgtcttgactgaccaaaacccaatccaagttgttgttgacgctatcaccaacactggtccaagagaagacaccaccagagtcggtggtggtggtgctgctagacgtcaagctgtcgatgtttctccattgagaagagttaaccaagctattgctttgttgaccattggtgccagagaagctgctttcagaaacatcaagaccattgctgaaactttggccgaagaattgatcaatgctgctaagggttcctctacttcttacgctatcaagaagaaggatgaattggaacgtgttgccaagtctaaccgttaa

SEQ ID NO: 1245 - DNA, 678 bp, Saccharomyces cerevisiae
atgtctgacggaacactgtttactgatttgaaggagagaaagttgattaggaccattgtgccaagaggtttagtgcgttccttgaagctggacgttaagcttgctgatccaagtgacgctcagcaactttacgaaagggagtttcccttgcgtaagtacccaacttttgttggaccgcatgacgagtggacgcttacagaggcaatggctattgactactacttgatccatctgtcgagcgacaaggaagctgtgcgccagttgttgggtcccgaaggtgacttcaaaactcgtgcagatattttaagatgggaatcgctttccaacagtgatttcttgaatgaggtttgtgaggtgtttttccctctaattggcgtaaagccatataatgccactgaattcaaagccgcaagagagaatgtcgacaccattgtttcgctttacgagaaaaggttaaagaaacagcaataccttgtctgtgatgaccacgaaactcttgctgatttaatctcagcggctgctttttcgctagggtttataagttttttcgatgaaacatggaggtctaagcatccagaggttacgcgctggtttaatcgagtaattaagtcccgcttttttgaaggtgaatttgagagtttcaaaatgtgtgagactgagatgcaacccattaaataa

SEQ ID NO: 1246 - DNA, 681 bp, Saccharomyces cerevisiae
atgaaggtaaaccattcaatttcaagattccgccccgcttcatggttcgaaaagacaaagataatcccaccccaggtatacatctttaggaacctagagtatggacaagtactatattctcaatttcccaacttttcgcaaacacaggtggataagctgtttgtgagaccaaactggagcaacagaaagccatcattgagaagggacatctggaaatgtatgtgtgtagtgaacttgcaaaactataagcagagtgtccatctataccagaacctctgccggttgagatacctccgtgatgtggcacagcgtaaggagagtgacaagctaagaaaaaaggactctaacgggcacgtctggtatagcggacagtatagacctacatattgtcaagaggcagtggcagacttgcgggagtccttgttgaaggtgtttgagaatgccacaccagcagaaaagcagacagtacccgccaaaaaaccgtccatatactgggaggacccatggaggatgggtgacaaggacaaacattggaattacgatgtgttcaatgctctggggctggaacacaagcttattcagcgtgtggggaacattgcgagggaagaaagcgttattctgaaggaactagctaagctcgaatcacatcctacagagcagacggaagtgtcttcccagtag

SEQ ID NO: 1247 - DNA, 681 bp, Saccharomyces cerevisiae
atgcctattatgttggaagactaccaaaagaactttctagagttggccatcgaatgccaggctctaagatttggttcattcaagttgaaatcaggtagagaatcgccatatttctttaatttgggattgttcaatactggtaaattgctttccaatttggctactgcgtatgcaattgccatcatacaatctgatttgaaatttgatgtgattttcggtcctgcctacaaaggtatcccacttgctgctattgtttgtgtgaaattggcggagattggtggctctaaatttcaaaacattcagtacgcttttaacagaaaggaagccaaagatcatggtgaaggtggtatcattgtcggctctgccctagagaacaagagaatattaatcatcgacgacgtcatgactgctggtactgccattaacgaggcctttgagatcatcagtaacgccaagggtcaggtagttggctccataattgctcttgatagacaggaagttgtgagtactgacgataaagaaggactcagcgccactcaaactgttagcaaaaaatacggtatcccagtcttgagcattgtctccttaattcacataattacctatttggaaggcagaataacagcagaagagaaaagcaagatcgaacaataccttcaaacctacggtgcctccgcttaa

SEQ ID NO: 1248 - DNA, 681 bp, Saccharomyces cerevisiae
atggccgacatcaataaatatattccgatggttgacgctattttgagcgtatccaaccccgatgaaataagcccaaaaagggtgaggaaagccctgcaaattctctattcagttaatttggattcacaaagaaagttaattaatgaattgattcttgagaggttcggcgatatacaagaaaacccaagagtcttaattccgaagaacgacctcattagtcgggatcaagaactatctttgaggttacagaaggaagaagaaagacccttgaggtctacgaggaaaaggaaaggtaaaagtgaaagtaaatctaaaaggaagaagaaaaagaatgatagtcctgattccaacagcatttccgtccgcaaagttctgttgtcagctcctttacaaaagtttctaggatctgaagaactgccacgaacgcaagtagtgaagatgatatggcagtatatcaaagagcatgatcttcaaaacccaaaagatcgtagagaaattctatgcgatgagaagatggaaccaatttttggcaaaaaaatgacgatgttttcaatgaataaactcttaactaagcacttgtttaatcccgatgaaattgtgaaacatgaagaggaacaaaagcaaacacccgaaaaagaaatcaaattggaaaacgaatctcttcccaatttaagcggttga

SEQ ID NO: 1249 - DNA, 681 bp, Saccharomyces cerevisiae
atggcgacgattgaagatattaaggaaacggcgttaatccctttccaaaagcacaggcaactttccatgcatgaagcagaagttataactttagagattataggcttattatgtgattcagaatgcaaggatgagaaaacattgaaatatttgggccgatttctcacaccggatatgtatcaagacctagtagatgagaggaatctaaacaaaagatgcggatatcctctttgcggtaaatcgccagaaagaatacgtgatccattttcaatgaatgatactactaagaaatttttattagaaaacaatccgtatgcatatttgtcgcactattgcagtaagttccattttagatgttcccaattttatcaagtgcaactatctgatgaagctttatttgcaagaacaggggttcacctatttgaagatcctgaacaggacaaacacgatatagatttcaaagtgactttgtttgaagagttgctaagagaaaaggcatccgaagaagacattaaatcattgatatccggtctcaaaaagttaggattaaatcctgacagtgggactacagaaaaagatgatactgagctggaagatgatttatcgaagtggttggcacaaatcaaaattgttgagaatgataatcccagcattttgggtgatttcacaagggaagattga

SEQ ID NO: 1250 - DNA, 681 bp, Saccharomyces cerevisiae
atggctccgacaataagcaaaaggataaaaactctctccgtgagcagaccaataatatatggcaatacggctaaaaagatgggtagcgttaaaccaccaaatgctcctgccgaacatactcatttatggacaatttttgtcaggggcccacaaaatgaagatatatcgtactttatcaagaaagtcgtttttaaacttcatgacacctacccaaaccctgtgagatccatagaagcgcctccgtttgaactgactgaaacagggtggggtgaatttgatataaatattaaggtttattttgtagaagaggccaatgaaaaagtgttgaatttttaccatagattacgacttcatccttatgctaatcctgtaccgaattccgacaatggaaatgagcagaatacaacagaccataatagtaaagatgcagaagttagttctgtgtattttgatgaaattgtattcaatgagccaaatgaagagtttttcaaaattttaatgagccgaccaggaaatttgttaccttcaaacaaaactgatgattgtgtatactccaagcaattagaacaggaagaaattgacagaatagagatcggcatagaaaaggttgacaaggaaattgacgaattgaagcagaaactggaaaacttggtaaaacaagaagccattaacggaagttag

SEQ ID NO: 1251 - DNA, 682 bp, Saccharomyces cerevisiae
atgtatgatatattacgcacacgatttaccgtttgcttggaggagtagtgtttcgtgatgaaatagactgatatagacagaattccacagacttttacgatataaagggaaaaacatgaagttgaacaccatatctcaaatgaataggatcactgtaattcgatagggtacaattatgtgaaatgtctgctttatgggaactttcattcatatacctgaaggtggcaaactagtcttacgaaactgttcagtgcagagatagaattttgtggagatgcatatagggaaacaaagtggaatttatgcttgtataatcaccaattcgaaacactaaacctcgacctatttagaatttccttcaagatttactaacatattttgatattttttcttttttgaatacagggctaaaagaactaagaaggttggtatcactggtaagtacggtgtccgttatggttcctctttgagaagacaagtcaagaagttggaaatccaacaacacgctagatacgattgttctttctgtggtaagaagaccgtcaagagaggtgctgctggtatttggacttgttcctgttgtaagaagaccgtcgctggtggtgcttacactgtctccactgctgctgccgccaccgttagatctaccatcagaagattgagagaaatggttgaagcttga

SEQ ID NO: 1252 - DNA, 684 bp, Saccharomyces cerevisiae
atgaatggacttagagttgcagcaaaaattcagccagcacgccaaactatcatattcttgcatggattaggtgatacaggttcgggatggggatttttagctcagtatttacaacagagagaccctgccgctttccagcatactaattttgtttttcctaatgctccagagcttcatgtgacagcaaacggcggtgcattgatgcctgcttggtttgacatcttggaatgggatcctagtttttccaaagttgacagtgacggttttatgaattctttgaattccatagaaaagacggttaagcaagaaattgataaaggaattaaaccggagcagattattatcggaggtttctctcagggtgccgcattagctctcgcaacatcagttactttaccatggaaaatcggtggtatagtagctctgtcgggattttgttccatcccaggaattctgaaacaacataagaatggcattaatgtaaagacaccaatttttcatgggcatggtgacatggatccagtagttcctattggactaggtataaaggcaaaacagttctatcaagatagctgtgagatacaaaattatgaatttaaagtatacaaaggtatggcccattctacagttccagatgaattagaagacttggcttcatttatcaagaagagcttatcatcatag

SEQ ID NO: 1253 - DNA, 684 bp, Saccharomyces cerevisiae
atgcaattcaaaaacgtcgccctagctgcctccgttgctgctctatccgccactgcttctgctgaaggttacactccaggtgaaccatggtccaccttaaccccaaccggctccatctcttgtggtgctgccgaatacactaccacctttggtattgctgttcaagctattacctcttcaaaagctaagagagacgttatctctcaaattggtgacggtcaagtccaagccacttctgctgctactgctcaagccaccgatagtcaagcccaagctactactaccgctaccccaaccagctccgaaaagatctcttcctctgcatctaaaacatctactaatgccacatcatcttcttgtgccactccatctttgaaagatagctcatgtaagaattctggtaccttagaattgaccttgaaggacggtgttttgactgatgccaagggtagaattggttctattgttgctaacagacaattccaatttgacggtccaccaccacaagccggcgccatctacgctgccggttggtccattactgaagatggttacttggctttgggtgacagtgacgttttctaccaatgtctatccggcaatttctacaacttgtatgatcaaaacgtcgccgaacaatgtagtgccattcatttggaagctgtttctttggtcgactgttaa

SEQ ID NO: 1254 - DNA, 684 bp, Saccharomyces cerevisiae
atgggagacaattactcgacttacttgcttgatattgaagggacagtgtgcccgatctcgttcgtgaaggagactttattcccttatttcacgaataaagtgccgcaattggttcaacaggatacaagggactccccggtttccaacattctgtcgcagtttcacatcgacaataaggagcagttgcaggcgcatattttggagttggtggccaaggatgtgaaggatccaatcttgaaacagttgcaaggctacgtctgggctcacggatacgaatctgggcagattaaggcgcccgtttatgcagatgctattgactttatcaagaggaagaagcgtgtgtttatctactctagtggatctgtaaaggcacagaaattgctgttcgggtatgttcaggatcccaacgcgcctgcgcatgattcgttggatttgaattcttatatagatggttatttcgacatcaacacttctggaaagaaaaccgaaacacagtcttacgccaacatcttgcgggatatcggtgcgaaggctagcgaggtactgttcttgagcgataatccattggaattggacgcagcggccggcgttggaatagctactgggttagcttcccgacctggtaatgcacctgtccccgatgggcaaaagtaccaggtatacaagaattttgaaactctttaa

SEQ ID NO: 1255 - DNA, 684 bp, Saccharomyces cerevisiae
atgtctcctatgaaagttgcggttgtcggtgccagtggtaaagttggacgtttattgataaaccaattgaaggccaacgatagtttctcaacaccattagcgattgttagaacacaggatcaagtcaattatttcaagaatgaagtaggtgttgatgctagtttgacagatatagaaaacgcgtccgttagtgagatcacagacgctattaaggcttatgatgccgtggtctttagcgccggtgcgggtggtaaaggaatggaaagaattttcacggttgatctggatggctgtatcaaagttgttgaagcatgcgaaaaggctggtatcaaaaggttcgttgttgtttcagcgctcaaggcggaggatagagatttttggtataacattaagggtttgcgtgaatactatattgcaaagagatctgctgatcgtgaggttagaaactctaatttggattacactattttacagcctggatcgttggaactaaataaaggtaccggtcttttgcaaccccttgacaaattagaagagaaggcttctgttaactactccattaacagggaggatgtagcttcttttattgtggaaagcttgctacatccaaatgcaacagtgaaaaaaaccatttcgttggtaaatggcaacgagccaatggaaaaattcattcaaagtttgtag

SEQ ID NO: 1256 - DNA, 684 bp, Saccharomyces cerevisiae
atgtctgcatctactacaagtttagaggaatatcaaaaaactttccttgaactgggattagaatgcaaagcactaagatttgggtcattcaagctgaattcaggcaggcagtcgccatattttttcaatcttagtttgttcaattctggaaagctgttggcaaaccttgccaccgcgtatgcaactgctatcattcaatcggagcttaaattcgatgttattttcggacctgcttacaaagggatccctttggctgctattgtatgcgttaaactagcagaaatcgggggcactaaatttcaaggtattcaatatgcttttaatagaaagaaagttaaagaccacggcgaaggtggtattattgttggagcatcgcttgaagacaagagggtgttgattatcgacgatgtcatgactgcaggaactgcaatcaatgaagcatttgagataatcagtattgctcaaggtagggtagtgggttgtattgttgctttagataggcaagaagtgattcatgaatctgatccggaaagaacaagtgctacccaatctgtttcaaagagatacaacgttcctgtgctaagtattgtatcactgactcaagtggtacaatttatgggaaatagactatcaccagagcaaaaatcagcgattgaaaactaccgtaaggcctatggtatatga

SEQ ID NO: 1257 - DNA, 687 bp, Saccharomyces cerevisiae
atgactaaacaagctgaggagacccaaaagccaatcatatttgctcctgagacgtatcaatatgataaatttactttgaatgaaaaacaacttactgacgacccaatcgatcttttcaccaaatggttcaacgaagccaaggaagacccaagggaaacgttgccagaagcaattactttttcatccgcggaactacctagtgggagggtgtcgtccaggattcttctttttaaggagctcgaccatagaggttttactatttattctaactggggaacctctagaaaggctcatgatattgctaccaacccgaatgcggcaatcgtattcttttggaaggatctgcaaaggcaggtgagagttgaaggtatcacagagcatgttaacagagaaacttctgaaagatactttaagacgagacctcgtggatccaagatcggtgcatgggcttcccgccaatcggatgttatcaagaacagagaagaactagacgagttgacccaaaaaaacaccgaacgtttcaaggatgctgaagacatcccatgtccagattattggggtggcttgagaatcgttccactggaaattgagttctggcaaggtagaccctcgagattgcatgatagattcgtttacagaagaaaaacagaaaacgatccatggaaagtcgttagactagccccatga

SEQ ID NO: 1258 - DNA, 687 bp, Saccharomyces cerevisiae
atgactgtttctacttccaagaccccaaaaaagaatattaagtataccttaacacatactttacaaaaatggaaagaaactttaaagaaaattacccacgaaacgttgagtagtatcgatgactctagtggaagcgatgaaaaaatagaggctctgtttactgtgtctcagcctgccgtcgtagcctccaagggtatagacagagatagtggtgcttctatgtcgcaggtaggaggaggtgtcaatagtacattggagatgaagctcacagatgagagtgaggaatctagctctgctaataacacgaccacaaccgcctcgcatactctatcgaattcgaagaagtctacgcagaactttgaaaactataacgtagtggaggaacgcataaaattagcacagaaaagtaaggcgccgttttgtaacgctgagaaaatctggaaacgaagaagacaactctggacacaacccactgagcaaagtgaaagcgccaataatgacggagttactcgaagggagattttccaagctatacctcaggaatattatgctcgagtttacaagaaactggtggtagatgataagccattgagagagcctctaaatctggaagatgctttacaagtcataaatgcaggctggacggaaacgagaaagtgggctaatgctgccaagggcatgccatga

SEQ ID NO: 1259 - DNA, 687 bp, Saccharomyces cerevisiae
atgagagctttttcagcagccaccgttagggccacaactaggaagtcgttcatcccaatggcaccaagaactccttttgtgactccatcatttacaaagaatgtaggctcaatgagaagaatgagattttattctgatgaagccaaaagtgaagaatccaaagaaaacaatgaagatttgactgaagagcaatcagaaatcaagaaattagagagccagttaagcgcgaagactaaagaagcttctgaactcaaggacagattattaagatctgtggcagatttcagaaatttacaacaagtcacaaagaaggatattcagaaagctaaggactttgctttacagaagtttgcaaaggatttattggaatctgtagataactttggtcatgctttgaatgcttttaaagaggaagacttacaaaagtccaaggaaattagtgatttgtatacaggggttagaatgacaagagatgtttttgaaaacaccctaagaaagcacggtattgaaaaattagacccattgggagaaccatttgatccaaataaacacgaagcaacgttcgagttgccacaacctgataaggaaccgggtactgttttccatgtacaacaattaggtttcaccttgaatgacagagttatcagaccagcaaaagtcggaattgttaagggcgaagagaactaa

SEQ ID NO: 1260 - DNA, 687 bp, Saccharomyces cerevisiae
atgctgttagaattgatttcttatgcaggaaccgtttcagggtttctttttttaacactttcaattgcatcgggtttatactacattagtgaacttgttgaagaacacacagaacccacaagacggtttctcacaagggctatttatggtataatattaatattaattctgctactgttactagacggtttcccgttcaaacttacacttttttccattgcatgttacatagtatattaccaaaacttaaaaagtttcccatttatttcgttaaccagcccaactttcctattaagctgcgtatgtgtggtcttgaatcactacttctggttcaaatattttaatgatacggaagttcccccacagttcaaatttgatccaaattatataccacgcagacgtgctagtttcgctgaagtagcctcattttttggtatatgcgtttggttcataccatttgccttatttgtttctctgtcagctggtgattatgtgctaccaacgactagtgagcaacatatggctaagaaaaatgatgacatcacaacgaacaaccagccaaaatttcgtaaaagggctgttgggttagctcgtgtagtcatcaactcggtaaggaagtacatctactctctagcccgtgtattcggttatgagatagaacctgactttgatagattggctgtttag

SEQ ID NO: 1261 - DNA, 687 bp, Saccharomyces cerevisiae
atggctgaattaaacgattatagtacgatgatcgatattcttctctctgatatggatttggaaacggtcacaactaaaaaggttaggatggctttgaaagaagtatatgcaatcgacgttgaatcacagggaaaagcaattaacaaattgattaggaaacatctagatcttgtaaaagaaaggccgcgcttcgaaagatctcttgaggatctgctaaaggaaaatgctactttggcgattgagctcaccaaggaaattaccgtaagcaaacgatcatctggagaggaaaagaacgatagcgaaaccaaaggtactcatgttgagaagaaaaaagggactgttagtaagtcacctatttcaacacgaaaagttacactatctaaatcattagcgagtttgctaggagagcatgaattgacgaggaccgaagtagtacgacgactctgggcatatattaaagcgcataatctgcagaatcctaacaacaagaaagaaatactgtgcgacgaaaaattagaattaatacttggcaagagtaccaatatgtttgagatgcacaaaattttggcaagtcatatgacagagcctaaaaaaataagcgactgtcctcctcttatccaagaagtccgtagaaaggaaaagcccatcgtttcagattccgagcaatcagatacaaagggcatttga

SEQ ID NO: 1262 - DNA, 687 bp, Saccharomyces cerevisiae
atgtctaattatcctttgcatcaagcctgcatggaaaatgagtttttcaaggtacaagagctgctacactccaaaccttccttgttgctacagaaggaccaggatggcagaatccctttacactggtcagtttctttccaagcacatgaaattaccagttttttgctttctaaaatggaaaatgttaacttagatgattatccagatgattctggatggacacctttccatattgcttgttcagtggggaatttggaggtggtaaagtctctttacgacagacctctaaagcctgatctaaataagataaccaatcaaggagttacatgcttgcacttggcagttggtaagaaatggtttgaagtatcccaatttttaattgaaaatggtgcgtccgtaagaattaaagataaatttaatcaaattccattgcatagagctgcgtcggtgggttctttgaaattaattgaactattatgcggtttgggcaaaagcgctgtaaattggcaggataagcagggttggaccccactatttcatgctttggctgaagggcacggtgacgcagctgtattgttggtggaaaagtatggtgcagaatatgatcttgtagataataaaggcgctaaggcagaagatgttgcccttaatgaacaggttaaaaagtttttcctaaataatgtataa

SEQ ID NO: 1263 - DNA, 690 bp, Saccharomyces cerevisiae
atgaacaggattttcggatatgggaacaaaaagagccatgatcagctcttacaagagtcgaatcagtccatgaatcaggcccaacaatcactatcgaacagaatatcccagttagatactcaaatcgcccagttaaacttccagctgcaaaatattcaaaagaatttgcaaagatcaaacaacaagcaaccctcgttaagaaaacaggctttgaagattttaaataaacgtaaacagttagaaaatatgaaggattctttagattctcaatcctggtccatgacgcaagcccagttaacaaatgataacttacagaacacaatgatcactataaacgcactaaagcaaacaaacaatgccatgaaggctcaatacggcaagataaatatcgacaaactacaggacatgcaggatgagatgctggatttaatagaacaaggggatgagctgcaagaagtcttggcaatgaataataacagtggcgagctcgacgacattagtgatgcagagctggatgcagagctggatgctctggcacaagaggatttcactttgccaaccagcgaaaactcattaggtaacgatatgcccagttacttactaggtgcgaatgcgccaccggcttttattgatgaagagccaaacttagatactgaagacaaaaataaagctttagaaagcgctcagtga

SEQ ID NO: 1264 - DNA, 690 bp, Saccharomyces cerevisiae
atggatggaaatcataggtttactccagattccaaagaatttaatactgttgtaaaaagtaaagagtcttccactggcagaaatccgtatcagactccgcccttagagcacaacggtactcatcatcagacaaattacagcagaaagaaaacaaatctagcaattatcatatcgaatttcttgtccgagatcagtcggcctctttcaaatggcaaaatcaataattctacccacaacattttaaaatttctaaatgaagtgcttaagagatcgaagtgcagtaaagaaaacgctgtgttagccactttctactttcaaaagattcaccaatccagaggtgtccgggatgagtcctcattgcctgaattctcgcactgttcccgcagaatttttctctgctgtcttattctatcgcacaaatttttgaacgacaacacttactcgatgaaaaattggcaaattataagtgggctccatgcaaaggatctatctctaatggaaagatggtgtctgggtaagctgaattatgagctggccattccatatgacgagtttttgctatgggaaacgaacactttaatgaaagcgaaattgcgcgtcggaactcccgccaacgctccggtgaagagacccagagaatcagacaatgattatgatgcaaattcttggaaacagattaaatcttgttaa

SEQ ID NO: 1265 - DNA, 690 bp, Saccharomyces cerevisiae
atggctccaaacgtacgttaattttcgttcctatgtcacaattagagaacatgaaagaaaataaaatctttaaaaagtttgtctattcctacagttcattgaacagtcccgctttcacagcgaactagtggattccatctcgaagttacatttttatgtattcagctattctgtattttaaaaattcaccccttatagctttaacagaggcaatgcgctttctctagctatatgaagtgattgttaatagcagtaggccagacattttttcctcgtccaaacgacaaggatgatttcatctcagttgggattactaacataaaactgtaacagacttccagaaagcaaaaagttatcaaaaccttaaccgttgacgtttcctctccaactgaaaacggagtcttcgatccggcttcatattccaagtacttaatcgatcatattaaagtagatggtgccgtaggaaacttagggaacgccattgaggttactgaagatggttctatagtcactgtagtatccagtgccaaattttctggtaaatacttgaaatatctaacaaagaagtatttgaagaagaatcagctaagagactggatcagattcgtctctataaggcaaaaccaatacaaattggttttctatcaagtcacccctgaagatgctgacgaagaagaggatgacgaataa

SEQ ID NO: 1266 - DNA, 690 bp, Saccharomyces cerevisiae
atgggaggtatacttaaaaacccgctagccttatcgccggagcagctggcgcaacaggatccagaaacgcttgaagagtttagaagacaagtttacgaaaatacgcagaaaaatgccaaattgacatcacataaaaggaatataccgggactagataatacaaaagaggagggggagataattggaacatcgagtaccttccttccaaaggacacactgtcactgaaacatgagcaagacatgttggccaagatgacaccagaagagcgagttcaatggaaccaaagaaatttagcagaaaatgaaataacaaaaaagcagttccaagatattcacatagacgagcccaagaccccctaccaaggtgctgtggaccctcacggggaatactacagagtagatgatgatgaagatgaggataatagtgataaaaaaccatgccaggtggcaaacgatgacatcgacgatttgtccctgggcgaaccggaatttgaaatcaaagagaacaaacaaccggattttgagaccaacgacgagaatgatgaagactcaccggaggctagacataagaaatttgaagaaatgagaaagaagcattacgacgtaagggcaattttcaacaaaaagtcccgtgaagcgctaaaggacgaagacgaagacgaagatgatagtacgacaaaagaaccatga

SEQ ID NO: 1267 - DNA, 690 bp, Saccharomyces cerevisiae
atgtcaagtaaacaacaatgggttagttctgctattcaaagtgattcgagtggaagatcactcagtaacgtcaacaggcttgcaggagaccaacaatctattaacgatcgtgcgttatcgttattgcagagaacaagagcgacaaagaacctgtttccaagaagagaggaaagaagacgttatgaaagctcaaaaagtgacctagatatcgaaacagactacgaagaccaagcaggtaatctagaaatcgagacagaaaatgaagaagaagctgaaatggaaactgaagtacctgcaccagtgcgaactcattcatatgccttagacagatatgttagacagaaaaggagggaaaaacaaagaaagcagagcttaaagcgcgtcgaaaagaaatatactcctagtgaattagctctgtacgaaattcgaaaataccaacgttccacggatttattaatctccaaaattccatttgcaaggctagtgaaagaagttacagacgagtttacaactaaagatcaggatttacgttggcagtcaatggcgattatggcgttacaggaagcaagcgaagcgtatctggtaggattattggaacatacaaacctcttggcgctgcatgcaaaaagaattactataatgaagaaagacatgcaactagcaagaagaatcaggggacagtttatttag

SEQ ID NO: 1268 - DNA, 690 bp, Saccharomyces cerevisiae
atgttgaggacaaaagtgtttgcaactactgttgctcgaatatctgggattcgcaggtatattcccatcagaactataaacacggtgacgaaaaagaatattagtaagatagaaaaactgtgtgaagtccttgaagttaatcctgacggatataaaggaaaggaacgcataccgactaaagaactaactaaactgctatataccacaagcaggaatatgttggtacgagtaccaatgactggagacttgagcacaggaaatacatttgaaacaagaaacgaaactttacaaaaattgggtgaacagctcattcacttggaaattaataagatgcttacaataacatttacgaatttcaatcagtttaatataatgaacaaaaacttcaattacattcataacttagatcgagctcgagtagtgaacatggactcgataagctggcttatcaagaattcgttgaaaattaaccaattagctcatttgcgaatacctgccaatttgccgaaggaaatgggattaacttccagctctaatgattttcagaacttgaacgattggaaagtgatcttatcctttattggttacctgaaattactcgaaattaaaaacgataacaaaaaattcattgaatcaattataaaaactatatgcatacctctaattaattaccatttgcgtaaatcatag

SEQ ID NO: 1269 - DNA, 691 bp, Saccharomyces cerevisiae
atggccggtttaaaagacgttgtcactcgtgaatacaccatcaacttgcacaaaagagtatgtcgaaattagcgttgtctttacgtgggaaattattgaaagccaacaagcgatattgtggtgaaataccaagcgaaatctatacgggtgaaatttcattttccaatgattgaccccaggttttaattcggaatattagaggttattatatggaatgcgtgatgcaaggactggaaggttcttcttcggtactgcatttctctgtgttctgcgatcgatatccgtacctcacgtttacactataatggcgcttgggccgatgtttttggcgtgatgctttagttccaccttcttataacaactttttttttactaacagaccaatcttgaattgatattaatatagctacatggtgtcagtttcaaaaagagagctccaagagctgtgaaggaaatcaagaaattcgccaaattacacatgggtactgaagatgtccgtctagccccagaattgaaccaagctatctggaaaagaggtgttaagggtgttgaatacagattgagattgagaatctccagaaagagaaacgaagaagaagatgccaagaacccattgttttcctacgtcgaaccagttttggttgcctctgctaagggtctacaaaccgttgtcgttgaagaagatgcttaa

SEQ ID NO: 1270 - DNA, 693 bp, Saccharomyces cerevisiae
atgaaattgtttcaaaacagttacgatttcaactatccatgggaccaggtaaccgccgctaactggaaaaaatacccaaatgaaatatctacacatgtcatcgcagtggacgttttaagaagagaattgaaggatcaaggtaaggtcttagttactgaacggttgattactgtaaaacaaggtgttcccaaatggatcatgatgatgctaggagggaccaatatgagtcatgtcagagaagtttctgtggtagacttaaataaaaagagcttgaccatgagaagctgtaatttaacgatgtgcaatctattaaaagtctacgaaactgtaacatatagcccgcatcccgatgactcggctaataaaacacttttccagcaggaagcccaaattacagcatatggatccattagaaagctgtgtaataagatggaagattggtcagttcaaaggttttgcgagaacgctaaaaagggtaaaatgggattcgatgctgttttgcaagtatttagtgaaaattgggaaaaacatgttgatgacttgagcaatcaacttgtcagtaaagtcaatgaaaccatggaggatgttaaaatatctgcaggtacgcttcttaaaggaactgaaaggagcggcagaaccatcttacagcaaaatattgacttgtttagagacgcatacaaccacgaaaattag

SEQ ID NO: 1271 - DNA, 693 bp, Saccharomyces cerevisiae
atgactaaggaagtaccatattattgcgataatgacgataacaacatcatcagattattcattattaggcatggacaaacagaacacaatgtaaaaaaaattttgcaaggtcacaaagatacctcgatcaatcctacgggagaagaacaagccactaaattggggcattacttgcgttcaagaggtattcattttgataaggttgtcagtagtgatttaaaaaggtgtaggcaaactacggctttagttttgaaacattcaaaacaagaaaatgtgcctacttcctatacttcggggttaagggagcgttatatgggtgttattgaaggtatgcagattactgaggctgaaaagtatgctgataaacatggtgaaggctcctttagaaattttggggaaaaaagtgacgattttgttgctaggttaactggatgtgtcgaagaagaagttgctgaagcatctaatgaaggtgtcaagaatctagccctagttagtcatggaggtgctatcagaatgattttacaatggttaaagtatgaaaatcatcaagctcataagatcattgttttcaacacctctgtcactatagttgattacgtcaaggactccaagcagtttattgtgagacgtgtcggaaacacccaacatcttggtgatggcgaatttgtcgtcagtgacttaagattacgttag

SEQ ID NO: 1272 - DNA, 693 bp, Saccharomyces cerevisiae
atgattttaaccacagctagattaaattgtagaccagtcaccgttcctcgtctatttaatcgttcttttagtcaatctttcataattttgaagaaaaaaagttctacccctactgagaaagtcgaagaagatgaaattgacgtgaatgaactgctgaaaaaggcagaaactcaattcaaaaaaactttagaaattcaaaaacagaaaatgaatgagataaaacagggaaattttaatcctaaggtattcaatagtttagtgttcaaaaataacagaaagtttacagatattgctaccacatccttgaaaggtaaaaatgcacttttaataacagttttcgaccccaaagatgtgaaaactgtgatcagtggggtgcttgctgcgaacctgaatttaactcctgaaagggtcccaaataacgatttgcaattgaaagtttcgttaccaccaccaactacagaatcccggttaaaagtagctaaagacttaaagagagtatttgaagaatataagcagtcatcgctaaaagactcattaggaactatcagaggcagtattctaaaggaattcaaaagtttcaaaaaggatgatgccgttcgaaaagctgagagggatttggaaaaactgcataaggattacgtgaacaagcttcatgaccaattccagaaagttgaaaaaagcattgtaaaatga

SEQ ID NO: 1273 - DNA, 693 bp, Saccharomyces cerevisiae
atgcctgtcccatctgttactgtcactaccgataatgaatatgaagacatatcgtccttttcttctattgactcttacaaaccggagccctttactgggttcaaagattctgaagctccagaacagcctcttttaaaaaacgataccattgttggaaaggggcaactggaagatgatagtaatgtagatgatcaacaccgtcattcagatgtgcattctcatcacagttctagtactttaaaaaggccaacttcaaattcgatagaaaagatggttacccacaatgctttagagggcaactcagaaacagttgattccttaaaagaagatggtttaaatttgaacaagaaagctcttccggatattaccgccccagtaacaaactcagctcacgatgctgcatttccagaagagtatcgtttagaaactgaaaccgggttggtcaaattgaagacgcttgaaagtttgaagagggaggactctcgcgtatcctcaactaaaaaagagcatattaacgaccatacagatatgcattcgacacgatccaaggttactacaaattctcaaggttcttctctagaaccaaacaagttgaacatggcagtagagaagaataagaagaggatcgaaaaatatcaaaaacataaatcagaaaaggggatcaaggggttttttcatagaattttcgattaa

SEQ ID NO: 1274 - DNA, 693 bp, Saccharomyces cerevisiae
atgcgccaggtactacaaaaagataaaagggatgtacagctttccaaagctttatcatatctgcttcgacatacagcggtgaaagaaaagttgactattgactcaaacggttatacaccgctgaaagaactattgtctcataatagattgaaaactcataaatgtacggtggatgatatccatcgcattgttaaggaaaatgacaaacaacgctttcatataaaaacgttaggagcggacgaagaatggatctgtgctactcagggacattcaatcaaatcgattcagccatcagatgaggttctcgtaccaattactgaagcgtcgcagttaccacaggaactaattcatggaacaaatcttcaatctgtcataaagattattgaatccggagcaatatcaccaatgagtagaaatcatgtccatttatcgccggggatgttgcacgcgaagggagttattagtggaatgcgttcttcaagtaacgtctatattttcatcgactgccattctccattattctttcaaactttgaaaatgttcaggtcgctcaataatgtttacttaagcagcagtattcccgttgaattgatccaaaaagttgtagttaaaggaaacttgaaagatgaggagaagttagatactttaagaagaattttacacgaaagaaacataccgctcgaaaagatataa

SEQ ID NO: 1275 - DNA, 693 bp, Saccharomyces cerevisiae
atgcgtaagccttctattacgataacaacagcaaaagctattataactccagactatactcttattaaatcgcattctaaataccaacttccttcacgttttcaaaagctagatgcagactcacctgagagaagtacagttgttaagctattttaccgccgatttatgaggcttaagcctttcatatcgaatgtgaaaatggttaaagatacttacagggattatgttcgatataagtttatgaaagaaaactacgaactcaaacgatacttggtattcaatcctgatggcttgaggtcgaaaatcaatcttgagcttctcagcaacacgaaatgttgtgaaaggatactccccgtgactgagatgcaaagaaccttggaatttgttctgaagagctgttcatacttgcccgaaacaaaagttcaaaagtgggatattgcaagggacaacacatattgcaggcaaattttaaagaaccttttaacaatgcaatatgaaaagtacagatcgattttgcatagaggaataggccatgatgagcttgacgtcaaattctctcatttgaaaactacttctagtccgctaactaagctaaataaaaccgaaaagaaaaagattccgcttttcaaagtatttagtgatttcgatacaacattgatatatctcaatgagacattaggtacaaggttataa

SEQ ID NO: 1276 - DNA, 693 bp, Saccharomyces cerevisiae
atggaagataaattagacagatactacacaaatgtgctttcaaatgctgaaaaggataaacacacaactgtcgatagcgatgacaaaagtagtggcgaggaaaatttagatgaactacttaatgaattggatagagaattagacgaggatcatgaatttttgagtgcttatcggtcggagaggctacaacaaatatcagatcatttaaaacaggtcaagaagaatgttgaggatgacggatacggtagattgcagtgcattgataacgaggcagatgctatccaaatatgtacaaagactactatggtggtcatacattttgaattagaaacattcggtaagtgccagtatatgaatgaaaaactggaaaacttggcaaagaggtatctaaccacgagatttattaaagtaaacgtccaaacatgtccatttttggttaataaactgaatattaaagtacttccgtttgtagttggatacaagaatggcctagaaaaagttcgctacgtaggatttagtaaactgggaaatgaccctaatgggtttgatattaggaggctagagcaatctttagcccattcaggtgttatagaagacacattcgaaataagaaagcattcatctgtgaatacggaacgcttcgcttctacaaatcatgatagaagtgaaagtgatagtgatttagatatataa

SEQ ID NO: 1277 - DNA, 693 bp, Saccharomyces cerevisiae
atgggtgtttgcactatttttaggtggctctttgctgcttacttgctctcttcatataagtcgcttcctggggcatattttgttaggttttattattatgttattcaaaacttgttcttgcctatgtttacagggtttgaaaccgagaatattaagaaacttgagaaaaatgaatatggctgtttctcgtacaccagcctagatacctatgcctctccattcgaatgtgacttctactttcataagagcaatagcacctattttgcggaattggacatttcaagaggtaatctcatgtgcaagatttttcaaaaattgatgctgaattccaagcattatccatatattccagttgcgaacgttttcactaatttcttgaaggaaatcaagccttttcaaaagtactcggtttcatcaaggattatctgttgggatgagaaatggatttacgtcatgagtagattcacaattaaaaagggcaccgtcttatgctcattatcattgaccaaatacgtccttaaggacggtagaaagaccatcaaaccaaaggatgctcttgaatactgtggtttatataatgagaaggtcgccaaaatttctgaggacaatctaaagcttttaaccgagcgttgtggtttccacgagacagtaccattggaaaacttgagccaagagtactgttcagaaatctaa

SEQ ID NO: 1278 - DNA, 696 bp, Saccharomyces cerevisiae
atgaatgggttggtattaggcgctacaggtttatgcggaggcgggtttctgaggcacgcacaggaggcaccccagttctctaaggtatacgcgatcttgagaagggaattgccctttccggccactgataaagttgtggccatagtagaaagggataattcaaagtggtcacaattgatcaccaatgaaatgaatccgcaggtgctattcaccgcactggcaacgacaagggcagctgcaggcggtttggacaagcaatacaagatcgatcatgatttaaacttacaattggcccaggctgccaaggaaaaaggatgtgaaacgatcgttctcgtttcttccgctggtgctcatccggactccaggttcggctacatgaagatgaagggcgagattgaacgcgatgttatcgctcttgattttaagcacattataattttgcgcccaggccctctccttggtgaacggacaaattctaaacaaagcggatttggcggcaatctgactgctgctttgggcactcgcgtgtaccgttctagattccagaggttgctaggctatccagtttatggcgatgaggtaggaaaagttggtgttcatttggcgttgaatacttctgggaaagacaaggttcagtttgtctccagcaaggacattcttgacatctcagcttctctggagaagattgctacctaa

SEQ ID NO: 1279 - DNA, 696 bp, Saccharomyces cerevisiae
atgacatccgttagaaaaagaaagatgaacagatcttctgttgggaaagcaaccaggagaaacaaagacaaacaaagaaagattaacatccagtctaatccgattattgcagcaaattgggactattcactgacaatggcacaaaactataagaaattagggctaagggctaaattacaaacaccagcaggaggcaaagaggccgatttaagtaaagtagttaaaagaattccattaacgaagcctgtgttggatgaagatgaagatgaagatgaaggtgaggacgagcaaaatgattataatgcggctaccgtggagctcgatgaaaatgagataccagaaggtggggcaaggatacagcgtgataagaatggtgatgttgtaagagttgtttacggtaagaaaaagaactttgatgctgatgaggatgttaacgaaataaaagctagggatactaccgaggagaccgaagtggttaagaaattagaagaacttgcgtctagaccagttatcagaaaggaacgtagccaaagtgaaagggaagaagaatggttggaaaaattatataagaaacacggtgatgattataaaaaaatgtttttcgataagaagctgaacatctaccagcaatctgagggtgacttgaaaagaaggttattaaggtggaaaaaaagaaacggtattgcatcaaaataa

SEQ ID NO: 1280 - DNA, 696 bp, Saccharomyces cerevisiae
atgaccggagcagcaactgcagcagaaaactctgccacacagttagaattctatagaaaagctttgaatttcaacgttattgggagatacgatccaaaaataaagcaactactttttcacacaccacatgcgtcactgtataaatgggacttcaagaaggacgaatggaataaactagaatatcaaggtgttttggccatatatttgagagacgtctcgcaaaatacaaatcttctacccgtctccccacaagaagtagatatttttgattcacaaaatggtagtaataacattcaagtaaacaatggttctgacaatagcaacaggaatagcagtggaaatgggaactcttataaaagtaatgattcgctaacatataattgcggcaaaactttaagtggaaaggacatatacaattatggattgatcatattaaaccgaattaatcctgacaatttttctatgggcattgttcccaatagtgtcgtaaataaaagaaaagtatttaatgcagaagaggatacacttaacccactagagtgcatgggggtagaggtgaaagatgaattggtcattattaagaacttgaagcatgaggtctatggtatatggattcatacagttagtgatagacaaaatatctacgaactaataaaatatcttctggaaaatgagccaaaagattcttttgcttga

SEQ ID NO: 1281 - DNA, 696 bp, Saccharomyces cerevisiae
atgacgagatactattgtgaatactgtcattcgtatttgacccatgacacgttgagcgttcgtaaatcgcacttggtcggtaagaatcaccttcgtataacagctgactattataggaacaaagcaagagacattattaataaacataatcataaaagacgccacattggaaaaagaggcaggaaagaaagagaaaacagtagtcaaaatgagacgctaaaagttacatgcctttcaaataaggagaaaagacacatcatgcatgtgaagaaaatgaaccaaaaagaactggcacaaacctcaatagataccttgaaattgttatacgatggctcaccaggatattccaaagtatttgtggatgctaacaggtttgatataggagatttggttaaagccagcaaattaccccaaagagccaatgaaaaatctgcacaccattccttcaagcaaacttcaagatccagagatgagacgtgcgagagcaatccatttcctaggttgaataacccaaagaagctagaacccccaaagatattatcacaatggagtaacaccattccaaaaacttctatattttacagtgtagatatactgcaaaccacgatcaaggagtccaagaagcggatgcattccgacggcatacggaaaccgtcgagtgccaacggatataaaaggaggcggtatggaaattaa

SEQ ID NO: 1282 - DNA, 696 bp, Saccharomyces cerevisiae
atgataccttccaataagagaaatgctagaattttaagcattacaacgctattattgttgttagtgtttttcgtagcgcaaaatgcgaacttcttgacggtagagataaaagaggaaacttctaaagcatttagtactaatatggacaatatggctggaggatcttccagggaatatgctgctatgccgacttctaccacgaataaggggagctctgaagtagacgaagaaattaatgaaataaaacagaaggtgggactccaacagcccatagcatcggttgatgatagtttgtcggccattaaaaacgataaagggtcgcgaataaccaaagcttttaatgttcaaaaagaatactccctcatactagacttgtctccgattataatatttagtaaaagcacctgttcatatagcaagggcatgaaggaactgcttgaaaatgagtatcagtttatcccaaactactatattatagaacttgacaaacatggacatggggaagagctgcaagaatatatcaagttggtgaccggtagaggaactgttccaaaccttttggttaatggagtatcaagaggaggtaatgaagaaatcaagaaactgcacactcaagggaaacttttagaatcattacaagtctggagtgatggtaaattctcggttgagcaacgtgaaaaaccttccaataattga

SEQ ID NO: 1283 - DNA, 696 bp, Saccharomyces cerevisiae
atgtcagcttgcccttgcaacatcgttatactcccagtcgagattttgaagaattcatctaaagatactaagtatagcttgtatacaacaattaatcgaggatatgatgtcccaagactcaaatatggcatcatagttagccctcgagtgcacagccttgagactttattcagtgatctgggctttgacaagaatatagagaaatcctcgctttacttattattaaatgatcctaccttagcataccctaatttccatgaacattttgaacagcttaaaggtgaaacaaacaaagatttatctctaccgacatattatattccgaaggtccagtttttgacagaggcattcgattcagaacataccctagcaaccatcggctacaaaccaaataataaggagagttatgagatcacaggttttacatccatgggtaatggttatggtataaaactattcaattacagtgtaattcatatgatgcggtctcataagtgtaaaagagtggttgcagatattatcatggagcatgacctattgggttactatgaaaagaagcttggctttgtagaggtgcaaaggttcaaagttctcaaagaacagcaccaagtaaaggtatttgacgataaagttgactttaccaaagactttcatgtgatcaaaatgattaaagagttgggaaatcatagattgtag

SEQ ID NO: 1284 - DNA, 696 bp, Saccharomyces cerevisiae
atgtcatttctatgtgggtcagcttcaacgtcaaataaaccgatcgaaagaaagatcgttattttgggcgacggtgcctgtggtaaaacttcgttgctgaatgttttcaccagaggttattttcccgaagtttatgagcctactgtttttgaaaactatatccatgatattttcgttgacagtaaacatatcacgctatcgttgtgggatactgcgggccaagaggaatttgacaggttacgatccttgtcttattcagatacgcaatgtataatgttatgtttcagtattgattcacgcgattctttagaaaatgtccaaaataaatgggtgggtgaaatcactgatcattgtgaaggcgtcaagttagtcttagttgcactaaagtgtgacttaagaaacaatgaaaatgaatctaacgcaatcacaccgaacaatatccaacaggataacagcgtttctaacgacaacggaaataacataaatagcacctcaaacggcaaaaacctgataagttatgaagaaggtctagctatggctaaaaagatcggtgcgctacgttatttggaatgtagcgctaagctgaataaaggtgtcaacgaagctttcacagaagccgcaagagttgctttaaccgcgggcccagtagcaaccgaagtgaaaagtgacagtggatccagctgtaccattatgtaa

SEQ ID NO: 1285 - DNA, 696 bp, Saccharomyces cerevisiae
atgtctgagtttttgaatgaaaatcccgacattttagaggagaaccaacttcccactagaaaagaagatagtaccaaggaccttttgttaggcgggttcagcaacgaagctacgctggaaaggagaagccttttgctgaaaatagaccattctttaaagtctcaggtattgcaagatatagaggtcttagacaagcttctttccattcgaattccaccagaactgacttccgatgaggatagtttgccagcagaaagcgaggatgaatccgtagcgggtggaggaaaggaggaggaagagcctgatctcattgatgctcaagaaatatatgatttgatagctcatatttccgaccctgagcacccgttaagtctgggacaactctctgttgtaaatttggaagatattgatgttcatgattcaggaaaccagaacgaaatggctgaagtcgtgatcaaaataacaccaacaattacccattgttctctggcaacgttgattggtctggggatacgggtcaggttagaaaggtctcttcccccaagatttagaattactattttgttgaagaaaggtactcatgatagtgagaaccaggtaaataaacaactaaatgataaggaacgtgtagcagctgcatgtgagaatgaacaactgttgggtgtagtctctaagatgttagtgacttgtaagtaa

SEQ ID NO: 1286 - DNA, 696 bp, Saccharomyces cerevisiae
atgttttacccatataactatagtaacctcaatgtttctactatgcccgcactgccgggaatctccgcatttgatggaatgcaagatgaagaaaacgttgaaataagcccggaaagaaaatatcagacgctactaccagttctaactaattctcatgtggtagagaatgaactaaaacacaaattaaataagactgcttttgatttccgataccaaaccaaatcagaaaatggctctgaaaagtgggagccaaaatacttaataacgcctaatttacaaacaagaagcgtctcttttgacaattcatcggtacaatataattcagattcatccgaaaaaagctcgctatcacaactaacttgtaattcatcaataatacaacagcctgagaacggaatagtttctaatgatgcatataataagatggcaaatagtagatactctctgaaaacgcggaagcaaagaacagatccaagaaatacgttatcagatgaggaagaccttgaacaaaggcgcaaatacatttgcaaaatttgcgcaagaggattcactacatcgggtcatttagcaaggcataatagaattcatacgggcgaaaaaaatcattgttgtccgtataagggatgcacgcagcgattcagtcgacatgataattgcttgcaacactatagaacacatttgaaaaagggacaataa

SEQ ID NO: 1287 - DNA, 696 bp, Saccharomyces cerevisiae
atgtttttgagaaacgtaagagttatttccctcaattcaaggagactatttagaactatgagcaccgtcaagggtaaaccagaagatgctaaaataattgaagcccgtcacgttaaagaaacatctgactgcaagtggatcggtttacaaaaaatcatctacaaagatcccaacgggaaggaaagggaatgggatagcgcagtccgcaccactagaagttccggtggtgtagacggcattggtatcttaaccattctaaaatacaaagatggaaaacctgatgaaattttgctacaaaagcagtttcgccctcccgttgagggcgtatgcattgagatgccagccggtttgatagatgcgggtgaagatattgacactgctgccttaagagaattaaaagaagagactggttacagtggtaaaataatttctaaaagcccaacagtttttaacgatcctggtttcacaaacaccaacctctgtctggttactgtcgaagttgatatgagtttacctgaaaaccaaaaaccagttactcaattggaagataatgaatttatcgaatgctttagcgttgagttgcacaagtttcctgatgaaatggttaagttggatcaacaaggctacaagttggatgcacgtgttcaaaacgtagctcaaggtatcctcatggccaagcaataccacatcaaatag

SEQ ID NO: 1288 - DNA, 699 bp, Saccharomyces cerevisiae
atgactaatgacaacagtggtatctgggtcctaggctacggatctctgatttacaagcctccgtctcattacacgcatagaataccggcaataattcacggttttgctcgtcggttctggcaaagttccactgatcataggggtacacctgcaaacccaggaagagtggccacactaatcccgtatgaggatattataaggcaaactgccttcttgaagaatgtgaatttgtatagtgaaagtgcacctatccaggatcccgacgacttagtcaccataggggtagtgtattatataccaccagaacatgctcaagaggttagagagtatttgaacgtaagagaacaaaacgggtacactctacatgaggttgaggtgcatctagaaactaatcgggagcacgaggcagaattgggtgaagcattagaacagttgcctcggcacaacaaatcgggtaaacgggtactacttacttcggtgtacattggtacaatagataatgaggccttcgtcggaccagagaccgtggatgaaactgcgaaagtaattgccgtgtcgcatggacctagtggatctaactatgaataccttgcaaaactggagcaagcgctagcgcaaatgcccatcatgaaagagcgagggcgtattaccgatcattatctgactgctctattggagactgtaaataaatacaggtga

SEQ ID NO: 1289 - DNA, 699 bp, Saccharomyces cerevisiae
atggacagaaaagctgtcgaagaaaaaagaattgttatttctatcggtggagggcatgctactggtgttggagcaattgcactggatttacaaaatactttcaaaagcctatataactctatcaatataagggtaataaacctagataatatgatagaagggaacatcaagagctacaataataacgactatgattttgataatatccttaatttggtatatgaaaagcacgctgtaacttctcaaaatgacatgattcaacatgattacgaggacccgatagatttgataatagtatgtggctgttatgcgctatacgataaacgcatcaacgaaatatctcaattaaaagtattcttggatagtgatgcagataaaagattaattagtctaatcaagaagaagaacgtagggagcaatgaacaactagcccagttgatcactgagtatatggaccatctgcgcccggagatgcaacaatatatagagcccactagaacttttgcagatttgatcattccttctacaaatgaaaatctagggcgcgcagtcctcgtggacggtatagttaaagcaatcgaagataccaaaagccaaatagaaggcaacaatacgaacaacaaaatacgcccacgtttatgggatttcgaagctgaaacaatggacttggagaaagatagatattacgatctgtcatga

SEQ ID NO: 1290 - DNA, 699 bp, Saccharomyces cerevisiae
atggacgtgcctgcagattcccatatcaaatacgaagatgccatcgactattggacggatgtggacgccactgtggatggtgttctaggtggatacggagaaggtacagtagtacccacaatggatgtcctgggatccaataacttcctgcgtaaactgaagtcgaggatgctgcctcaggagaacaacgtgaagtacgctgtagacattggtgcggggattggacgtgtaagcaagaccatgcttcacaagcacgccgctaagatagaccttgtagaaccggtaaagccttttatcgagcaaatgcacgttgaattggctgagctgaaagacaaaggccaaattggacaaatatatgaagtagggatgcaggactggacccccgatgccggcaagtactggctgatctggtgccaatggtgcgtgggacacctgccagatgcagaactcgtcgcattcctgaaaagatgtattgttggtttgcaacctaatgggacaatcgtggtcaaagaaaataacacacctacagataccgatgatttcgacgaaacggattcttcggtcacaaggtcagatgctaagttcaggcaaatcttcgaagaagctggcctaaagctcatcgccagtgaaagacaacgtggcttaccaagagaattgtacccagtgaggatgtacgcactcaagcccatgccaaactag

SEQ ID NO: 1291 - DNA, 699 bp, Saccharomyces cerevisiae
atggcagattatgatagtgcgaaatattggtccaagcagggagctcgtcgtgggttacagaaaacccgttactactgccaaatatgccaaaggcaatgtaaagatgcaaacggatttcaatcacataacaaatcgccatctcatttaaggaagattagtcaagtgacagctgaggacgctaggcgctacaatatccagtttgaaaagggatttctacagttattgaagcagcggcacggagaaaaatggattgatgctaacaaagtatacaacgagtatgttcaagatcgcgatcatgtacatatgaatgccaccatgcatcgttctttgacgcagtttgtccggtacctaggccgcgcgggcaaggtagacgtggatatggatattgatgatacatctgagaacgttgaaggtcctttgcttatcaggatccatccctcatctttatcatcaccttctgaagatggaatgctgcgaagtcaacaagaggagcaagaagtcatagccgccgagcttttgaaaagacaactcaatcgtgctaagcgacaaactgaaaaggtatatcaaccagagatgaaatcggaaattagcggggatagcactctgaaacgtgttcaagtcaccttccacgggaatggtcgggtaaataaaaagaaaaagaaggttcctccacggaaagatggtatcaagttccgttga

SEQ ID NO: 1292 - DNA, 699 bp, Saccharomyces cerevisiae
atgtccttcgagaacaaactgccaactccattagaaaacaacgatgctaagggccatatggtctgtaccctgaacaagactacggatgccagaagagcagcagagactttgtctattgcttttagtaactcgccagcgtttcattttatctgcaagaaaatcttaaatattcctctagctgagaaggtgcctacaaggacaataaccaccgatatcatatcgccattcctggattcaccttatggtgagatctccgaagttaatactttcgatgctgttgcagtgtggagtcttccacctcacgttccgaaggcaaggagtaatgatgcaaagttcaacaaggactttattgacgatttaaatgctcgcgtaaagcaagtcattccaaatggcatcaattactactatcttttctgtattggtaagaacttaaatgagaaaggaatcagaggttctgtaaggactatttttgaagagtacaaaaggagagcagacgaagaaaattgcgccattgtccttgaagctattgccgagcatgctaaatctgtgtacgaatattttggatttagaaattacatgacgttcaaatacggtgagtgtgaggtcgactctaacggcaattgcgatccgaatggtgaagggttcacagcctatttaatgatatatcataaggacggtaataaagtcttaaaagagtag

SEQ ID NO: 1293 - DNA, 699 bp, Saccharomyces cerevisiae
atgtctggaaatagtcaactgccacccgacgtaatcgggtttatatgttctaagtatgatatcattttggccagcacctctccacggaggtatgaaattttacacgatataatgggaatcaccgatttaaaaacaatggtttctacttttgaagagaatcttgataaaatgaattattctaccgatccgattggatatgtgtgcgatactagctggcataaagcgcagaatataatcgagattttgacagattacgaagatgaaaacccaaatgaaattgataaacctaagcttatcatatgtgcagacacaattattatagataagagtgggagaatctacgagaagcctaaaacaaaagaggtccaaaagaagtttttaatgaagttttgctatgaagatgatgaaccagttaacgttgtcaccgctgtgactttaattaaatggtacggcagagaaaactttgaattggtaccattccgagatgaaaccaaggtatactttgataacaaaatacctttgagaatattggaagaatatgtagaaagcggagatgggctggaggttggcggtggatttaaaatacaagggcaaggtgctattctaattgaaaaaattgaaggtgattactataacgtagttggtttaccgctcaataaaacgttcaaaggactctatgctgaggctaattccatataa

SEQ ID NO: 1294 - DNA, 699 bp, Saccharomyces cerevisiae
atgttcccctatttaacaagaatgaatttatccataaagatgggagggctaactttaaaagaaagttcccccaatgcttttttaaataacaccactattgctaggagattcaagcatgaatatgccccacgtttcaaaatcgtacagaaaaagcaaaaaggtagagtgccagttcgtacaggtggttcaataaagggatccactttgcaatttggtaagtacggattacgactgaaaagcgaaggtattaggatatccgcgcaacagctgaaggaagcagataacgcaattatgagatatgtcaggcctttaaacaatggtcatttgtggaggcgtttgtgtacaaacgttgctgtatgtatcaagggtaacgaaacaagaatgggtaaaggtaaaggtgggtttgaccactggatggtgagggtacccacagggaagatccttttcgaaataaatggtgatgatttgcatgaaaaagtcgcacgggaagccttcagaaaagcaggcaccaagttacctggggtatatgaatttgtatccttggattctctggttagagttggattacatagtttcaaaaatcctaaagacgacccagtgaagaatttttacgatgaaaatgcaaagaagccatcaaagaagtatttgaatattttaaagtctcaagaaccacagtacaaactcttcagaggacgttga

SEQ ID NO: 1295 - DNA, 701 bp, Saccharomyces cerevisiae
atggtacgtagatgcaactatatctttccgtttctcattggcggtttttagcgatcgaaaatactaacataatctttttggggggtgagaatgtatatgtgtactggatatgtatattcttggctttattcaaatagttgaaattacgccaattacaaaagaaaaagcaaaaagaaaatgaaaacagcagttctattcagcctaatttatcggcagcaagaattcgtttgaaaagggaccttgattcgctggacctcccaccaacagtgactttgaatgtaataacatcaccagatagtgcggatagatcacaatcgccgaaattggaggtaattgttaggcctgatgaaggatattataattatggatctattaatttcaatttggattttaacgaagtttatccgattgaaccaccaaaagttgtatgtttgaagaagatctttcatccaaatatcgatttaaaggggaacgtttgcctaaatattcttcgagaagactggtcgccagctctagatttgcagagtattataaccgggcttcttttcttgttcttggagcctaatcccaatgacccgttaaacaaggatgcagcaaagttactgtgtgagggtgagaaagaatttgctgaagctgtgagattgaccatgtctggaggttcaattgaacatgtcaaatatgataacatagtttctccttga

SEQ ID NO: 1296 - DNA, 702 bp, Saccharomyces cerevisiae
atgaaacagtttggactggcagcctttgacgagttgaaggatggaaagtacaatgacgtaaacaaaaccatacttgaaaagcaatctgtcgaactaagggaccaattaatggtattccaagaacgactggtagaatttgccaagaaacacaatagcgagcttcaagcttcacctgaattccgctcaaaattcatgcatatgtgctcatctattgggattgatcccctatctttatttgatcgagataagcacttatttacagtgaatgatttttattatgaagtatgtcttaaagttatagaaatttgtcggcaaactaaagatatgaatggaggcgtcatttcttttcaagagttggagaaggtgcattttcgtaagctgaatgttggactcgatgatttggaaaaatctatcgacatgctaaagagcctagagtgttttgagatatttcaaattcgcggcaaaaagtttttacgaagtgttccaaatgagttgacatcagatcaaacaaagattttggaaatatgctcaattctgggctactcaagtatctctttattaaaggcaaacttgggatgggaggctgttaggagtaaatctgctcttgatgaaatggtcgctaacggtttattgtggattgattatcaaggtggtgcagaggcgttgtattgggatccctcttggattacgaggcaactgtga

SEQ ID NO: 1297 - DNA, 702 bp, Saccharomyces cerevisiae
atgaatggcagaggtttcctgatttacaatggaggtgaaaagatgaaacaaaaaatgataatatatgacacacccgcagggccttatccggcccgagtccgcattgccttggctgagaagaacatgctatcaagtgtgcaatttgtgaggatcaacctctggaagggagagcacaagaagcctgaatttcttgccaagaactattcaggcacagtgccagtgcttgaacttgatgacgggactttaatcgctgaatgcacagccattactgaatacattgatgcacttgatggtacacccactcttaccggcaaaacaccgctggaaaaaggcgtaatccacatgatgaacaaacgcgcagagttggaactgctcgaccctgttagtgtttattttcaccatgctacacctggattggggcctgaagtcgagctttaccaaaacaaagagtggggacttcgccagcgcgacaaagccctacatggaatgcattattttgataccgttctcagagaacgcccatatgttgctggtgattcattctcaatggctgacatcacagtaatagctggtctaatatttgctgcaattgtaaaactacaagtgccggaagagtgcgaggcgcttcgagcttggtataagagaatgcaacagcgccccagcgtgaagaaactgctagaaatccgttcaaaatcctcgtaa

SEQ ID NO: 1298 - DNA, 702 bp, Saccharomyces cerevisiae
atgacaaaagatttttaccgtcagctagatcccgttgaggagaagattgttccaccagaaaacgctatagtaatttcttcggaggccaaagaggctactgttaatgagaaggaagccaagcaaggtgttctttcgcaaagggttatgaaatatattggagaaaatgagctggtagacggtatttcagtacgtgatcctgactacttgaagaggtttttcaacgaaagaagaaaacaattttccgctaaatgggacaaggtgacaaataaaatagatgatatcgcaggcagatattatgcccgtgaagagagctttacatcaacaattgctagtttacataccgatccaaacgagcgcctaataccggggttgttgtccattttggttgcttccatgacaggttccgttttggcaagaagaagaacatggcttcttcgtgcaaccatgcccattatactggggtcttgttgttttgcgtatgcaatgccaacaaccttcaggaacaccatgggtctcatccataatctagaaatgaacacctttccacactttaccgaaagacaagatcgtgtttggaaagaaacaaagagattaagtaccgcgtctgtgcaatactactatgatgccaaaaaatggttgaacaaagatgtagaaaaaacagggaatgcaatcaaaaattggactggcgttaacgtgaagtga

SEQ ID NO: 1299 - DNA, 702 bp, Saccharomyces cerevisiae
atggcaaatgatgggattcagaggaatgacaacagaaagggttttaaaactgtacagttctcggcttattctaaagaaattgacgtcataatgaaaaaaatatcattcttggaaagaaacattacccaacaactagatactcttcctcattttccaaaaaccttaccaccaaatcacaaagattgtgtaagtagaaagcacagggccaggcgaggttggagtagtcagctgaaaaacttgctaggcatttactccaaagaggaaatttttactctggataatttagctgcaacactgcatgatcaagttttaaagttacaagctacactttttcccaatgccatactgaaacaggttcatctcgacaatgccaacatagaaaacaagagaattctgaaggaaattacatataaatacctttccaacgaaaactgtaaagaggagaacaaattcggaacattcatcgtaaagagaattttttttggtgacttatcactcggggtttccgtgttaatcaaccgtattgctttcgaatcggccacatcatccattatggtagtgagaagttcatttattgaaagtgatttcttttatgaagattatttgattttcgattgcagagcgaaacgacgaaaaaaattgaagaggaaaattttgtttatttccactaccatgaatttcaattaccaaaccaaagtctaa

SEQ ID NO: 1300 - DNA, 702 bp, Saccharomyces cerevisiae
atggctaaattacagaggaagagaagcaaggctcttgggtcatctctagagatgtcccagataatggatgcaggaacaaacaaaattaaaagaagaataagagatttagagaggttattaaaaaagaagaaagatatacttccatccacagtaataatagaaaaggaaagaaatttgcaagctttacggttggaattgcagaataatgaactcaagaataagattaaagccaacgctaaaaaatatcatatggtgagattctttgaaaaaaaaaaagcattgagaaaatataacagattattgaagaaaataaaagaatctggcgcagatgataaagatttacaacaaaagttgagagccactaaaattgaattatgttacgtgataaattttcccaaaactgaaaagtatattgcactatatccgaatgatacaccatctacagacccaaagggcgtagaattgacaaatcttagaagagaacaatttcttaaattagtagctgaaagaatggatgcgaacaccttaaacgtatctttcgaagagatattgaagggaaagaaattggatgaagattccatcggattaacattatcacctgataaagatcatgaggatggatcacaagtatcacctacacaggatagaaaagaattggatcaagttgtgggagaagatgaaaaggatgacttttttgagtaa

SEQ ID NO: 1301 - DNA, 702 bp, Saccharomyces cerevisiae
atgtcagagaaattccctcctttggaagatcaaaacattgatttcacacccaacgacaaaaaagatgacgacaccgattttttaaaaagagaagcagagatacttggagacgagttcaagactgaacaggatgacatattggaaacggaggcttcccccgccaaagatgatgacgaaattagggattttgaagagcaatttccagatatcaactccgcaaatggcgcagtctcgagcgatcaaaatggtagtgctactgtatctagtggtaatgacaatggcgaggcagatgatgatttttccacattcgaaggtgccaatcagagtacagaatccgttaaagaggatcgttctgaagttgtagaccaatggaaacaacgtcgtgctgtagagattcacgaaaaggatttaaaggacgaggagttaaaaaaggaattgcaggatgaagctatcaaacatattgacgatttttacgattcttacaataaaaagaaggaacaacaattggaagatgctgctaaggaagctgaggctttcttaaagaaaagagatgaattttttggtcaagacaatacgacctgggatcgtgcacttcaattaattaaccaagatgatgccgatatcattgggggtagagacaggtctaagcttaaagaaattcttttgagattgaaaggtaacgcgaaggctcccggtgcttaa

SEQ ID NO: 1302 - DNA, 702 bp, Saccharomyces cerevisiae
atgtccaagctttcgaaagattacgtatcagattcagactctgatgatgaagtgatatcaaacgagttcagcataccagatggtttcaagaaatgtaaacatttaaagaatttccctctcaacggtgataacaaaaaaaaagcgaaacagcaacaggtttggctgatcaaattcccatcaaatgtggacatctccaagttaaaatctctgcctgtagattttgaatcctctacaaccatgacaattgataaacacgattataaaatcatggacgatacagatattgagtcctcgttaacacaggataacctcagtaatatgactttattggttccttcggaaagtaaggaaagtcttaaaattgctagcactgccaaggataatgcaccattacagtttgacaaggtattttctgtcagcgaaaccgctaaaatcccagctattgattacagtaaggtaagagttccacgtaaagatgttccaaaagtagaaggcttgaagttggagcattttgctactggttatgatgccgaagatttccatgtggctgaggaagttaaagaaaataagaaagaaccaaagaagcgttcacatcacgacgatgaagaggagtctagtgaaaagaagaaaaagaagaaggagaagagggagaagagggagaagaaggataaaaaggataagaaaaagaaacatagagattga

SEQ ID NO: 1303 - DNA, 702 bp, Saccharomyces cerevisiae
atgtcctccgctattactgctttgacaccaaaccaagtgaacgatgaattgaacaagatgcaagctttcatcagaaaggaagctgaagaaaaagcgaaggaaatccaattgaaggctgaccaagagtacgaaatcgagaagaccaacatcgtaagaaatgaaaccaacaacattgacggcaacttcaagagcaagttgaagaaggccatgctttcgcaacagattactaagtcaacgatagcaaacaaaatgaggttgaaggttctttctgctcgtgaacagtcgctagacgggatattcgaggaaaccaaggaaaagttgtcaggaattgccaacaaccgggacgagtacaagcccattttgcaatcattgatcgtggaggcacttttgaagttgttggaacctaaggcgattgtcaaggctcttgaaagagacgtcgatttaatcgagtcgatgaaggacgacattatgcgtgagtatggggaaaaggcccagcgcgcaccattggaagagattgttatctccaatgattacttgaacaaagaccttgtttccggcggtgttgtggtctccaatgcatcagacaagattgaaattaacaacactttggaggaaagattgaaattgttaagtgaagaggcattgcccgccatcagattggaattgtatggtccttccaagacaagaaagttctttgattga

SEQ ID NO: 1304 - DNA, 702 bp, Saccharomyces cerevisiae
atgttatcccgtgtttcagttttcaaacctgccagcagaggcttttccgtcttatcatctttaaagataacagaacatacatcagcaaaacacaccgaaaaacctgagcatgctcccaagtgtcagaatttatcagatgctcaggctgcatttttggaccgtgttattcgtgtagatcaagctggcgaattaggtgcagactacatctacgctggccagtacttcgtgttggctcataggtaccctcacttgaaacctgtgctaaagcacatatgggaccaggagatacatcatcataatacttttaacaatttgcaattgaaaaggagagtcaggccttccttattaacgcctttgtggaaggcaggagcctttgcaatgggggctggtaccgcattgatttctccagaagcagctatggcttgtactgaagctgtcgagacagtaatcggagggcactacaatggccaattgcgaaacttggccaatcaattcaatttagaaagaacagatggaacaaagggtccaagtgaggaaatcaaatccttaacttctactatccaacagttcagggatgacgagctagagcatctagacaccgctatcaagcatgattcgtatatggcagttccatatacagttatcactgaaggtattaaaacgatttgcagagtagctatatggagtgccgaaagaatttaa

SEQ ID NO: 1305 - DNA, 702 bp, Saccharomyces cerevisiae
atgttcgcgaaaacagcagctgctaatttaaccaagaagggtggtttgtcattgctctccaccacagcaaggagaaccaaagtcaccttgccagacttgaagtgggacttcggtgcattggaaccttatatctccggtcaaatcaacgaattgcattacaccaagcaccatcaaacttatgtgaacggattcaacactgctgttgaccaattccaagaactctcagatcttctggccaaggagccctctcccgcaaacgcaagaaaaatgattgctatccaacaaaacatcaagttccatggcggtggtttcacaaaccactgtctattctgggaaaacctggctccagagtcgcagggcggtggtgaaccacccaccggcgctttggcaaaggcaatcgacgagcagtttggcagtctggacgagctgattaagttgaccaacacaaagctagcaggcgtgcagggctccggatgggccttcattgtgaaaaacctctctaatggaggcaagctggacgttgttcaaacctacaaccaggataccgtcacaggcccactagttcctctagttgccattgacgcctgggaacacgcctactacttgcagtaccaaaacaagaaagccgactacttcaaagccatttggaatgtggtcaactggaaagaagcatccagaagattcgatgctggcaagatctga

SEQ ID NO: 1306 - DNA, 705 bp, Saccharomyces cerevisiae
atgaggtttttgaggggatttgtattttctttggctttcactctatataaagtaactgccacggcagaaataggatctgaaattaatgtggaaaatgaggcaccacctgatggtttatcctgggaggagtggcatatggaccatgagcatcagctaaaagattacactccagagactttcttcgcgttacatgatatcaagaagaaaggatttttagatgaaaacgatattctatctctctacgggttgaaccgtgaagaaattgtgggggctggtgatggtatgggacaacacgatgaatctgagaaaattgacaatgaaatggctaagcgtgttgttagccttattatgaggttattggatgttgatgataataccaaaatcaccaaggaggaatatctacaatttgctaagagaggaaacaagttccctgaccttggcgttggtgtaggtcaccactccgattttgagctagaatatgaaattcatcactggaataagtttcataaggacaaagatccagacgttaaagtcgttcacaaagaagacatagaacatgaattgcttcatcatgaacatgaaattgaacatgaagaagaaattcaaagaggcgcttctagagctactgtaataactgatgacgaactagagtctagaatagagctgaaaaatattcccgagaaattcaaaaatggaattttttaa

SEQ ID NO: 1307 - DNA, 705 bp, Saccharomyces cerevisiae
atgcaaacaccttcagaaaataccgacgtaaagatggatactctcgacgaacccagtgcacatttaatcgaagagaatgtagctcttcccgaagacacattcagttcacatctgagttatgtactttatgaaattgctcattgtaaaccgatcatgtttatgatcatcataatcgtgagtttgatctcattgattgtgctttttcatgataacgacgggtgcactgtgatcttagtgatgtcccttatagtagcctccatggctttaatggtggttgcagcattcacattcgggaaagcgatcactgaacaggagttcatgataaagcttttagtggaggtgatcgcacgcaagcctgcggggaaggaatggggtactgtcgcatataatatgaaccaatatctattcatgaagagactatggtataccccgtactatttctatagcggcaagaagtgccatgagttcttcaccactcttatcaaggaagtgaattctggttcgcactcggattcctcatcgaatagtgccgaggatacacaatcacctgtctcagcagggaagacttcaaatggtctaaacaacttttatagtattagatcagaccctattttgatggcatatgttttgaaggcaacacaaatagaaaaggaggctcaaagtgaatactggagaaagcaatatcctgacgctgatttaccttga

SEQ ID NO: 1308 - DNA, 705 bp, Saccharomyces cerevisiae
atgcagacccctccagaaagtaccgacgtcaagttagatacacttaacgaacctagtgcacatttaattgagaaaaatgtggctcttcctaaggacatattccgttcgtacttgagttattggatctatgaaatcgctcgctatacaccagtcatgattttgtccctggtaataggggttttggttttattaattatattttttaatgacaacgaagcttgtgttttcaattctgcaatatttgcttttacttctcttgtaggtttgttaataatattaagtgatggtaatccaaagctagtcagtcgtcgaaattttaggaccgagcttttagtggatgtcatcacacgtaaaccggcggtagaagggaaagaatggaggatcatcacatacaacatgaaccaatatttgtttaatcatgggcaatggcatactccgtattacttttacagcgatgaggattgctaccgttattttctacgccttgttgagggagtaacccccaagaagcaaacagccacgtcaattggcaattctccggtcaccgctaagcctgaagatgccatcgagtcagcttctcctagttccagactgaattatcaaaactttttgctcaaggcagcggagatcgaacgacaagctcaggaaaattactggcgaaggcggcatcccaatatcgatgcgcttcttaaaaagacggaatag

SEQ ID NO: 1309 - DNA, 705 bp, Saccharomyces cerevisiae
atgcagacccctctagaaagtaccgacgtcaagttagatacactcaacgaacctagtgcacatttaattgagaaaaatgtggctcttcctaaggacatattccgttcgtacttgagttattggatctatgaaatcgctcgctatacaccagtcatgattttgtccctggtaataggggttttggttttattaattatattttttaatgacaacgaagcttgtgttttcaattctgcatactacgcttatctttctcttgtagtattgttaataatattaggtgatggtaatccaaagctagtcagtcgtcgaaattttaggaccgagcttttagtggatgtcatcacacgtaaaccggcagtagaagggaaagaatggaggatcatcacatacaacatgaaccaatatttgtttaatcatgggcaatggcatactccgtattacttttacagcgatgaggattgctaccgttattttctacgccttgttgagggagtaacccccaagaagcaaacagccacgtcaattggcaattctccggtcaccgctaagcctgaagatgccatcgagtcagcttctcctagttccagactgaattatcgaaactttttgctcaaggcagcggagatcgaacgacaagctcaggaaaattactggcgaaggcggcatcccaatatcgatgcgcttcttaaaaagacggaatag

SEQ ID NO: 1310 - DNA, 705 bp, Saccharomyces cerevisiae
atggtaaatttttatgatgacgtggatgagtcgaaatcacacggtgaattcccattaatacccgttgtgcttcaaaattcatcagagctatcagtcagaactatacctaccgggaatgaaatcattgagtcagtgcacctgaccaaatggttacggaaatatagaaacgcacttgccagtcaactagatcgttatgagaaggggtggcaatccaagatagccaactttaggctccaggtccaacatgttatcaattattcgagaaagaatattttcaatgttgattctgaaaataaacatactgtggtcccggggtcattaatagcgttaggtgccttttttgctggaagcatagctgtgaacaggtctaattggggagctaaaaggttgatatttggtcacaaatctagtatcctcgagaaactatgtacgtcattgccatctaggatattgttaccatgggtattggcagcagctacattcaagtattgggctccacagacatcacagaatttggtcaatgccactgaaaatgatttactgccagctgatttcgtcaagtcatatcacaatacttggaaacgaatttatgaggaaggatatgttgccaagaaatgtgatttaaaacgtcaaatcgatcagacattacaaaaaaatataaggtatgcaagggaacagctttatgaaaagttggagcaagcatga

SEQ ID NO: 1311 - DNA, 705 bp, Saccharomyces cerevisiae
atgtcagatcttcaaaagttacagaggttctcaacctgtgatatttcggacggattgttgaatgtttataacattccaacgggtggttatttccctaatctaacagcaatttctccaccgcaaaatagctccatagtaggcactgcatacacagtactgtttgcacccattgatgatccaagacctgccgtgaactatatagactctgtccctcccaactcaatactcgtcctcgcactggagccccatttgcaaagtcagttccacccatttattaaaattacgcaagcgatgtacggggggctgatgagtaccagagcacaatatttgaaatcgaatgggacagtagtctttggacgcataagagatgtggatgaacaccggactttaaaccatcccgtttttgcttacggtgttggatcttgcgctccaaaggctgtcgttaaagccgtaggcactaacgtacagttgaaaatcttaacgagtgatggcgtaacccaaacaatatgtcctggtgattatattgcaggtgacaataatggaatagtacgcattcctgttcaagagactgacatttcaaaattagttacctatatcgaaaagtcaattgaagtggatttacttgtctctgaagatattaagaatggtattcccgccaaacaagctcaaaatgatcgaagatcagtattaaagaaatacatttaa

SEQ ID NO: 1312 - DNA, 705 bp, Saccharomyces cerevisiae
atgtcgttgccaattatcaaagtccattggttggaccattccagagcgttcagacttttgtggttattagaccatttgaaccttgaatatgaaattgtcccttataaaagagatgctaacttccgtgctccaccagaattaaagaaaattcacccattaggaagatctccattgttagaagttcaagacagagaaactggtaagaagaagatacttgccgagtccggtttcatcttccaatatgtcttgcagcattttgatcattcacacgttttaatgagcgaagatgctgatattgcagaccagattaactattatctgttttatgtagaaggttccttgcaaccacctttaatgattgagttcattctttcaaaggtgaaggattctggtatgcccttccctatttcgtacttggcaagaaaagtggcagacaagatcagtcaggcatactctagtggtgaagttaagaaccagttcgactttgtggagggtgaaatttccaaaaataacggctacctggttgatgggaagttgagcggtgccgatatcttgatgtctttccctttgcagatggcgtttgaaagaaagtttgccgcaccagaggattatcctgccatttccaaatggttaaagaccataacctcagaggagtcgtatgctgcttctaaggaaaaggcgcgtgctttaggtagcaatttctaa

SEQ ID NO: 1313 - DNA, 705 bp, Saccharomyces cerevisiae
atgttcaggaacaattacgacggggacacagtcactttttctcctacaggccgtctgttccaagtggaatacgccttggaagctattaaacaagggagcgtcactgtggggttacgttcgaacactcatgctgttttagtagcgttgaaaagaaatgcagacgaattgtcatcataccagaaaaaaatcatcaaatgtgacgagcacatggggctctcgttagccgggttggctccagatgctagagttttaagtaattatttgagacaacagtgtaattactccagcttagtttttaacagaaagcttgccgtcgagagagcaggtcatttgctttgcgataaagcacagaaaaatacacaatcctatgggggcagaccctacggtgttggtttgttgatcatcgggtatgacaagagcggtgctcatcttttagaattccaaccttccggaaatgtcacagaactatatggtacagctattggcgcaagaagccaaggggcaaagacttatctagagagaactttagacacgtttataaaaattgacgggaacccggatgaactaatcaaagctggcgtcgaggctatcagccagtctctaagggacgaatccttgactgtagacaatctttcaatcgccatcgtgggtaaggatacgccttttacaatttacgatggagaagctgttgctaaatacatctag

SEQ ID NO: 1314 - DNA, 705 bp, Saccharomyces cerevisiae
atgttgcaatttaaactagttttattgggtgactcatccgtgggtaaatcttccattgttcatcgttttgttaaggatacattcgatgaactacgtgaaagtacgattggtgctgcttttttatctcaatcaatcactattcacccaaacgatggtaatgaaacaaaggatgtcgttataaaatttgaaatctgggatactgctggtcaagaaagatacaagtcattggcaccaatgtattatagaaacgctaatgcagcattagttgtttatgacattacgcaggaagattcactacaaaaggcaaggaactgggttgatgagctgaaaaataaggtaggcgacgacgacttggttatttatttactgggaaacaaagtggatttatgtcaagaaacgcctagcactgagacaagcccagattcaaacgaaggtggagatgaagaacaaaaagtaagagcaattagcactgaagaagcgaaacagtacgcacaagaacaagggttgctgttccgagaagttagtgctaagacaggtgaaggggttaaggaaatttttcaagatattggtgaaaaattatacgatttaaagaaagacgaaattctctctaagcaaaatagacaaatcggtggaggcaataacggacaagtagacattaatttgcaaaggccatccacaaatgatccaacatcttgttgcagttga

SEQ ID NO: 1315 - DNA, 705 bp, Saccharomyces cerevisiae
atgttttcacagattgttcttttactcagtgcatttatttatgtcgccagtgctacggccaggagagggaccattaagggtcgcttagacttagcagcaagtaacatcaccggctttgtttcaactagaacaagtttcaaactttatcagatcggcaatttttcgacagaatatccttacacatctacgaccatgtttcaagatgacgaaggcaactttgaattcgctaatctccctttaaacgacggtgttaatgaaacgacatactatgtgatgtacccagcatctatggacttcaatctgaagccaaacagaattcttattgaattcaagaatttagagaatggcaccttacaattgaacgcgttcaagaacttttttggaagagaatatttcccatccaaagatataacgtacccagaaaaattacaatctatgaaggtgcacccttatattacagtggagcttttacataaggccccgattagatcttatttacaggctagaaacgtcagtatcttttctacaggtattgtgggtaatattttgaactcacgttggaaactggcgggcgttattaccttaattgcccttgtcgttttcccaatcatagtagaaaagttggaccccgaaacagctcgagccatcagagaggaggcaaaaagaaaacaaagagaaaagtatgctgccgttgcctcaaagtag

SEQ ID NO: 1316 - DNA, 708 bp, Saccharomyces cerevisiae
atgcaaaccccttcagaaaataccgacgtcaagttggatactctcgacgaacccagtgcacatttaatcgaggaaaatgtggctcttccagaggatacattcaattcgtactggagttatatacttaatgaaatcgctcgttgtaaaccgctaatgattatgttcctaatacctgtgtgtttggttttattgattacgttttttcatgatatcaaaggtatccttgtgtttttagtgatttctcttatcctctctattatcattttattgatcggtataactgccttcgtgtctgagaccttgaataagggtttcataattaagcttttagtagaagtcattacacgtaaaccagcagtaggggggaaggaatggagaataatcgcatataatatgaaccagtatctgtttgaccatgggatatggcatactccgtattactttttttgtgaacataggtgccataaatttttcaaaagccttatcaaacagacaaggtcgaatgcacatttgagttcaccaacgaacggtgcagagaatacgcagtcaaacacaccagcaaaagaggtttcaaatgagatggtaaaaccttatatctttagttctgatccagttttagaagcttaccttattaaagctgcggaaattcacaaagaagctgaatttgagtattggagaaagcaatacccagaggttgatttgccttag

SEQ ID NO: 1317 - DNA, 708 bp, Saccharomyces cerevisiae
atgaaaaatattaaaaaaaatcaagtaataaatttaggacctaattctaaattattaaaagaatataaatcacaattaattgaattaaatattgaacaatttgaagcaggtattggtttaattttaggagatgcttatattcgtagtcgtgatgaaggtaaactatattgtatgcaatttgagtgaaaaaataaggcatacatggatcatgtatgtttattatatgatcaatgagtattatcacctcctcataaaaaagaaagagttaatcatttaggtaatttagtaattacctgaggagctcaaacttttaaacatcaagcttttaataaattagctaacttatttattgtaaataataaaaaacttattcctaataatttagttgaaaattatttaacacctataagtttagcatattgatttatagatgatggaggtaaatgagattataataaaaattctcttaataaaagtattgtattaaatacacaaagttttacttttgaagaagtagaatatttagttaaaggtttaagaaataaatttcaattaaattgttatgttaaaattaataaaaataaaccaattatttatattgattctataagttatttaattttttataatttaattaaaccttatttaattcctcaaatgatatataaattacctaatactatttcatccgaaacttttttaaaataa

SEQ ID NO: 1318 - DNA, 708 bp, Saccharomyces cerevisiae
atgagtagaaatgtagataaggccaactcagttctggtacgatttcaagagcagcaagcagagtcggcaggtggatacaaggattattcacgttaccagaggcccaggaacgtgtctaaggtaaaatccataaaagaggccaacgaatggaagcgacaagtaagtaaagagataaaacaaaaaagcacaagaatatatgatccgtctttaaatgaaatgcagattgcggaacttaacgacgaacttaataatcttttcaaagaatggaagagatggcagtggcacattgaccatacacttatggaaaaaaaaaccaagaggaaaaggttagaagacagtcatgtgctgatgaattcaggaaagctgataaatggtaagagatattttggaagagccctggaattgcctgaagtaaaagaatggctcaagcagtctcaaaggcagaatgatgggggttctataaacaccaaatgcataccgaaggatagaaatgatttttattaccatggcaaagtcacagccgccttaaccgaatttgaggctaactggacatccattttgaaagcacattataatgtgcctgtgaatgaagatgaagaagaaatgtcaaggcagacacaagaaatccatgtaccaactctggcagatatggagcattggttagtgcaaagaagaaaaaagaaactaatggatgaacttaacctttag

SEQ ID NO: 1319 - DNA, 708 bp, Saccharomyces cerevisiae
atgagtcacaagagaaggggcctggtaatatatcaggatcagaagcagcaacaacaacaccccccggggcagtccctaagctctatatcctggtctccaaccaggcgacctcatcaccctttaaaacaacaaagcaccaacagtttctcagaaatactatcgaaatcaagtgtgcaaccgaacgtgcaacatgacggtaatcatatgcccatttcattgctagttctgaaacaagaacatcataagcagcagcagcagcagcagcagcgccagaatatccgatcacaaaactctacgcctcccctgcgacagttggttcaggagtcgcagtggacgagctccgcaagtaatagttctctaaagaaacaggaaaagcagccgcaaacattctacaacactgactctaaacttgtttctcaactgcatagctccgtgaaggacctggatgccataatccagacgcataaaccaaagtttgacacaattattcgcgatttctctcaagcaaccatactgtcctcaaacgagttactcatcaaacttccgaaggaccaaacaataatattgcatagcagagcgccaaaaattaacgcagaatggctacagaacaaggttaatgaccctagtgcctcgttagtgatcgattcaagatcttttctaaccttgtgtaacaatataaaatggtacctgcattggaaatttatatga

SEQ ID NO: 1320 - DNA, 708 bp, Saccharomyces cerevisiae
atgagttcagaattattaatatctaattctaaaccaagaccagaaggattaagaaaattatgcgaaggtgagacagtgatccttccaagggacataacccccagcaaatgcgcttatttcttaaaacagaatatcgtattcatttcatatattttcatccatattattattaccataatcttaaaccgcctggcattatctgcacacggtaatactttgattattatcttagcggctttactaattacaatttcactattccttttactcctcttaccttacttaagctgctcaagatataagttaagatgtttagatgatgattgtaagttcaaactattagcggaagtcattacacataaacctaacatggacttgagcacatgggaccggattgcatatgacatgaaccaatttgtatatgaccgtcgtatatgtgcagatagatcttttttctacgatggcagttattgctatcaggtttttaaaaagttggtggctaccccgtaccttgtgaattccaatatgaatagtatatatgctgatctggagatgagaagtaatggagcaaccaacattaacgattctggtaatagttcattacacatcgaattgggcacttatatttttaaagcattggccgttttcaggaactctgttgacaagtactgggaggataagtatccagagatgggggtcacagtttga

SEQ ID NO: 1321 - DNA, 708 bp, Saccharomyces cerevisiae
atgcattgggcagcagcggtagcgatattctttattgtggtcacaaagtttctacagtatacaaacaaataccacgagaaatggatctctaaatttgcaccaggaaatgaattatccaaaaaatacttagccaaggtcaaagaacgtcacgaattaaaagaattcaacaactctatctccgcgcaggataattatgccaaatggactaagaacaatagaaaattggactcgttagataaagaaataaataacttgaaggacgaaatacaatcagaaaataaagcctttcaggcccatcttcacaaactcaggttattggcattgacggtgccattttttgtgtttaagattatgtacggcaagacaccagtttacaagttgagttcctcgactagcaccttgttccctacgtttgtaagtggtgtttggtctcaaggctggttatatgttctcttgcatcctctaaggactatttctcagaaatggcatataatggagggcaaatttggtgcttccaagtttgatgatatggctttacagagtgtctctttgggaatctgggtttgggcattgatgaatgtcatcaacggcgtggaatttatcgttaagcaattgtttttgactcccaaaatggaagcacctgcatctgtggagactcaagaggagaaagccttggatgctgtcgacgatgccattattttagattag

SEQ ID NO: 1322 - DNA, 708 bp, Saccharomyces cerevisiae
atggataccaagctatctgtaacaggagctaaaaaatctcagggaaaagcttctggtttgggaaacgaaggaactccaatcgggaatgaggagagcacaaataaagctaaaaatggaaataaaaagcggaataaaaatcgaaacagaaataagaagacagagacaaaggaacaaaatgaacctaaacctgtgactggaggggaagaagtgagagtcgagaaatctcaagcgaaaaacagaaggcggaaaaacaataatggagctaataaaaagaataccctacactactcaaaggaaattaatgtagaagagcgaaaacaaatcgcaaaaaggcaagaagaaatcgaacaatgcattcacaccttatccgattttaaactgtttaaaaagggtaagcacgttacctcatatggctatcgaatctcccccatgacagactccggtaagatttctttgaaaattttattcaacatacctttggattatccaaaggccccaataaaactaacgatgaaaagtaatgaagaagtttcctcttacatggacaccgtgatagcgaatttcaactggaaagcccgtcaattggttaaggaggactggaggatattatctcaaataaactatttggttagtgagttagaaatattgaaaatggaaaattataaacaaattgataaactacgtaatagcttttacaaaaccatataa

SEQ ID NO: 1323 - DNA, 708 bp, Saccharomyces cerevisiae
atggctgttcacaccaataggcaaatccttacaagaggcaaaaactatgctacaaagcaatcaaagaaattcggtaccgatgaggtgacgttcgacaaggattctcgtttggattatctgactggctttcacaagagaaagcttcaaagacaaaagaaagcacaagagtttattaaggagcaggaaaggcttagaaaaattgaagaaagacagaagattcggcaggaacgtaaggaggtgatggaagaacagttaaagacgtttaaagagagtttaaacttggaagctgagatagaggatgcgaaaaatgataagacggaggatttgcaggtagaatctgatgaatcctggcacgggtttgattctgataaagatgacggcgataacgacaataatgaaagtagcgtaaagcctattttgaagaaaggagcaatcacggaaatatacgatgactcaactactgttgaattggagacattggaacccaatgataactttgaatatttagcccagctaaataatgtcaaattagaaaaggcagaaaaagtactcaaacaaagcataaatagagccaccaaatacgcgaagtttctgggcgtggatgagaaacaaaagaagaagccaagagtaaaaaagttcagatatttgaccaaaaatgaacgaagaataaaccaaagaaaggcaaacgacaacaagcgtaggagataa

SEQ ID NO: 1324 - DNA, 708 bp, Saccharomyces cerevisiae
atgtcatacggaagagaagacactacgattgagcccgacttcatagaaccagatgcacctttggctgcttccgggggtgttgctgacaacataggcggaactatgcagaattcaggcagcagagggacgctcgacgagactgtgctgcaaacactaaagcgagatgtggtggagattaattccagactgaaacaagtggtatacccgcatttcccctcattctttagcccctctgatgacgggataggggcggctgataacgacatttcagccaattgcgacctgtgggcgccccttgcgtttatcatattgtattctctatttgtatcgcatgcgcggtcgctgttctcgagcctatttgtgtctagttggttcattttgctggtgatggcattgcatctgagactcaccaagccacaccagagggtgtcgctgatttcgtacatctccatttccgggtattgcttattcccacaagtgctgaatgccttagtctcgcagatactacttccattggcctaccatattggaaagcaaaatcgctggattgtgagggtcctgtcgctcgtgaaactggtggtcatggcgctgtgcctgatgtggtctgtggccgccgtttcgtgggttaccaagagcaagaccattatcgagatataccctctggcactctgtctttttggcatggcctggttgtcaactattttataa

SEQ ID NO: 1325 - DNA, 708 bp, Saccharomyces cerevisiae
atgttttttttcccgaagcttagaaaacttataggttcaactgtgatcgatcacgataccaagaactcatcaggaaaggaagagatcatgtcaaatagccgattagcacttgttattatcaaccacgcctttgataaggtactatctttgacgtggcactgcgggatattatccgaaataagatcaggactgatgttaatgtttggcattttccagttgatgtgctctttgggtgtcatcgtattgctgttgcctattatcatactggacgcgatcgatctattcctctacatgtgcaggttgcttgattacggttgcaagttattccactacaatagatcatcattaccggtggcagatggaaaagaaaagaccagtggtcccataagcggaaaggaggaaatagttattgatgaggagataattaatatgctaaatgaatcctcagaatcattgatcaatcatactacagctggtctggaatatgatattagttcaggtagtgttaacaaaagtaggcgtttgaattcaactagtacagttacatttgtgaagcagaataaacttgttaatgaaaggagggaagacgcctactacgaggaagaggatgatgatttcctatcaaatccgaattatgataagatatcattgatcgaaaaatcattcacgagtcgttttgaagtggcttgtgagcagaaagctgcttaa

SEQ ID NO: 1326 - DNA, 711 bp, Saccharomyces cerevisiae
atgacacatcctgtagcagtgaaggcatgtctatttgacatggatggtcttctcatcaacacagaggatatttatactgaaactttaaatgaaactctcgcagaatttggtaagggacctttaacttgggatgtgaagattaaattgcaagggcttccgggaccggaagcaggaaaaagggtgatcgaacactacaaattaccaataactttagatgagtacgacgaaagaaatgttgcattgcaatctcttaaatggggtacttgcgaatttcttcccggtgcattgaatttgttgaaatacttaaagttaaagaacattcctattgcattatgtacgtcttcgaacaagactaaatttcgcggcaaaacaagtcatttagaggaaggttttgatcttttcgataccattgtcactggtgatgatccaagaattgcaaaaggtaggggtaagcctttcccggacatttggcagttgggtttaaaggaattgaatgagaagtttcataccgatattaagcccgatgagtgtatagtgttcgaagatggtattccaggcgtaaaatcagccaaggcatttggtgcacacgttatttgggtcccccatccagaagcacatgctgttttgggggacacagaagctttgttagccggtaaaggtgaactattgtcttctttggaaaaactggaaatgtccaaatatggactgtga

SEQ ID NO: 1327 - DNA, 711 bp, Saccharomyces cerevisiae
atgagcggagaaaatcgtgctgtggtgccgattgaatcaaaccctgaagtttttacaaattttgcacataaattaggtttaaaaaatgaatgggcgtatttcgatatctatagcttaacagagccagagttactagcattcttaccaaggccagtgaaggccattgtgctgctatttccgataaacgaggatagaaaatcgagtaccagtcaacaaattacaagttcttatgatgttatatggtttaagcaatcagtcaaaaatgcgtgcggattgtatgcaattcttcattctttgagcaataaccagtcattgttggagcccggctccgacttggacaattttttaaaatctcaaagtgatacttcaagctcgaagaataggtttgatgatgttactaccgaccaattcgtcttgaatgtaataaaagagaatgtacaaacattttctactggccagtcagaagcaccagaagcaactgcagatactaatctacactatatcacatatgtggaagagaacggagggatatttgaactggatggaaggaatttgagcggacccctctatttgggaaagagtgacccaactgccaccgatttgattgaacaggaattagttagagtgagagtcgcctcatatatggaaaatgcaaatgaagaagatgtattaaactttgctatgctaggattgggccctaattgggaataa

SEQ ID NO: 1328 - DNA, 711 bp, Saccharomyces cerevisiae
atgccaagatcaaaacgttccaagctagtcactttagcacaaaccgataaaaagggcagagaaaataaagaaagaattttcgatgaagtgagggaagccttagatacttatagatacgtctgggtcctacatcttgacgacgtaagaactccagttttacaagaaatcagaacatcttgggcaggctctaagttaattatgggtaagaggaaagttttacaaaaagcattgggagaaaagagggaagaagaatacaaagaaaatctgtatcaattgagtaagctttgtagcggtgtcactggtttattgttcactgatgaggatgtcaacactgtcaaggaatactttaagtcatacgttcgttcagactattcaagaccgaacacgaaagcaccactaacatttacaattcctgagggcattgtctactcacgtggtggtcaaattccagctgaggaagatgttccaatgattcattctttagagccaactatgagaaacaaatttgaaattccaactaaaatcaaagctggtaagatcaccattgacagtccatatttagtttgcactgaaggagaaaaattagatgttcgtcaagctttaatactgaaacaattcggtatcgctgcttctgaattcaaagtcaaggtgtcggcctactatgacaacgatagctccactgttgaaagcactaacatcaacatggaataa

SEQ ID NO: 1329 - DNA, 711 bp, Saccharomyces cerevisiae
atggagcaaatgcattcattggaatcaagtttacctccagagcaacctcctacaaagcaagcgattgagagtcttaatttggaactttctcaagagttcaagctagccgccaatgcggtgacaagactttaccgggtggctaatgagaaaaactctttaaccaaacatcagggctacctcacctgtttggatgatatactatgtgcattggactcaaatgtgactgctgacgagttaagggcttggtgctataaacgaagaaatgatatcctttcaaactcgcaggataaatctttaaatccggtgaaagaaagggaaagaaagcttaataagttcagtgaaaaccaacaccgcgaaaatgaagctcataaggaaccttttgaaaaagacagcgcagtcaagtataatttcagtttcaacgaatcaaatggggacctctcaaatattaatgaaaatatagcacctaaatttagactttctatgccgcctttaagtgtcgaacatcctcctaggaatgctagtcgtataaaatcctggaaagcacgaacaatcaatcacggaagaggggacacgagaaacctaaatgacataacgggacttggacatgagcgtgagcgtgatcgtgaaaatacacattatgaaaaaaaaccgaaattggattctgattcagaagtagacataaggagtttccgccaggatatggacctgtaa

SEQ ID NO: 1330 - DNA, 711 bp, Saccharomyces cerevisiae
atggcaacgatggaaacgaccacacaaaaagataccaatattttgaaatctggtctcaaaaaaactataggtgttctcaatgaggcagtattacagaacgggagagaggtggaggcagtgcaggcaggaaatagtgacacaatggaagatacagaaacaaccacaataggttatatatcaatcaaagattatgcgtacgcagattcgaatcctctccattatggttattttgatggagacaatgaggaggatgaaatggtttcagattcttcaaatggagaagacacatacaataaaagacaaagtataacactaccagacgactacatagttaaccaacgtgctgttgccctctacgatttcgaacccgaaaatgataatgaattgagattggctgagggtgacatcgtatttatcagttacaagcatgggcaaggttggctagtagcagaaaatgagtcaggatcaaaaacagggttggtaccggaggagtttgtctcttatatacagccggaagatggtgagaacgaggtggagaataaggctcgacctttctatttgacacatttgattacacagagcgttagtcctaaaaacaatattgataacactaacgaagatgaatacgacgacaacgatgaatgggaagatattgatgatgttgcggaggtcgaagcagatatgaaaacaaaattagatatatcggattga

SEQ ID NO: 1331 - DNA, 711 bp, Saccharomyces cerevisiae
atggcgaatttaaatatatttgggcaagaagttggtgctgacgtcgaaggttggacaacaagggccttcccagagaaagttgtattgaaaggtaacacttgcagactagaacctctagatagagaaagacatggttcggaactttttagtgcctatagtgaggcaggccaaaaattatggacgtatttacctgcgggaccattcactaacttggaggaatatctagaattcattaaggaactcaatgaaactaaagatactgtgcctttcgcaattattaataaagagactgaacgtgccgttggtacattgtgcttaataagaatcgatgaagccaacggttcactagaagttggatatgttgttttttcaccagaattacagaagacgattattgcaactgaagctcaatttctgttaatgaagtatgtatttgatgatcttcaatacaggagatatgagtggaagtgtgatagtttaaatgggccgtcaaggagggcagcgatgcgcttaggctttaagtatgaaggcacgtttcgacaagtggtggtatataagggtcgcactcgcgacactcaatggttttcaataatcgataaagaatggttacgcattcgtaaaacctttgaagaatggttagacaaaacaaattttgaaaatggcaaacaaaagagaggaatagcagcaataagagaaagcttgtcaaactga

SEQ ID NO: 1332 - DNA, 711 bp, Saccharomyces cerevisiae
atggtctgtgatacactggtatatcatccctccgtgacgagattcgtcaaatttctagatggctcagctggcagagaaaaggttctcagattactgcagtatttagcaagatttttagcagtacagaactcatctctcttggccaggcaattacaagctcaatttaccacagtcagaaaatttctgaggtttctgaagcctttaaaccacttgcaggcagctgctaaattctacgataacaagttggccagcgacaacgtcgttagagtctgcaatgttttgaaaaacatcttctttgctgcatatttgtcgttagatcaagtcaatcttttgagaattttgaaagtgattcctgtaaccgttcttaccggtaagaaaatacctcgctggtccaattggtgttggctgttcggcctcctaagtggtctggctatggatcttcgtaagatccaaacatctcatgcccagattgctgcgtttgtcaaggcaaaatcacaaagccaaggcgatgagcatgaggatcacaagaaggtactagggaaggcataccaagacaggtacaccgcgttaagaagactattctgggatgctgcagattcgttcatcgtcctcaacaacctagggtacttgtctagcaacgaagagtatgttgcgctatccggtgttgtcacatctatccttggtatgcaagacatgtggaaagctacatag

SEQ ID NO: 1333 - DNA, 711 bp, Saccharomyces cerevisiae
atgttaggattatatctatcctcccttttcttcgccttttttatggcacaagtgtttgctaccaaatactcaattacttttacatcagatgagtatgaagaagatgaaacaggacaaaatgaacctggtcctttagttttccatttggataaaaactcattaccaccagctctgctaaatcaaatggagtttaatccatacttagtattagcagatttaccggaggagccgcgagctgttgattctcaagaacataccgatacggtccttgcttccaaatctgttatagattttctgttggaagatcctctaacaatagtggagcacaaaaagttttctcaaattgaaagtattctacatgaaattatggaagacagcatacagaagaaagtcggggcagacgaggtatttgaagagattccgaaaccgaaaatttacgcgtatgaagatattttagtaactaatatgagcatcatcaataatagtgaaatgccgacaagtactgcaacattaacgagcaccatttcttatttatctagtacgacaagtttagctttatccacgggtgttaccagcgttgagattttcccaacaatcaccccgggaaatattacaactattgggggatacgaaaattcatcatcctccttaatgccgtcgatgggaatcttatcttttctatttggtctgtacttgttacttcacccttaa

SEQ ID NO: 1334 - DNA, 712 bp, Saccharomyces cerevisiae
atggctggttgggatatttttggttggtgtatgttatcaccctgttcacgtttttcggatacttagttttattcaatgtggtaaacattgaatgttttcagcttaagatctatttttttttttctagaagaaattgcgtcctttactaactttattttactgtacagtcagagatgtgttggcttcccttggtctgtggaacaaacatggtaaactacttttcttgggtttggataatgccggtaagaccacattgctacatatgttaaagaacgatagattggcaaccttacaaccaacatggcatccaacttctgaagaactggctattggtaacattaagtttacaactttcgatttgggtggtcatattcaagctcgtcgtttatggaaggattatttcccagaagttaatggtatcgtctttttagtcgatgctgctgaccctgaaagatttgatgaagcacgtgtcgaattagatgctttattcaacattgccgaattgaaggacgttccttttgtaattcttggtaacaagatcgatgctccaaacgccgtttctgaagcggagctacgttctgctttaggattattgaataccactggctctcaaagaattgaaggtcaaagaccagttgaagttttcatgtgttccgttgttatgagaaatggttatttagaggcgttccaatggttatctcaatatatttaa

SEQ ID NO: 1335 - DNA, 714 bp, Saccharomyces cerevisiae
atgactccaaaaagagcgctaatatctcttacttcataccacggtcccttctacaaagatggtgcgaaaacaggcgtttttgtagttgagattttgcgatcgttcgatacattcgaaaagcatggtttcgaagtggacttcgtttctgagactggtggatttggctgggatgaacattacttgccaaagagctttattggtggcgaagataagatgaactttgaaacgaaaaattccgccttcaataaggcgttagcgaggatcaagaccgcaaatgaagtcaacgccagcgactataaagtattctttgcatctgctggacatggtgctctatttgactatcccaaagctaaaaatctgcaagatattgcatccaagatatatgccaatgggggtgtgatcgctgccatctgtcatggaccgctccttttcgatggattaatagatatcaaaacaacaagaccattaatcgaaggcaaagctataacaggtttcccactcgagggtgaaatcgccctgggagttgacgacatcttgaggagcagaaaattgacaacggttgaacgcgttgcaaacaagaatggagccaagtacttggcgccaatccatccctgggatgactactctattacagatggaaagctagttacgggtgttaacgcaaattcttcctattcgaccacaattagagctataaacgcattatatagctga

SEQ ID NO: 1336 - DNA, 714 bp, Saccharomyces cerevisiae
atgcaaaccccttcagaaaataccaacgccaagtcggattctctcgacgaacccggtgcatatttaatcgaggaaaatgtggctcttcctaaggacatattccattcgtacttgagttattggatatatgaagcagctcactgtacaccggtcatgcttttgtctctagtaattggggttttaatctcaataattattctttttcatgataacgaaaattgcgttggggtttctgtagggtttctcctcatattctctggcattttagtgatagttctaatactcaggtttggaccacagatcagtgatgaagatttcaaatgtaagctactgatggaaattatcacacggaaacctacggtaaaggggaaagaatggaggacaattacatacaagatgaaccagtatttatttgataacgatttatggaacactccctactacttttaccgtgatgaagattgccaccgttattttctaagtcttattaagggaagaactttcaagaagcaaaaggaatcgtcagccagcaatgttaaagacgcacaatcaaatgacgaaaccgctggcacaccaaacgaagccgctgagtcttctagttttagtgccggaccgaactttataaagctcctcaccaaggcagccgaaatcgaacaacaatttcaaaaggaatattggcgacaagagtatcctggtgtcgatgagtttttttag

SEQ ID NO: 1337 - DNA, 714 bp, Saccharomyces cerevisiae
atgaaaacggcctacttggcgtcattggtgctcatcgtatcgacagcatatgttattaggttgatagcgattctgccttttttccacactcaagcaggtacagaaaaggatacgaaagatggagttaacctactgaaaatacgaaaatcgtcaaagaaaccgctcaagatttttgtattcttaggatcgggaggtcatactggtgaaatgatccgtcttctagaaaattaccaggatcttttactgggtaagtcgattgtgtacttgggttattctgatgaggcttccaggcaaagattcgcccactttataaaaaaatttggtcattgcaaagtaaaatactatgaattcatgaaagctagggaagttaaagcgactctcctacaaagtgtaaagaccatcattggaacgttggtacaatcttttgtgcacgtggttagaatcagatttgctatgtgtggttcccctcatctgtttttattgaatgggcctggaacatgctgtataatatccttttggttgaaaattatggaacttcttttgcccctgttgggttcctcccatatagtttatgtagaatcgctggcaaggattaatactcctagtctgaccggaaaaatattatattgggtagtggatgaattcattgtccagtggcaagaattgagggacaattatttaccaagatccaagtggttcggcatccttgtttaa

SEQ ID NO: 1338 - DNA, 714 bp, Saccharomyces cerevisiae
atgaacagcaaatctcaacaacaagaacaacaaccaattgtattcgtcaccggtacagacactgatgttggtaaaacctttgtatcaacattattggtacacaaatggaaagctgcatactggaaacccgtacaaactggaattgagtcagatcaaggtgactccgagacattgaaaaatttcaaaatagccgcatcaacttggcaaccacctatattcacgcccacttatgcgctgcagaagcctctatctccgctccaggccatggagtacgaacctaatgtcgacatcaggttgttggatttcgtagttcctgaagagtggagcgcagagaatccattggtcgtagaaggagccggcggggtttgcgttcctatcactcgtaaattggaaattacgacggatctaattaaacatctgattgagactagcggccatccagtgtacgtagttgtcgtggcacgcagcgggctagggactctgaatcatacattgctgacttggaatcatctttgcgataatggcttgagaagccacctttttggggtcattctcaatggggaaccgaatgaaggcaacgtgcaggccctgaagaagttcggtgtcaatattatggcacaggttgcacaatgtactacggcacatgatcaggatatggagttgcatgaactgccatcggtggagtcattaatgacccaacaagacgtagaatag

SEQ ID NO: 1339 - DNA, 714 bp, Saccharomyces cerevisiae
atgaatcaaggttacacacagctttccgcaccggaactgaaggagactaaaacatcgaagctaaataaaatgaacaactttcgaagctctccgattgctgagataattaataagataccaccagattgcgggaagatacagaatacaacatttcctgagttcaatccagcgttaagaagacgacaacacgaacagtggcctgcatacgaaaaaccaataagagttactgacagtatgtcaccacagctttcttcaatcaattgtttgccaaatttgtatccccacggtacgctaccattaccaaacccttatttatcctatttaaatcacattgaaaaagttaattgccaagatgtcaagtttagtaactggagtgttttacataattcgaataatggatttgaaattccgacatatttcagtccacggacaacacaaaacatgccttgttccgaaaaagttgaaagctggcttgaaagattaccaatttttgtggggttcgacggttatttatttacaaactgctttgattatgaatatatgttggattgggaagagacagaatttacattcgagaaaacatcatgtatggagacggattattctaaagctttaaccgatactgatattatatatattcaagagaaaaaaattgaagcgttgataagaaaccaatatctgaaggagtatgaattttctcaaaaagatttttga

SEQ ID NO: 1340 - DNA, 714 bp, Saccharomyces cerevisiae
atggcaaactctaaatttggatacgtaaggcaatttgaaacacacgatgttattttgcctcagtgttatattgtggtaagaatagacggcaagaagtttcatgaattttccaagttctacgagtttgccaagccaaacgatgaaaatgctttgaagttaatgaatgcatgtgctaagaaccttgtcctcaagtacaaaaatgatattatattggcgttcggggagagtgacgaatactcatttattttgaagtcaagtacaactttatttaacagaaggaaagacaagcttgcgactttatttggttcttttttcacgtccaattacgtcgcattatgggccaagtttttcccagaaaagccgttgaatatcaagcatttgccatatttcgattcaaggtgtgtagcataccctaatttacaaacgataaaagattatttatcctggagatatgtcgatacacatataaacaatctttataatacgacgttttggcagttaataataaagtgtggcttaactccccaggaatccgagaagaaactatgtggaacatttagtaatgagaaacaggaaatactattttctgaatgtgggataaactacaataatgaacctgaaatgtttaaaaagggttcactagtaacaagaaaaggagaaatacttcatattaacgtcatcgcacagatagatgagttgttcgaaggctattaa

SEQ ID NO: 1341 - DNA, 714 bp, Saccharomyces cerevisiae
atggccccaaaaaaagttttactcgctcttacctcatataacgatgtattctacagtgacggcgccaagaccggtgtttttgttgtagaagccttacatcccttcaacacattccgaaaagaaggttttgaagtcgattttgtatctgaaaccggaaaatttggttgggatgagcattccttagccaaagattttctaaatggtcaagacgaaacggattttaaaaataaagactcagatttcaacaagacattggctaaaattaagacaccaaaagaggtgaatgccgatgattaccaaattttttttgcatctgcaggccacggtaccttatttgactatcctaaggctaaagacttgcaggacattgcttccgaaatttatgctaacggtggtgttgtcgcagctgtttgtcacggtcctgctatttttgatgggttaacagacaaaaaaacaggaagaccattgatcgaaggtaaatctatcaccggttttactgatgttggtgaaaccattttgggtgttgatagtattttgaaagccaagaatttggcaaccgttgaagatgttgctaaaaaatatggcgctaagtatttagctccggttgggccctgggatgattactctattactgacggaagactggtaacaggtgtgaatcctgcttctgcgcactccactgccgtaagatccatcgacgctttaaaaaactga

SEQ ID NO: 1342 - DNA, 714 bp, Saccharomyces cerevisiae
atggctcgccaaaattttttaggcttggtcgtctcccaagggaagatgcaaaagacggttaaagtacgtgtagaaacaaaagtctttaataagaaaatcaacaaggagttatttcatagaagagattatttagtgcatgatgaaggtgaaatatcaagggagggtgatttagtaaggatagaagcgacgaggccgctttcaaagaggaagttttttgccattgcagaaattattagaaacaagggtcaacaatttgcattatacgaatcagaagctcagttaagcgttgcaaaagaagaagcccaaaaggcaaaagaatttttggataaaagatcagtgagggagaataaactaaatgaaaaaacaacccttttacgtgatattaggaccatccaagatgctttatctagcgggtcaacgccgaaagagttattggagattaaacaaaggtacggcattcaagatttttcacaagaaacagtgaggcaacttttacagttagacatctctggattggaggttaatttggagaaacaaagaagtctcattgatcgtattcaaacgcgattatccgaattgttgtcgaatgatctaaaatgtgatcaatttttgaaggatcatggtgttgaggatcctttgaccttgaaaaaaaacatcaaaaaaaatttgttaagaaagcacgtcatgatggatatgcaacaaccaagccagtaa

SEQ ID NO: 1343 - DNA, 714 bp, Saccharomyces cerevisiae
atggttcttcaatacccccagaataaaatattggttttatcagatcacccacacaactttttaaaaacacaatttttgcaagacctgtttcattgctctagcacgggcatcagtatagttaaggaccaaacttgggaaaatagatactataaagtccattttgatctttatattgactcttgcaaagagataccagtatgggtggaagaatttataacgcctgaatgtgaaccgcttagaaatgtcatggcaggaattatcttaataacggacatccggcaaacaaaacctcaagaactgctgcaccaattcatgatagctgcccatcgaaatacttttgttgtgttggccaatgtgaacgaagaagtcgagcaagatgaaattgatgaactgaatgagatatggagcaatgcctttacaaacgtcatcgaattcgtaaactggaaaaggtcaaaaccaactgttaatcataacgactatggagaaaaattggggcttgataggatccaggagattatagatacccacgactggttaaattgtgaagttcaaccggctactaaaataagggaggaaattcctaatgaaatgcccctcgaacaaataattaggaatttgcaaagtgcaaggctaaaatataagtctatcgagaatagtagtgaagctgatgcttttgcaaatgaaatggctgacgaactatccagatatttatga

SEQ ID NO: 1344 - DNA, 714 bp, Saccharomyces cerevisiae
atgtcgttaaaggataggtatctaaatctcgaattaaaattaataaataaactacaggagttgccatatgttcatcaatttatccatgatcgaataagtggtaggataactctctttttgatagtggttggtacgcttgcattttttaacgaactgtatataacgatcgaaatgagtcttctacaaaagaacacatcagaagaactagagcgtggaagaatcgatgaaagtctgaagcttcatcggatgttggtgagtgatgaatatcacggtaaagaatacaaagacgagaaaagcggtattgttattgaagagttcgaagatcgcgataagttttttgcaaaacctgtgtttgtatcagaattggatgtcgaatgtaatgttattgtagatgggaaagaacttctgtccaccccattaaaatttcatgttgaattttctccagaggattatgaaaatgaaaaaagacctgagtttggtactaccttgcgtgtattgaggctgagactttaccactactttaaagattgcgaaatatatcgcgatataattaagaatgagggcggtgaaggggcaagaaagtttacgatttccaacggtgtcaaaatttacaatcataaagatgaactactgccattgaatatcgatgatgttcaattatgtttcctgaagattgatacgggaaacacgataaaatgcgaattcatactatga

SEQ ID NO: 1345 - DNA, 714 bp, Saccharomyces cerevisiae
atgtgcgatagccatcaaaaggaagaagataacgcaaatacgagcgaaagggcgttattttttaattaccatgagttttcgtattcattctacgaagacctcggttccgaagacgctaaacccacagagcacgacgaagaccacaaattgtgtattacacatttcccgaatgtgtatgctgctcggggctctgccgagttccaggtgacccgggtggtacgagtgccccggcggttcgatgagtctcgcagcagccttgaaacgccacaatttagtacacagcttcccggtagcgagccggcggcaatcgtgggcgacgatggcactagctttgtgcggtgcgggcgttacgacattggggatcacgtgtttggctgctcctccgtctcgcctctgtcagaatatcttagtgcggcagagctcgcggaggttgtgcaccgggtaaacggattcttgctgcgtgaagaaggtgaggtgttcgggtggcgtaacttaagtggcctgttgctcgatatgcttacgggcggtctgtggagctgggttttggggccccttctttctagacctgtgtttcaggagtctctcgcgttagagcagtacgtggcgcagctaaactcgccgggaggtctgcttcacgagcgcggtgtgcgcctagtattgccccgacggtccgggtgcctatccctagatttcgtcgtgccccgacccaaatag

SEQ ID NO: 1346 - DNA, 717 bp, Saccharomyces cerevisiae
atgaagttcacccctagcatagttattgatgctccgcaatattatgttgatcattttaatggcaagtataacgtggataaatgtgttattttaagagacctgcagctagaaacggattcagaatccatgccatccagcttaaagcatttgaccaaacctacgcacatcttggatttgacaaacaatgaccttatcatgattccagatctatcaagaagagacgatatacatacattactgttgggccgaaacaatatcgttgaagtagacggtcgcctattgcctatgaatgtacagaaccttacattatcgaataacagcataagaaggtttgaagatcttcaaaggttgcgtagagcgcccaggacgttgaagaatctaactttaatagggaatcaagtatgtcatttagccaattatagagaacatgtacttcgattagtaccgcatttagagactttagactttcaaaacgtaacagctgaggaaagaaagagcgcaatgagctttccaaggcaggcggacggcgatacgttgggcccagtaaatactgcaataagagataatggatccagagataaaacgatggagatcatgaatttggtggtgagtaagatgacagtagagagaagaaatgaattgaaaaagcagttagcagaagctacttctttagaagagattgccaggctggaaaaactactctctggtggtgtttaa

SEQ ID NO: 1347 - DNA, 717 bp, Saccharomyces cerevisiae
atgacagacacatataatagcatatccaattttatagaaaatgaattgaccgcactgctgtcgagtgatgactacctcatggatgacctagcaggcgaattaccaaatgaagtgtgcagattactaaaggctcaagtaattgaaaagagaaaggatgccatgagcaggggaaaacaagacttactgagcaaagagatatacgataacgagtctgaattgagagccagtcaatcgcagcagataatggaacttgttggagacataccaaagtactctcttggaagtgaactaagaaatagagttgagggtgaacctcagagtacatcgatagagagattaattgaagatgtgttgaagctgccgcagatggaagtagcagacgaagaggaagttgaagtggaaaatgatctcaaagttctaagcgagtatagtaatttaaggaaagatttaatactgaaatgtcaggctctccaaataggcgaaagtaaattatcagatattctgagccaaacaaattctataaattctttaacaacttccattaaagaagcttctgaagatgatgatatcagcgagtacttcgccacttacaatgggaaactagtagttgcgttggaagaaatgaagctattattggaagaggccgtgaaaacatttggcaattctccggaaaagagagaaaaaataaaaaaaatcctaagcgagttaaagaagtaa

SEQ ID NO: 1348 - DNA, 717 bp, Saccharomyces cerevisiae
atgacagcaacgatcacaaataagaaatcatgctctggttctgttgaggcaggaaagacacgtttaacaactgaatggaagcctgaaagccaagtaccccaatatgttaaaaatgagctctctaaaccccatccaaactatatcctggcgtttttgaacgtggtacagcaattaaaaattcagagaagaaccggttatcttgacctcggtattaaagaatgtgaaagcatatcagatcacatgtacagattgagcataatcaccatgctgatcaaggattcgcgggttaaccgcgataaatgtgtccggatcgcattggtgcacgatatcgccgaatctttagttggcgatattactccagttgaccctattgggaaggaagaaaagcatcgtcgggaatgggaaaccataaaatatctatgtaatgctctgatcaagccatacaatgagatcgcggcaaaggaaattatggacgattggttggcttatgaaaatgtcacctcattggaagctagatacgtgaaagatatcgataaatatgaaatgcttgtacaatgttttgagtacgagagggaatacaaaggaacgaaaaacttcgatgatttctttggggctgtagctagcataaaaacagacgaagtaaagggctggacaagtgaccttgtcgtgcagcgccaaaaatacttcgccgatttgactcaatcgataactaaataa

SEQ ID NO: 1349 - DNA, 717 bp, Saccharomyces cerevisiae
atgacagtgggtattgctaggaaactctctagggacaaggcgcatagggatgcgctgctaaaaaaccttgcgtgccagttgtttcagcatgaatctatagtgtcaacgcatgccaaatgtaaagaggcttccagggtcgcagagcggatcattacctggacaaagagggcaataacgacaagtaatagtgttgcacaggcggaattaaagtcccaaattcagagccaattgtttttagcaggagacaacagaaagttgatgaagcggttgttcagcgagatcgcaccgcggtacttggaaaggcccggtgggtacacgcgtgtgctgcggttagagcctagggctaacgactcagcgccgcaatccgtcttggaactagtcgactctcccgtgatgtccgaatcgcatacggtgaacaggggcaatttaaagatgtggctgttagtcaagtcagtcatcaacgatgacgccaaccagctacctcataacccactcacattgcagaatcttcacaaagtggccaagtttaaagcagaagcgcagctacatggtgaaattatgctcatcaagcaggtcttactcaaggaaatgtcccttccctatgatgaggcactcgaaaacgaaaggacgcaggcacttttgaaggaggtctactcttcgtcattgccaaagaagacgaagaaaccctcctcctatgtcatggttcccagaccttaa

SEQ ID NO: 1350 - DNA, 717 bp, Saccharomyces cerevisiae
atgacatctaaagttggtgaatatgaggacgttccagaggatgagtcccgcctcacagaagagaacgtatccgtacctgaagaagaagtagaagacgaagacgaggaagaagacgacgatgatgatcatatatatatcaatgaagaaacagaatctggtcgcgaaaaggtcttggtatcacatgccccacaagaacgtatcgttccacctttgaatttctgtcccgttgaaagatacctctatagatctggtcagccttcacctgtgaatttcccctttttactaaacctaaaactgaaaacaattatatggctgtctaacgaagaacctcaagataccctcctagagttttgtgatactcatagaataaacttacaattcgcagccatcaacccggatgccggtgaggacgataatccatgggacggtctcactgaacattctataattaatgtactacaaacgatcgtcactcaagagaattatcccttgctagtgtgctgtggtatgggaagacataggactgggacagtcattggatgtctcagaagaataatgggttggaacttagccagtgtatccgaagaatatagacgctttactggtagcagaggtggtagaattcttgtagagttgcttatagaagctttcgacactaatttagtaaaaatagacaaaaataaagcaccaagttggttactgacagctttggagtag

SEQ ID NO: 1351 - DNA, 717 bp, Saccharomyces cerevisiae
atgacgatacaagcgaagcccagttcgagcatatcgtatgattcgactacatacggcacagcaccgggcttggatataaaagagttccaaatcatcgaagattggaatggaagacctgccagcgcttggtcggtgcagaggattgggcttctacagtccaagatcgaaaggtacacgtacaatatttaccacaataataaatatgggaagcacaacttatctaagctgataccagggcatgctctcattcagttcgctaatgaaacattcgggtatgatggttggcgaatggatgttatagatgttgaggcccgggagtgccagcccttcaccgcagtaaataatggagaaaacaccaacactagtgaggtcaagtatacagttgtggcagaagcccaagtaaaggttaccttaaaggatggcaccaacacacagtgtggtgggctaggtagaattactttgtcctcgagaggtgaatgttataacaggtcgaaaaaagaggctgtaggcgatgcgttaaagaaggcgttattgagctttgaaaaaatcatactcgattatgagactaagattacaaataattactatgtcgatggcttgtatggctcaaaaaaaattaaaaatgaagctaacaccaattacaacttattgtcagcgactaatagcaagccgacttttatcaaattggaggatgctaaaggcacgcatatcaaataa

SEQ ID NO: 1352 - DNA, 717 bp, Saccharomyces cerevisiae
atgcctattaatattcgcagagcgacaatcaatgacattatatgtatgcaaaatgccaaccttcataacctacccgaaaattatatgatgaaatattatatgtatcatattctctcgtggccagaggcttcgtttgttgctactaccaccactttggactgtgaagatagtgatgaacaagatgagaacgacaaattggaattgaccttagatgggaccaatgacggcaggacaatcaagttggatccaacatacttggctccgggcgaaaaattagttggatacgttctcgtgaagatgaacgacgaccccgaccagcaaaacgagccaccaaatggtcatattacttccttaagtgtcatgagaacctatagaaggatggggattgccgaaaacttaatgagacaagctttatttgcgttgagagaagttcatcaagcggaatatgtttccttgcatgtgagacaatctaatagagcagctttacacttgtacagggacacattggcgtttgaggtgttgagtatcgagaaaagctactatcaggatggtgaagatgcatacgccatgaagaaggttttaaaattagaggagttgcagataagcaacttcacccatcgccgtttgaaagagaatgaggaaaaactagaagacgatctagaaagcgatctactagaggatatcattaagcaaggcgtaaatgatatcattgtataa

SEQ ID NO: 1353 - DNA, 717 bp, Saccharomyces cerevisiae
atgcgtgccaccactttattatcttcagtcgtttctttggcattgttgtcgaaggaagtcttagcaacacctccagcttgtttattggcctgtgttgcgcaagtcggcaaatcctcttccacatgtgactctttgaatcaagtcacctgttactgtgaacacgaaaactccgccgtcaagaaatgtctagactccatctgcccaaacaatgacgctgatgctgcttattctgctttcaagagttcttgttccgaacaaaatgcttcattgggcgattccagcagcagtgcctcctcatccgcttcttcatccagcaaggcctcttcttctaccaaggcttcttccagtagcgcttcctcctctaccaaggcttcttccagtagcgcttcctcctctactaaagcttcttccagcagcgctgccccatcttctagcaaggcttcttccaccgaatcctcttcttcctcttcttcttccaccaaggctccttccagtgaagaatcctcttccacttatgtctcttcgagcaagcaagcttcctccactagcgaggctcactcttccagtgctgcctcttcgaccgtgtcccaagaaacagtctcctctgctctaccaacttctaccgccgttatttctactttctctgaaggttctggtaatgttctagaggcaggaaaatccgttttcattgctgctgttgccgctatgttaatctaa

SEQ ID NO: 1354 - DNA, 717 bp, Saccharomyces cerevisiae
atggattacgagaagtttctgttatttggggattccattactgaatttgcttttaatactaggcccattgaagatggcaaagatcagtatgctcttggagccgcattagtcaacgaatatacgagaaaaatggatattcttcaaagagggttcaaagggtacacttctagatgggcgttgaaaatacttcctgagattttaaagcatgaatccaatattgtcatggccacaatatttttgggtgccaacgatgcatgctcagcaggtccccaaagtgtccccctccccgaatttatcgataatattcgtcaaatggtatctttgatgaagtcttaccatatccgtcctattataataggaccggggctagtagatagagagaagtgggaaaaagaaaaatctgaagaaatagctctcggatacttccgtaccaacgagaactttgccatttattccgatgccttagcaaaactagccaatgaggaaaaagttcccttcgtggctttgaataaggcgtttcaacaggaaggtggtgatgcttggcaacaactgctaacagatggactgcacttttccggaaaagggtacaaaatttttcatgacgaattattgaaggtcattgagacattctacccccaatatcatcccaaaaacatgcagtacaaactgaaagattggagagatgtgctagatgatggatctaacataatgtcttga

SEQ ID NO: 1355 - DNA, 717 bp, Saccharomyces cerevisiae
atggtcaaaccaattatagctcccagtatccttgcttctgacttcgccaacttgggttgcgaatgtcataaggtcatcaacgccggcgcagattggttacatatcgatgtcatggacggccattttgttccaaacattactctgggccaaccaattgttacctccctacgtcgttctgtgccacgccctggcgatgctagcaacacagaaaagaagcccactgcgttcttcgattgtcacatgatggttgaaaatcctgaaaaatgggtcgacgattttgctaaatgtggtgctgaccaatttacgttccactacgaggccacacaagaccctttgcatttagttaagttgattaagtctaagggcatcaaagctgcatgcgccatcaaacctggtacttctgttgacgttttatttgaactagctcctcatttggatatggctcttgttatgactgtggaacctgggtttggaggccaaaaattcatggaagacatgatgccaaaagtggaaactttgagagccaagttcccccatttgaatatccaagtcgatggtggtttgggcaaggagaccatcccgaaagccgccaaagccggtgccaacgttattgtcgctggtaccagtgttttcactgcagctgacccgcacgatgttatctccttcatgaaagaagaagtctcgaaggaattgcgttctagagatttgctagattag

SEQ ID NO: 1356 - DNA, 717 bp, Saccharomyces cerevisiae
atgtcccacaaattaacaatcctgccatttctgattaagttcacgcccaagtttccacaatccattgatcacgacgagcatggtctaaacgtttatgcctttgatctggaccatacaattatcaaaccaaagtcccccaatataagttttagtagaagcgcaagtgattggcagtttattaattttaactccaagaaatccaccctggattacctgtgtaatatcattgataatgatcccacggccgtcatagtcatattttctaaccaaggtggtgtcatcaccgtcccaagaacttctaaaagttgcaccaagtacactaataaaattttgctatttttaaaggcaatcaaaaacgatgagagaggagaaacgttatcacacaggttatggctatatgcagcacctaaaaggccgaaaacttttgcagcaaatcatagtaagatcacattcgcaagcttaggtgaaagttataacaatgatcctaacatattcgaaaaagttcgaaaaccaatgacaggaatggtagagttttttaaaagggacctggaaagtgcatacagggtttcagaacaaatttctcccatcaagttgaattggatatattattgcggtgacgctgctgggaggaaaaaggacttcagtgattctgacataaagtttgctgaaaacttgcacgttgaattcaagtaccctgaggaaatatttcacgggtag

SEQ ID NO: 1357 - DNA, 717 bp, Saccharomyces cerevisiae
atgtttactggtattgtagaatgcatggggactgttttggaaaacaacccatatgatgactctgaaagtggaggtcaaggagtttctattactattggcaatgcggggagtattctcaccgattgtcacgttggagattcaatagccgtaaatggggtatgccttactgtgaccgagtttaataacgactccttcaaagttgggatatcaccagaaactataaaacgaagtaatgtcgcttcctggattcaaggcacccaggtcaacttggagagagcggtatctcaagacgttaggttcggtggtcattatgtacagggtcacgtagacactgttgctaatattgtctcaagaagacctgaggggaattcaattatttttgggtttcagttaagagatcaagagtactttaaatacatagtagaaaagggattcatttgtatagatggaacttccttgaccataatcaaggttgacccactttcgcaaggtggagccttctatattagtatgataaagcacacccaagacaatgttatcatgcctttgaagaaaattggcgacgaggttaatattgaagtagatttgactgggaagattattgagaagcaaattctattaacgttggaaaaccaaatatcaaagaaagatagtactttgaatactatgatctcaaacattatcgaggagaaggttagaaactacctaaataaataa

SEQ ID NO: 1358 - DNA, 720 bp, Saccharomyces cerevisiae
atgaaattctccactgctttgtctgtcgctttattcgccttggctaagatggtcattgccgattccgaagaattcggcctggtgagtatccgttccggctcggatttacaatacttgagtgtttacagtgataacggcactttgaaacttggcagcggtagtggctcatttgaggcaactattaccgatgacggtaaactgaaatttgacgacgataagtatgctgttgtcaatgaggatggctcattcaaagaaggttctgagagcgatgctgccactggtttttctattaaagatggccatctaaactacaagagctcttctggtttctacgctatcaaggacgggtcgtcttacattttctcttctaagcaatccgacgacgctaccggtgttgcgattagaccaactagtaagagcggatctgttgcagcagatttttctccaagcgactctagttcctcttcatctgcttctgcttcgtctgcttccgcatcatcttctacaaagcatagttcgagtatagaatctgtcgagacctctactactgtggaaacttcctctgctagctccccaactgcttcagttatctctcaaattactgatggacaaatccaagctccaaacacagtttacgaacaaacagaaaatgcaggtgccaaggctgccgtcggcatgggtgctggtgctctagcggtcgcagctgcttacttgttgtaa

SEQ ID NO: 1359 - DNA, 720 bp, Saccharomyces cerevisiae
atgaatagtaccgccgctgcaataaatccaaatccaaatgttataccattcgatgacacatacattctctatgattcgcatgactttctatcattccttagtgcatatttctcgctgatgcccatcctagtgctagctttttatttgtcgtggtttatcatcacaagagagttagaagcctgcattgtagcctttggccaattgatgaacgaaatattcaataacgtgatcaagaatataataaaacagccacgccccgtatcgttcggtgcgtcgttccaaaatgacactataagatccggttacgggatgcccagtgcacactcccaattcatggggttttgttttacctataactctctgaagatatacacttcctggaagaatctaaacttcttagaaaaatgcattttttctggtgcattggctttattatcgttttgcgtttgcttttccagagtttacttgcactaccacaatttagatcaagtaatcgtgggattcagcgtgggggcactgactggatcactttatttttttatagttggcatcataagagagcttggtttaatcaattggtttttaaaactacgtattgtcagattattttacatgacagattcttacaatctggcgcctttgacattgaaagagaattacgaggcgtattggaaaagaataaatcagcgatctttcaatgataaatccaaaagggattag

SEQ ID NO: 1360 - DNA, 720 bp, Saccharomyces cerevisiae
atgagctcaagtttgcctaggtctttactccgtttaggacatagaaagcctttgtttccacgatataatactttcgtgaactcatcggtaataactcatacgtcactgcttagaacaagattatatagtaatggcaccggcgcaacatcaggaaagaaggatgacaagactaggaataaacctaagccattatggcctcaagtaaaatccgcttctacgttcaccttttctggcatacttgtgataggagctgttggtatatctgctattgttatttacctaattctttcagaactattttcgccttcaggtgatacacagcttttcaacagagcagtttctatggtagagaaaaacaaagatataagaagtttgttacagtgcgacgatggcattacgggaaaagaaagattgaaagcgtacggtgagcttataacgaatgacaaatggacaagaaacaggcctatagtatctaccaaaaaattagataaagaaggtaggacacatcactatatgagattccacgttgaatccaaaaagaaaatagcgttggttcacttagaggctaaagaatccaaacagaattatcaacctgactttatcaacatgtacgttgatgttcccggagagaagcgttactatttgatcaagccaaaattgcatccggtttctaattcgaagggctttctgggaattagatggggccccagaaaagattaa

SEQ ID NO: 1361 - DNA, 720 bp, Saccharomyces cerevisiae
atgatgtcttgtctggtaccaacacgttttactttgacccttaacaccgcgtgtcttttgacgagcacctgggggtttgttagggccacatctgtagtcttacctccaagtttaagtaaagcaggccataaacagtttctaaccattatatctattattgcaacaatcattaataacgcggttaacatttctaattattatatccaaagaaacaataagatgaatctagaaaccaagaaaaaatcagactttattagtagacatgtcactttgccagtttctttagtattagaatctattgttgctaccgtttattggccgcttagattgttttttgtcaacttaataatgcatggagttgaatctactgcaaagacaccttttcctatgacagtggatatggcaatccacttatatcctattttatatttactagccgatcactacttatcgggatctggcacgaaattcaaattatcgaataagcatgcatggctcattgtaaccagtttagcattttcatattttcaatatttagcattcctgatagatgcggggcaaggccaagcctatccatacccgtttctagacgtgaacgagccgtacaagtcgattatatttgttgttgttgctactattacgtgggcttattatgtattttatcaaaagtttccgccaaaatacatcaagaagtcggcaaagaaaggtgataagaattag

SEQ ID NO: 1362 - DNA, 720 bp, Saccharomyces cerevisiae
atgcaccaagattttcaagaagacgagcatgagtatccagacatcagacgcaatccgctgcatgaggtgaccatgacttcctacatactggggattcttttaggtatatttgttggtctttttccacaaattagattcaagaattttaacctctttattattgccctgtccttattccattttttggagtattatattacagctaaatacaatcctcttaaggtacattcagagtcctttcttctgaacaacggcaaaagttacatggcggcacattcctttgctattctggaatgcctcgtagaaagctttctttttcctgatctgaaaatttttagctactctctagctaccaagctttgtacagtacttggatgtcttctagttattctgggacaatataccagaactattgctatgcatactgcgggacattccttttctcatattgtgaagaccaagaaggagtccgatcatgttttagtgaaaactggcgtttactcctggtcaagacatccaagttatcttgggttcttttggtgggcaattggcactcagctactgcttctaaatcccctatcattggttattttcatttttgtactttggaaatttttcagtgatagaattcgtgtggaagaaaaatatttgatagagttctttagcgcggaatacatagaatacaagaataaggttggtgtcggaataccttttatataa

SEQ ID NO: 1363 - DNA, 720 bp, Saccharomyces cerevisiae
atgcagcctcatttagacaacaacagtaataatgacgatgtcaaattggatacattaggggaacaaaatgtgttatcatccgcagaaaatatcactttacctgaagacacctttaaatcatatatgacctacttgctgtacgagatggctcattacaaaccgatgatattttccttcttggcactttcagtttcaattttaatagttgtgatctttcataatgttaaagcttgtgatgtcgtttttggtttttcaattttcgtcacttctattttgtttttgtctacgttgattccgtttaatgtgtatatctcggatgagggtttcagaattaagcttttgctggaagttatcacccacaggccagcggtaaagggaaaagaatggagagcaatcacagacaatatgaatcaatatttacttgataatggtttatggagtactcgctattacttttatagtagtgaaagatgctacaaattcttcagatttcttgtgaaagaaaaacccccaggtgtgaatgtaaattcatcggtaaaggacgccacaagtacgcagatagatgcaccagcaaatgaggcttcaaatgaggtaataaaatgctttagtttcagttctgacccaatattcgaagcatactttgttaaagcagtagaagttgagaaacaagcacaacaggaatattggagaaagcaatatcctgacgccgatataccatga

SEQ ID NO: 1364 - DNA, 720 bp, Saccharomyces cerevisiae
atggatgttgaaaaggatgtcctggatgtctacataaagaacctggagaaccagatcggaaacaaacgatatttcttgaagcaagctcaaggtgccatcgatgagatcacgaagagatctctggatacagagggtaaaccggtcaattctgaggtctttacagagttattaagaaaacccatgttcttctcagagagagctgatcctattggtttcagtttgacatcgaattttttgtctttgagagcccaaagttccagtgaatggctctcgcttatgaatgatcaatcagttgatcaaaaggccatgttattgttacagaataatattaatagtgacttgaaagagctgctacgaaaactgcagcatcaaatgaccattatggacagtaagaagcaagatcacgcccatattagaacacgaaaagccagaaataaagagctttgggactcactggcggactttctcaagggttatctagtaccgaatttggatgataatgatgaatcaatagatagcttaacgaacgaagtcatgctgttaatgaaaagactaattgagcatgatttgaatctgacattaaacgatttttcatctaaaacgataccaatatacagattattacttagggctaatataataacagtaattgagggctctacaaatccagggactaaatacatcaaactaatagatttcaatgagaccagtctaacttaa

SEQ ID NO: 1365 - DNA, 720 bp, Saccharomyces cerevisiae
atggcaatagcattatggtattgtccaccacaaggatcagttgcttacgagacattacagatgcttatattttcgtttcaaacgttgttcccagattcaccagtttttgaacctcatgtgacggtaacgtcccatttggtgtgcaatagtaaagatgatgtcaacaaaatcttgacctcctgtgttgctgccatccaatcgataaggtcacaccaaacagcaaagaaaggacgtaagggacaggtatcccatgctgttgcagctcctttggtatctttcaatggatgcagtgtaggtaaacaatatttcaagaaaattgtgctcgagtgtaacaagaacaaaatactttatggggtcgcacaagtcatgagagagatgtacgtagagatcgatcctgagacgcgaagtagccgtgccgccacttgggtgcacgaggaattccatcctcacgtctcattgctttattcggatattcatccggtaagtcaggcgtcattgcgagtagttcaacaaagaattgaagatgctctagacgtgcaactagttccaagagagaaacgtaagggttccggaaacgctgatgggtccaatgaagtgcaaatgagatgggattttgacgtatcttcatcgctatcttggaatatcccaggaacgtttaaagtggtcaactgtgtggggcccgttcaagaatgggaggtattgggacgggtggacgtttaa

SEQ ID NO: 1366 - DNA, 720 bp, Saccharomyces cerevisiae
atggttagcatgatccatattgtggtgtttttgctagcaatcacaaccatgttcgaaatacttccgctaataaccgtccccgtgaccaagtacctatcgttatcgtcattcagaaaccactattatggcctgtttggctggtgtgtacgtggtcaaaaccaagaattgatgtgcacgaaaatgaagataggatatgacagtacagatgtcgactcctccgggcacgttttgaccctgccatcgaactcaaaagtggtcgtctccaatttattagtggttcacccgatttcactggcattcacaggaacgctattaattttagcagtgattatcatggtaactccactaggggactcacctgagatgttattgttcacggcccttttttcgctgccaacgttcatgctatgtcttttatgttttttggtagatattcttctgttcatctccaaactggactggcccggctggctaatgctagccgctactattagcgtagcactttgttgttccatgctgtgggtcatgagaagagttgtgtcagtcaaaaaatatgaatcgcaacagtcaattgcgcatgcgtgctcaatggaacagtactcaatttccgacatttaccagagtaaacagaacggcaatagctcagaatatgaagtggctccaacacatacagatagtctgattgctccagaagtgacatatagagggttcattgaataa

SEQ ID NO: 1367 - DNA, 721 bp, Saccharomyces cerevisiae
atgtctagtatgtttaatcacatagtgaacatttttaaagcatctctattttccattgattgttgttgaatgtttctgacgacgtgcaagatacattgaaagtcagaaacataaagacaattcaacgaattcattgcctccaaagtaattcatagcgattagttgagcctattgtgtcaatggcagtatattttgtcaacttttttttcgatggaaaagcaaagatactatgtaagaattaaaaaaaaaaacttttggatactaacaacattacgtttgatatcgtccgatatcgatttactatttccatttagacgttgttcaagctcgtgacaattcccaagtttttggtgttgctagaatttacgcttctttcaacgatactttcgttcatgttaccgatttatctggtaaggaaaccatcgccagagttactggtggtatgaaggttaaggctgacagagatgaatcttctccatacgctgctatgttggctgcccaagatgttgccgctaagtgtaaggaagtcggtatcactgccgttcacgttaagatcagagctaccggtggtactagaaccaagactccaggtccaggtggtcaagctgctttgagagctttggccagatctggtttgagaattggccgtatcgaagatgttaccccagttccatctgactccaccagaaagaagggtggtagaagaggtagaagattatga

SEQ ID NO: 1368 - DNA, 723 bp, Saccharomyces cerevisiae
atgaaagatctccagaaaaaaagctcagtacgaaggcaaatcacgaatgaagacgatgaacggtatggggaggacagcatccatgaccttcccaggacaataccaaatgtaaatccctatattagaaattcaggatttaggccatcttattcttcccaaattccttcgacaaggagtctattcaataactattataaccgttcaagtgctaacacagttggtaatgacacaatagataccgatagtgttagctataacggagttgccaaattccggagaaatagcgtagatataccgctacagacacataacagactggaagtacggcctataatcgacagacaagactatttgtggagagaaatagatgccctagatgacgttaaaagacaggcgcaggcaacagaattgtatgatcagtttcctccagggttcgagaacaaactgatgcaattaaggcaagcacatagtaaactacttcaagtcttgagggaccgcaatgctaaaatagaagaggaacaacgtcgtgaagtggcggtcgcaaccgctgctgccatgatgactagaacgccatcaccaacaggaaaatccgtcggagatgaagctacaagcaacaacatgcatagtagcagcgcaattagaaatccaaatggaccaaccgttgatcctgaagaaggaaagtacattcaagagctggtgaacactataagggaattacaatag

SEQ ID NO: 1369 - DNA, 723 bp, Saccharomyces cerevisiae
atgaaaggaacaggtggagtagtagtcggaactcagaatcctgtaagggactacaatcatagcactgatgaagagtatcaaagattgagaagattagcagatgaagcgtataagaaaagagaccaactcagccatgaatcgcaaaccgcttatcaacaaggtgacaagaagctagctcatgaactaagcgagaaaagtaaggcacaactgaaaaccgctgaagattttaacatgcaagcggcagaatatgtgtttgtagagaacaatgctgattcttccagtaatgaaattgacttacatggattatacgtaaaagaggccctatttattctccaaaaaagaatcaaattcgctattgatcataatgaaccacaactgaacgttattgttggaaaagggttgcattctcaaaacggtatagcgaaactcaaaccgtcaattgaggagttctgtgctaagcatggtatcagaaaccatttggaaaaaggaaattcaggagtcttggtgcttgagttgcaaggtgtgcaaatgcagatggatggccccgcagtgaatgcccccactaatcagtacaatgcacaaccacatcctcaatataacaacaatggaggacagcctcaaggtcaagctcagaattataataacagtggcaatgacaacaaagatagtactttgactagtatattcaaaatcttttgtaattgtatacaaagtttggcgtga

SEQ ID NO: 1370 - DNA, 723 bp, Saccharomyces cerevisiae
atgacttcgaaaaaagtgatattagttgcattgagtggatgctcctccagtggtaagacgacaattgcgaaacttacagcaagtttattcacgaaggctacattaattcatgaagatgacttttacaaacatgataatgaagtgccagtagatgctaaatataacattcaaaattgggattcgccagaagctcttgattttaaacttttcggtaaagaattagatgtgatcaaacaaactggtaaaatagccaccaaacttatacacaataacaacgtagatgatccctttacaaagttccacattgatagacaagtttgggacgagttaaaggctaagtatgactctattaatgacgacaaatatgaagttgtaattgtagatgggtttatgattttcaataatactggaatatcaaaaaaatttgatttgaagatattagtgcgtgctccctatgaagtactaaaaaaaaggagggcttccagaaaaggataccagactttggattctttctgggtggatccgccgtattatttcgacgaatttgtgtatgaatcttatcgtgcaaatcatgcgcagttatttgttaatggagacgtagaaggtttactagacccaaggaagtcaaagaatataaaagagttcataaatgatgatgacactccaattgcgaaacctttaagctgggtgtgccaagagattctaaagctttgtaaggattag

SEQ ID NO: 1371 - DNA, 723 bp, Saccharomyces cerevisiae
atggccgatgaggaacgtttaaaggagtttaaagaggcaaacaagatagtgtttgatccaaataccagacaagtatgggaaaaccagaatcgagatggtacaaaaccagcaactactttccagagtgaagaggacataaaaagagctgccccagaatctgaaaaagacacctccgccacatcaggtattgttccaacactacaaaacattgtggcaactgtgactttggggtgcaggttagatctgaaaacagttgcgctacatgcccgtaatgcagaatataaccccaagcgttttgctgctgtcatcatgcgtattagagagccaaaaactacagctttaatttttgcctcagggaaaatggttgttaccggtgcaaaaagtgaggatgactcaaagctggccagtagaaaatatgcaagaattatccaaaaaatcgggtttgctgctaaattcacagacttcaaaatacaaaatattgtcggttcgtgtgacgttaaattccctatacgtctagaagggttagcattcagtcatggtactttctcctcctatgagccagaattgtttcctggtttgatctatagaatggtgaagccgaaaattgtgttgttaatttttgtttcaggaaagattgttcttactggtgcaaagcaaagggaagaaatttaccaagcttttgaagctatataccctgtgctaagtgaatttagaaaaatgtga

SEQ ID NO: 1372 - DNA, 723 bp, Saccharomyces cerevisiae
atggtcgctttaatctctaagaaaagaaagctagtcgctgacggtgtcttctacgctgaattgaacgaattcttcaccagagaattagctgaagaaggttactccggtgttgaagtccgtgtcactccaaccaagaccgaagttatcatcagagctaccagaactcaagatgttttgggtgaaaacggtagaagaatcaacgaattaactttgttggttcaaaagagattcaagtacgctccaggtactattgtcttatatgctgaaagagttcaagaccgtggtttgtccgctgtcgctcaagctgaatctatgaaattcaaattgttgaacggtttggctatcagaagagctgcttacggtgtcgtcagatacgttatggaatctggtgctaagggttgtgaagttgttgtttccggtaaactaagagctgccagagctaaggctatgaaatttgctgacggtttcttgattcactctggtcaaccagtcaacgacttcattgacactgctactagacacgtcttgatgagacaaggtgttttgggtatcaaggttaagattatgagagacccagctaagagcagaactggtccaaaggctttgccagatgctgtcaccatcattgaaccaaaagaagaagaaccaattcttgctccatctgtcaaggactacagaccagctgaagaaactgaagctcaagctgaaccagttgaagcttag

SEQ ID NO: 1373 - DNA, 723 bp, Saccharomyces cerevisiae
atgtcagggttcattaagagcacgttgcttggtctaggccaagattacttagaagatcaatatcaagagttcgcagaacagcatttccagccaaccagggatccgttttatgaaacgaataaagatggtaaaaagcaccgccgcagactgccatattattgcactaaggatgaaagtaaagcgtggaaaaaggtccaaaacaaagcctggctgcatgacaaatcactgtgcggatgctgttgctggacaaacactataggatgggcaccattacttgcacttctaccggttataggacccttattgatgtattgggtgcatgataagttgattgaattggcagatgacaggtataaattgcctgcggaaatcaaggtgaagatgcatggtaatatcgttatcgatttacttattagtttagttcctattctgggaagtgtttttgcatggttgcacgcatgttccacgagaaacgcagctatagtttacaattttgttggaaaaagggcattggaaagaaagcaagcggagctcatgcatcaaaaagaagaaaatgagaaacattccaatgccaatactgcacctccagtagttggtggcaacaaaaatgtgaatggaaacagaaataatagtaaaatgtataacagaccgcctgtgacagctccacctgcaccagcatacacgcgcagtactaacggtcgcccccaaagaggttacaggtga

SEQ ID NO: 1374 - DNA, 723 bp, Saccharomyces cerevisiae
atgtctacgttcatattccctggtgatagctttcctgtagaccctactacacctgttaaactgggccctggcatatattgtgaccccaatactcaagaaatacgacctgttaatacaggtgttttgcatgtttccgctaagggtaagagtggtgttcagaccgcatatatagactattctagtaagagatacattccatctgtaaacgattttgtaatcggtgtcattatagggacattttcagatagctataaggtttcgttgcaaaatttctcctccagtgtttcactatcgtatatggcttttcccaatgcttcaaagaaaaacaggccaactttgcaagtgggagatctagtgtatgcgagagtttgtaccgcagaaaaggaactagaagccgaaatagaatgttttgactcaactacaggacgcgatgctggtttcgggatattggaagatggtatgatcattgacgtgaatttgaatttcgcacgccagttgcttttcaataatgacttcccgttattaaaagtgttggctgcacataccaagtttgaagtcgccattggtctcaatgggaagatctgggttaagtgcgaggaattatctaacactttagcttgttatagaaccataatggagtgttgtcaaaaaaacgacacggcagcgttcaaggatatagcaaaaagacagtttaaagaaatacttacggtcaaggaggagtag

SEQ ID NO: 1375 - DNA, 723 bp, Saccharomyces cerevisiae
atgtggtcatcactttttggttggacatcaagtaatgccaagaataaagagtcaccaacaaaggccatagtgcggttgagggagcatatcaaccttctatccaaaaagcaatcgcatttacgtactcaaattacaaatcaagagaatgaagctagaatctttttgacgaagggcaataaagtaatggcgaagaatgcacttaaaaagaagaagacaatcgaacaacttttaagtaaggtagaaggcacaatggagtctatggaacagcagctattctctatagaaagtgcaaacttaaatctagagacaatgagggctatgcaggaaggtgctaaggcaatgaaaactattcacagtggccttgacatagataaagtggatgaaactatggacgagataagggagcaagtcgaattaggagatgaaataagcgacgctatatccaggcctttaattactggggcaaacgaggtggatgaagatgagctggacgaggaattggacatgctggctcaagaaaatgctaaccaagaaacgtccaagatcgttaataataatgttaatgcggcgcctatctcagagaacaaagtctcactacctagtgttccaagtaataaaattaaacaaagtgagaactctgtgaaggacggggaagaggaagaggatgaagaagatgaagatgaaaaagcattaagagaactacaagcagaaatggggctttga

SEQ ID NO: 1376 - DNA, 724 bp, Saccharomyces cerevisiae
atggaaaacgataagggtcaattagtacgtaaattatagcagatgatggcgcgcaaaggaagaaagaagaggactgagtaagcgtggacagacaagggagcatcgacagaaaaataaaattataataagttaagtgtgcaagattagtggtacaaatagggtgggaccaacatgggtttataatcatattggttagtaatacatcaaattcaagaaaatgcaaataacccatttaaattggcacaagtgttacctgatactttatcatgtgtggtctaagtacacatctctaagaaatgtggcgttttaacgacaaaattggaatcccaagagagatatgctgaaaagacatcataattccgaattagtgggtttccatattccagaactactcttagaacttttctttcattcatgtgcagaataattttacaagaatataagcgcaaatgtactaacattgaataatttctttttttactaggttgaattatatgttccaagaaagtgttctgctaccaacagaatcatcaaagccgatgaccacgcttctgttcaaatcaacgttgccaaggttgatgaagaaggccgcgccattccaggtgaatacatcacttacgctttgtccggttacgttagatccagaggtgaatccgatgactctttgaaccgtttggctcaaaacgatggtttgttgaagaacgtttggtcttactcccgttaa

SEQ ID NO: 1377 - DNA, 725 bp, Saccharomyces cerevisiae
atggtacgtaccacgagatgttgatgaagccggatatgatggactgggcgctgaacacatgaaatgagggcaaggtttgcagagagattgaaagcgttatgggaacgaggggaccagcagggcattcttatttatgagcagattagaaaactccattactgattagtttagaagagcgctcaatgaagtagtagatatttaaaagatcaccaaataaccaattgctttcgaatggcacattctatcttatccaatggtcttgaagagaggtatttactaacttaagttgtctcatttgattattgctatttttatagggtagagttagaaccaagaccgtcaaacgtgcctccaaggctttgattgaacgttactatccaaagttgaccttggatttccaaactaacaagagactttgtgatgaaattgcaactatccaatccaagagattgagaaacaagattgctggttacactactcatttgatgaaaagaatccaaaagggtccagttagaggtatttctttcaaattgcaagaagaagaaagagaaagaaaggatcaatacgtcccagaagtctctgctttggacttgtctcgttctaacggtgttttgaacgttgacaaccaaacctctgacttggttaaatctttgggtttgaagttgccattatctgtcatcaacgtttccgctcaaagagacagacgttacagaaagagaaactaa

SEQ ID NO: 1378 - DNA, 726 bp, Saccharomyces cerevisiae
atgaatatgggaggcagtagcagcactgctgccaaaaaagcgacttgtaaaatatcgatgttatggaattggtataccattgacacctgcttcattgccagatcttggagaaatgacaccaaaggaaaatttgctggttcttgcatcggctgttttgcgcttgtggtggtagctcaatggcttactcgtttttcaaggcaatttgacgtagagctattaaaaagacagaaaataaagcatttagctagttactcgccagaggagtacgttgtcaaatgtggagaagaggatgctaaatctgatatagaagaactacaaggcttttacaacgaaccaagctggaaaacaactttaatttccttacaaaaaagtttcatttatagtttttacgtttggggtccaaggagattgaacgagccagaagacgacctgttaaagaaggtcctatcatgctgtacattaataacgccagtggatttgtacccaacttttttggatcacatgataagagttactattttcgtattacagtgggggttatcttatatcatcatgctgctgttcatgtactataacggctatatcattattagttgtttaataggtgctatcgttggtcgtttcatattttgctatgaacctctaggctcattgggtgctaatggatcagcccagggtacagtgagttatgataaagagagtgatgatcgcaaatgctgcttgtag

SEQ ID NO: 1379 - DNA, 726 bp, Saccharomyces cerevisiae
atgagtgaagaagaagcgcataaaacagtggaggtggatgacgtcggggttcaattggatgagggcgatgaagaagaccttttggagtatgatgatgaactcgtggaggaacaaccatcggacgcccgtatacgcaacgtggcagagactttaatgaaaagcgaattgcccaaagtcaccgtggaatataaagatactacatttctgttgttcacgtcggatgataagaacgaaagtaacaaccccataatatgtgaaaacgctgctctttatcagcgacccatgggggaattcatggaatccattcgtaaatttatgggaaatcgttttggcaggttggcttttgctacgaaggagttggttttacaactgaaaagcctcgatttgaccttgttcgaagataatgtctacaacaaccatatttcattcagcgatgtttatactatatttaaaatcctgaaggaaagatcggagtctaattttgaaactgatataccgacgcacttggctattgaattaagtacaaggccaagatttgtctctcggtacaacgccttggttgaattaactgaaagctcagctacgttgaaaaacataaagccattttctaacgatgaaacgcatcccttaattgtggatgacaatgaccaatatacacaccagaatacttcagaagtcattgtaatggacatagatgatgacgtaggtgaggattctgaagactaa

SEQ ID NO: 1380 - DNA, 726 bp, Saccharomyces cerevisiae
atgctggtagtgggattgacaggtgggatcgcttgtggtaagagcacagtgtcgagaagactcagagacaaatacaaactacccattgttgatgcggacaagattgctagacaagtggtcgaaccaggacagaatgcttatgatcaaattgtgttatacttcaaggacaaaataccgaatttattattggaggatgggcatttaaatcgtgaagccctagggaaatgggtttttagtcataaagaagatttgcaagccttgaatgggataacacatcctgcaatcaggtatgcaatgttcaaagaaattggctactattacttgaagggatatagaatgtgtgtattggatgtgccactcttatttgaaggaaatctggattcaatatgcggagtgactgtaagcgtaatttgtacgcaagaattgcaactagaaagattaatgacaagaaatcctgaacttagtgaagaagatgcaaaaaacaggctaaatagtcaaatgagcactgaagaaaggatggcaagatctgactatatcctacaaaataacagcacattggttgacttatacgaacagattgaaagtgttgtaaaaaaaatccaacctagtaaattaagaactgttttggagtatttcccaccttttggggccgtaagtgccagtagcatcgtcatgtccagattactgatgaaaaaacttcaaaataaaaagtcttcagcggtataa

SEQ ID NO: 1381 - DNA, 726 bp, Saccharomyces cerevisiae
atggccactattgcatcagaatactcttcggaggcgtcaaatacacccattgaacatcaattcaatccttacggtgataatggtggtacaatcctgggcattgcaggtgaagatttcgcagtgttagcaggcgatacaagaaatatcaccgattactcaattaattctcgttatgaacccaaggtttttgattgtggtgataacatagtcatgtcggcgaatggatttgcagcagacggcgacgctttagtaaaaagattcaaaaatagtgtaaaatggtaccatttcgaccacaacgacaaaaaactatctataaactctgcagcaaggaacattcaacatcttctgtacgggaagaggtttttcccttactacgttcatacgatcattgcgggtcttgacgaagatggtaagggcgctgtctattcgttcgacccagttggctcctacgaaagagaacagtgtagagcaggtggtgctgcggcatcattgatcatgccatttttggacaatcaggttaatttcaaaaatcaatatgagccaggtacaaacggtaaagtcaaaaagcctttgaaatacttgtccgtggaagaagtcatcaaactggtgagagactcgttcacttctgctacagaaagacatatacaagtgggtgatgggctggaaatccttattgtcaccaaggatggtgtaaggaaagaattttatgagctaaaaagagattaa

SEQ ID NO: 1382 - DNA, 726 bp, Saccharomyces cerevisiae
atggtacccgcacctgggtcacgtgcattcccctcacccgtttttttaggtggtgtcttttttgtttttttttttaggtggcgcggcaactataaagtacagcaagtgaggttgaggcaatactgggagtttacactatgggagacagctcctaacaccaagcagaaaaacgactttttcgcaaagtatgtaaggcgctgggtgagcccagcggacgaggatgggcttaataagaacgtacagtttagcacagctagaacaggatacagctaagggcaactctgcttttcgggagaagttaaagaggggtagacaatgatggtaatcttataaaccggctacaatgaaggttgtagcagcaaggaagatgatattttaatacggttcaggtgaaatgaaatagccgcccataacggcatgctcaagttgtaagtcaggactctagctttctactgtagtatcctctaaaggactgctgttctgtgcacccccttcctttgtttatcatagcgcacgacaagagtactaactaattaacttagaacattaacatatataaaactagcgctatggccgcaactaaagaagcaaagcaaccaaaggaaccaaagaagaggaccaccaggagaaagaaggatcctaacgcccctaagaggggcttgtcagcttatatgttctttgctaatgaaaacagagacattgtccgttccgagaatcctgacgtaa

SEQ ID NO: 1383 - DNA, 726 bp, Saccharomyces cerevisiae
atggtcaaagctgttatttttaccgatttcgacggtaccgttactttggaagattctaacgattatctgaccgatactttaggtttcggtaaggaaaaaagattaaaggtcttcgaaggcgtgttagatgatactaagtcttttaggcaaggtttcatggaaatgctggaatccatccacacccctttccctgagtgtatcaagatcttagaaaagaaaattcgattggatcctggtttcaaggatacattcgaatgggctcaagaaaatgatgtccctgtcatcgttgtttccagcggaatgaaaccaattatcaaggttttattgaccagattagttggacaagagtctattcacaaaattgacattgtttccaatgaagtggaaatcgatgcacatgatcaatggaaaatcatctataaggatgaaagtcccttcggacatgacaaatccagaagtatcgatgcttataaaaagaaatttgaatctaccttgaaagcaggtgaacaaagacccgtttacttttactgtggtgacggtgtttctgatctaagtgctgcaaaagaatgtgatttgctatttgccaaaagaggtaaagatttggtcacttattgtaaaaaacaaaacgtcccattccatgaattcgataccttcaaagacatcttggctagcatgaaacaagttctggctggtgaaaagacagtcgctgaattgatggaaaattag

SEQ ID NO: 1384 - DNA, 726 bp, Saccharomyces cerevisiae
atgtctgcgtcactagtgaatcgatcattgaaaaatataaggaatgaattagaatttttgaaggaatcaaacgtcatatcaggcgacattttcgaattaatcaatagcaagttacctgagaaatgggatggaaaccaaagatcgccccaaaatgcagatacagaagagtacgttgaagctttatatgattttgaagctcaacaagatggagatttgtcattgaaaacaggtgataaaatacaagttttagagaagatttctccagattggtatagaggcaagtcaaataataagatcggaatattccctgcaaattatgtgaaacctgctttcacgagatcagcctcacctaaatctgcggaagctgcttcaagctcgactgtttctcgtcccagtgttccacctccatcatacgaaccagccgcatcacagtatccttcacagcaggtttcagcaccttatgcacctccagccggttatatgcaagctccgcctccacagcaacagcaggcgcctttaccatatcctccacctttcactaattactatcaacagcctcagcaacagtacgcaccaccttcacagcaagcaccggtggaagcacaaccgcaacagagcagtggggctagtagtgccttcaagagttttggtagcaaattgggaaatgctgctatatttggcgctggttctgctattggtagtgatattgtcaacagcattttttag

SEQ ID NO: 1385 - DNA, 726 bp, Saccharomyces cerevisiae
atgtctttttcatctatcttatcacaggatatcacagatgacattacaccaccagcgtattccgccaccttggggtcgagagaacagattgttttcagagcttaccaaaatgaaccttggttggctggtactgcttcgaatcttatcttagataaaaaacttgttattgtagacagagaactgttgttccaggtgttgatggtagagaatatcaccaaatccaagctaacacagatcgatgatataaaaaccaagctggatccgaaaaaacagaaagtggatagactacgatcaggcgcgcaaggaaatggcgctaagaagtacgaggtcatcactcaagtggacatggaagatgacgggaatgtggcggataacaactgcgccaaggaaaataatagcaacaataatagcagtgccgccaagaataaagcagtgtttaaattgacactacaaagtaagtcgggcgacgttttttttgctatcaactcgactccaatatcttggagctcttgcatgctgggttctaaaattgtgatactgccgggaactgtgttcaataggggcgttttcatattgaaggactcacaagtcatttttctcggcggcattaatagagtttggaatgaaaatagagatcagaaattttgtgattatttggaatctaaattacaacgtgacaaacaacttgtaaatggcggctccaagaaaaggaaagccaatgattag

SEQ ID NO: 1386 - DNA, 727 bp, Saccharomyces cerevisiae
atggcaccgaaaaagaaatcaaacgatagagccattcaggcaaaaggctcagaaggttaagtatttttttacatgctcatcaaataccgccattactaacaattgtaccccgggtattttatcagctgaacaattaatagaagattacttggtgtcacaatataaaccattttctgtaaatgatatagttcagaatttgcacaataaagtgacaaaaacaacagcaaccaaagcattagaaaatctcgttaacgagaaacgcatagtgtctaaaaccttcggaaagattataatttactcttgtaatgaacaagatacagcattaccaagcaatattgatccttctcagtttgattttgaaactgtattgcaactgagaaatgatttaatagaactagagagagataaatcaacggccaaagacgctcttgactctgtaactaaagaacctgaaaatgaagatctcctaacaatcattgaaaacgaagaaaacgagttgaaaaagattgaatcaaaattacaaagtctacaggatgattgggatccagcaaatgatgagattgtcaagcggataatgtctgaagatacgctgctacaaaaagaaatcacgaagagatcaaagatttgcaaaaacctaattgctacaataaaggactcagtgtgcccgaaaaatatgaatgaatttttggtatgtattttgaacatttttcgagaccttttcttttga

SEQ ID NO: 1387 - DNA, 728 bp, Saccharomyces cerevisiae
atgttgatgccaaagcaagaaagaaacaaaattcaccaatacttgtttcaaggtatgtttgcattttttaggtgaaatatgcagtgatatgctccgaaatggatagcaaagatgataaatgaaaatacaattaaattgaacttgaatatcattaaaagtggtagaaaaccgattgtttcaaaaagatctttgtggacaagtacggcagtgcatgaatccgaaagaaaagtgcaacctaagcagaattccattatttcacgcgtccatttttataatgtttgaacttttgagtccttatagaaatgctaatattatgatcaaagcgattatatcatttactttacagtttccggagtttccgtattattgcaaaaggaccacaaacaattgaaatcatgatatcgtaagaaatattattactaacaaggaagatcattgaattacgatcgcatatcgaaatagaaggtgttgtcgtcgctaagaaggatttcaaccaagctaagcacgaagaaattgataccaagaacttgtatgttatcaaggctttgcaatccttgacttctaagggttacgttaagactcaattctcatggcaatactactattacactttgactgaagaaggtgttgaatacttgagagaatacttgaacttgcctgaacacattgtcccaggtacctacattcaagaaagaaacccatcccaaagacctcaaagaagatactaa

SEQ ID NO: 1388 - DNA, 729 bp, Saccharomyces cerevisiae
atgactgataggaatttctcaccacaacaaggacaaggacctcaagaatcgctcccggagggaccgcaacccagtacgatgattcagagagaggaaatgaatatgccaaggcaatattcagaacagcaacaactgcaagaaaacgaaggggaaggggaaaatacgaggctacctgtttctgaggaagagttccggatggtacaggagttgcaagctatccaggcgggccatgaccaagctaatctaccgccaagtggtcgaggatcgcttgaaggcgaagataatggaaacagcgacggcgcagacggagaaatggacgaggacgatgaagagtatgatgtgtttaggaacgttggtcagggattggtgggccactacaaggagataatgatccgttattggcaagaattaatcaacgagatcgagtctacgaatgaacctggttccgagcatcaagatgacttcaaatcacattccttaccatttgcgagaatccgcaaggtcatgaagacggatgaagatgtcaagatgattagtgcagaggcccccatcattttcgccaaagcctgtgagatctttattacagaactgactatgagagcttggtgcgtggcagaaaggaataaaagacgaactttgcagaaggcagatatcgcagaggccctgcaaaagagtgacatgtttgactttctcatcgatgttgtgcctagaagacctcttccacaatga

SEQ ID NO: 1389 - DNA, 729 bp, Saccharomyces cerevisiae
atgataaaaaactatttgggacgaagatggctcaataatcctgcaattcaagcatatgtgaaacaaaatgctgctgtcgcccattctacggtgtttcaaggaaatctttatgaatatacggtgatgagggagttatctgagaaactacgaatgacaaagttgagaaaaaccggtggcgcccatgatggtggcgtagacataaagggaagctggccagtagatgatatttattggaaaatttcatcgttaatgcccaatttggaaatggctagtaacataaaaagaacgaactcgcaaaatggcttcgtattgaaacctttaaagtataggataatcgaccatacttttgaaccattgaaagtactagtccaatgtaaggctttcactaaatcaaaattatctcctagagaattccgtgagttagtaggaacattcacctcactagtatcacatagtcaacgcaacaaaacagtatgcattatgtgttcccctcatatgttaacaaaagataccttaaatcttatcaataacatcacgcttcctctgatatatttacgtgttgagatgctgaaagagaagactgacgggcactttgacttaatcaattcaggaaaactaattaattattacgagaattcatacgcctctacgttaatgcaagattgcaagatttctgaatggctgaagttgaagttgtacaaaaatagtgactttaattcggaaaaataa

SEQ ID NO: 1390 - DNA, 729 bp, Saccharomyces cerevisiae
atgcaaaaacacaatataaaattaaaccaaaaccaggatatttcccaattattccacgatgaagtacccttattcgacaactctataacttcaaaggataaagaagtcattgaaactttatctgaaatatattctatagtaatcacactagaccacgtagagaaagcctacctaaaagactccatagatgacacccaatacactaatactgttgacaaattactaaagcagttcaaggtctacctgaattctcagaataaagaagagataaacaagcatttccaatccatagaagcgttctgcgatacatacaacatcactgcttcgaacgcaataacaagactggagaggggcataccaattacagcagaacatgcgatatccactaccacatcggctccctctggtgataataaacaaagttcttctagcgacaaaaagtttaatgctaaatacgtcgctgaggccactggtaatttcatcactgtaatggatgctttgaaactaaactataatgcaaaagatcaattacatcccttattggctgaactgttaatcagcataaatcgcgtcaccagggatgattttgagaatagatcaaaactcattgactggattgtcagaataaataaactctcaattggtgacactttaactgaaacacaaattagagaacttctgtttgatctagaactagcctataaaagtttttatgctttactggattaa

SEQ ID NO: 1391 - DNA, 729 bp, Saccharomyces cerevisiae
atgctcctatttccaagaagaactaatatagcctttttcaaaacaacaggcatttttgctaattttcctttgctaggtagaaccattacaacttcaccatctttccttacacataaactgtcaaaggaagtaaccagggcatcaacttcgcctccaagaccaaagagaattgttgtcgcaattactggtgcgactggtgttgcactgggaatcagacttctacaagtgctaaaagagttgagcgtagaaacccatttggtgatttcaaaatggggtgcagcaacaatgaaatatgaaacagattgggaaccgcatgacgtggcggccttggcaaccaagacatactctgttcgtgatgtttctgcatgcatttcgtccggatctttccagcatgatggtatgattgttgtgccctgttccatgaaatcactagctgctattagaatcggttttacagaggatttaattacaagagctgccgatgtttcgattaaagagaatcgtaagttactactggttactcgggaaacccctttatcttccatccatcttgaaaacatgttgtctttatgcagggcaggtgttataatttttcctccggtacctgcgttttatacaagacccaagagccttcatgacctattagaacaaagtgttggcaggatcctagactgctttggcatccacgctgacacttttcctcgttgggaaggaataaaaagcaagtaa

SEQ ID NO: 1392 - DNA, 729 bp, Saccharomyces cerevisiae
atggaagttttaaagaacattagaatttatcctttgtcaaacttcatcacatcaaccaagaactatataaacctaccaaatgaattaagaaacctaattagtgaagagcaggagagtaaactagggttcttgcacatcattgaaagtgattttaaaccttcggtagcgctgcaaaagttggtgaattgtactacgggggacgaaaagatcctaatcatagatatagtatcaatatggtcccaacaaaagcaaagacagcatggcgcgatctacatgaattcgctatcttgcataaacatcacgggattaatcgtatttctagagttactgtatgactctcccatggatgcgttaaggaggtgccaggttgataatttcaactttcaattacgaggaatagtaatcgacaatttgtctttcttgaattttgaaagcgacaaaaactatgatgtaataaatttatcgaaatttgaaaaactgtttaagattctaaggaaactaagagaatttttgggctgctggatcatcaccaaaagttttcccacagacttctataatggtatcgaaaacaccttagttgataagtggtcaatcaagaggaaaagcggcgttacactgtaccccacaaaactacctgattcatacatgaagggaatggatctgataatctacagagaagttgttgacggcaggccacagtacagaaggatagccgcacttgaagaatga

SEQ ID NO: 1393 - DNA, 729 bp, Saccharomyces cerevisiae
atggctgtcaatgaatttcaagtggagtctaacatctctccaaaacaactgaataaccagtcagtgtcacttgttattcctcggttgacaagagataaaattcataattcaatgtactataaagtaaatctaagcaacgaatctttgagaggcaatacaatggtagagcttttgaaagttatgattggcgcatttggtaccataaaaggtcaaaatggtcatttacacatgatggttctcggtggcattgagtttaaatgcatcttaatgaagttaatcgaaatcagaccgaatttccagcagttgaacttcttattgaatgtaaaaaatgagaacggttttgactcgaaatatattattgctttgcttctggtttatgcgcggttacagtattattatttgaatggcaataacaaaaacgatgatgatgaaaatgatttgataaagttatttaaagtacaattatacaaatattcacagcattatttcaaactaaaaagtttcccactacaagtagactgctttgctcactcctataacgaagaactttgtataatacacattgatgaattagtcgattggttggccacacaggaccatatctggggtattccattagggaaatgtcaatggaataaaatatacaactctgatgaagagagtagttctagcgaaagcgaaagtaatggtgacagtgaagatgacaacgacaccagcagcgaatcatag

SEQ ID NO: 1394 - DNA, 729 bp, Saccharomyces cerevisiae
atgtcctcgacagtgatttcattggctcatttctgcgacaagcatggcccaaggatcatatcagttacacaatccgcagaaaagggaacgctaggtgaagaattactagtgcctgattatccaactgaatcatattgcgaatcatgtcttttacagtttcctgaagagtcaactagatcgatgcggtgcttcatcgaagatgttccgtttataactacccaatattcttctataagataccaattgctaaattctattattaaaagagccttttctgaagaaacaatgatttatgataatatgccttttatattttttgatgatcttagaggattgaacttagttataggctttaaactgtatgatgaaaatgctagaggcaatgaaagaagatattgttttattttaacagtcgattccagaagccatgacgattctatgaaaatgttgagtgaacactggaactttatcatcggtggatttgataaaatgattgcatatattaaaaacattcataaaagcgaattcttggggaaaaataaaacggtggaaaacaatttggaaacattgaataataacgctttcattggctcatatttacgtgcaaacaaatctaaattcggccgtaatttggtgtctctgacggatgataaatttctcttcgtgcgaatacataaatggaattcatttttactccatacagtaatgaatgaaaataaattaccttga

SEQ ID NO: 1395 - DNA, 729 bp, Saccharomyces cerevisiae
atgttgcatttggaagatgacaatggacgacaaaggtcagtgatagcgaatttgcagaaattcgtttattgctgcctgtacttgaggtttatcaaagatggatcattattcttgatcctcctggggtggataatttcatcgctctgtgatttcattcaggaattgacactcaggtacctgaagaagaactatttagaggtgggccgcgacaatgatcaggaagatgatgaaagtcttgccatcagagggttagaaacacctattgtaagaatgataataaacaaagccatacgatattaccaaggcctaatacttctagaaacagcgtactgtatagtataccacattaggctagacgtatcgagagacatatgttccaaaccgtacggatttgtgataatgcttttgataagggaatttacttgtccggtacccacagcgtttcctagcaagctacttctggtactactcgatattttattacttttctgccagattgtaataataaacggctcactgagctcgagtcttcagaacgtgaaacttattgtcaaggagttgaatgcagaagaagagggcgcactcaacattctcaaacttaatacctggcacatggatgcaaccggaccggaactcatagtactcaagaatcatgacaagtcgattcctcaacaggcagacggggatgacgctacagagatcactcctctactgaatatcgccgaataa

SEQ ID NO: 1396 - DNA, 730 bp, Saccharomyces cerevisiae
atggcatcattacccaagagaataatcaaggtatgttcaaacaagagcagtggattatatacgaaatctgaagtgacgttttcgtctgagccgtcacactctacactgtttcctcttgataatggctagaacttacatactaacgcaaaacttccaaaacaagaaggctttttttgtccagtttgtagcagcgttccgccttccctttgtccatatccgcaaacgctcatatggagggaattcaacagaacaaactactagggcagaaaacgcaaagtctttgtgaactttcatataggaaactgagaaattagtaagtgacccagtacctggcattacagcagaaccacatgacgacaacttacgttacttccaagtaacaatcgaaggcccagaacagtcaccatatgaagacggtattttcgaattagaattatatctgcctgacgactatccaatggaagcaccgaaagtacgttttttaaccaagatatatcatcccaatattgataggttgggccgtatatgtcttgatgtgcttaaaactaattggtcacccgctttacagatcagaaccgtcctgctgtccattcaagcactgttggctagccctaatcctaatgatccgctagctaatgacgtcgctgaagattggataaagaatgagcaaggtgccaaagctaaggctcgcgaatggacgaaattgtatgcaaagaagaaacccgagtga

SEQ ID NO: 1397 - DNA, 732 bp, Saccharomyces cerevisiae
atgactgtacaaattccaaaattattatttttacacggcttcttgcaaaacggtaaagttttctccgaaaaatcatctggtattagaaaattattgaagaaggctaatgtccaatgtgactatattgatgcaccagtccttttagaaaagaaggacttgccatttgaaatggatgatgaaaaatggcaagccaccctagatgcggatgttaacagagcctggttctatcacagcgaaatctctcacgaattggatatctcagaaggtttgaagtctgttgttgatcacatcaaggccaatggcccatacgacggcattgtcggtttctctcaaggtgccgcattgtcctctatcatcaccaacaagatctcagagttagttccagaccatccacaattcaaggtaagtgtagtcatttccggctattccttcaccgagccagacccagaacatcctggagaattgagaataaccgaaaaattcagagactcatttgcggtaaaaccagacatgaagaccaagatgatcttcatctatggtgcttctgaccaagccgtcccatccgtcagatccaagtacctgtacgatatttatttgaaggcgcaaaatggtaataaggaaaaggtgttggcttacgaacaccctggtggacatatggttccaaacaagaaggacattatcagaccaattgttgaacaaataacctcttccttacaagaagcttctgaataa

SEQ ID NO: 1398 - DNA, 732 bp, Saccharomyces cerevisiae
atgcaacaaacaaaatttggcaagatgtatttggaccacgattcggtagttgagtactcagaagatgaaattgtcgaagccgatcgtattacattgggctataaaaagagattgtcaatgattgaaaatcaaatgcgacatcttttggaggattttagtttggacgttcagcagattgaacccattcttgccgacttgcagaagtactacgacgcgtttctacaacttttacagaaaaggaacaaatcattacaatgtaagaggtccactcaccagccggtcccatccccaatgaatagccagacatcaacaaatgcaaaggttaatttgagcggaaagcttatgaagtttcagctaaatagtgtacaaaagttcgacgaagaaaatatactaaggattctgcaaaataaaatagaattcgaacattatttccaaattgataaaggtaagaagcaaaaggtgctattacttgccgtatatcaatgcctcaatgggccaacacgtttgcataaagtgcttaatattgagggaattatacataataatagtatcagaactatactgggcaaacaagtgtccagttctaagtggacagtgtttctgtacgatgtaaaactagttttattggcgcatagacaagatgttccgaacttagaaactagcaagatgatcgtcagatatggtgatttatttccctgtgcattgtacttcaaagatcatacagcatactaa

SEQ ID NO: 1399 - DNA, 732 bp, Saccharomyces cerevisiae
atgcataacatccaattagtgcaagagatagaaagacatgaaaccccgttaaacattagacctacctctccatacactttaaaccctcctgtcgagagagatgggttttcttggccaagtgtgggtacaagacaacgtgcagaggaaactgaagaggaggaaaaggaacgaattcaacgcatttcaggcgctatcaagacaattttgaccgaactgggtgaagatgtcaacagagaaggtctactagatactccacaaagatacgctaaagccatgctttatttcactaaaggttaccaaacgaacattatggacgatgtcattaagaatgctgtctttgaagaagatcatgatgaaatggttattgttcgtgatattgaaatttactcgttatgtgaacatcatttggtgccatttttcggcaaggttcatatcgggtatataccaaataaaaaagtcatcgggttaagtaagttggccagattggcagaaatgtatgcgagaaggctccaagttcaagaaagacttacaaagcaaattgcaatggccctaagtgatattctaaaaccattaggtgtagccgttgttatggaagcttctcatatgtgcatggtttcaagaggcattcaaaaaacgggatcttctacggtaacttcttgtatgcttggagggtttagggctcataaaacaagagaagagtttttaactcttttaggaagaagaagtatttga

SEQ ID NO: 1400 - DNA, 732 bp, Saccharomyces cerevisiae
atggctagaaatagaacaacctccaagaaaaatgttcaaagtaaacgcttaatagacagagtggttcccatggacaagattaaaaaagttggcgtagcgaaaaaaaaaaccgtagaacacactaaagaaggatttagcgttgtcaacggtaagctagtaagcagcaatgacgtcggtgtactgttaagagaagcacagggtgctatcgataaaagaactaatgtttcccaaagaaataggaaaaagggaataaagaataataggccccacaaagacataaacagcagtcctgactggggcaatgcccacagaggaaccgattggcagagcgaaaaagcaaacggcatgaacagggccaagaactctcggaattttaccactaatattaaattgcagcgacaacattttggcgaagaaatacaaggtggcagccagcttgtgatatctacaaattcagatgcttcagataaattgttaatgctattcaacctaactttgggagtaaaccaagaaaacttgaaaaatgttctggaaaacatttctcaggtgcagatagctcaaattagggttagagacctgccttcaggatctgccaccgctaaggtccgtctggcatatcctacaacacagtctttggagaaggtaagaaaactgttccatggcgctctagttgatggaaggcgcatccaagtggtgattgcatctgatgaatcgtcccacttgtcgtattag

SEQ ID NO: 1401 - DNA, 734 bp, Saccharomyces cerevisiae
atgggaaaatcagcgtatgtaaagctggagcgtccttcgtggcgcatcggaatttcttcaattgaactacctgttgctaacaacagttttttttttctctcttttatgtatatagcgttatattcgtggaaagagccactcccgctacactaacggaactgaaggatgctctctcgaatagtatcctgtccgtgcgagacccttggtcgatagactttcggacgtaccggtgctctatcaagaacctacccgcggatgtctccaagctcatgtactcgataacgttccaccaccatggccggcagaccgtgctaatcaaggacaactcagcgatggtgacgactgccgcagcggcggatatccctccggcgctggtgttcaatggctcatctacgggcgttcctgagtccatagacactattttgtcgtccaagctgtccaacatctggatgcagaggcagctcatcaagggtgatgccggtgagacgttgatcttggacgggctcaccgtgcgactcgtcaacctcttctcctccactgggttcaagggtctcctgatagaactgcaggcggacgaagcgggcgagtttgagaccaagattgcaggcatcgaaggacacctagctgaaatccgggccaaggagtacaaaacctcatccgactcgttggggccggacaccagcaacgaaatatgtgatttggcgtaccagtatgttcgtgctctggagctgtga

SEQ ID NO: 1402 - DNA, 735 bp, Saccharomyces cerevisiae
atgactgtggttgaaataaaaagccaggaccaatttacgcaactaaccactacaaacgctgctaataaactcattgtcttatattttaaagctcaatgggctgatccttgcaaaactatgagccaggtgctagaagctgttagtgaaaaagttaggcaagaggatgtccggtttttatcaatagatgcagacgaacatccagaaatatcagacctttttgagattgcagccgtaccatacttcgtcttcattcaaaatggtactattgtaaaagaaatatcagccgcagatcctaaggagtttgtgaaaagcttagaaattctttcgaatgcttctgcctcactagcgaacaatgccaagggtcctaaatctacgtctgatgaggaaagcagcgggtcttccgatgatgaagaggacgaaactgaagaagaaataaatgctaggctggtgaagctagtacaagctgcacctgtgatgctattcatgaaaggaagcccatcagaacctaaatgcggattttctagacagttagttggtatcctcagagaacaccaaataaggttcggattttttgatatattaagagacgaaaacgttagacaaagcttgaagaagttttctgattggcctacttttcctcagttatatatcaatggggagttccagggaggtttggatattatcaaggaatctatagaagaagatcctgaatatttccaacatgctctacagtaa

SEQ ID NO: 1403 - DNA, 735 bp, Saccharomyces cerevisiae
atgagcatgagtatgggtgtccgtggcctagcgttaaggtccgtttctaaaacattatttagccaaggtgttcgttgtccttcgatggtgattggagcccgttatatgtcttccactccagaaaaacagacagatccaaaagcaaaggctaactctatcatcaatgccattccaggtaataatattttgacaaagacgggggttttggggacttctgctgccgctgtcatttatgccatttccaatgaattgtacgttatcaacgatgaaagtattttattgctgacttttttgggtttcactggtttagtggcaaagtatttggcgccagcatataaagattttgccgatgcaagaatgaagaaagtctccgacgttttaaatgcctcgagaaacaagcatgtcgaagctgttaaagatagaatcgactctgtctctcaactacaaaatgttgctgaaactacaaaggttttgtttgatgtttccaaggaaactgttgaacttgaaagcgaagcctttgaattgaaacaaaaggtagaattagctcacgaagcaaaggcagtcttagattcgtgggttagatatgaagcttccttgcgtcaattggaacaaaggcaactagcaaaatctgtcatctccagagttcagtcagaattgggtaatccaaaattccaagagaaagttttgcaacagtctatatctgaaattgaacaattgctttctaaattgaagtaa

SEQ ID NO: 1404 - DNA, 735 bp, Saccharomyces cerevisiae
atgccagcattattaaaaagattattgtttcaagtgggtcctcatccaaacgaaagaacattcaccttatcctctgtttcaactgatgggcactatatttccttgagaccatttgttaagccaagcggtgatgagttatcttttcctttcgaatgggcctttgccggtacaaacgaaacagttaaagctaatgatcaaggaaacggtgtcgttactcaagatttcaatttctggttggatacaaatgtgtacttgaacgttccaaacacccatcgtggcgaagtgaacaccacttggaaaaattgggattctggttgtgtcgaggaaacaggcgctgtttacccattcggtgccgacaaagaaagcgtctctttcagagaattgtggcaaccagttgacccatcaagagaagatctagtcatcgtctcaccaaacaatgagaagttctcgtcgaatgctaggtcaattgtcctcaaagttactgacgaagcttatgatggtttggttattgttattggtagatggattcaagggtttttgtcccaaaagaataataacactattgaaggcttgaacttcatcagattacttgaaaaagattcaggtaaatctgagttcttattaagctacggtaaggaagtaaacaaaattccacaaagctacgaaaatttgaagaaaggttccactgtaaccagcaatgggttgaactgggaagttattgaatatcacgcttaa

SEQ ID NO: 1405 - DNA, 735 bp, Saccharomyces cerevisiae
atgcttagtaatacacttattattgcctgtttattggtgatagggacaaccatagcgctaatagcagtgcaaaaggcatcctccaagacagggatcaagcaaaaaagttatcaaccatctattatcattgcaggtcctcaaaattctggaaaaacgagcttgcttacgctgctaaccacagattcagtaagaccaactgttgtttctcaagaaccgttatcagcagcggattacgatggttccggcgtcacgttagtggacttcccaggccatgtcaagttgcgttataaactctcagattatttgaaaacaagagccaaatttgttaaagggttgatatttatggtagactcaacagttgatcctaagaaattaacaacaacagctgagttcttggtagacatattatcaattactgaatctagttgcgaaaatggtattgatatcttaattgcatgcaataaaagcgaattgttcactgcaagaccaccatcaaagatcaaggatgctttagaaagcgaaattcaaaaggttattgaaagaaggaaaaaatcgttgaacgaggttgaaagaaaaattaacgaagaagattatgcagagaatacactagacgttttacagtctaccgacgggttcaaatttgcaaatttggaagcatctgtagttgcttttgagggcagtattaataaaagaaaaatttcccaatggcgcgaatggatagatgaaaaactgtaa

SEQ ID NO: 1406 - DNA, 735 bp, Saccharomyces cerevisiae
atggaaacaagaatacttgttgtgaatcctaatagttcgaagtcaatgacggtgtccttgcgggaaaccattgaaaagactttttcaatggaatcatgtaaaatcagttatttcacagggccagacacgtcgccaccacaaattgatgggcaggaaacaagtattaaaagtatggaggcctgtcttcccctcttaattgatgaccaggagtcggtatattactttcagaaattcaacgggatattaattgcctgtttttcagatcatcctttggtagcaaagataaaggatagagctgctaaagaaaaagcagatgtttctattgttgggttattagatagtagtattaattattgcaatttggttggaaagaagttctctattattacttcaaataaagaatggattccaatattgaataactctgtggaatcgaaattcttgacagggaatacagttaacaaaaatttatggaaaggtacggtatctactgatttacaggtcctcgacctacatagtccagaaaatttccagcagatagcagaaattatatatcgcgaaaatattaaaaagcttgattcagacattgtaatattaggttgtgcaggattctcgggtttgcaaaataaactggcgaaaacattccaaagggatggcacgctgtttctggacacgattgagatcggtttacagattctaatcactatgataagatttgtcaactcacaaaaataa

SEQ ID NO: 1407 - DNA, 735 bp, Saccharomyces cerevisiae
atgtctgctgttgaaatttcccctgacgtgttggtgtataagtctccattaacggagcaatcgacagaatacgctagtatttccaacaattcagaccaaaccattgcatttaaggtcaagaccacagccccaaagttttactgcgtgagaccaaacgccgcagttgttgctccaggtgaaacaatccaggttcaagttatcttcctgggtttgactgaagagcctgccgcagactttaagtgccgtgacaagttcctggttatcacgttgccttctccttacgacctcaatggcaaggctgttgcagatgtttggtccgacttggaggctgagttcaagcaacaggctatctctaaaaagataaaagtcaaatatttgataagtccagatgtacacccagcacagaaccaaaatatacaggaaaacaaggaaactgttgaaccagtagtccaagacagtgagccaaaggaagtgcctgctgtggtaaacgaaaaggaggtccctgctgaaccggaaactcaacctcccgtccaagtaaagaaagaagaggtcccacctgtcgttcagaaaaccgttcctcatgaaaatgagaagcaaacgtccaacagcactccggccccacagaaccagataaaggaagccgcaaccgtacctgcagaaaatgaatcatccagcatgggtatattcatattggttgcactccttatcttggttttaggatggttctacagataa

SEQ ID NO: 1408 - DNA, 735 bp, Saccharomyces cerevisiae
atgtcttcacaagatgttctgatacattcagatgatccgtgccatccagcaaatctcatttgcacgctatgcaagcagttttttcataataattggtgcaccggaactggaggtgggatttcaataaaagatcctaacacgaattattattatctcgccccatctggggtgcagaaggagaagatgatacctgaggatttgtttgtcatggacgctcagacattagagtatttgcgctctcccaagctttacaagccaagcgcatgtactccattgttcttagcgtgctaccaaaagaaaaatgcaggtgctataatacatacacactcccaaaatgctgtgatatgctccttgctatttggcgatgagttcaggattgctaacatcgaacaaatcaaagcaattccaagcggaaaggtggaccctgtgaccaagaaacccatggcgctatcgttttttgatacgctgaagattcccatcattgaaaacatggcgcatgaggacgagttgatcgatgacttgcacaagacttttaaagattatccagacacatgcgccgtaattgtgaggagacatggcatttttgtttggggtccgacaatcgataaggccaaaattttcaacgaagccatcgattatttgatggagctggccataaagatgtaccaaatggggattcctcccgactgtggcattggcgaagagaagaagcatctgaagatggccagtccgtga

SEQ ID NO: 1409 - DNA, 735 bp, Saccharomyces cerevisiae
atgtctttgacaccactgtgtgaagatttaccacaatttctgcaaaactatctaccgaatgctggtcaaacggaaaataccattgtgccctttgtcacactaacttatgctcaatcgctcgacgcgagagtatctaggggccctggagtgaggactacaatttcacatcccgagaccaaaacaatgacgcattatttgagacatcatcacgatggaatactcgtaggaagtggaacagtgctagctgataatcctggattgaattgtaaatggggtcccgatccggctgcaaattccccaaggccaataataatagatacaaagcaaaagtggcgatttgatggttcaaaaatgcaagaactttttattaaacgacagggtaagccgccaatcgttgttgtcacaagtgagcccattataaaagaacaacatgtagactacgcaatttgtccaataaatgatactacgaaattggtcgattggaagaaattgtttgagatattaaaagaagaattcaatataaggtcagtaatggttgaaggaggtgccaatgtaataaatcagttgttgctgaggagcgatattgtcaacagtcttataataactattggatcaacatttctgggtagctcaggcaccgaagttagcccaccccaaacagtaaatttaaaggatatgtcatggtggaagggcattaccgatgtggtgctttgtgcgagactggccgatgactaa

SEQ ID NO: 1410 - DNA, 735 bp, Saccharomyces cerevisiae
atgtttaaaagaatcgcaatagcccagataagaacgtatacaaatggcgttgttttcaagacagcctctaaacccaaaagaagatggattccatggacaatttttgggggaagttttcttggagggtggtacttgacacagcatatgacgttcacggacttactagcttattggagatatgatgccctacccaagaacgcagatgaagtcgtcaaatatcacgctgatctgaatagacgtttaaatggcctacccatagtaaaacagttggagaatgctggttttgtacaagtgattgctaatgaagaggagaacttgttagtgtcaagggcattaaatacaccaggtggcgtcgctataccaccaagagtttactacaaccccagtaggcgtgaaactgtcgggctataccatttaggaatgaaacttactggttatcctttcttaattcacggaggcattttagcaacagttattgaagatttaatgaaggaggccattagactcgaaaaaggaacaaaaaatataaaccaagaaaccaagaatttgagtatctcgtacaagttccccacgttagctaatcaatttgttgtagtaagaaccaccgatcttcagcaatacggtaacaaaactaaattaaaggctgaacttatggaccaaagtggcaacaggacattggtcaaagctaatgccacgttttctagcgaacaagggaatccaaaagaagaaaaatag

SEQ ID NO: 1411 - DNA, 738 bp, Saccharomyces cerevisiae
atgaatagatgggtagagaagtggctgagggtatacttaaaatgctacattaatttgattttattttatagaaatgtatacccacctcagtcattcgactacactacttaccagtcattcaacttgccgcagttcgttcccattaataggcatcctgctttaattgactatatagaagaacttatactggatgttctttctaaattaacgcacgtttacagattttccatctgcattattaataaaaagaacgatttatgcattgaaaaatacgttttagattttagtgaattacaacatgtggataaagacgatcagatcattacggaaactgaagtgttcgacgaattccgatcttccttaaatagtttgattatgcatttggagaaattacctaaagtcaacgatgacacaataacatttgaagcagttattaatgcgatcgaattggaactaggacataagttggacagaaacaggagggtcgatagtttggaggaaaaagcagaaattgaaagggattcaaactgggttaaatgtcaagaagatgaaaatttaccagacaataatggttttcaacctcctaaaataaaactcacttctttagtcggttctgacgtggggcctttgattattcatcagtttagtgaaaaattaatcagcggtgacgacaaaattttgaatggagtgtattctcaatatgaagagggcgagagcatttttggatctttgttttaa

SEQ ID NO: 1412 - DNA, 738 bp, Saccharomyces cerevisiae
atgacaatggaaaaaaatggaggtaatagcagccgtggtggccaagtaggcggcaagtctgtgtgtgtttactgcgggtcttcatttggcgctaaggcgctatactcagaaagtgcagaagaattaggagcccttttccataagctgggatggaaattggtatacggtggaggcactactggtttgatgggcaagatagcaaggtctacgatgggacctgatttaagcggacaggttcacggtatcattccaaatgcacttgtgtctaaggaaaggacagacgaggataaagaagatgttaataaagcattgttggagtctgtagaaaatcataagggcgccactcctatttctgaagagtatggggaaacaacgattgtaccagatatgcatacgagaaaaagaatgatggcaaatttgagtgacgcgtttgttgctatgcctggtggatacgggacttttgaagaaatcatggaatgtatcacgtggtcgcaactggggattcataataaaccaattatcttgttcaatatcgatgggttctatgacaaattattggagttcctcaaacactctattcaagaacggttcatcagtgtgaagaatggtgaaatcattcaagttgcctccactccgcaggaagttgttgataaaatagagaagtacgtcgttccagagggccgtttcaatttgaattggagcgacgaaggtcacgctcacgaggattgtgctaaataa

SEQ ID NO: 1413 - DNA, 738 bp, Saccharomyces cerevisiae
atgagacaacgaaggtctgtagtagcagttagcgtaaagcccaaaggcttcaaattggggcataaacagggttccatgtctacgacgtctccacctccatcctcaccagatggaaatgtgagtacatcaggaccgtcagctattaagttatccaagaattgggagttaccacagcgcctaaaaccgggccgcaaaccgaaatccaagcgcggggatgcatcagctaataatgatggatcgtccaagataaagaaggttcaaacttccaaccagaaagaccaaatgaccacaaaagatcatgagaacgaaggcgcaaaaggtcatgaggggaaatctgatgatgaaggcaacggaagtggtgatgaaaacggtgtcgatagcgtggaaaagcgaaggaggcaaaatagagatgcgcaaagagcatatagggaacgcagaacaacaagaatccaggttctggaagagaaggttgagatgctacacaatttggtcgatgattggcaaaggaaatataaactgctggaatctgagttttccgatacaaaggaaaacttgcaaaaatcaatagcattaaacaacgaattgcaaaaagccttgcctttgattgttaatactccatttcaacagcagccagaaaacccgccagacaatcctatttcgatattagaaatggtagaaaactttaaaccaatcggcgctgtcagtttaaaaaaaggaaagctgaaggcccattgttaa

SEQ ID NO: 1414 - DNA, 738 bp, Saccharomyces cerevisiae
atgccttatacttggaagtttttaggaatcagcaagcaactttcactggaaaatggtatagcaaagttgaaccaattgctaaacctggaagtagatttagacattcaaaccattcgagtacccagtgatcctgatggtggtaccgccgctgacgagtatatccgttacgaaatgaggttggacatctctaatttagatgagggcacttactctaagttcattttcttggggaactcaaaaatggaggtgccgatgtttttgtgctattgcgggacagataaccgcaatgaagtggtattgcagtggctgaaggcagagtacggtgtcattatgtggccgataaaatttgaacagaagaccatgataaagttagctgacgccagcattgtgcacgtaacgaaagagaacatcgaacaaattacctggtttagctcaaagttatattttgaaccagaaacacaagacaaaaacttgcggcaattcagtatagaaataccgagagaaagctgtgagggtttggctcttggctatggtaatactatgcacccgtataacgatgcaattgtaccctacatttataatgaaacggggatggcggtggaaagattaccgttgacttccgtcatattggcagggcacacgaaaataatgagagaatccattgtcacttcaacacgaagtctcaggaacagagttctagcagttgtactccaatcgattcagtttaccagcgagtaa

SEQ ID NO: 1415 - DNA, 738 bp, Saccharomyces cerevisiae
atggcatgtactaatgatggtcctaataaatatcccgaaattgtgagtgttaagcacctgttccaacattcgggatccaagcatgaatttagtgctggtaaacgattttcaaaatccattggtaaaatattcaaacgaaactctgctttgaaaacttctagaactgaaacggcaaatcataaaatggaattgaaaaaaagagagggtgttaccttattgccacctgtcccagaatcattattacataaactcaattcttggttggaaactttttcttccaccaagaacatgaaaatcgaagaaaacaaaattgttattaatgaaaaagagattcgggattcagtctcttactaccctgataagaatggaggaagtgctgtattttgttacttgcccgaccttgtgctatattataagccgcctataaaagtcacaggcaagcaatgtccaataaagagaagtccttgggaatcgatggaaatccaatatcaaaagtttatgtaccccttagaaaggttggaaagacagtttgaggaagttccatttaggccctggtattttgcaatgcgattaaaggaactttacagatgctgtgaaaggtcttttactaacgcggcaaatagaggaaaggcaaggttattgcgggggaagcaaaggacgaaaaaatcgtatcataagactgtcaacctggtatcagcgaagatttccacccattcaaatgcgccgtcgccgggctga

SEQ ID NO: 1416 - DNA, 738 bp, Saccharomyces cerevisiae
atggctacaccaagcacgggagcaaacaattctatacctgcggtacgaaatcaggttgaagttcaggttggattagtaggggatgcacaagtagggaaaacatcgctgatggtgaagtacgtacagaacatatacgataaggaatacacacagacgctgggagtgaactttttgaaaagaaaagtaagcatacgctccacggatattatattttctataatggatttaggcggacaaagagaattcatcaacatgctcccaattgcgacggtagggtcttcagtgatcatatttctgtttgacctgacacgtccagagacgttgagttcaataaaggagtggtataggcaggcgtacgggctaaatgattcggcaattcctattttggtgggcacaaagtacgatttactaatagacttagacccggaatatcaggaacaaatctcgagaacgagtatgaagtatgcacaggtcatgaatgctcctcttatattctgctctactgccaaatctataaacattcaaaaaattttcaaaattgcactggcaaagatctttaatttgacattaaccatcccagaaatcaatgaaatcggcgatcctcttttgatatataagcacctaggtggccagcaacatcgacatcataacaaaagtcaggatagaaagagccataatatcaggaagccctcctcgtcgccctcatctaaggcaccatcgccgggcgttaatacatga

SEQ ID NO: 1417 - DNA, 738 bp, Saccharomyces cerevisiae
atggctaccaggactcaatttgaaaactccaatgaaatcggtgtattctccaaattaacgaatacttactgtttggttgctgttggtggttctgaaaacttttactctgcatttgaagctgaattaggagatgctattcccatcgttcataccactattgctggtacgcgtatcatcggtagaatgaccgcgggtaaccgtagaggtctgctagttccaacccaaactactgatcaagaattacaacatttaagaaatagtttgccggattccgttaagattcaaagggtagaggaaagactatctgccttgggtaacgtcatctgttgtaatgattacgttgctttagtgcatccagatatcgacagagaaactgaagaattgataagtgatgtactaggcgttgaggtcttccgtcaaaccatatcaggtaatatcttagttgggtcatattgttctttaagtaatcaaggtgggttagtgcatccacaaacaagtgtccaagatcaagaagaattgtcctccttattacaagttcctttggtggctggtaccgttaaccgtggtagttcagttgtcggtgccggtatggttgtgaacgattacttggcagttacaggtctggatactacagccccagaattgagtgttattgaaagtattttccgcttgcaagatgcccaaccagaatccatttcaggtaacctacgtgatactttgattgaaacctactcatag

SEQ ID NO: 1418 - DNA, 738 bp, Saccharomyces cerevisiae
atggctctacctctgataaaacctaaggagtctgaggaaagccacctcgctcttttgtccaagatccacgtgtccaaaaattggaaactgcctccaaggttgccccatagagcagctcagcggaggaaaagagttcatcgacttcacgaagattacgaaactgaagaaaatgatgaggagctacagaagaaaaaacggcagaatagagacgcccaaagggcctacagagaacgcaaaaacaacaagttgcaagtgctggaggaaaccatagagtcactgagtaaggtcgttaaaaactacgaaacgaaactaaaccgcctccaaaatgaacttcaagcgaaagaatcggaaaatcatgcccttaaacagaaattggagacccttactctgaaacaagcctctgtgcctgctcaggaccctatcctgcagaatttgatcgagaatttcaaaccaatgaaggcgatacctattaagtacaataccgctatcaagcgccaccagcactcgacagaactgcctagctctgtcaaatgcggcttttgtaacgacaacactacttgcgtttgtaaagaactggaaacagatcaccgtaaaagtgacgacggtgtggccacagaacagaaggatatgtcgatgccacatgcagagtgcaataataaagataaccccaatgggctctgtagtaattgtactaatatcgacaaatcatgtatcgacatccggtccatcatccactga

SEQ ID NO: 1419 - DNA, 738 bp, Saccharomyces cerevisiae
atggctgaaacttccaacgacccctttctgtcctacgttttgagtagcaaacaattaactaatttgaatcgtctacgaaggaaagcagttacaaaacaactgggatcaagtgacgacaataaggtctcagaggagtttttgaggtatcaacatacttatcaaagagaagcatttgaatatctgcaaacaaaacatgacgcccacaaaataatggagtcacagtacgaacagtaccaaagcagttcaaaaacaagaagatatagtatcgatttagattctgtagatgcagttgacacggaatcgcaaacagaatacccaaatgaggagtttattgatagaaacgaagatagcgaagctgttatggagttgagaaagagattgttggggaagggacagaataagggtttaggatatgaaactacgaaatcagtcgataggcaaattgaggaccaggacacgttgcaacaggatttgattcaggatatgagcaaacttgtgggcagtttgaagcaaggagctgtggcatttcaatcagcacttgatgaagataagcaagttcttggagctgcagagataggtattcaagttgcttctcaaggtttaatggatgttagcggtaaattaaggaaatatgacaagagtaaattgagttacttgttttatattactgttttcatttttatgattctcggactggtgtttacatttatcataattcaattattcccggccctataa

SEQ ID NO: 1420 - DNA, 740 bp, Saccharomyces cerevisiae
atgagtactttagcggaagtaagtttttgaattatgcccccactttttttttgttcatggtgactaacatgaattaggtttatactattattgaggacgccgaacaggaatgtcgaaaaggagattttacaaatgcaaaagcgaagtatcaagaagccattgaagttttaggtccgcagaacgagaatttgtctcaaaataaattaagttctgacgttacgcaagccattgacctattaaaacaggacattacagccaaaatccaagaattggaacttttgattgaaaagcagtcatcagaagaaaataatattggaatggtcaacaacaatatgcttattggctctgttattttaaacaacaaatctccgataaatggaataagcaatgctaggaattgggataacccagcatatcaggacactttaagtcccataaacgatccacttcttatgtcaattttaaaccgcttacaatttaatttgaataatgatattcaattgaaaacagaaggaggaaaaaattccaaaaactcggaaatgaagattaacttaagactggaacaattcaaaaaggagttggtattatatgagcagaaaaaatttaaagaatatggtatgaaaattgacgaaattacgaaagaaaataaaaaattggctaatgaaattgggcgattaagagaacgctgggacagcttagtagaaagtgcgaagcaaagaagggataagcaaaaaaactag

SEQ ID NO: 1421 - DNA, 741 bp, Saccharomyces cerevisiae
atgactacagatccttctgtcaaattgaagtccgccaaagactccctcgtctcctccctcttcgagttatcaaaagctgctaatcagacagcctcctctattgttgatttctacaatgccatcggcgacgatgaagaagagaagatagaggctttcaccactttgactgagtctttgcaaacattgacttctggtgtaaaccacttgcacggcatcagctcggagctggttaaccctattgatgatgataaagatgctattatcgctgctccagtcaaggctgtaagaagaaagatcgaacgtgatccaaatgctccaaagaagccactgactgttttctttgcttactctgcgtacgttcgtcaagaacttcgtgaagacagacaaaaggctggcttgccacctttatcctcaactgagattactcaagaaatctccaagaaatggaaggaattgagtgataacgaaaaagaaaaatggaagcaggcttacaacgtcgagttggagaattaccaaagagagaaatccaaatacttagaagcaaagaaaaacggtaccctaccaccagcttccttggaaaacggtccaactcatgcgccggttccaattcctttcagtttacagcacgccgctgaacctcctgtggaaaagagacctcacgatgatgatggatcttcggaaaagaagaagaagaagaagaagaaggataagaagaaggacaaatccaactcttctatttga

SEQ ID NO: 1422 - DNA, 741 bp, Saccharomyces cerevisiae
atgagcaaagacaaagatatcaaagtcactcctggaacttgtgaattagttgaacaaatactcgccttactctcccggtatctctcatcttatattcacgtgctgaacaagttcatcagtcatttgcgaagggtagctacgctacgattcgagagaactactttgattaaatttgttaagaaattgagattttacaacgattgtgtgttaagctataatgcatcagagtttatcaatgaaggtaaaaacgaattagacccagaggcggattcgtttgacaaggtaattttaccaatagcttcaatgtttgttaaatgtgttgaaacgtttgacttactgaactattatctaacgcagtcattacaaaaggaaattttatctaaaactttgaacgaggacctaacgctaacagcagagtccatattagccattgacgatacctacaatcatttcgtgaaattttctcaatggatgattgagtctttgcgtataggcagcaacctgctagatttagaagttgttcaatttgccattaaatgcgcagatgaggacggaacgaatatcggagaaactgataatatcttcttgcaggagattcttcctgtcaactccgaagaagaatttcagaccttgtcagctgcgtggcactccattttagatggtaagctgagcgccttggacgaagaatttgatgttgtcgctactaaatggcatgacaaatttggtaaattgaaaaactga

SEQ ID NO: 1423 - DNA, 741 bp, Saccharomyces cerevisiae
atgccacaattttcagtagatctttgtctttttgacctagatgggactattgtcagcacaacaactgcagcggaaagtgcctggaaaaaattatgccgtcagcatggggttgatcctgttgagttattcaagcattcccatggtgcaagatcacaagaaatgatgaagaaattttttccaaaattggacaataccgataataaaggtgttcttgcgttagaaaaggatatggcagataattatttggacacagtaagccttatccctggtgcagagaatttattgttatcgttagatgtagatactgagactcaaaaaaagttacctgaaaggaaatgggctatcgttacctctggttctccatatttggcattttcatggttcgagacaatattgaaaaatgttggaaagcccaaagttttcattactggatttgacgtgaagaacggtaagcctgatcccgagggttactcaagagctcgtgatttattgcgtcaagatttgcaattaactggtaaacaggatctgaagtatgttgtctttgaagatgcacccgtgggcataaaggccggcaaagcaatgggcgcaattactgtgggtataacatcctcgtatgataagagcgttttatttgacgcaggtgcagattatgtggtctgtgatttgacacaggtttccgtggttaagaacaatgagaacggtatcgttatccaggtaaacaaccctttgacgagagattaa

SEQ ID NO: 1424 - DNA, 741 bp, Saccharomyces cerevisiae
atggagagtatatttggtgggtttggagatctagttgttcctaggccaaaggagcatctcggtcaaacagacctttccttcggtggaaaattattgcctgcattgaaaatttgtgaagatggcggtgaaagtggttgtggcggtaaagtctggatcgctggcgaactgttgtgcgagtacatactcgagaaatcagttgaccatctgctaagtaagacggtcaatggtacgaaacaatttaaaaaagtcttagaattgggtagtggtacaggtttagttggattgtgcgtggggttgttggaaaaaaacacattccacgatggcactaaagtatatgttacggacattgacaagttgataccactattgaaaagaaatatagaactggacgaagttcagtatgaagttcttgcgagggaactttggtggggtgagccgctgtcggcagatttctcacctcaagaaggtgctatgcaagcaaataacgttgatctagttttggcagctgattgtgtgtatctcgaggaagcttttccattactagaaaaaacactacttgatctcactcactgcataaacccacctgtaatcttgatggcttacaagaagagaagaaaagctgataaacattttttcaacaagattaaaagaaattttgacgttcttgaaattacagattttagtaaatttgaacattatcttaaggaaagaacccacttgtttcagcttatcaggaagtaa

SEQ ID NO: 1425 - DNA, 741 bp, Saccharomyces cerevisiae
atggcagaattttcagctgatctatgtctttttgacctagatggtaccatagtgagtacaacagtggccgcagagaaagcatggaccaagttgtgttacgaatacggtgttgatccttccgagttatttaagcattctcatggtgcaagaacacaagaggttttgagaaggtttttccctaaattggatgatacagacaataaaggtgttcttgctctagaaaaagatattgcccatagttacttggacacagtaagccttattcctggtgcagagaacttactgttatcgttagatgtagatactgagactcaaaaaaagttacctgaaaggaaatgggctatcgttacctctggttctccatatttggcattttcatggttcgagacaatattgaaaaatgttggaaagcccaaagttttcattactgggtttgacgtgaagaacggtaagcctgatcccgagggttattcaagagctcgtgatttattgcgtcaagatttgcaattaactggtaaacaggatctgaagtatgttgtcttcgaagatgcacccgtgggcataaaggccggcaaagcaatgggcgccattactgtgggtataacatcctcgtatgacaagagcgttttatttgacgcaggagcagattatgtagtctgtgatttgacacaggtttccgtggttaagaacaatgaaaacggtattgtcatccaggtaaacaaccctttgacaagggcctga

SEQ ID NO: 1426 - DNA, 741 bp, Saccharomyces cerevisiae
atggcatctaatcaacctggcaagtgttgctttgaaggagtttgtcacgatggaacacccaagggtcgtcgtgaagaaatcttcggtttagatacttatgcagcaggctctacatctcccaaggaaaaagttatagttatcttgacagatgtgtatggcaataaattcaacaatgttttattaacggccgacaaatttgctagtgctgggtacatggtctttgttcccgatattttattcggcgatgctatctcatcggacaaaccaattgatcgtgatgcctggtttcaaagacattctcctgaagtcaccaagaaaattgttgatggattcatgaagttgttaaaacttgaatatgacccaaagtttattggcgttgtgggttactgttttggtgcaaagtttgccgtccaacacattagtggcgacgggggtcttgccaatgctgcagccattgcacatccatctttcgtcagcatcgaggaaattgaagcaattgatagcaagaaaccaatattgatttcagcagcggaagaggatcacatctttccggcaaacttaagacacttaacggaggaaaaattaaaggataatcacgctacttaccagttagacctcttcagtggtgtggctcacgggtttgcagcaagaggcgatatatccatacctgccgtaaaatatgcgaaggagaaagtcttgctcgaccaaatatactggttcaatcatttttcgaatgtttaa

SEQ ID NO: 1427 - DNA, 741 bp, Saccharomyces cerevisiae
atgtcaagactagaaatatactcgccagaagggctacgtctcgatggacgtcgatggaatgaactccgccgttttgaaagttccatcaacacacatccgcacgctgcagacggttcatcctacatggaacaaggtaacaacaaaattatcactcttgttaaaggtccaaaagagccaagattgaaatctcaaatggatacctcaaaggctttattgaacgtatcggtaaacattacaaaattctccaaattcgaaagaagtaaatcaagccacaagaatgaaaggcgtgttcttgagatacaaacctccctggtgaggatgtttgagaagaatgtcatgctgaatatctaccccagaacagttatcgatatcgagatccatgtccttgagcaagatggcggtattatgggatctttaatcaacggtattaccctcgctttaatagatgccggtatatcaatgttcgattacataagtggtatatccgtcgggctgtacgatactaccccattattagataccaattcattagaagaaaatgctatgagtacagtgacactaggtgtggtagggaagtcagaaaaactttctcttttattggtggaagacaaaattccgttagataggttagagaacgttcttgccatcggcatcgcaggtgctcatagggtaagagatttgatggatgaagaactgaggaaacatgctcagaaaagagtcagtaacgcctctgctaggtag

SEQ ID NO: 1428 - DNA, 741 bp, Saccharomyces cerevisiae
atgtctacgttgaaagttgtttcatcaaagcttgcagctgaaatcgacaaagaattgatgggtcctcaaatcggattcactctacaacagctaatggagttagctgggtttagtgtcgcgcaggctgtatgtcgccagtttccactgagaggcaagacagaaacggaaaagggcaaacatgtatttgttattgctgggccaggtaacaatggcggggatggtctcgtgtgcgcaagacatttgaagctttttggttacaaccctgttgttttctaccccaagagaagcgagcgcactgaattctacaaacagctggttcaccaattgaattttttcaaagttcctgtcctgtctcaagatgagggaaactggctggaatatttgaagccggaaaagaccttatgcattgtagatgcaatatttggttttagtttcaagcctcccatgagagagccattcaagggcattgtcgaagaactgtgcaaagtgcaaaacattatcccgattgtttcggtggacgtccccacaggttgggacgttgacaaaggtccgatctctcagccctcaattaatcctgctgttcttgtatctctgactgtccccaagccatgcagctctcacataagggagaatcaaacaactcattacgtggggggaagattcattcctcgagatttcgccaataaattcggctttgagccatttggatatgaatccacagaccaaatattgaaactctga

SEQ ID NO: 1429 - DNA, 741 bp, Saccharomyces cerevisiae
atgtttcttaagacacctaattgggaaacggtaaatgagactcccaaatcgagagtcttaacgataaacgaattgatctctcccaacctggatactgaatctaacagccttctggcgacgccggcaaggaaatatttcaaaacttcaataagtgaagcgcaagattctcctacatctgccccttcgcccgatggcaatgaggatcccacatatcaatacaacgtacaatttcattttccaggaccaataacacctacaacacccaggtctaagaatgcagaaatgtttccatcccccacgcccccattggtttctcccacagcggttatcgaggaagagaatgacgattccgtacgggagttttcacgcacgctaaaatcaagactcaactgcgcaatggttaagctatcaaaggaacatgagcaagtagctttgattcctccacctccgacggaaaagatacgaaagggctcttatagtaataaatttgccgctaagcataggcgctgtcactcgttagatgaatccaaaaagtttctgagttctctggaagattcatccgctcatgcagcgttcttgaaggcaatttcgtccaaacatgccaaaagcaatagggtagacaacgttaacgtttcgccgttacgttggtcatctcatagaagaacgcaaagtacacaggagaattctttacaagaagttgttgctatcgatacattattgaagatgtcctcatcggactga

SEQ ID NO: 1430 - DNA, 741 bp, Saccharomyces cerevisiae
atgtttgctgcaattgcctcaggaaatccattgcaactatcggtagaagtccccaattcaaatgggttacagcatacaattgtcctttctcgaacgaaaccgaaactatactcgcatataacactgtttatattacctaatgttacctttcctcaggattatatagctacagtctatttcaaacttagccctcaggaagaatttaaactatttgggtacctaagcagtgagaaacccagtgccatattcaaagtgcaaataccgagctcgaagaaagacgctggagatacaagtgatggattaggtgagatagacatggatgtagatgatggttcgggggccgctgatccgtttactgacaccaatggaagtagcagtaataacatatcagaattgattattggtatttccattgagcctcgagaacaaggaatgatgaaattagaagagtggaaggccagcatgaatgccgaagcacaaaagaacaactcattgatcttgtcaagacctaacttaggaataattcgaaatattaccacggcagggcagttggcacaagtttacccttcattgacacaagaattggccgccaaaatcgttcagcatgcatataactatttatcagggttcctagatgctcagggaaacgtgcccatcaagaggtttgatacatggtgggacaaatttagaaatagactggccaacgacgggacgtttttggatgaagtaactaaaaattag

SEQ ID NO: 1431 - DNA, 743 bp, Saccharomyces cerevisiae
atgatcttaagcaaaacaaagaaacctaaaagcatgaataagccaatatatttcagcaagtttcttgtaactgaacaagttttctatgtatgcactctcatatgtttttttgtaccccattcgcaccattgcgttactaactatatggagaccttataatctctgcttctttacagaagtcaaaatatacgtatgcattggtaaacttgaaaccaattgtacccggacatgtactgatcgttccactgagaactacggttttaaacttatcagatctgaccatgcctgaatctcaagattatttcaagactttacagttaatacatagatttattaagtggcaatataaggctgactctatcaacgttgccatccaagatggacctgaggccggacagtcggtaccccacttgcatacacacattattccacgttataaaataaacaatgtaggggatttaatatacgataaattagatcattgggatggtaatgggactttgactgattggcaaggaagaagagacgaatatttgggtgttggtggtaggcaagcaagaaaaaataactctacatcggccactgtagacggggatgaactctcacaaggtcctaatgtcttgaagccagacagtcaaaggaaggttcgagctttaaccgaaatgaaaaaagaagctgaggatcttcaagccagactagaagaatttgtatcttctgatcctggtttaacacaatggttatag

SEQ ID NO: 1432 - DNA, 743 bp, Saccharomyces cerevisiae
atggtatgtctaataaaaccatcatggtacacaggactgaacactaacttatagacgggtgcgtgctaccctcttcttattattaggggccaaagagacagacagtatcactccaagagaaaaagaaccggattctgaacttttttcaagagacgtacacattctacaacatcaaggaattagagaaaagcatacctaaaaaatgcggaatctcacccatgatcgttaaagatttagtgcaacaaatgattgatgaagacggcgtcatttcggtggaaaaatgtggtaatattaacatctactggtgctttaaaaatcagacactgcaaaaattgtatgattcaagcgagttgataaaaaaaaagatacaggaagtaaagtgtgatattgccacttataaacaagaactagacaaaacgctagcaactggaaggcgtaaaaaatttacggtaggccaaaaatcatacaatagggaggctctactggaaaagagaaaaaaaattcaggatgaaattaagaaaaagagtaatagtctccaaaaaatagaaagcattagatgggatgcagcaaaaatacaagagaataaacaacagatccgcctaaaaaaagtgcatctggagaaaactactgataacattgagattctcattgattatttatacaagaaattctttttgaagccagaacagataagaaaagaatttggaattccagaagagttcaaggaatttacggaggtttaa

SEQ ID NO: 1433 - DNA, 744 bp, Saccharomyces cerevisiae
atgagtgagcaaagccaattagatgattcgactatagacaaactgattccacagattttcaatgagatgagatctaacctcaataacacgaccaataaatttccaaaaagcacaggaggtggagcaagcgataatatttcggctaacagcaattctataagatcgtttaattcaatcacaacgcaatccttactcaaagaatcagaatcgttagataaaataacagcaatgataaaaaatgttacggccgcattaaaaaataacttgccagtatacgttaatcaagtacatgaggtatgtaaatctacgaattccattttagattcatggatcaacattcattctcaagctggttatattcataaattgatgagcgatcaaacctatttaaagctaattaatgatagactgcacaatgaaaatgtaaacacaaatgatgaagatgggagtactttacacaacgtgatagcgttgaaaaagaaggagatcttggatttgagacaaaaattagaaaataggaagggtgaaaaggatgctgcaccagcaaagccaccaaatcaaggcttaaatccaaggtacggtgtgcaatctggtagaaggcccgttccttcggcaggaatttcaaataacggaagagtaagaaagacccatgttcctgcctcgaaaagacctagtggtataccaagagtaactaacaggtggactaagcccactgctagcagctcaaggaagatgtttcgctaa

SEQ ID NO: 1434 - DNA, 744 bp, Saccharomyces cerevisiae
atgccaaagttagttttagttagacacggtcaatccgaatggaacgaaaagaacttattcaccggttgggttgatgttaaattgtctgccaagggtcaacaagaagccgctagagccggtgaattgttgaaggaaaagaaggtctacccagacgtcttgtacacttccaagttgtccagagctatccaaactgctaacattgctttggaaaaggctgacagattatggattccagtcaacagatcctggagattgaacgaaagacattacggtgacttacaaggtaaggacaaggctgaaactttgaagaagttcggtgaagaaaaattcaacacctacagaagatccttcgatgttccacctcccccaatcgacgcttcttctccattctctcaaaagggtgatgaaagatacaagtacgttgacccaaatgtcttgccagaaactgaatctttggctttggtcattgacagattgttgccatactggcaagatgtcattgccaaggacttgttgagtggtaagaccgtcatgatcgccgctcacggtaactccttgagaggtttggttaagcacttggaaggtatctctgatgctgacattgctaagttgaacatcccaactggtattccattggtcttcgaattggacgaaaacttgaagccatctaagccatcttactacttggacccagaagctgccgctgctggtgccgctgctgttgccaaccaaggtaagaaataa

SEQ ID NO: 1435 - DNA, 744 bp, Saccharomyces cerevisiae
atgcctttgttagataccttcaagagttttattcaatcaccgacggaatcaaaggtgaaacaggctaccaacgaggacgaaacaagtggagcaacggggacgcttatgaacgaaatatcaatcttgacctacagccccaagacagtacgagaaatcatccaggtaatccggaagcgattgctacttgggcagaacagaagaaattctcatcgaaattgtatccaggtgatgaagacgctgactttggtctcatatctgatgaataacgggtccaatgaattcatcaagtggctgaaaggaaacatgatactaattgagatcctggaggattttcaggttcaggatcctcgggatgaacgtaaggcggaagatattcaaaagctaagcaggaacgttctggggctgctgcaagacgacgggttactagaaaaacaacgcaaggatgtaatacaattccgctcaagcatatcgactccgggcaggaagtccacggacaatagccatttgaagctggaggaaatgagaagcgagctcacgcgacaaagcttagaaaagaaagcaaagcctcccaccaccagcactagcttagatttccagagacaacggacaaggaatacgcacgaatatgcccgattctctttggatcccctggccgaagaagacagtgaagatacgcccggcgtggcgggtggaataagcaagctctcatttagacccaagtcttcaaataacccgttcagatga

SEQ ID NO: 1436 - DNA, 744 bp, Saccharomyces cerevisiae
atgctgcattgtgcgaggaggtatatgttagtcaggccacgtctcctgtggcaaagtgggacatgtgttgctcgtttccagtcgtcagtacgaacaccagctagcgaaccatcggcagagaaaggggtcgacgagtggcttgaagcgatcaacgagctaagggaagagttctctgcaaaagaatacctgccagagacctcgctggctccaccgggccagtccaaagtagacctcttacagggttcacaggcgggctccaagataaagccaactgcagagcagttggcacaatgggaggcactgaagtccgtgcccattcctccacgcaagaacgcaacgctggatcacatcacaaacatgatcatgcgccacggtaagaaggaaaaggcacaaaccattctgtccagggccttatatctggtgtactgccagacccggcaggaccccatccaggctttggaaaagtcactcgacgaactagctccgctgatgatgaccaagacattcaacacaggcgtggccaaggcttctgtcattcctgtgcctctgaacaagaggcaaagaaataggatcgcgtggaactggatcgtacaaagcgcaaaccaaagagtgtcgagcgacttcgccgtgcgtttgggagaagaactcactgccattgccaaaggcacttcgtctgcctttgaaaagagggaccagattcacaagacagccattgctcacagagcatatattcaattaaagtaa

SEQ ID NO: 1437 - DNA, 744 bp, Saccharomyces cerevisiae
atggtaaagattgcgataattacttactctacctacgggcacatagacgttttagcccaagctgttaagaaaggtgtggaggcagctggtggtaaagctgatatatacagggtcgaggaaactttacctgatgaagtcctcaccaagatgaacgctcctcagaaacctgaagatattcctgttgccactgagaaaacgttgctcgaatatgacgcctttttgttcggtgttccaactaggtttggtaatttgccggctcaatggtccgccttttgggataaaaccggtggattatgggccaagggctctttgaacggcaaagctgcggggatattcgttagtacttccagttacggaggtggtcaagaaagtaccgttaaagcctgtttgtcttatttagctcatcacggaattatctttttaccactgggttataagaattcatttgctgagttagccagtatagaagaggtacacggtggctctccatggggtgctggtacccttgcaggacctgacggctcaagaactgcgtctccacttgaattgagaattgctgaaattcaaggtaaaacattctacgaaaccgccaaaaaacttttccctgcaaaagaagccaagccctccactgaaaagaagaccactacttctgatgcggctaagagacaaactaaacctgcagcagctacaactgcagaaaagaaggaggacaaaggattattatcctgctgtactgtcatgtaa

SEQ ID NO: 1438 - DNA, 744 bp, Saccharomyces cerevisiae
atgtggagaacaaaaacgctagaatctatgctttgtagcccaatgaaatgttcatcgtctaacatagggggatcctatgcgcaatcttcaaaggaagtctcgaacacgaccaaaagggaagtgcatcttccaccttgttcgtcgattatgcacgctccacttactcctgaaataaaccaggccgcactaccacctcccgcttaccattacgcaccttcttctctgcatcagacagaggatcccgtatggagatcaagtcccaactctattatcttttcgccggttatagcaacaccgcaacctttccctttaacgttcgttgaacgtcaatcttgttgccctatttattcaacggcagcttcctcttatactgcccaatctgtacctccatcaatgcagcattttcaggaggaaaaccacagagcggtgagcaacgagcagtactccctcccgaatgtgcatatagggcaaaatcctgggacgctattatcccaaacacaaaccgacttagatcttatacaaaagcaactgcgcgctgtggtaaagctacggaaacaatgtcctatctgtgggaaggtttgttcgagaccttcaacactgaggactcattacttaatacatacgggagacacacctttcaaatgtacttgggagcattgcaacaaatctttcaatgtcaagagtaacatgttaaggcatttaagaacccatcaaaagaaaatagcaaagaaaaaacatcagtga

SEQ ID NO: 1439 - DNA, 747 bp, Saccharomyces cerevisiae
atgataagaaatcagggatggtcattactttacagaatttatccggtgcggaggttcacaagatactccagagtagatatgacttttgaaggaaacactcaagatatctctacttctgtcgaagaaagaatgaccactgtttttggaggacgcttaaagggtgaaccaccaagatccacaagtagagtgcttagcggcggaacgaagaaaatagcaggtgtccaagtgcctgcaaaaccacaagaacccgataactgttgcatgtcaggttgcgttaactgtgtctgggagatatatagcgaggatttaagagactggaaacatagaaggaaagaggctgcggaaaagatcgcaggaactaaggagaagtggcctaaagactggaatccacctttgggattgttacatatggaaaatgtccctgttgagttacgtgaaaagaagctggaaaccgatagcaaaaaagcagaacaacctcatgatttatctgctatcagaagtttgttccctaaaagaaaagggcctctgcccaagagtgtattggcagccaagaggaaaaatattgctttgagacacaattacgaacagaaagatggaggagaccaatcagtcagtgaatcagatgctgatgaaggctgggaagatattcctgtctacgttaaagcctttgcagagtttgaatcaaagaaaagattacaaaaaattcgccgacaggaagaaataaaaaagaggacagctttggtttga

SEQ ID NO: 1440 - DNA, 747 bp, Saccharomyces cerevisiae
atggatcattcaatagaagtcactttcagagtaaaaacacaacaggttataataccggaacaaaacatccggggaaatgaacttcccttacgtcggtggcagatggaactcctcatgttagatgcaacaggaaaggaagtggagcctaccatcctctctaaatgcatctaccatttgcactctagcttcaaacagcccaaaagacgactgaactcgctgccattttttatcaaggaaaccggttggggagagtttaacttaaaaatagaatgcttttttataggtaacgctggaaagtttagcattgaacatgacttaacgtttgaagatgatgcatatgcagttgactataccgttgatgtgcctcatgaattctcacatctcaatagtgaactatctaaatattttgatctcccgtggaaagtagtgtctccggaggaagaaatgtctcttcgtatagccgatttgccctggattaaaagccttgcgcttatagatgaggatatgatgacggacgtggttcagatgatattgaatgatcctgcagtacagagagcaattgaaaatcatcccagaagggagcagttttttatgtttataacacaactaccagatgatttgttaatgaaaattcaggcatttttgaaattaccgaacaaaaattccactaaacaagaaaggacaaattttgggtcagacgcaatacataaggacgagccagtgaaggctcataacaagctaaagtag

SEQ ID NO: 1441 - DNA, 747 bp, Saccharomyces cerevisiae
atggcgaaaactttggcacaaggaaggaaacctggaagcggcagaaagcccggaaaagggaagacgttgagagagggaagaaagcctggcagtggtaggaggaggaggcaagatactgggggtaaagagaccgacgggtctcagcaagatcaggagtcgcgtcttattagttccagggacatggaagctgtggacgcactgagagagttgacgcacagcccgtcgtctcactcagctcataattcatcagcagcaccaccgccgcatgcagcagcggcgtcaacttcattgcctccatctctggattatacccatcagtcattcatggatcaacaacaacaacagcagcagcagcagcagcaacaactactacagcaacagagagtggacgtcgttccgcccaagccgttcatcacccacaagatcctgttatcttcaacgggaaactctggcggccacgtgaattcaaattacaacgccgaccacagcattaatcataattcaaaccacaaccttaacagcaacgtgaacgtgaacatgaactttactataaatgggagcaatcaagacccgtcatcttctttcctgatggggccctacaactacttacagcggcctttcattgtgaaaccatatcttgatctgtccacaagcacagcagcatcaaatcagccacggacgcaaccatcgccggcagcacatatcactaagaattccgattctacagagaaaaacgcaaccatatga

SEQ ID NO: 1442 - DNA, 747 bp, Saccharomyces cerevisiae
atggctagaactttctttgtcggtggtaactttaaattaaacggttccaaacaatccattaaggaaattgttgaaagattgaacactgcttctatcccagaaaatgtcgaagttgttatctgtcctccagctacctacttagactactctgtctctttggttaagaagccacaagtcactgtcggtgctcaaaacgcctacttgaaggcttctggtgctttcaccggtgaaaactccgttgaccaaatcaaggatgttggtgctaagtgggttattttgggtcactccgaaagaagatcttacttccacgaagatgacaagttcattgctgacaagaccaagttcgctttaggtcaaggtgtcggtgtcatcttgtgtatcggtgaaactttggaagaaaagaaggccggtaagactttggatgttgttgaaagacaattgaacgctgtcttggaagaagttaaggactggactaacgtcgttgtcgcttacgaaccagtctgggccattggtaccggtttggctgctactccagaagatgctcaagatattcacgcttccatcagaaagttcttggcttccaagttgggtgacaaggctgccagcgaattgagaatcttatacggtggttccgctaacggtagcaacgccgttaccttcaaggacaaggctgatgtcgatggtttcttggtcggtggtgcttctttgaagccagaatttgttgatatcatcaactctagaaactaa

SEQ ID NO: 1443 - DNA, 747 bp, Saccharomyces cerevisiae
atgtctttctacaatactagtaacaatgctaataatggcggtggcttttatcagccttctgcacaatttgccgttccccaagggtcaatgagttttcaaaataccgtcggttcttctaatactggcaacgataacaatttgggtgttgcccccgaccctttgcctgtaggtattttacatgctctttcaactaagggatatccacatgaacctccattactggaggaaattggaataaatttcgatcatatcataacgaaaactaaaatggttcttataccaatacgttttggtagtggtgtgccacaagaaattctaaacgattcagatttggctgggcctttgatattctttttgttattcggactttttctattgatggctggaaaggttcattttggatatatctatggtgtcgctttgtttggtaccatttctttgcacaatctatcgaaattaatgagcaataacgatacttccactcaaacgaacctacaatttttcaatacagcgtccatcttaggatactgctttttgcctctgtgtttcctttctttactgggcattttccatggtttgaacaacactacaggttatgttgtatcagtactatttgtaatttggagtacttggacctcgtctggatttttaaattctttgctccaattgcaaaatgcaagattgctaattgcctacccactgttgattttctacagtgtttttgccctcatggtaatttttgtctga

SEQ ID NO: 1444 - DNA, 750 bp, Saccharomyces cerevisiae
atgaagttctcttccggcaaatctatcatctttgcaactattgcttctctagctttgagtgctcctgtcacttacgacaccaactctactgctgagttacaatctccttcatctcaagaaattctgggttggagtcacgcaacttttcctaccatttaccaaacctgtaatgagacgaacgcaagaatgttgaatgcagcttttaaggataccgctgaaatcaccgcttatggtaaagatagacttttgaactatggtgtcgatgacgtttactacaaaagatggtttggtaatggtagtattttcaccgtcatgggtgtctttgagcaattgatggaggcttccaagggtgccatgctcatgagatgtgatgatattgatggcttgtgtgcagctaatccaaactattacgctggtcatcaccgtcaatctgctccagctgaaactgttatttgtgattacttctacacttccaaaaagccactatcaacaatttgtttcgaaggtactattgtcgatgtcggtccaaaacattatgcaggtattgatatgttacatcgttacttgcacgtccctaccatgagtatggatggatatgttggcgagtacgcggaaactcttgaagaagttgtggactacacccagaacaatgctacttacgcagttagaaacaccgacaactatctttactatctcgctgacgtttacagtgcttctgttatacctggtggctgtctaggtaacttgtaa

SEQ ID NO: 1445 - DNA, 750 bp, Saccharomyces cerevisiae
atgaccacgaacgatacatacgaggctacttatgccattcccatgcactgtgaaaattgcgtgaatgatataaaggcatgcctaaaaaatgtcccaggaatcaattcattgaatttcgatatagagcaacaaataatgagcgtggaaagctcagtagccccttcaaccatcatcaacaccttgcgaaactgtggtaaagacgccatcataagaggcgccgggaagccgaattcttccgcggtcgctatcttagagacctttcaaaaatatactatagaccagaaaaaggacaccgccgtgaggggcctagcaagaatcgttcaggttggagagaataagactctttttgacatcactgtaaatggcgtcccagaggcgggaaattaccacgccagcattcacgagaaaggcgacgtctccaagggcgtggaatctactggtaaagtttggcacaagttcgacgaacccattgaatgcttcaacgagagtgatttgggcaagaacttgtacagtgggaagacctttctgagcgctcccttgccaacatggcaacttatcggccgcagctttgtcatttccaagtctctgaaccacccagaaaacgagccttcctccgttaaggactactcatttctgggagtcattgcgagaagcgctggtgtgtgggaaaataataaacaagtgtgtgcgtgtaccggaaagactgtttgggaagagagaaaagatgccttggccaacaacatcaaatag

SEQ ID NO: 1446 - DNA, 750 bp, Saccharomyces cerevisiae
atgatttatacgtcgtcaaagagcttacaataccttgccgtgcccatctacacaattttcaagaatctgacgatcattctcattgcttatggcgaggtcctcttctttggcggaaaagtcacttctatggagttgacgtcatttattatgatggtcctttcatctgtagtggccacctggggcgatcagcaggccattgcaatcaaagcatcatctttggaggatctcgatcaggaacttgttgagtcaaccatctttgtgttgaatccggggtacctctggatgttcaccaattgtatttcgtctgcattgttcgttttgattatgcggaagagaattcggctgactaactttaaagactatgatactatgttttataacaacgttctggcattgcctttgctgctagtcttttccttcattatggaagattggtccacaaagaatttgtctgtgaacttgtccgccgactcactggcagcaatggtcatcagtgggctcatgtccgtggggatatcgtactgttccggctggtgtgttcgtgtaacttcctctacaacgtattctatggttggtgctttgaacaaattgcccatagcgttggcgggattggtgttctttgacgctccaaaaaactttttgtccttcttttctatctttctaggatttctgtctggcctgctgtacgctgtggctaaacagaaaaagatacaacagcaaaaagttctagcagctactcttgagaagtag

SEQ ID NO: 1447 - DNA, 750 bp, Saccharomyces cerevisiae
atgctaatagaggagatagagttttataacgtcaacggaaaaaaaacaacaacagttgttcctgaaaatacaaaaataaaaaaaagagtactaaatgataggaggacattatatgtcggcaatcttcctaaaaactgccgtaaacaggacttgagagatttgtttgagccaaattatggtaagataacaataaatatgctaaagaaaaagccactcaagaaaccgctgaaaaggtttgcatttatagaatttcaagagggtgtgaatctgaaaaaagtgaaagagaagatgaacggtaaaatttttatgaatgaaaaaattgttattgaaaacatcttaacaaaagaggaaaaaagttttgaaaaaaaccagaaatcaaacaagaaaactgctcctgatctcaagccactatccacaaatactctctatgtgaaaaacattcccatgaaatcgacaaatgaagaccttgccaaaatctttggtgttgaccctaaaaatataaactttgtaagaagagaattggtggatttgagaacaaacaaagttttcttttccgacgagtttcacaccggcgaagccttcatcaagtttgacaacctggggactggagatagtattcaaaagaaatgtcgagaatttaaaggtcggaaggcaagtaatggtagagtattgttggttaagatagcctctgccaagaaaaatgaacagaaacaagaaggaggagataatacaaaaataaaacaaaattaa

SEQ ID NO: 1448 - DNA, 750 bp, Saccharomyces cerevisiae
atggtgacagtcggtgtgttttctgagagggctagtttgacccatcaattgggggaattcatcgtcaagaaacaagatgaggcgctgcaaaagaagtcagactttaaagtttccgttagcggtggctctttgatcgatgctctgtatgaaagtttagtagcggacgaatcactatcttctcgagtgcaatggtctaaatggcaaatctacttctctgatgaaagaattgtgccactgacggacgctgacagcaattatggtgccttcaagagagctgttctagataaattaccctcgactagtcagccaaacgtttatcccatggacgagtccttgattggcagcgatgctgaatctaacaacaaaattgctgcagagtacgagcgtatcgtacctcaagtgcttgatttggtactgttgggctgtggtcctgatggacacacttgttccttattccctggagaaacacataggtacttgctgaacgaaacaaccaaaagagttgcttggtgccacgattctcccaagcctccaagtgacagaatcaccttcactctgcctgtgttgaaagacgccaaagccctgtgttttgtggctgagggcagttccaaacaaaatataatgcatgagatctttgacttgaaaaacgatcaattgccaaccgcattggttaacaaattatttggtgaaaaaacatcctggttcgttaatgaggaagcttttggaaaagttcaaacgaaaactttttag

SEQ ID NO: 1449 - DNA, 750 bp, Saccharomyces cerevisiae
atgtccattatgaagcagaggctaccactgggggagttttccagctcgaagatcaacaaactggcaattgccaatattgcagacgctagcgagcctagaaaccatggagaaaacaacgtcgggactgtgtgtcttccctctatcaagagtttgatggttagtcctgaagtatacgaaaacacgaagagtcttcctgttcccctaatgaggagcagtggcggaggtatggcttgtgccagtaagtcctcatgccaggatggtattagtacgaaaacaacgtctagagattactctgagctttccaagaagttgcaaattcgtttacagttcgcctattataaatacaagactaagcaaacagacaaaaatttcacagacttgaaatcaaagcatagcattacgaggccttccaaagtcgcgactcacagtaaatcagaacctttaactaggagaagaaaattagtactatctcagggtcattataaaacccctgctaggtctaagatcaaaactccatcttcgatttgctctcacgataatacatcttcctttacatctttccgcggtgtcagcgaaagctcgagcactaccgcagatatgaacgtcgcagataccaccacaccaatacgcaacaacataaacacaaagcattcaaacagtcataatcgcacattgtatcagagacaagaaacacctacaagcatcaaagccgctaagtctttaattcatctctttacaagtaaccaataa

SEQ ID NO: 1450 - DNA, 750 bp, Saccharomyces cerevisiae
atgttgcagctaaggtttatgcctggatgggtccccagaaatggtttttttggtttgaaggagacaattggtacagtacataagagattttatgctctggcttctgaacaaccctcaagaaagacagtaaagccgctggactcgaggaagacgtttctcatcgatacatacaagcatttaatggagaacagttctatgattttttttgtccattacaataatctttccaaaacagaagatcaccatttcagattcaagattaaacagacaggagggaaactcacaaaagtaagaaacaacctgttcgaagtctacttgagaaattcgcatctgcccgacccatgtggattcgtgaagcgtaaagagcaaaactggaaacatccactcttgccactactgaagggtcctacggccacaattacatacgaagacaccaaccctcaacaagtagccaagctattgaaggttctgcagtcagcacaagacaagctgatggtgattggtgcaaaagtagaaaacgaagttttgaatgtggaaaaaataaacacttttaagactctccccacaaagccggaaatgcagtcgcagttagtcagcgttttgcaaatgctaagtgggttgggtttggttcgtacgttggaaaacagttcaaatgcattgtatttaacactaaaatctcacaatgacaaccaaaaacctaaagaggatgtggagtcaactacagatgcagaatcgaagggatcaaagtaa

SEQ ID NO: 1451 - DNA, 753 bp, Saccharomyces cerevisiae
atgaagttcgaagacctcttggcaaccaataaacaggtgcagtttgctcatgcagctactcaacattacaaaagtgtcaaaactccagatttcttggagaaagacccacatcacaaaaaatttcataacgcagatggcttgaatcaacaaggttcttcgaccccatctacagctaccgatgcaaatgccgcctcaactgcttccactcacacaaacaccacgacattcaaaagacacattgttgccgtggatgacatatcgaaaatgaactatgaaatgataaagaattctccagggaatgtaataacgaacgctaaccaagatgagatagatataagcaccctcaagacaaggttgtacaaggacaatctttacgctatgaatgacaactttttacaagctgtcaatgaccaaattgtaacattaaatgcagcggagcaggaccaagaaactgaggaccctgacttatcagatgatgaaaaaattgatatactgaccaaaatccaagagaacttgcttgaagagtaccaaaaactttcacagaaagaaagaaagtggtttatattgaaagaactactgttggatgcaaatgtagaactcgatttgttcagtaatcgtggcaggaaggcaagccatccaatcgcattcggagcagtagccataccaacgaacgtcaatgcgaattcactagcatttaacagaaccaagagaagaaaaattaataagaacggccttttggaaaacattctttaa

SEQ ID NO: 1452 - DNA, 753 bp, Saccharomyces cerevisiae
atgaatgttcaagacagaaggaggttattaggccctgctgctgccaagccaatggcgtttagcaacactactactcatgtgccagaaaagaaatcaacagatttgacacctaaaggcaatgaaagtgaacaggaactttctctacataccggtttcatcgaaaactgcaatggatctgcattagtagaagctagaagcttaggacaccaaacatcgctcattaccgctgtctatggaccacgctccattagaggatccttcacatctcaaggtactatatctattcagttaaagaacggtcttctggaaaaatataacacaaatgaactgaaggaagttagcagctttttaatgggcattttcaattcagtagtaaacctatctcgctaccccaagtccggcatcgatatcttcgtttatttaacgtatgataaggatcttacaaataatcctcaggacgacgattcgcaaagcaaaatgatgtcttctcaaatatcatctctcataccacattgtatcactagtataacgctagccttagctgatgccggcatcgaattagtggatatggcaggtgccggtgaggccaatggcactgtcgtatcattcatcaaaaatggagaggaaattgtaggtttttggaaggatgatggtgacgatgaagatcttttggaatgccttgatcgttgcaaggagcaatataaccgttatagagatttaatgataagctgtttaatgaaccaggaaacttag

SEQ ID NO: 1453 - DNA, 753 bp, Saccharomyces cerevisiae
atgaccgacagatattctttttcgttgaccactttttctcccagcggtaaattgggtcaaattgattacgccttgacggcagtaaaacaaggtgtcacctcattgggtataaaagctacgaatggtgtagtaattgccacagaaaagaagtcgtcctcgccactggccatgtcagaaacactttcgaaggtatccttactaacaccggacattggtgcagtatattccggtatggggcctgattatagagttttagtggataaatcaagaaaggtagcacatactagttataaacgaatttatggtgaataccctcccaccaaattactggtttctgaagtagccaaaataatgcaagaggctacacagtccggtggtgtcagaccctttggtgtttcactgttgattgctggccacgacgaatttaatgggtttagtttatatcaagtggatccttccggttcctacttcccttggaaagccaccgctataggaaaaggttctgtggcggcaaaaacgtttttagagaaaagatggaatgatgaactggaactagaagacgccattcatattgccttactaacgctgaaggagtcggtagagggcgaattcaatggtgacaccattgaactggctattattggcgatgagaaccctgacttgctaggctacactggtattccaaccgataaaggccctagatttagaaaattaacttctcaagaaataaatgatagattagaagcattatga

SEQ ID NO: 1454 - DNA, 753 bp, Saccharomyces cerevisiae
atgagtgacgacgattatatgaacagcgatgacgacaacgacgccgaaaaaagatacgtaaggccaattttcgtcagaaagcgcaggagagaagaagactacgttgcaactagcaaagacaacatccaccaccacccatgcgattggtccgcgaaaccatcgcaacgtcaaaacgaaaatgagcaaaaaagcaccatacggcttgtaccagtggcgatgaatacgccgaagtgtcaagagaaaaaaaagaaaagaaagggcgttggtacaactagtcatgaggctacgcttttcgagtacggtgaaagcatagcaggctacaagtgtgttacaaccgagagcgaaagagaccgcttgaaacgaagtcatgaaagcgaaagcagcagtgaaagcgaggtagacgttttcgcctttgaccaggcaaaaggtatcagctctaaggttgaagccgaagaacgctacgcgcgggccgttcgacagtattggcgcatgaccaaagacgagccggctaccttaccactgccaggcacacctaccctagcggctgtgagtttagatatgattgatgacaaaagcgtagaacaattttacacaatgagcagtgccttgatggatgcaaacagactagacttgattcgccgcgatagaatccggtggcacccggacaaacatcgttatcataagtccaaagtcacaaaactgtttcaggccattaacggcctgtgggagcaagaaaagaccgagaaaaggtaa

SEQ ID NO: 1455 - DNA, 753 bp, Saccharomyces cerevisiae
atgataaacacaggaagaagcaggaattcagtactgctggcacacagattcctttcaactggaggattttggcgaggcggtacgaatggcacaatgtctcgcacaatcaacaacgtaaatcctttcaaattaaaattcataccgaagacagtgcccgcagctgcagactctgtctctccagatagtcaacgtccaggtaagaagcccttcaaattcatagtttccaatcagagcaagagtagcaaggcttctaaaagcccgaagtggtcgagctacgcattcccttcgcgtgagaccatcaaatctcatgaggaggccatcaagaagcagaataaagctatagacgagcaaatagctgctgcagtatccaagaatgactgctcttgcacagaacctcccaagaaaagaaagaggaaattgagaccaagaaaggcgctgatcaccctgagtccgaaggcaatcaagcatttaagggcactgctagctcagccggaacctaaattgattagagttagcgctagaaaccgtggatgttcaggactaacgtacgatctacaatatatcaccgagccggggaaattcgatgaggtagtagaacaagatggcgttaaaattgtcatcgattcaaaggcgttattcagcatcattggaagtgaaatggactggatcgacgacaagttggcctctaagtttgtcttcaagaatccaaactccaagggcacatgcggttgtggcgagagtttcatggtttaa

SEQ ID NO: 1456 - DNA, 753 bp, Saccharomyces cerevisiae
atgattgagaataaggttgaactggtagcagaactagtgttggagtccatcggtaaaactgaggtggtgtcacgccatacagagggaaccaaatcatgccaagtgagttttcgcattaaagattctcccagtgagaagggttcaacatcgtttctctctgagctagtggtgattcagactctggatgacaatgacaagtatactgttgttattcgtcatggtacgtcgatcaccatggcatgtgtggtgggttacagcgattttaaattgcccacagaattgaaatggccactagaaagagaaagcttacctgtggagccagacctgaaacctataatgacacaacttaaaagacaaactgcaggtagtgcggacatgccaaaatttgacgatgagtaccaggcacaagcaagacaaaaccagggaacagcaccgttgaacccatatcccggacttacggtaactgaaccgagcttcgctaacccagcaggagggtatgcggatggtgatctgtatcctgttggcacaagccatccggattggtctggagggcttcccaatcctctggggaatccaagtagccaaggcggtatgattttcgatccaaatagaagacctgccccaagacgggaagatatgccgccaggatggatgcctggatccaagtacgacgaaccatttggtcctggatctggcggatttggaggttcaggatccggcggatttggagggtcaggatctggctttatttaa

SEQ ID NO: 1457 - DNA, 753 bp, Saccharomyces cerevisiae
atgcagcatattaaacatatgaggacagctgtccgtttggctagatacgctcttgaccacgatgagacaccggtagcttgcatctttgtacatacgccaactggccaggtgatggcttatggcatgaacgatacgaacaagtcattaactggagtagcacatgctgagttcatggggatcgatcagatcaaggcgatgttgggctcccgaggagttgttgacgtgttcaaagacattactctatatgttactgtagaaccgtgtataatgtgtgcatctgctctcaagcaattagacattggaaaggtggtgttcggttgtggcaacgagagatttggaggcaacggtactgtcttgtcagtaaatcatgatacgtgtacattagtgcccaagaacaatagtgcggcagggtacgagagtataccggggatcttgaggaaagaagcaataatgctgctgagatacttttatgtaagacaaaatgaaagggcgccaaagccacggtccaagagtgacagagtgttggataaaaacacgtttccgcctatggaatggtcaaagtatcttaatgaagaagcattcattgagacttttggtgatgattacaggacttgttttgcgaataaagttgacttgtccagtaatagcgtcgattgggatttgattgactcccaccaagataatataatccaagaactggaagaacaatgcaaaatgtttaagtttaatgtacataagaaatctaaggtttga

SEQ ID NO: 1458 - DNA, 753 bp, Saccharomyces cerevisiae
atgcctatcaatcaaccgtcgggacagattaagttaactaatgtttcattagtgagattaaaaaaggctcgcaagagatttgaagtcgcgtgctaccaaaataaggtccaagactatcgaaaaggaattgaaaaagatctggatgaagtgctgcagatacatcaagttttcatgaatgtttcgaaaggcttggttgctaataaggaagatctacaaaagtgtttcgggactacaaatgttgatgatgtcatcgaggagatcatgcataagggagagattcaattatcggaaaaagaaagacaattaatgcttaataaagttaataacgaaatgcttacaatagttagcgctaaatgtataaatcctgtgtcaaagaaaagatatccgcccacaatgatccacaaagctttacaggaactgaagttcagccctgttattaacaaacctgccaaattgcaagctttagaggctatcaaattattggtttctaagcaaattattccaatagtaagggcgaagatgaaagtcaaagtggccataagtgagccatctagacaacccgaacttattgagaagattagtaaattgatagcttcatcgcctggagagtcaacgaagccggaattggatccttggacatgtacaggtcttatcgatcctgtcaattatagagatttgatgaccctatgtgataaaaagggaactgtgcaagtcttggatatggcagtcatagataatacaacgcataactaa

SEQ ID NO: 1459 - DNA, 753 bp, Saccharomyces cerevisiae
atgcctttgaccacaaaacctttatctttgaaaatcaacgccgctctattcgatgttgacggtaccatcatcatctctcaaccagccattgctgctttctggagagatttcggtaaagacaagccttacttcgatgccgaacacgttattcacatctctcacggttggagaacttacgatgccattgccaagttcgctccagactttgctgatgaagaatacgttaacaagctagaaggtgaaatcccagaaaagtacggtgaacactccatcgaagttccaggtgctgtcaagttgtgtaatgctttgaacgccttgccaaaggaaaaatgggctgtcgccacctctggtacccgtgacatggccaagaaatggttcgacattttgaagatcaagagaccagaatacttcatcaccgccaatgatgtcaagcaaggtaagcctcacccagaaccatacttaaagggtagaaacggtttgggtttcccaattaatgaacaagacccatccaaatctaaggttgttgtctttgaagacgcaccagctggtattgctgctggtaaggctgctggctgtaaaatcgttggtattgctaccactttcgatttggacttcttgaaggaaaagggttgtgacatcattgtcaagaaccacgaatctatcagagtcggtgaatacaacgctgaaaccgatgaagtcgaattgatctttgatgactacttatacgctaaggatgacttgttgaaatggtaa

SEQ ID NO: 1460 - DNA, 753 bp, Saccharomyces cerevisiae
atggacccgattggaataaacaaagtcttggaccatttagcaccctcagagcttatcaaacctgttaagagttgccataataaaccttcagtgttggtgttggatgacaggattgtggatgcggcaaccaaagatctctacgtgaatgggttccaagaagagattcagtatcagaatcctacaccggagaacttgcaacatatgttccaccaaggtattgaaatattggattcggcaaggatgatcaacgtgacacatttagcgctttggaagccttcttcttttaagttggggaatcctgtggactttgctctagatgataactacgatacgttttggcagagcgatggagggcaaccacaccaattggacattatgtttagtaagagaatggacatctgtgtcatggcaatattcttttcgatgattgcggacgagtcctatgctccaagcttagtgaaagtttacgcggggcatagtccttctgatgcgaggttttataagatgcttgaagtgagaaatgtgaatggctgggtggcactaaggtttctagataatagggaggacgaccagctgctgaaatgtcaattcatcaggcttttgtttccagtcaaccatgaaaacggaaaagatacacatctgagaggcataaggctatatgttccatctaatgagccacatcaagatacccatgagtgggcacagaccctcccagaaactaacaatgtcttccaggatgctatattacgttaa

SEQ ID NO: 1461 - DNA, 753 bp, Saccharomyces cerevisiae
atggctaaacttgtacatgatgttcagaaaaagcagcatagagaacgttctcagctaactagccgttccagatatgggtttttagaaaagcataaagactatgtgaaacgtgctcaagacttccacaggaagcagtccactttgaaagtcctcagagaaaaagcaaaagagagaaatccagatgaatactaccatgctatgcattcaaggaagacagatgcaaaaggactgctgatcagctcacgtcacggtgacgaagaagacgaatcgctttccatggatcaagttaaattactcaaaacgcaagatagtaattatgtgaggacgctgaggcaaatagagctgaaaaagctggagaaaggagcgaaacagttgatgttcaaaagcagtgggaatcatacaatattcgtcgattcccgagagaagatgaacgaattcaccccagagaagtttttcaataccacctccgagatggtgaatagatctgaaaatagattaactaaggaccaattagcccaagatatttcaaacaataggaacgcttcatcaataatgccaaaggaatcattagacaaaaagaaattgaaaaagttcaagcaagtcaagcagcacttacagagggaaactcaattgaaacaggtccaacaaagaatggatgctcaaagagaattgttgaagaagggttccaagaaaaaaatcgtagactcttcaggaaaaatttcatttaaatggaagaaacaacggaaacgttag

SEQ ID NO: 1462 - DNA, 753 bp, Saccharomyces cerevisiae
atggctacaaagcaggctcacaagagattgacgaaagagtacaagttgatggtggaaaaccctccaccatatattcttgctcgccccaacgaagataatattttagagtggcactatattatcacaggacctgcggatactccttacaagggcggtcaatatcacggtactttaactttcccgtctgattatccatacaaaccaccggctatcagaatgataacaccgaatggacgtttcaagcccaacacacgattatgcctttctatgagtgattaccaccctgatacttggaatcctggctggtctgtctcaaccattttgaacgggttactaagtttcatgaccagtgatgaagccacgacaggatcaattacaacatcagaccatcagaagaagacattagcaagaaattccataagttataacacttttcaaaatgttagattcaaattgatttttccggaagttgtacaggaaaatgtagagacattagaaaagagaaaattggatgagggggatgcggcaaatacaggtgatgaaacagaagacccttttacaaaggctgcgaaggaaaaagtcatctcgttggaggaaattctagaccctgaagacagaatacgcgctgaacaagcgttgagacaatcagaaaataattccaagaaagatggcaaagaacctaatgatagttcttcaatggtttatattggtatcgctatttttttgtttttggttggcctttttatgaaatga

SEQ ID NO: 1463 - DNA, 753 bp, Saccharomyces cerevisiae
atgggattgactactaaacctctatctttgaaagttaacgccgctttgttcgacgtcgacggtaccattatcatctctcaaccagccattgctgcattctggagggatttcggtaaggacaaaccttatttcgatgctgaacacgttatccaagtctcgcatggttggagaacgtttgatgccattgctaagttcgctccagactttgccaatgaagagtatgttaacaaattagaagctgaaattccggtcaagtacggtgaaaaatccattgaagtcccaggtgcagttaagctgtgcaacgctttgaacgctctaccaaaagagaaatgggctgtggcaacttccggtacccgtgatatggcacaaaaatggttcgagcatctgggaatcaggagaccaaagtacttcattaccgctaatgatgtcaaacagggtaagcctcatccagaaccatatctgaagggcaggaatggcttaggatatccgatcaatgagcaagacccttccaaatctaaggtagtagtatttgaagacgctccagcaggtattgccgccggaaaagccgccggttgtaagatcattggtattgccactactttcgacttggacttcctaaaggaaaaaggctgtgacatcattgtcaaaaaccacgaatccatcagagttggcggctacaatgccgaaacagacgaagttgaattcatttttgacgactacttatatgctaaggacgatctgttgaaatggtaa

SEQ ID NO: 1464 - DNA, 753 bp, Saccharomyces cerevisiae
atgggctccaagcacagagtagacactaaggataagaaaagaaccagaaagaatgcagaatttgggcgtgaaaaaaggaatagtggcaaccaagagttaagtaatgagccggaaaaagatacaataatggaaggtgatgaagccgaagaagacgagcagaatagctctagcgatgaatcatctaaaattatagataacgaacaaagtgatgctgaagaagatgatgatgaagaagaagaggacgacgacttcccaagaaagaaaaaatcgaaaaacagcaaacatgatgatggttctactggattttctgctgcagtaaatgctattttatcatcacatctgaaagcatacgacaggaaggaccccatcatggctagaaacaaaaaggtgctgaagcaaagtgagtcagaaaagctagaatacaaggccaaaaaagcattgttggcagaaaaaaaaaagttattaggtaaagccagaaagacggatattattccaattgcttccggagaagacaggtcagaaaatattagaaaagtccttgagaaggagacagcgctcagaaagatagctcaaaaaggtgccgtgaaattatttaacgccattttagcaactcaagtcaagacagaaaaggaagtatccgaaaatttaagcgaaattaagaataaagaagaaaagaaagaattgatcactgaagtttccaaagaaaaatttttggatttagttaaagctgccgcaggaagcgacaatgaataa

SEQ ID NO: 1465 - DNA, 753 bp, Saccharomyces cerevisiae
atgtcccaggaagagaaagtggatgctaaggcaaccttaaagactgaaatttcgaacaataaaaagaacgacaagcaagagctcgagctggatgaacttgtgggtaaactatctatcgagggcactccacaggtgtcgcaaaagctaagcaaggaggaaaaacacgctcatcaacttgaagctgactcgcgttctatctttgtcggtaacatcactccggatgtcaccccagagcaaatagaagatcatttcaaagactgtggccagataaaaagaataacacttctttatgataggaatacgggaacaccaaaaggctacggctatattgaatttgaaagtccggcatacagagaaaaagccctgcaattaaatggaggagaacttaaaggcaaaaaaattgctgtctccagaaaaagaactaacattccaggatttaataggcattacaactcgcaaaaccagtatttccaacaatggcaatggaattatcccttaatggcctaccccaatcccgataccttcccttattacccaccgtaccctccaaatcagtctccaaatcaaaatttcggatataataagaacaattattataggagtccttacaataacaagaatagaaccttccaaaaaaaacacttcaacagtgccaaagactctacaaaaaatattagatctacttcccaaaaacctgttgtcatgccgtctgacaacgttaaaagttctacccaagaaaaagattcgaaataa

SEQ ID NO: 1466 - DNA, 755 bp, Saccharomyces cerevisiae
atgcaaatgtatgttacggcgaatacagaatactatgttcgaaataatatgaggattatacgatagcaaaaaagccataaacgaaagacataaatggaaaatgattgacaagctcacaatttattaaacaagtagcaattgagaaaaactattacctgcggcaagcttctgagtttacattaaatctgtagagcaaattgaaaatgtcgcatatgtgctgaagggtttgtttgttccatcttattttgcataacatagttatatttacttggtcgcataaaaaatattttttactaacgtgaagtttctttctttatgatgtacgcacgcacgtctgtgcttactccataaatgaacttattccaattttgtacagcttcgttaagactttgactggtaagaccatcactttggaagttgaatcttctgacaccattgacaatgtcaagtccaagatccaagacaaggaaggtatcccacctgaccaacaaagattgatctttgctggtaagcaattggaagacggtagaactctatctgactacaacatccaaaaggaatccactttacatttggtcttgagattaagaggtggtatcattgaaccatctttgaaagccttggcttccaaatacaactgtgacaaatctgtttgtcgtaaatgttacgccagattaccaccaagagctaccaactgtagaaagagaaagtgtggtcacaccaaccaattgcgtccaaagaagaagttgaaataa

SEQ ID NO: 1467 - DNA, 755 bp, Saccharomyces cerevisiae
atggccccaaacgtatgatactttaaaaggaatccacgcccgattacgaagtctatgttttactgttattgtaatgattgattgtacgcgaataacaaggaagatagtaaaaccaaaaaaaaaaaaataaaaatgtacgaaacgaagaagcgtctatgtgtttagttgcttttctgtattttaaaaattcactacttgaacattgaactctatatcgactcccttctttttatccgtttctgaatgtttttttgtttgagattgtcatatgtgattgttaatagcagtaggcaactttgtggtttcgggattgaaagaaaatcgtgaaatattcgttttttactaacattactgttctgaaaatttttactaattttcaatctttaatttttttgatatagacttccagaaagcaaaagattgccaagacctttaccgtcgatgtctcttctccaactgaaaacggtgtcttcgacccagcttcctacgctaagtacttgatcgaccacatcaaggtcgaaggtgctgtcggtaacttgggtaacgctgtcactgtcactgaagatggtaccgttgttactgttgtttccactgccaagttctctggtaagtacttgaagtacttgacaaagaagtacttgaagaagaaccaattgagagactggatcagatttgtctctaccaagaccaacgaatacagattggccttctaccaagtcactccagaagaagacgaagaagaagacgaagaataa

SEQ ID NO: 1468 - DNA, 755 bp, Saccharomyces cerevisiae
atgttgatgccaaaggaagacagaaacaagatccaccaatacttattccaaggtatgttttagaataactttcagaaagcatgaagatacacggaaagtcaagcgagggaagttatgcgtatacacagtagcggtagtgtgcattcacatacacgatgtttcaaacacacagatggataccatgcatatgaggttaaaggatttcttatgaatatattagtggattacatagaagaaattacaaggaaccgtgtgacgacattttcgaaaggacagcacaaggccatcgaccctggagacgtatgaaatatggtatacgtcctatatttgggcaagaaaacggtaaaactgttttacgcggagatccaacttttgatccttaccgagtaccacgaatcatctatatgatctttttactaacttatcttcaatttcaacggagagatgtaaacatcattctctcctatgataatttctttttttatacagaaggtgttgttgtcgccaagaaggatttcaaccaagccaagcacgaagaaattgacaccaagaacttgtatgtcattaaggctttacaatccttgacttctaagggttacgtcaagactcaattctcatggcaatactactactacaccttgactgaagaaggtgttgaatacttgagagaatacttgaacttgccagaacacattgttccaggtacctacattcaagaaagaaacccaactcaaagaccacaaagaagatattaa

SEQ ID NO: 1469 - DNA, 756 bp, Saccharomyces cerevisiae
atgacagtaaaaaaaatagctattctttatacagatgaagataacgaatggagtaaaccatggggcaattttgttgatatggctatcaagctattagaacagaccaggaaattggaatgtatcgcagaagatgtcgaatatgaagtgttccacgtacaaaaaaacgtgttccctcaattgtcagatcttcagaaagatgagtatttaggcatatacatcactggttcaaaatatgattcatttgataatgaaattgaatggattatgaaattaagaagtttcttaaatgagatgctaactagcaagactgaatatccgcccgtagctggaatatgttttggtcatcaagttatcgcggctgctctaggaagttcagttggacggaatccgaaagggtttgaaggtggggttgtgtcactaaaactgaactctgtgggtcaaaagttatttggtgctcaagaattaaatctttctgaagtgcacagtgactgcgtgttcgatgtcccagagggataccaaaattgggcgtcaagtgaaaaatgtcaaaaccaaggattttacaggcaaaacagagtgctgacgtttcaaggacaccctgaattcaatagtgatgtcgctcagaaggggcttttgaagtctcaagacaagcttacccttgaagagtttaatagatacgaaagacagtgccaggagctggataacaatggcatacaagctgccaggaatatttggaggttattcttgcaaaaaatatga

SEQ ID NO: 1470 - DNA, 756 bp, Saccharomyces cerevisiae
atgagttcttataggggcggcagtagaggtggcgggagcaactatatgagcaatctacccttcggattaggttatggagatgtaggcaaaaatcatattacggaatttccatccatcccattgcccatcaatggtcctataacaaataaggaaagatctttagcagtaaagtacatcaattttggaaagactgttaaagatggcccattttataccggatcaatgagcttgataatagatcaacaggaaaacagcaagagcggtaaacgcaaacccaacataatcctagacgaagacgatactaatgatggcattgaaagatattccgataaatatttgaaaaaaaggaaaataggtatttctattgatgatcatccgtataatttgaacctctttcccaatgaattgtacaatgtaatggggatcaacaagaaaaaattattggcaatctccaagtttaataatgccgatgatgtttttactggtacaggtttacaagatgaaaacatcggactatccatgctggcaaagttaaaggagttggcagaagatgtggatgatgcgtcgacgggtgatggggcagcaaaaggaagtaaaacaggcgaaggagaagatgatgatttggcggatgatgatttcgaagaagatgaagacgaagaagatgatgatgattataatgctgaaaagtatttcaacaatggtgacgatgatgattacggtgatgaagaggatccaaatgaagaggccgccttttag

SEQ ID NO: 1471 - DNA, 756 bp, Saccharomyces cerevisiae
atggacctagatctagccagtatcttaaaaggtgaaatttctaagaagaagaaagagctggccaactctaaaggtgttcagccaccatgcactgagaaattccagccacatgaatccgcaaacatagacgaaacaccgcgacaggtagaacaagaaagtacagatgaagaaaacctgtcagacaatcagagtgacgatattaggaccaccattagcaaattagaaaatcggccagaaaggatacaagaagcgatagctcaagacaaaaccatctctgtaatcattgatccatcacaaattggttctactgaaggaaaacctcttttgtcaatgaaatgtaatttatatattcacgaaatattatctcgttggaaggcgtctttggaagcttatcatccggagctgttcttagacactaaaaaagcactctttccactcctactgcaactacgaaggaaccagcttgccccggatttacttatttcccttgcgaccgttctctatcatttacaacaacctaaagaaataaatttagccgttcagtcctatatgaaactcagtatcggcaatgtggcctggcctattggtgttactagcgtaggcattcatgctcgtagtgcacattcgaaaattcaaggaggccggaatgctgctaacataatgattgatgaaagaacgcgattatggattaccagtattaaaagattaataacttttgaagaatggtataccagcaaccacgatagcttagcctaa

SEQ ID NO: 1472 - DNA, 756 bp, Saccharomyces cerevisiae
atggcttacatcaagatcgctttattagctgctatcgctgctttggcttctgcccaaactcaggaagaaattgacgaattgaacgttattttgaatgacgttaagtccaacttgcaagaatatattagtttggctgaagattcttcatctggattttccttaagcagtctgccatctggtgttttagacatcggtttagctttggcttccgccactgatgactcctacactactttgtactctgaggttgactttgctgctgttagcaagatgttgaccatggttccatggtattcttccaggcttctaccagaattggaatccttgttaggaacttctaccaccgctgcctcttctactgaagcttcttctgctgctacttcttccgctgttgcttcctccagtgaaactacttcttctgccgtcgcttcctccagtgaagctacttcttctgccgtcgcttcttccagtgaagcttcttcttctgctgctacttcttctgctgtcgcttcttccagtgaggctacctcttccaccgtcgcttcctctaccaaggctgcctcttccactaaggcttcttcctctgctgtttcttcagctgttgcttcttccaccaaagcctccgccatttctcaaatcagtgatggtcaagttcaagccactagcactgtttccgaacaaactgaaaacggtgctgccaaggctgtcatcggtatgggtgctggtgtcatggccgctgccgccatgttattataa

SEQ ID NO: 1473 - DNA, 756 bp, Saccharomyces cerevisiae
atggctttaaggctatttcgaaaatccagtttttttgcaaagatatcaatggaaggccctaaaggttcatcgccatttgcgttttacgcattttatcaactttattcgcacttgaatccggggaaatcgagcagcctttctttagaagatattagaagaaggctataccccgactttaaaatagattacaatgagaaaacttcgttgttcataacttggaagaaaaagtccaataaacatcacacaatagacactaacgaagagaattatatacttagaggatgtatcggtacatttgctaagatgccgattgcacatggtattgagaaatattccttgattgctgctttagaggataggagattttctccgatccagaaaagggaattggtggacctgaaatgcagttgcaacatcttaggcaacttcaaaactatttttcgaggtggtggtaatccaaatggggacattttcgattgggaactcggaaagcacggtattgaactgtattttaagcatcccaaaacaggcaccacatgtagcgcaacctttttacctgatgttatgcctgagcaacattggaataaagaagatacctttgccaatttaatcgagaaggcgggttactggggcaatattagtgaagtaatggataattttgaaacttatttcattgaagtaataaggtacgagggcaaaaaaagttccataacttatgaggaatttaacaaacagttaaaagatatagaggcttag

SEQ ID NO: 1474 - DNA, 756 bp, Saccharomyces cerevisiae
atgttagatttattaagattacaattaacaacattcattatgaatgatgtaccaacaccttatgcatgttattttcaggattcagcaacaccaaatcaagaaggtattttagaattacatgataatattatgttttatttattagttattttaggtttagtatcttgaatgttatatacaattgttataacatattcaaaaaatcctattgcatataaatatattaaacatggacaaactattgaagttatttgaacaatttttccagctgtaattttattaattattgcttttccttcatttattttattatatttatgtgatgaagttatttcaccagctataactattaaagctattggatatcaatgatattgaaaatatgaatattcagattttattaatgatagtggtgaaactgttgaatttgaatcatatgttattcctgatgaattattagaagaaggtcaattaagattattagatactgatacttctatagttgtacctgtagatacacatattagattcgttgtaacagctgctgatgttattcatgattttgctattccaagtttaggtattaaagttgatgctactcctggtagattaaatcaagtttctgctttaattcaaagagaaggtgtcttctatggagcatgttctgagttgtgtgggacaggtcatgcaaatatgccaattaagatcgaagcagtatcattacctaaatttttggaatgattaaatgaacaataa

SEQ ID NO: 1475 - DNA, 757 bp, Saccharomyces cerevisiae
atgggtaaaggtaagccaagaggtttgaactctgctagaaagctacgtgtccacagaagaaacaagtatgttgactatttcaaaattaaaaaaaactatcaaccccctattgtgatatcgttttaggtgaaggaaatgttgtgagctctggagtgataaatttatcagtaacatatcctggcgcaaatcagtttggagaggcttaaaatgacacgtcacagtgataaaaagtaatgaatagtgaacggtcagcttcggccattcttcccaatctatagtgtggaaaataaaccttttcttcccaaaataactcagaaagtcacaggaggccgttttttacaacggaatcatttttttactaacagtttttttttattattatagccgttgggccgaaaacaactacaagaagagattgttgggtactgccttcaagtcttctccattcggtggttcttctcatgccaagggtatcgtcttggaaaaattgggtatcgaatccaagcaacctaactctgctatcagaaagtgtgttagagttcaattaatcaagaacggtaagaaggtcactgctttcgttccaaacgatggttgtttgaactttgtcgacgaaaatgatgaagtcttgctagcaggtttcggtagaaagggtaaagctaagggtgatattccaggtgttagattcaaggtcgttaaggtctctggtgtctccttgttggctttgtggaaagaaaagaaggaaaagccaagatcataa

SEQ ID NO: 1476 - DNA, 757 bp, Saccharomyces cerevisiae
atgaatccgtttagaatcttaggtatgttactatttggagtttcatgaggcttttcccgccgtagatcgaacccaatcttactaacagagaaagggctttttcccgaccatcaagacaggtgatttatcacatctaaccagtatactgatcctgattcataatatcaagaccacaaggtacattgaaggtatttctttcaagacccaaacgttgtacgctttggttttcataacacgatacttggatctcttgacttttcactgggtatccctatacaatgctctaatgaaaatatttttcattgtatctaccgcttacattgtagtgctattacaagggtctaaaagaaccaacaccattgcgtataatgaaatgcttatgcatgatacctttaagatccagcatttactaattgggagtgctctaatgagtgtttttttccatcacaagttcacttttcttgaattagcatggagtttttctgtatggttggagagtgtggctattctacctcaattgtacatgctatctaagggtgggaagactagaagtctaactgttcattatatttttgccatgggattatacagagcattgtatattcctaactggatttggaggtacagcacggaagataaaaaattggacaagattgccttcttcgcgggacttttgcaaactctgttgtactctgatttcttttacatttactacactaaagtcatcagaggaaagggtttcaaactgccaaaataa

SEQ ID NO: 1477 - DNA, 759 bp, Saccharomyces cerevisiae
atggctgccgcatgcatttgtcaacctaatcttcttgagattaatgtatctgatggaccactggatatgatccgcaagaaaagaaaaatacaacagccgcaactacgtccaccccttcgagagaataaatgccaaccacacttttctgtacgaaaggtaaaccagtcttacataatttctctccataaagaaatcacatgccaactcattgcagaaattgtcaaacaaaagttatcgaggatttgggaaaaagtatacataccatcttatgaactgatatcagacaaagacggtaatcaaatttatgtggaacagagtgtcgacgaaaataggctaacttctgagattatggagaaactggaccccaacaatattgatatagaggcgatcgaaatattattcgacgactatcacctagaattatcacgcttgacaaacggtattattatatctagtgccaatgatcacttttacagggaattctccttcaataacataattgatgacaactttaaaatttgtggaacaagcatgtctgcagacagttttgataagatttatggcgttatgtggattgaagtacctttcaatggcaatggcttacagaatgatagcgccgttaatagggtttcaacatctcacaatcagatagaagaattgaatgacatagagcaggagataagagcttttaatattagtcgaagtaatcaagaaagtatcatcaaaaaggaagtatctagaagattgaatgggcggtaa

SEQ ID NO: 1478 - DNA, 759 bp, Saccharomyces cerevisiae
atgggcttttatgaaggcgatgacaatgatgccaacaccaaggcatttaatgacaaatatatcaaagatcaaaagttcgcaacggcacccttctggaacctctttccaaagttaagggatattgatgaatacgataatccactcctaccactgcccttcaatttcaacttcagagatcttggagatagtgcacttgccatggcgtccggaatccctacggtgaagcagtttgacaagtgcgaagaacttaagggccagtctgcatggaccacccaagggatttggaaatgtcttgtcccaagtaaggctatcccccctctaccacaattggacttcctcttacctctggaggagatcaaatctgacaagtcgcactctcatgggttgttcttcaatgatttcaacctctttttgaagtggaggtcgcacatgaatagactacaaaaacaaagaatcaagactaggagcactgccgtagagcctctggctagaactccagaagacctcatgttgaattgggacgacttgcatctgggcaacgatgctgaatatgcttctgcagatggatccaagaaaattgttggaagggcacagtccattagtaccacgaaggattccaatgatgcaaaacccagcaccgtcaaaactgaaaaaatctactttgacgatggcacggtagacattactaccaccactacctccaagggttccagtccccaggtgaagcataaagtggtgagtgttgacgaagacaattag

SEQ ID NO: 1479 - DNA, 759 bp, Saccharomyces cerevisiae
atggtcgaagattccagagttagagacgccctcaaaggtggtgatcagaaggcattaccggcctctttggttcctcaagcacctcctgtcttgacatcaaaggataagattactaagcggatgattgtggtattagcgatggcatccctcgagacacacaagatatcgtccaacgggcctggtggtgacaaatatgtccttttgaactgtgacgaccatcaaggtttattaaaaaaaatgggtagagacattagtgaagcaagacctgatattacccaccaatgtcttttgacgttgctagattctccaatcaacaaagccggaaagctgcaggtctatattcaaacaagtcgaggaattctgatcgaggttaaccccactgttcgtataccaagaactttcaaaagattttcaggtttaatggttcagttactacataagctttctatcagatcggtaaattctgaagaaaagttacttaaagtcattaagaacccaattaccgatcacctacctactaagtgccgtaaggtgacattatcctttgacgcaccagttatccgcgttcaagattacatcgaaaaactagacgatgatgaaagtatatgtgtctttgttggtgccatggcaagaggtaaagataactttgcggatgaatacgtcgacgaaaaagtcggcttgtccaattacccattgtctgcctcagttgcatgttctaaattttgccatggcgctgaagatgcttggaatattttatag

SEQ ID NO: 1480 - DNA, 759 bp, Saccharomyces cerevisiae
atgtcgggtgctgctgctgcatctgctgctggttatgacaggcacatcactatcttttcccccgagggtcgtttatatcaagtagaatatgcctttaaagcgactaatcaaactaacataaactcactagcggtcagaggtaaagattgtacagtggtgataagtcagaaaaaggtccctgataaactgttggatccaactactgtttcgtatattttttgtatttcaagaacaattggtatggtagtgaacggaccaataccggatgcaagaaatgcggccctaagagccaaggctgaggctgcagaattccgttataaatatggttatgatatgccatgcgatgtattggctaagagaatggctaacctttcccaaatctatactcaaagagcatatatgagaccattaggtgttatactcacatttgtttcggtagatgaagaattgggtccctccatttacaaaactgaccctgcaggttattacgttggctacaaagctactgcgacaggaccaaaacaacaggagatcacaacaaacttagaaaaccatttcaaaaagagtaaaatcgaccatattaatgaagaatcatgggagaaggtggtagaatttgctattactcatatgattgacgcactgggtaccgaattttcaaagaatgacttggaagtcggtgtcgctacaaaggacaaattctttaccttgagtgctgagaacatcgaagaaaggctagtagcaattgctgaacaagattaa

SEQ ID NO: 1481 - DNA, 762 bp, Saccharomyces cerevisiae
atggaaaatagcatgatgtttatatcgcgttccttgcggagacccgttactgctttgaactgcaatttacaaagcgttagaacagtcatataccttcataagggtccgagaattaatggtttgagacgagatccagagtcgtacttgagaaatcctagcggggtactctttactgaagttaacgcaaaagagtgtcaagacaaagttagatccatactacaattgcccaagtacggaataaatttatcaaacgaactgattttgcagtgtttaacacataagtcgttcgcacacgggtcaaagccatacaacgaaaaactgaatctgctaggagcacagtttttgaaactacagacgtgcattcattcgttaaagaatggttcgccggccgagagttgcgagaacgggcaactttctttgcagttcagcaatctgggaacaaaattcgctaaggaattaacgtccaaaaacacagcatgcacattcgttaaattacataatctagaccctttcatattttggaagatgagagacccaataaaagatggccacataaatggtgaaaccacgatttttgctagtgtcttgaacgcatttattggtgcaattctgtcaacgaatggatctgaaaaagcagctaaatttatccaaggaagtttgctggataaagaagatcttcattccttggttaacattgctaatgaaaatgtagcatctgcaaaggcaaaaatatccgacaaggaaaataaagcatttctgtga

SEQ ID NO: 1482 - DNA, 762 bp, Saccharomyces cerevisiae
atggattatagtaactttggaaacagtgccagtaaaaagtttcaagacgatactctaaacagagtaagaaaagagcatgaagaagccttaaaaaagttgcgagaagagaacttcagttcaaacacgtcagaattgggaaacaagaagcactatagagcacaggaaaggatgagttcgccattacatagattgtctcccacaggtaaatcagacgataggaaagtgaagagcccgctagatgataagctaaggaggcaattaagggaaggtaatacgcgactacctcctccaccattttccagctacgggatgccacccaccaaccgatctaatttggatagaataagaagaaggactagctcaccagtaagaactgataaatttgcatcacaaaatgtgatagatgaccaaagattagaaataaaatatttagaacgaatcgtatatgaccaaggcactgtcattgataatctaacatcaagaataacaagactggaatcattcatactgaattcgatctcagacagaggagataaaaattttgcctctctcgaacactcccgctctttttctgggtttccgaccaacaagacgtatggcttacaaatgggtggactgtatgagaatgatatgccctatcgaagaagtagcgacaacattaataaagaaggagcaagagaagatcgatcgtcacaaatccatattgaaaatgaaagtacggaggatatactaaaaatattgtcttcgtcttttcacaattga

SEQ ID NO: 1483 - DNA, 762 bp, Saccharomyces cerevisiae
atgggtatgtggacgattaggaatagacaaaccatgttatttatctccattagggcgtgagagtgtaattagtacacaggtactactagaatgctaaagaactttttaaaatatcctgaatcgtagggcaaatccatgtcaagcaagaaactaatagttattaaacttcatttacttttgagctagttaaatattttcatcatttcctaaagtactgaacacctgaatgatacttttattggcccttttaataagaactctggttagaaaatatattgaggatatcattagtaatactcattagatatttgtgaatttagccgtttccccattacagaaaaaagatacaactaattacatgtgcagtcaaattactttttttttaagatcaattactaacaatcaactatcatgctaaatttgctgtgatatcattttgaaccagttaacgtcccaaagaccagaaagacctactgtaagggtaagacctgtcgtaagcacactcaacacaaggttactcaatacaaagctggtaaggcttccttgttcgctcaaggtaagagacgttatgaccgtaaacaatctggtttcggtggtcaaaccaagcctgttttccacaagaaagctaagactaccaagaaggttgttttgagattggaatgtgtcaaatgtaagactagagcccaattaaccttgaagagatgtaagcacttcgaattgggtggtgaaaagaagcaaaagggtcaagctttgcaattctga

SEQ ID NO: 1484 - DNA, 762 bp, Saccharomyces cerevisiae
atgtactttgatgaagaacaattgctaaaatatactatatatgcctatagattatccttttttgtaggcatttgctcacttttcatagcaaaaagttgtctaccagaatttcttcaatatggtaaaacctaccggcccaaagagaattcaaagtactcaagcattttagaacgaatcaagaagttcacagttccaaaggcgtatttttcccatttttactatttggctacctttctatccttagtcaccttatatttctatcctaaattccccatcgtttggatcatatttggacactcattgcgccgactttatgaaacgctttatgtactacattatacaagcaattctaggatgaattggtcccattatctagtcggtatatggttctattccgtactcttgttaattcttaatatatcactgtacaagaactccattccaaatacgttaaacatgaatgctttcatcatattctgcatagcatcttgggatcagtacaaaaatcatgttattctggccaatctggttaaatattcgctgccaacaggaaggcttttcaggttggtatgctgtcctcattatctcgatgaaataatcatttattctactctgttgccctatgaacaagaattttacctaacactagtttgggtaatcacaagtttgactatatccgcattggaaacaaaaaattattacaggcacaaatttaaagacaatcacgtagccccctacgccataataccttttataatctag

SEQ ID NO: 1485 - DNA, 762 bp, Saccharomyces cerevisiae
atgttattagatgaccagctgaagtattgggtcctgttacctatttcgattgtcatggttttgacgggtgtactcaaacagtacatcatgacacttataacgggaagcagtgcaaatgaagcacaaccaagggtaaagttaactgaatggcaatatctacaatgggcacaattattgattggaaacggtgggaacctgtcttccgatgcatttgctgcgaagaaggaatttctagttaaggatctcactgaggaaaggcacctagccaaggccaagcagcaggatggttcgcaagctggagaggttcctaatcccttcaacgatccaagtatgtctaatgctatgatgaacatggctaagggtaatatggccagtttcatccctcaaactattattatgtggtgggtgaaccatttttttgctggatttattcttatgcaactacctttccctttgactgccaaattcaaagagatgttacagaccggtattatctgtcaggacctggatgtgagatgggttagctccatttcatggtattttatttctgtgctcgggctaaatccagtctacaacctgattgggttaaacgatcaggacatgggtattcaggccgggataggtggccctcagggcccccaaggccctccacaatcacaggttgacaaagcaatgcatgcgatggctaacgatttgactatcattcagcatgagacttgtcttgataacgttgagcaaagggttttgaaacagtatatgtaa

SEQ ID NO: 1486 - DNA, 762 bp, Saccharomyces cerevisiae
atgttgaagctagctcgtccatttattccgcctttatcaaggaacaatgccatttcttcaggaatagttctcacttctagaagatttcagtcttcctttacgttcttaagtaaccagtctttactatctaaaaatcaaatgaaatccaaaagaaaaaagggcagtaaaaaggcagcgtaccatcgtcaacccccggaacacgaacatactgcaccacttataaagcaaaacaagacaatcacaaagaaagaacatagcgatgtgagaggttctcatttaaaaaagaaaagaagcgatttttcgtggctaccaagagtaccatccacctcacatttaaagcagagtgacatgaccacaaatgtactctattctggatatagacccttattcatcaatcccaatgacccgaagctaaaggaagacaccggaagtacgttatacgaatttgcgatgaagcttgaagatttaaatgaacctctatcaccatggatttcctctgccactggacttgaattcttttcagagtgggagaatatacctagtgaactactgaaaaatttgaagccttttcatccacctaaggaaaaatcaatgaacacaaatgagcttattcatgtaagtgctaagagaaatacattagttgacaataaaacaagtgagacgcttcagcggaaaatggatgaattttcaaagagaagaggaaaggggagaaaaaagtcagtagtgacgttgctccaaatgaagaaaaaacttgagggatga

SEQ ID NO: 1487 - DNA, 763 bp, Saccharomyces cerevisiae
atggcccaacgtgttactttcagaagaagaaatccatgtatgttaaaggcacacttataaattacgagaaattctgacgagatgatgattattcaactaaaaaagagcaagagaggagaggataccatgtcaggggtcctagtatagttatcaaaagcaatttaccccgtttttgtaatccactatcaataacttattctgcgcgaaatattgtgtccagaaataatacaatattagtagcaatgagaagaaaaacgatagttaataagagcagccacttttaaccctgatactgactagagctaataatctcaatctgtgttacgaaaatttcttttaaagttttctcgaactccttcctattgaaacatttcgtactaacatatttttcaaatgagaaagtataccaactttctgaaaacattttcaaatagacaacacccgttctaacaaaatcaaggttgttaagaccccaggtggtattttgcgtgcccaacatgtcaagaagttagctaccagaccaaagtgtggtgactgtggtagcgctttgcaaggtatctctactttgagaccaagacaatacgccactgtttccaagacccacaagactgtttccagagcttacggtggttccagatgtgccaactgtgttaaggaaagaattattagagctttcttgatcgaagaacaaaaaattgtcaagaaggttgtcaaggaacaaaccgaagctgccaagaaatctgaaaagaaggctaagaaataa

SEQ ID NO: 1488 - DNA, 763 bp, Saccharomyces cerevisiae
atggccggtttgaaagacgttgtcactcgtgaatacaccattaacttgcacaaaagagtatgtgaaagaataaaaatataatgcccaagggcttgtcatctgaatggttaattaagaagatatttctatagtcaaggaatacaatatcaagaatttgtaccacagaaacctatcaacaaagatcattgatcaagatatattttataatacggaatttgaagaccataatcaatattataacatccaagaggggaaagatacacttcggctggacttaaagagcgatgaagacagaaatagttatcttaaatagtggaatcctagattttaagtcgacaattatccatatcccaagtttgactaaatatgaatcagaacaaattgggtctccaatatacaaaaccattcatcaagattacactaatattaaaatgaacaatcgttactaacaaaaaatttaccattttatttttaatagttgcacggtgtctccttcaagaagagagctccaagagctgtcaaggaaattaagaagttcgccaagttacacatgggtactgatgatgtccgtctagctccagaattgaaccaagctatctggaagagaggtgtcaagggtgttgaatacagattaagattgagaatttccagaaagagaaacgaagaagaagacgccaagaacccattgttctcctacgttgaacctgtcttagttgcttctgccaagggtctacaaactgttgttgtcgaagaagatgcttaa

SEQ ID NO: 1489 - DNA, 764 bp, Saccharomyces cerevisiae
atgaatggaattcaagtggacatcaatcgtttgaaaaagggcgaagtcagtttaggtacctcaatgtatgtatataagaatttttcctcccactttattgtttctaaaagttcaatgaagtaaagtctcaattggccttattactaactaataggtatcttataatcacctaataaaatagtatggccgtgacatttaaggatggtgtgatactaggtgctgattcacgtaccaccactggtgcgtacatagctaaccgtgtgacagataaattaacgagagtacatgacaaaatttggtgttgtaggtccggttctgcagcagacacgcaggcgattgccgacattgttcagtaccatttggaattatatacttctcaatatggtaccccctccacagagactgctgcctcggtgttcaaagaattatgttacgaaaataaagataaccttactgctggtataattgtggctggttatgatgacaaaaacaaaggggaagtatatactattccattgggtggctccgtccataagctgccttatgcgatagcaggatctggctctactttcatatatgggtattgtgataaaaactttagagaaaatatgtcaaaggaagaaaccgtagatttcataaagcattcgctatcgcaagccattaaatgggacggatcttccggtggtgttataagaatggttgttttgacagctgctggtgtggaacgtttgatattctaccctgatgaatatgaacaactataa

SEQ ID NO: 1490 - DNA, 764 bp, Saccharomyces cerevisiae
atgattagtaaagagtatgaatttggtaagactagtatactgaatagaaagaagtatacattagttatcgatgaagacaagaatggcaattttataagatttaccgttttacctgtatctaaccgaaagttcaaaaaagtcaagcaaaatgggagggtagagattaacatgggcatacaatatcaccaaattgtacttattttactactgaatattttgttctatgtaatttgcctaagatcaagatttctcgaacatattaatagaacttttgaagtgacaatcgcgcgaagtttccagatcttaattataatgggattgtttgccttaggtacaattatacttgtgaggggacctagtgtggaaactgtaacaattttcaaagaaagtggactacagctgtccagagtgaagggtatggttatatttcctcaacaatggaatcggaagttctttgaacaagtagagtttatatccaatgaaagaattattgatgtagtgatcaatgaaggattctgtcggggatttcgagtgatattctatcttgcagcaattgtacgtaaatcgtctacgcttaagctattatttccagtatgtattcaagcgaatttaagattgtttcttacttcaacgatctgattagaaatactaacacaacaatgcagtcaaatttgcccagtatcgatgaccaacgtctaatatacaacatatctagaaaatatctcagtaagcaagaaaaacccctgagcagaccaaaagattga

SEQ ID NO: 1491 - DNA, 765 bp, Saccharomyces cerevisiae
atgaaggcctgttccatattatttaccaccttaattactctagccgctgctcaaaaagactctggttccttagatggccagaactctgaagatagctcacaaaaggaaagctcaaactctcaagagatcacacctaccacgacaaaggaagcccaagaaagcgcatcaactgtagtttctaccggaaaaagcttagtacaaactagcaacgtcgtcagcaacacctatgctgtggctccaagtaccaccgtagtgacgacggatgcacaaggcaaaaccacgacacagtacctatggtgggtggccgaaagcaactctgccgtaagcacaacttcaactgcctctgtgcagcccaccggagagacgtcaagcggaatcaccaactccgcatcctcctcaacgacatcaacatcaacggacgggccagttactatagtaactaccacgaattcgttaggtgagacttacacatctactgtttggtggctaccgtcctcagccacaactgacaacacggcttcatcaagtaaatcatcttcgggatcctcatcaaaaccggaatcaagcaccaaggtagtaagcactatcaaatcaacttataccactacgtcaggttctacagtagagacactgaccactacatacaagtctacagtcaacggtaaggtagcgtccgtaatgtccaattctaccaatggcgcctttgccggcactcacatagcttatggtgcgggtgcattcgccgttggtgcccttttgttatag

SEQ ID NO: 1492 - DNA, 765 bp, Saccharomyces cerevisiae
atgagtatcgctgaattcgcttacaaggaaaaaccagaaactttggttttattcgatgttgatggtaccttgacaccagccagattaactgtttctgaagaagttagaaaaactttggccaagttgagaaacaagtgctgcattggttttgtcggtggttctgacttaagcaagcaattagaacagttaggcccaaacgttttagatgaatttgactattctttctctgaaaatggtttgaccgcctacagattaggtaaggaattagcttctcaatccttcatcaactggctcggtgaggaaaaatacaataaattggccgtcttcattttgagatatctatctgaaattgacttgccaaagagaagaggtactttcttggaatttagaaatggtatgatcaacgtttccccaattggtagaaatgcttctactgaggaaagaaacgaattcgaaagatacgataaggaacaccaaatcagagccaagttcgttgaagctttgaaaaaggaattcccagactacggtttgactttctccattggtggccaaatctctttcgacgttttccccgctggttgggataagacctactgtttgcaacacgttgaaaaagatggtttcaaggaaattcatttctttggtgacaagactatggtcggtggtaacgattacgaaatttttgtcgatgaaagaaccatcggacattcagtacaatcccctgatgacaccgtcaaaattttgactgaactattcaacttatag

SEQ ID NO: 1493 - DNA, 765 bp, Saccharomyces cerevisiae
atgagtggttacgatagagctttgtccattttctccccagatggacacattttccaagtggagtacgccctggaggcggtaaagaggggtacctgtgctgtaggtgtcaagggtaagaattgtgtagtattgggctgcgaaagaaggtctactttgaagctgcaagacactagaattacgccttccaaagtttccaaaattgactcgcatgtggtgttgtcattttctggtttaaatgcagattccagaattcttatcgagaaggctagagtggaggcccaaagtcacagactaacgttggaggatcccgtgacggtggagtatctcacacgttatgtcgctggtgtgcaacaaaggtacacgcagtcaggaggtgttagaccatttggtgtgtcgacgctgattgccggcttcgacccgagagatgatgaacccaagctttaccagaccgagccaagtggtatatactcttcgtggtccgctcagaccattgggagaaactccaagacggtacgtgagtttttggagaagaattacgatcgcaaagaaccaccagccacagtggaagaatgtgtcaaacttactgtaagatctctgttggaggtagttcaaacaggtgcaaaaaatattgaaatcactgttgttaagccggactcagatattgttgcgttgagcagtgaggaaattaaccagtacgtcacccaaatcgaacaagaaaagcaagagcagcaagagcaggacaaaaagaaaaaatctaaccattaa

SEQ ID NO: 1494 - DNA, 765 bp, Saccharomyces cerevisiae
atgcgtcaaaagagggctaagtcatataggaaacaacttcttgtttacagtcacacatttaagttccgtgagccatatcaagttttggttgataatcagcttgttttagaatgtaataattctaattttaatctaccgagtgggttgaaaagaacgttgcaagcagacgtaaaggtcatgatcacacagtgttgcatacaagcgttatatgaaactagaaatgatggtgcaattaatttagcgaaacaatttgagagacgtcgttgtaaccactcttttaaagatccaaagtcacctgcggagtgcatcgaaagcgtcgttaatattagcggtgcaaataaacacaggtatgtggttgcttctcaggacatagatttgaggaggaagctgaggacggttccgggtgttccattaatccatttaaccaggtctgttatggttatggaacctctcagtacggcgagtgccaaggcaagcaagattactgaagaacaaaaattgtataagggtctcaatgatcctaatattgaaaaacttcaagaaagtggtgatggatcaggaaaggaatctatcactaagaaaagaaagcttggtccaaaggctcctaatcctttgagcgtaaagaagaagaagaaagtcaactcgcccagcgatgaggtgaaagacaaagaagatacttctaaagaaaagaaaaaaagaagaagaaggaaacacaaaagcaacactaacgtccccgtttcaaatgggaccacagccgcgcagtaa

SEQ ID NO: 1495 - DNA, 765 bp, Saccharomyces cerevisiae
atggcttacactaagatcgctttattcgctgctattgctgctttggcttccgctcaaacccaagatcaaattaacgaattgaacgttattttgaacgatgtcaaatctcacttgcaagagtacattagcttagcttctgattcttcctctggattttccttaagcagtatgccagctggtgttttggatatcggtatggctttagcttccgccactgacgactcctacactactttgtactctgaggttgactttgctggtgttagcaagatgttgaccatggttccatggtactcctctagattggaaccagctttgaagtctttgaatggtgatgcttcttcttctgctgccccaagctcttctgctgctccaacttcttctgctgccccaagctcatctgctgccccaacttcttctgctgcctcaagctcttctgaagctaagtcttcttctgctgccccaagctcttctgaagctaagtcttcttctgctgccccaagctcttctgaagctaagtcttcttctgctgccccaagctcttctgaagctaagtcttcttctgctgctccaagctccactgaagctaagataacttctgctgctccaagctccactggtgccaagacctctgccatctctcaaattaccgatggtcaaatccaagctaccaaggctgtttctgagcaaactgaaaacggtgctgctaaggcctttgttggtatgggtgctggtgttgtcgcagctgccgctatgttgttataa

SEQ ID NO: 1496 - DNA, 765 bp, Saccharomyces cerevisiae
atgggtaaagttattttagttacaggtgtttccagaggtatcggtaagtccatcgtggatgttcttttcagtttggacaaggacacggttgtttacggtgtagccaggtctgaggcacccttgaagaagttgaaagagaagtatggcgacaggtttttttacgttgtcggtgatattaccgaggattccgtgttgaagcagttggttaacgctgctgttaagggccacggcaagatcgactccttggttgccaacgctggtgtcctagagcccgtgcaaaatgtcaacgagattgatgtcaacgcttggaagaagctgtatgacatcaacttcttcagcattgtttccttggttggcattgcgttacctgaattgaagaagaccaacggtaacgtggtattcgtcagttcggacgcctgtaacatgtacttcagcagttggggagcttacggttcttcaaaagccgctctgaaccacttcgccatgactctggccaacgaggaaaggcaagtgaaagccattgccgtcgccccaggtattgtggacacagatatgcaagttaacattagggagaacgtggggccttcctccatgagtgcagagcaattgaagatgtttagaggtttaaaggagaataaccagttgctggatagctctgtgccagctacagtttatgccaaattggcccttcatggtattcctgacggtgttaatggacagtacttgagctataatgaccctgccttggcggactttatgccttga

SEQ ID NO: 1497 - DNA, 765 bp, Saccharomyces cerevisiae
atggttagagttgtcatagagagtgaattggtccgtacagaaaaggaattaccaaattcgcttaaattaaggcagttcaaggaccgattgtaccatgttaccggagtggaaccagaggatatggaaatagttgtgaaaagacagtacgacaacaaggagatatatagtactaaaaaggggggtgcctattcaaatgaggatgaagatgccaacttcctaaaaggagaggaggagcttattgtggttgttacagactctaatgcccaatcaatctctaaccagctggccacgcaagcggaaggaatcccctcaatggaagtaattagcgaggaggattatttgcgaagggatcaatccgtattacgatggaagatggctcacggctatggtaggtttaatgctgcacagcagagccagcgcgctgcgctggcaaagcaggacgaagcatatgcccgagagcaattaacggcggctatcggccgccactgtcgtgtcacagtagacgggagcgctccacgtgaggccattttacggtacgtaggaccactaccgttggacgtgatgggcacatggtgcggtgtggaattcccggaagccgcaggcaaaaacgatgggcgcataaatggggtaacactgtttgggcctgtggcgccgggtcacggatcgtttgtgcgtccgcgggctgtggaaattctatcaaaagacgaagaatccgccgaggtggaagacgtccatgatgacgtggagagcgatgatgaaatttga

SEQ ID NO: 1498 - DNA, 765 bp, Saccharomyces cerevisiae
atgtctctgaaaaagcagataccaataatctttgaaaacacgcattacttcatagttaataaaccacctggcataccttctcaaccaccagactgcagaacatggggcaggacacatcctaatcttgaccctactccactactagaaagattcaaggctatttattattcacatagagaagtagaattatgtcgtactgtacataggttagaccattgtgttacgggggggatgctgattgcaaagactaaagacggaagtgtaaaattctctagatttttacaaaagggcggcaacaacggttataagttgcaaagaaagtatgtagctattgtcgagtcgtccggtcgtttcaacaaaccaaataactatgaaattaaatatggtcctaaatataatttcttgatttcacatggtggtagggagattactaagttcaaagaagttgacgaaaattgtattgttttacaattggttacaggaaaaaaacatcagattcgaaatcacgtctctcaaattttaaatcagcccatattaaacgacaagagacatggcagcactgtcaattttccagagttgttcaatgaccaaatagcgttgcattcagcgtgcataataacgaaaattggcctgcaaactaaaacgcacttgatacctatggaacacaataatactggccaactttggtcaagaaaatacgtcaatgaagagggtgagttcactttgcccataaaagaagtcctgttggaaaactgggaccagtaa

SEQ ID NO: 1499 - DNA, 765 bp, Saccharomyces cerevisiae
atgtctgctccagaagctcaacaacaaaagagaggtggtttcggtggccgtaacagaggccgtccaaacagaagaggaccaagaaacactgaagaaaagggatgggttccagttaccaaactaggtagattagtcaaggctggtaagattaccaccattgaagaaatcttcttgcactctttgccagtcaaggaattccaaatcattgacactttgttgccaggtttgcaagacgaagtcatgaacatcaagccagttcaaaagcaaaccagagccggtcaaagaaccagatttaaggctgttgtcgttgttggtgactctaacggtcacgttggtttgggtatcaagaccgccaaggaagttgctggtgccatcagagctggtatcattattgccaagttgtccgttatcccaatcagaagaggttactggggtaccaacttgggtcaaccacattctttggccaccaagaccactggtaagtgtggttccgtcactgttagattgatcccagccccaagaggttctggtatcgtcgcttctccagctgtcaaaaagttgttgcaattggctggtgttgaagatgtctacacccaatctaacggtaagactagaactttggaaaacaccttgaaggctgctttcgttgctattggtaacacatacggtttcttgactccaaacttgtgggccgaacaaccattgccagtttctccattggacatctactccgatgaagcttctgctcaaaagaagagattctaa

SEQ ID NO: 1500 - DNA, 765 bp, Saccharomyces cerevisiae
atgttgactatcacgaaaagactggtgaccaccgatgtgcggtcgcgaatactgttaagcagtttaaacgggaaaatgtccgatgcactggcgctgctgcgtcagcagcagcagaccagcgtggatgtggagctgctgcacacgatgctagcgcgagccgctgcgcttgcccatgccgacactatagcatacatgtggtatcagcatgtgatgccacgccggttgccagtagagggccgcctgctatgtgaaatggctggcgtagcattgtaccaggacaggctcttcttacccgcgcagttcctccagcactaccaggcgatgaatcgcgatcgtcgcaccagcccagaagatgaactgattgagtatgagcttagacggattaaagtcgaagcgtttgcgcgtggcacaatgcactccacggcgctcagggaaaagtggaaggtattcttgcaggagatggatacgctaccagggcagccgccattaaggctgcgcgacttcccgcaaatgaccaaggctatgggcatagcattgatgcagcaagatgagcaagcagctgccctggcgttgtttggacgacagcccctagtgataaagaacgaatggtcactaccgctactactggctggtgtcctttggcatgttcccggcccagcgcaggcgcgacgtgtgctggcggagttccgtcaaagttatcgcgggctgccgctgctggatgccgaactagtgataaagagaagaggatttgaaatcaacacataa

SEQ ID NO: 1501 - DNA, 766 bp, Saccharomyces cerevisiae
atgaccgttaagacaggtatgtgagacataaacaaggaactgaacgggttatgacgattttcgaacttataaaggggtttaccccaaatacgagaagaacatgagtgcattgaaaacttaaaaggaaacaaaaacaagaatattatataattttgagtgattaatgaccaatggaaatagccagaggaaaaataccatttaatatgcatacacaggcttatctcttcactcctatctaaaaaactattgtgtttgaagatgaggtccattttacaaaaagaatagtattgcgaaaacgccttcaaatggaacattttagtagttgcaccattgtaagaattgccatggaaaacaatcacaaaaagatgctatacaaagccgtacattatacgtcacttcccgccgacacatatacacgtgtatatgtatgcctatttcacatgttactaactgaagacaacctgtgtccttatatttaggaattgctattggtttaaacaaaggtaagaaggtcactagcatgaccccagctccaaaaatctcttacaagaaaggtgctgcttccaacagaaccaagttcgtaagatctttggtcagagaaatcgctggtttgtctccatacgaaagaagattgattgatctaataagaaactctggtgaaaagagagctagaaaggtcgccaagaagagattgggttctttcaccagagccaaggctaaggtcgaagaaatgaacaacatcattgctgcttctcgtcgtcactaa

SEQ ID NO: 1502 - DNA, 767 bp, Saccharomyces cerevisiae
atgagatcatctcttctaacccttccaaaagtatgtttccggcaaacgctataaatttttgttaacttgtaaggattcgaagcaaagcacaattttactaacctgttctcaaacatatttttttttcatagtcttttttggggtttatgccgctataccttgcagttgagattgtcttaggtatttccattctaaacaaatgcagtggtgcttatggtattttagcattgttcacgggtcatccgttggattttatgcaatggatagcatatctttggtcggtatttacattaatcgtattctcacaagggctgtatttgattcataagccaaacttgctggtattttcgcaaatctgcgtactttatacaatcgataccatttccacttgtttttttactctatggtttaccacgcaatggttcaccttggaagacactgctaatattgatggaaataatgcactacaaagtaacccaatatcgacaggtaagctgacagaacgtggtattgatataagtaaacaaagtgcaactgaaagctacgaatataccatgactattttaattacgttggtgtcattgatattcaggttctactttaacttcattttggcatcttttgttcaagaattgttacaccaccccaaatatttagttgatagggatgacgtagaacaaaacttgaaaaacaagcctatttggaaaagactgtgggctaagagccaaaaaggttgttataagctatgtaagaatttgttagagtaa

SEQ ID NO: 1503 - DNA, 767 bp, Saccharomyces cerevisiae
atgagtttgtttgagtgggtatttggaaagaatgtcactccgcaagagaggttaaaaaaagtatgttgttctgtatttggatcagttattttagtgaacatactaacgttaattatttgagtttttagaatcaaagggctttagaaaggactcagagggagcttgaaagagaaaagagaaaattggaactacaagataaaaaacttgtatcagaaattaaaaaatcggcaaagaatgggcaagttgcagctgcgaaagttcaagcaaaagatttagtaagaacccggaattacatccaaaaatttgacaacatgaaagctcaacttcaggcgatatcattgagaatacaggccgttcgaagtagtgaccaaatgacacgttctatgagcgaggccactggtcttttggctggaatgaacagaacaatgaatctacctcagttgcaaaggatatcgatggagtttgaaaagcagagtgatttgatgggtcaacgacaggaattcatggacgaagctattgataacgtcatgggtgatgaggtggatgaagacgaagaagctgacgaaattgtaaataaagttcttgatgagattggagtggatttgaattcacagttgcaaagcacgcctcaaaatctggtttctaatgcgccgatcgcagaaacagcgatggggattcctgaacctattggcgccggatcagaatttcacggtaatcctgacgatgacttgcaagctcggttgaacactttgaagaagcagacttga

SEQ ID NO: 1504 - DNA, 768 bp, Saccharomyces cerevisiae
atggatgaatcggtggatcctgtggagctgcttctacgactactgatacggcacaaacctcatctgaaaccatatgcctacagacaagatagctggcaaagggtgctcgatgagtacaacagacagactgggtcaagatatagacaatcaaggacgttaaaaaccaaatttcgtcgactgaaggacctcttcagcgcagatcgagcccaattctctccttcccagttgaagctgatgggagcactcttggacgaagcaccagaacatccaagaccaagaactaaattcggaaatgaatcatcttcatccttatcatcatcttctttcattaaaagtcatccggggcctgatccgtttcaacaattatcatccgctgaacatccgaataaccacagctccgacgatgagcattcaggctcacaaccgctgcccctggattcaataacgattggaattccgcctactcttcacacaatccccatgattctgtctaaggataacgacgtcgggaaagtcatcaaaagccctaagataaacaagggtacaaataggttcagcgagacagtactgcctccacaaatggctgctgagcaatcgtggtcggactctaatatggaattggaaatatgtctagattatcttcacaacgaactcgaggtgataaagaaaaggcaagaagattttgagtgtaaagttttaaacaagctcaacataattgaggctctcctttcacagatgagaccacccagccaaggagataaaatataa

SEQ ID NO: 1505 - DNA, 768 bp, Saccharomyces cerevisiae
atggatgtgttgaagctgggttatgaactggaccagctctctgatctggtcgaagaaagaacaaggctagtgtcggtgttgaagctcgccccgacctcaaacgataacgttactttgaaacggcaattgggctcaatattggagttattgcagaagtgtgcgcccaatgatgaactaatatcccgatacaataccatactggacaaaattcctgatacggcggttgacaaggagttgtataggttccaacagcaggtggcaagaaatactgatgaggtgtccaaagagtctttgaaaaaagtgcggttcaagaatgatgacgagcttacggtcatgtataaggatgacgatgaacaagacgaggagtcgccgctgccttcgacgcatactccatacaaggatgaaccattgcaatcgcagttacagtcacagtcacagccacagccaccacaacccatggtttccaaccaagaactatttattaaccagcaacagcagttgttagagcaagattcccacttgggcgcactgtctcagtctattgggaggactcatgacatttcgctggaccttaataatgagatcgtttctcagaacgactcgctgctggttgatttagaaaacctgattgataataatggtaggaatttgaacagggcctctcggtccatgcatggctttaacaattctaggttcaaggataacggcaactgcgtgattattcttgtgctgatagtggtgctcctgttgcttctattagtattataa

SEQ ID NO: 1506 - DNA, 768 bp, Saccharomyces cerevisiae
atggctgtcggaaagaataagagactatccaagggtaagaaaggtcaaaagaagagagtcgttgacccatttaccagaaaggaatggttcgacattaaagctccatccacttttgaaaacagaaatgttggtaagactttagttaacaagtccactggtttgaagagtgcttcagatgctttgaaaggtagagttgtcgaagtttgcttggctgacttacagggttctgaagaccactctttcagaaaaatcaaattaagagttgacgaagtccaaggtaagaatttattgaccaacttccacggtatggacttcactactgataaattgagatccatggttagaaagtggcaaactttgatcgaagctaacgttactgttaagacttctgatgattacgttttgagaatctttgctatcgccttcaccagaaagcaagctaaccaagttaagagacactcttacgctcaatcttcccatatcagagctatcagaaaggttatttccgaaatcttgactaaggaagttcaaggatctaccttggcccaattgacctccaagttgattccagaagttatcaacaaggaaattgaaaacgccaccaaggacattttcccactacaaaacatccatgttagaaaggttaagttgttgaaacaaccaaagttcgatgtcggtgctttgatggctttgcacggtgaaggttctggtgaagaaaagggtaagaaggttaccggtttcaaggacgaagtcttggaaactgtgtaa

SEQ ID NO: 1507 - DNA, 768 bp, Saccharomyces cerevisiae
atggctgttggtaagaataagagactatccagaggtaagaagggtttgaagaagaaggtcgttgacccatttaccagaaaggaatggttcgatattaaagccccatccacttttgaaaacagaaatgttggtaagactttagttaacaagtccactggtttgaagaatgcttccgatgctttgaagggtagagttgtcgaagtttgtttggctgacttgcaaggttctgaagaccattctttcagaaaggtcaagttgagagtcgatgaagttcaaggtaagaacttgttgaccaacttccacggtatggacttcactaccgacaaattgagatcaatggtcagaaaatggcaaactttgatcgaagctaatgttaccgttaagacttccgatgattacgttttgagaatctttgctattgccttcaccagaaagcaagctaaccaagttaagagacactcttacgctcaatcttcccacatcagagctatcagaaaagttatttctgaaatcttgaccagagaagttcaaaactctactttggctcaattgacctccaaattgattccagaagttatcaacaaggaaatcgaaaatgctaccaaggacatcttcccactacaaaacatccacgttagaaaggttaagttattgaaacaaccaaagttcgacgttggtgctttgatggctttgcatggtgaaggttccggtgaagaaaagggtaagaaggtttctggtttcaaggatgaagtcttggaaactgtgtaa

SEQ ID NO: 1508 - DNA, 768 bp, Saccharomyces cerevisiae
atgggcaaatttgagcaaaaagaaagagaaagaataagcacatttagttttcctactacgggcagtcaatctagtacatccattaaatcacttggcagcccactctatggacgtttcagctctctctcttcaacagaatctcagttcgatagcagcaaacaaccccatgagtacgaaaagagcttttattttgaagagtctcaaggcgaagctctgttcaacaagctgaagacctactctttccctggagacaaggatggtgtgaaaacgaggagaaattcctccatatgtccaagaaagcctaatgcggtatcacctttaagggtagaaagtaatgaattatcatcacattcgcattcacgttcattatcacacgaacttacaaagccttcagggcgaaggaaaagttaccacagaaaaagtcatgcaatctcattcagcaggtcttgtaagccaaatttcattgacgggtacgattctaattcaagcataggcgtcaattcaagaaaaacttcattggcaagttctttcttggacaaagaatatcattcttcaccggatacttcatatacccaccaaatgtccccgaaaaacacaatcatgaataccaatgaacaattaagaagaaacgcaagcggtagattcgggagtttgaaagaattcgctgaaaaaaatcagataaatattgagggcaaaatttttgctcataaagtggaaactggagacatattgcaaccactaattgacttagatattgacaataaatga

SEQ ID NO: 1509 - DNA, 768 bp, Saccharomyces cerevisiae
atggtatgtagagatgaatatacatgaaacggacgtgatataatgtgctatggaagaaaaaagtctcctttaatgtctgcaggataaataatcaagtggtctgaagaaaatttacagctacagtattactgcaaaccttgcaggcaaatatcagagagatctcaccagctacaacttggtaacagaaatttataagtttatggcacttgttaaaattgtttggaagttttcgaaattataatattggtcttcagaaacctggaaccacatgtgaactattttttttggataatgcattgcacagagcgtattagtgtatacgagaatctaaaaatttgaaactggctcataaaaacaggaacttttactaacagttatgattttttgttcccattttcttatcaataggccggcgttaaagcttacgaactaagaaccaaatccaaggaacaattagcttctcaattggttgacttgaaaaaggagttggctgaattgaaggtccaaaagttgtccagaccatctttgccaaagatcaagaccgtcagaaagagtatcgcctgtgtcttgaccgtcatcaacgaacaacaaagagaagctgttagacaattatacaagggtaagaagtaccaaccaaaggacttgagagccaagaagaccagagctttgagaagagctttgaccaaattcgaagcttcccaagttaccgaaaagcaaagaaagaagcaaatcgctttcccacaaagaaagtacgctatcaaggcttaa

SEQ ID NO: 1510 - DNA, 768 bp, Saccharomyces cerevisiae
atggtgaaattacaaaggtttagcgaaaagaaaagcctcatacacgaattcggcaagtttatccttgaaaagcaagaatcggcgttaacgggcgacgctgatgcagtgttcaatatcgccatcagtggaggatcgatgaaccaagcgctgtacgaaagtttggtaaatgacaaaaacatttttccacatattaagtggccacaatggagaatcttcttctgtgacgaaagattggttccatttgaggatccgcaaagtaactatggtcagttcaaaaaaacagttttggacccgctagtgcatcagggcaaccaattgaacttaggccccactgtatacactatcaacgaatcattaatcggtggcggtgaaacggccaatagaaagattgccgaagaatacgcttccatgctgcctgcatcattcgacctaatcttactcggatgcggagaagatggacatacatgctcgttgtttcccggggttgaatttaattaccttgtagaagagatggaccgcaaggttttatggtgtaataattcgcccaaggcacccaaggacaggatcacctttacattagcagtagtagccgaggctaaaagtgtgtgctttctcgttaggggagctgctaaaaaggctatcatgcatgacgtgttaatcgtaaaaaatagcgaactacctagtgtgctggttaatgaaatggtcggaaccaaagtaacttggtttctcgacgacgaagctggcgccttgattcctgaaaactgctaa

SEQ ID NO: 1511 - DNA, 768 bp, Saccharomyces cerevisiae
atgttgcgaccactgagaaaaagcgttctagcaagctgccgacattgtttcaaggtgtgcggtgggttgcctcaaaagcaattacccttattttcaccattgctcttgagagcacgatactcatcaactgatagctcaactaaaaggtctaacaaatcagataaaatagatgctccaggatttaagaaaattttccttgttgctattatcggtacagtgatatttgtcaagacagtacagtctttagataagaacaaaccgaagacaacattatcagaagaagaattcgaaaatgtggttaaagggttgaaaagacgtgtggctatcttcccacaaggtgaggtcgatataaagttttccttatcacccagcattgaagaaactagaaaggtactgcagaaatcacaaggcgatgatataaatgagctgcagtttgtcgatccagtcaaggtcatcgattactacagaaccttgagggatgatagatatgaggctttattaaatgaatactacaaaaaatacgggtgtgacacgtacgcttacaatttgccgaccggtatgttggtcatgcttttgggtagatatttcaaagagaacttcaagaccggtgacaagctagtagttgtgaactttcctcattcgattgctgatgcaacaagatttgaaaatgaggtttctatagtgtctaaaatctttgttccgaggaaattgagtggctctgacgtctgtaaatattacgaaactgtaggtaaagctgatatcatctga

SEQ ID NO: 1512 - DNA, 771 bp, Saccharomyces cerevisiae
atgaatacttcatcaagaataacttactttatcatcggtggtagccgtggaattggttttaatttggtcaaaattttaagcgcttctacgggcaatacagttataacctctattcgtggatcaccttcattacccaagaacaaacaagtggaagatttagcaaaaatcaggaagaatatccatattgtccaacttgaccttacaaaggacgaaagtattggcaatattgcggacgagatcaagaaaacgccattcttcttgggtattgatatttttatcgcatgttctgcagtatctgattcttattacaaggtcctggaaactcccaaatcagtctggctcaaccattatagcacaaacgctctgggtccgatactagcccttcaaaaagtttatccactgcttcttttgaaaaagacgaggaagatattctttatctctagtgttgcaggatctatcaatgcgtttgtaccactttctgtttccgcttatggtcaatcgaaagctgccttgaattatgcggtaaagacgctcagttttgaattgaaaccggagggttttactgtcgttgcttttcacccaggtatggtatctactgatatgggccaatatggccttgatcattttaaagagaagaatatagacatcagcggcgtaaatattatcacaccagaagaaagtgcctctgcgctaattgatgtcttccgaaaaattttaccagaagataatggaaagttcttcaactatgacggcagcgaaggcgtcttttag

SEQ ID NO: 1513 - DNA, 771 bp, Saccharomyces cerevisiae
atgacaaacatggctgccaagaatcagttcaaaggaagcagcttcacactagcgcagctaatcgaagaagtcggacgtaacggaggaaaaaagcctgtgttccagtataaggtaccacggtcgatacgatgggcttcaactgctctagctgtagtgtttctcacatatggcgctgcatacactgatatgtcgtggagaactgctcgagaagtgtacggaaacgctactgaggaagaaaaacacagcccgtggttcaagtgcaaaacttttgggcctgtggctttaggggttttgcctgtgatcctcgctgctgccacgaaacacgtaacgtcaagactagtcacagaaatgaaatatctgccaccgctcaagaatagtacggtgccacggtgtcaattgactcgacgcacttacttgttaggaagaccagtttctatcacgagggagatcaatgaactgtctaaaaataaggccaccaagatcttcacaggagtaggttctcaaggtatggaggataaggccacctttgttttcttcacagtggatgaaaaagcaccctcatttttcaataaattttacattttctcgagatctggtagcgttgtgaagaatgacgccaggatcttggactgctttttcaacagtgtggcagaaaataagctattgaacaggtcaatattaactcagatcctttcacatacgtctgccaagaccctatttcactcggggaattctagatcatccatcaagaatatcgtgaagcccaaatag

SEQ ID NO: 1514 - DNA, 771 bp, Saccharomyces cerevisiae
atgagtgttcgcttatcatacggcgcaagccttgcgtcaatcccaagatgtttcgacttgaaatcttcgaagattactgtaatgggggatgatcattctggaaaaacttctctggttcgcagttggctaggtagttcatttcaaatatcagatgctaatcgttatagggtttcggacctctaccacaagacaatccaatttgatactttggtaaaatactatcgtacctttggcgtaaaaggacagttgccgaattatgcgggtttcaaagctaaaaactctggcacaatttatgaaagttgtggcaatttcctagaagagcgcctgatcaatgccaataaatcgactgctcaaagacgcaccagtattgatgttcaagtttttgataccaatcaaatggaggtttcgtacctttcggagctaactactcttcaaattaggcagtctgatgcaattatattatgtttcgattctactaatgacagctctcttgccagcttagagtcttatatttgtattattcaccacgtacgtttggaatgtgaattggatattccaattattatagcgtgtacgaaatgtgatcttgattcggaaagaacaattactcatgaaaaggttttaacatttatccaagagctgggtttctcgccaggcaatttagactattttgagacatcctccaagttcaatgtaaatgttgaagatttgttcttggcagtattattgaaaattgaaaaatctaaaagtgatcgcaggaaacttttgtaa

SEQ ID NO: 1515 - DNA, 771 bp, Saccharomyces cerevisiae
atggatttcacaaaaccagaaactgttttaaatctacaaaatattagagatgaattagttagaatggaggattcgatcatcttcaaatttattgagaggtcgcatttcgccacatgtccttcagtttatgaggcaaaccatccaggtttagaaattccgaattttaaaggatctttcttggattgggctctttcaaatcttgaaattgcgcattctcgcatcagaagattcgaatcacctgatgaaactcccttctttcctgacaagattcagaaatcattcttaccgagcattaactacccacaaattttggcgccttatgccccagaagttaattacaatgataaaataaaaaaagtttatattgaaaagattataccattaatttcgaaaagagatggtgatgataagaataacttcggttctgttgccactagagatatagaatgtttgcaaagcttgagtaggagaatccactttggcaagtttgttgctgaagccaagttccaatcggatatcccgctatacacaaagctgatcaaaagtaaagatgtcgaggggataatgaagaatatcaccaattctgccgttgaagaaaagattctagaaagattaactaagaaggctgaagtctatggtgtggaccctaccaacgagtcaggtgaaagaaggattactccagaatatttggtaaaaatttataaggaaattgttatacctatcactaaggaagttgaggtggaatacttgctaagaaggttggaagagtaa

SEQ ID NO: 1516 - DNA, 771 bp, Saccharomyces cerevisiae
atggccccaggtaagaaagtcgctccagctccattcggtgctaagtcaactaagtctaacaagactagaaacccattgactcactctactccaaagaacttcggtattggtcaagctgtccaaccaaagagaaacttgtccagatacgtcaaatggccagaatacgtcagagtgcaaagacaaaagaagatcttgtccatcagattgaaggttcctccaaccattgctcaattccaatacactttggacagaaacaccgctgccgaaaccttcaagttgttcaacaagtacagaccagaaactgctgctgaaaagaaggaaagattgaccaaagaagctgccgctgttgctgaaggtaagtccaagcaagatgcttctccaaagccatacgctgtcaagtacggtttgaaccacgttgttgccttgatcgaaaacaagaaggctaagttggttttgattgctaacgatgtcgacccaattgaattggttgtctttttgccagctttgtgtaagaagatgggtgttccatacgccattgtcaagggtaaggctagattgggtaccttggttaaccaaaagacctctgccgttgccgctttgactgaagtcagagccgaagacgaagctgctttggctaagttggtttctaccattgacgctaacttcgctgacaaatacgatgaagtcaagaagcactggggtggtggtatccttggtaacaaggctcaagccaagatggacaagagagctaagaactccgactccgcttaa

SEQ ID NO: 1517 - DNA, 771 bp, Saccharomyces cerevisiae
atggctccaggtaagaaagttgctccagctccattcggtgctaagtccactaagtctaacaaggctaagaacccattgactcactctactccaaagaacttcggtattggccaagctgtccaaccaaagagaaacttgtccagatacgtcaaatggccagaatatgtcagattgcaaagacaaaagaagatcttgtccatcagattgaaggttcctccaaccattgctcaattccaatacactttggacagaaacaccgctgctgaaaccttcaagttgttcaacaagtacagaccagaaaccgctgctgaaaagaaggaaagattgaccaaggaagctgccgctatcgctgaaggtaagtctaagcaagacgcttctccaaagccatacgctgttaagtacggtttgaaccatgttgtctctttgattgaaaacaagaaggccaagttggttttgattgctaacgacgtcgacccaattgaattggttgttttcctaccagctttgtgtaagaagatgggtgttccatacgccattatcaagggtaaggctagattgggtactttggttaaccaaaagacttctgctgttgccgctttgaccgaagtcagagccgaagacgaagctgctttggctaagttggtttccaccattgacgctaacttcgctgacaaatacgatgaagtcaagaagcactggggcggtggtatccttggtaacaaggctcaagctaagatggacaagagagctaagacttccgactccgcttaa

SEQ ID NO: 1518 - DNA, 771 bp, Saccharomyces cerevisiae
atgtctggtaatagagagcaagtctttcctacgcgtatgacgctgggtttgatgaagaccaagttaaaaggtgccaaccaaggttattctttactaaagcgtaagtctgaagccctaacaaagagattcagagatattaccaaaagaattgatgatgctaagcaaaagatggggagagttatgcaaactgctgccttttccttggccgaagtttcctatgcaacaggtgaaaacattggctatcaagtgcaagaaagtgtctctactgcaagattcaaagtgagagcacgtcaagaaaacgttagtggtgtgtatttgtctcaatttgagtcctacatcgaccctgaaattaatgatttcagattaactggtttaggtagaggtggtcaacaggttcaacgagccaaggaaatctattcaagagccgttgaaactttagttgaattagcctctttacagactgcatttattattttggatgaagtgattaaagtgacgaacagaagggttaatgctatcgaacacgttattatcccaagaactgaaaacacaattgcttacattaacagtgagttggatgagttggacagagaagaattttatagattgaaaaaggtccaagaaaagaagcaaaatgagactgcaaaattggatgctgagatgaaattgaagagagatagagcagaacaagatgcttcagaagtagctgctgatgaggaacctcaaggtgaaacattggttgctgatcaagaagacgatgttatattctga

SEQ ID NO: 1519 - DNA, 771 bp, Saccharomyces cerevisiae
atgtggtcgaaaaagtttacattaaaaaagctaatcttaggcgggtatttgtttgctcaaaaggtctattgtgaagacgaaagtaactctatatacggtacctggtcatctaaatcaaatcaagtgttcacgggaccggggttttatgatcccgtagatgaactattgatagaaccttcattgcccgggcttagctattcgttcactgaagatggttggtacgaagaagctacttaccaggtaagtggcaatcctcgtaacccaacttgccccatggcttcgttgatttatcagcatggtacatataacatttcagaaaacggtacgttagttctgaatcctattgaagttgacggtagacaactattcagcgacccatgcaatgatgacggagtttcgacttattctagatataaccaaacagaaactttcaaggaatatgccgtaggtatagatccttaccatggtatttacaccctgcaattgtaccaatatgatggtactccaatgcaaccactatatttggcttatagaccaccaatgatgcttccaacagaaactttgaacccaacatcgtcagcgaccagcactgacgacccatcctctaataagaaaagatcactgagaagtttagtgaggaggagcctggaaaacagacacaagacgaatgccattaaaagacaaaatacctcatttttaacctccaatgccatttggtatatttctgcgggtatgctaggtgtaggttcattattatttttagcattttag

SEQ ID NO: 1520 - DNA, 771 bp, Saccharomyces cerevisiae
atgttcaaatcagtggctaaattggggaagtctccgattttttacttaaattctcagagattaattcatattaagactttaacaactccaaatgaaaatgctttaaaatttctctccacagatggcgagatgctacagacgcgtggctccaagagtatagttattaagaacactgatgaaaacctcatcaaccattccaagttagcacagcaaatttttttgcagtgtccaggagtggagtctttaatgataggtgatgattttctcactattaataaagacagaatggtccattggaatagtatcaagcctgaaattatagatttgttaaccaagcaacttgcttacggtgaagatgttatatccaaagaattccatgctgtccaagaagaagaaggagaaggtggctacaaaataaatatgcccaaatttgaacttaccgaagaagatgaagaggtcagcgaattgattgaagagctgatagatacaagaataagaccagccatcttggaggacggcggtgatatcgattaccgtgggtgggatccaaagactggaaccgtttatttaagattacaaggtgcatgtacctcatgctcttctagtgaagtgactttgaagtacggtattgagtccatgttgaagcactatgtggatgaagtgaaagaagtgattcagatcatggatcctgagcaagaaatagcattaaaggaatttgataagcttgaaaaaaagttggaatcgagtaaaaatacaagccatgaaaagtaa

SEQ ID NO: 1521 - DNA, 771 bp, Saccharomyces cerevisiae
atgtttaatttaattttatggcccttatttttgcttacctcagttgccattcctttgcagctgacattagaagtggtctatctgacgtcttccgttgacttctcaaaggcaagtgctgctaaaaccgctacttctttgggtcagtccccagttgtcatcaccatttataaatcactgttaaaatattggagtctttacgagttcatacattttatttacctctatactcctattgatgcctttctgaatttcttaccatttacctctttacttatgtcgtttggaagtatttgcttgacaagagagctggtatatgacttcattgcctttatggaatctcaaaacaagcttaccggattccttaataagataacagaaccgaattttaacagttatttactgttttcttcaatttataacatttggtttgcagatgacaccaatgacaaattcttattcggtaaattaactcagattttaatatctgtaacaaaaaggtacgaatttccaagaacattctacttagcaaaagtttctgatttcctacaaaatctcattctaacgagattgagaccctttgtaacggagcaaccccaaggcgacaaaaatcgctatcaaaacggtgaccgtgaatctacaaagaatggagctgcttatcagaagtcttcacaacaatcatcgtctttcgaacaaaattttaccagcactgagttcccgaatgattatgattttatggaggatattctagatgagacaactgaattggattag

SEQ ID NO: 1522 - DNA, 771 bp, Saccharomyces cerevisiae
atgtttgtggtggattggagcgtgcagctatgcatgggagtgatttcacctctcttccgtgccctcgtgcaactgcctttatcaattttcgtatggaatgggtttcagcttgtggcattgcctatcaacatcccattgaggttgttcctggggacgtcgctgagccgtttagttgcacaaacaagcacattagacttctatgtggttttgacgttgtttcaatattttgctgtgctttgtgcttttggcagcatcataggactcatctttggatttatattgggtgtgttccactcaatctgcggggtacccagtgtatacataagtctagaatggaaacggtggtttgctccgatacgtacggtccttgaacgtgcttccactagtattgtcaacattatgcgaggacaaactattgcgccaatacccatgcctaagcccaatcccacgcatatatcaaagcctaacatgaaaaaattccatgatgagcctggagctgatgatatgactataacgcatgatgtgaactgctacatcaccccttgccaaacgcctactaacgaaaaaattcagcattataataatgattcattcaacacgaccaccacagacgatgaacccactgatatttgggataggtctgacacttaccaaaactcattcgtcaccaatgaaactttgatgtctctttctaatagagctaagcttcgaagaaatgccagtgatgcggacatcgttaatataaagattttacgaaggaattctaggtga

SEQ ID NO: 1523 - DNA, 774 bp, Saccharomyces cerevisiae
atgaaaagaagtgaaaaaaaatcgatgagctcagctcttaagaacggtattatggaacgaactcaacccgaaaaggtagtacagatgcagggcacggcagatttgagcacttcgaaacttggtacgaaaaaatactgggatgaactgtatgccctggagctggagaatttcaggcggaatccgcaggataccggggactgttggtttagcgatagcgatgctgaacaaaagatgattgattttctggtagataacattggtgcgtacagaatttctgagaatgcttctgttgtagacctcggtacaggtaatggacacatgttatttgaactgcatcaaacggaattccaagggaaactggtcgggatagactattctgaggaaagcgtcaaactcgctagtaatatagccgaggccaccggtgttgacaatttcatcagtttccagcaagcagacatctttagtggtgactggaagccgggaaagtatgacattgtgttggataaagggaccctagatgccatttcattgagtggcatgaagatcaacggtaaacttgatgtagtcgatgtatacgccggagtagtggaaaggattttgaaaaaagacggtattttcttgatcacttcttgtaatttcacacaagatgaactagtaaagatcatagagactgataatttgaaaatgtggaaaacaataaaataccctgttttccaatttggcggggtccagggtgcgaccatatgtagtgtagcatttgttaaacaaaactga

SEQ ID NO: 1524 - DNA, 774 bp, Saccharomyces cerevisiae
atgaactctacaaccccatcgattcaagatcaatatattttggccagcaaagtacgctccaagctggcaaaatgcgttagcgtgactactaaaaacaaagactacaacctgagagttttagtcgggcacgcaaacttgctggataagattacagaaaatgtggaaactcataatgctgcaaccaacgcccttgccggagaccctttcagtaaaggacctgaaaacttgtccatcgaacatatcgaattgtccaatgctaatgctagtaaaaatgacgtcggtaaggaggaaaatgcagaaaagacgatagaaagtgaagattactgtgatttttactctagtgacgaagatccagatgctgacactctatcttctactgacagtgaagacgatgatgattatgaagactatgattttgagtacgattactctggcggtgattataacaagaaaattgacatgtactttagttttcacaccgcacctaattatcaatatttgactcacacaaactctcattccgagcagacggatgaacttgccgaatcaacgccgcgctacaatgctcttcccgccactgcctctacgacagaggaagaacaggacactgaaacgctcgatgctgtgagtttgcatagttcagcgccaatcttccgtgtgctctctcggcgggtaaatggacaagaagatgacagcgaaaacgagagtagtagcgatgtcgacgatggttccgtaccattaacgagatttcattcttgtcctatcacagcataa

SEQ ID NO: 1525 - DNA, 774 bp, Saccharomyces cerevisiae
atgtcacggaaattatgcacactaaattttactcttagcggaaagcagggaagtttggtcattagggatatccaactttggagcaatcgacctacagcaagtaaatcaacttcagagttgaggggacaattcattcagtatgtagatctcgcaaaactgcctttgtgggtccgctccacaaatatgaatacatatagatgttatagtaccagtgcaaccgcacaggcttacttcaaatcaaaactaaggaacgcgaatcgtggcattgtcattgaattgtttgacaaggtcgatcagcgatcgcaggagccagcatacttgattatatttcgagagaacacagagttaaactgctttcaagtggatctaacaatgaagcatgagtttgatggccaggtcaccaaattgaagcaagatattggaaagacaagggcctccgtatcaaaggaaggtagtattgatataataatacaacaatctcaacaaaggaagatcggaacgaaaacggaagtgtatcgcaacgtgcatattaatgacaaacggcttcaattcaatgaaactttgtccaagctaattttgggtggcctccgacttcgaggtatttctaattctattacagactatcaaaagttatacaagataacgtttgatgcagctgaatttacgcacagggatgaattaaaacgcatttcgatgggatctggtgaagaggtttcgtttgaatcattgcaggaaactgtggaaactcttctgaagctctttaccaaatcatga

SEQ ID NO: 1526 - DNA, 774 bp, Saccharomyces cerevisiae
atgtccactggtattacttatgatgaagatagaaagacacaattaattgcccaatacgaatctgtaagggaagttgtgaatgcagaggcaaaaaatgttcatgttaatgaaaatgcctccaaaattttattattggttgtttcgaaattgaaaccagctagcgatatacaaattctttacgaccatggtgtgagggagttcggggaaaactatgttcaagagttgatcgaaaaggcaaaattactaccagacgatatcaagtggcactttattggcggtttgcaaacgaataaatgtaaagatttggctaaagtgccaaatttatactctgttgaaacaatcgactccttgaagaaagccaaaaaattaaacgaatcgagggctaaatttcaaccagattgcaacccaatattgtgtaatgttcaaattaatacctcccatgaggatcaaaaatcgggcttgaataatgaagcagaaatatttgaagtcatcgacttcttcttatccgaagaatgcaagtatattaagttgaatgggttaatgactattggttcatggaacgtctctcatgaagatagcaaagaaaacagagactttgctacgctggttgagtggaagaagaagattgatgctaaatttggtacatcattgaaattgtctatggggatgagtgctgatttcagggaggctataaggcaaggaacagcggaagtcagaattggtaccgacatttttggtgctagacctccaaaaaatgaagctagaatcatttag

SEQ ID NO: 1527 - DNA, 774 bp, Saccharomyces cerevisiae
atgtttgttgattattccggactggagcgttacacggatataaatgcatcttttggtaagttggtcaacacttactgctgttttcagcgctgtgaagccatcagcgaacaattggagattctgaaaagtctagtaccaaagtgccacgacattgtggcacttactgacgaagactttgctagtggccgtactgccggactgacgcagaaattgtttgctatggcgatgaccctacaccagatcaccgactgtatcgacctcctgcagaaatgcaacaccataatacccatcgagatcgccaacccggctagctttgaaagcggcgccgcgacggcgccgctacgtcaaagctatgctaggctcttggatgactggtcccactacatgggcccatcaacggtaaaacacacaggctgtaccaaccgacccaagtggagatttccctggcaacagtcacggactatcatcatccccatgctgtttattggcgaaactgcaatgagcaccagggacctaaggtctgtgctgcatgattgtgagatcaggcacgcgagcgaaatgccgctgcagctactttggacgtcgtcaccggagttggtgtacgccacaccgcatgttgacgactacgacatttggtcgcgctacgggtctgattacaacatgcagatagaggacgaagacgaagcatcaaaagggcgacagcgcaagtgtgtggtgcagttggaggcactgttgggtgcgctacctactacggacccgttgttccaatggtag

SEQ ID NO: 1528 - DNA, 777 bp, Saccharomyces cerevisiae
atgaagaagacgttcgagcagtttcgaaaaagcaatttactatttcaggttctcaaaggaccccagcatctagaatgtcagaagttatttgtccttgattcttcattcaatccaccacatctggcccattttcaactactatcgcagactattaaaaacttcaaattgaaggacacccgttcgcatgttttattactgttagcggtgaataatgcagataagttgcctaagccggcatcttttccaactcgtctggaaatgatgtgcttattcgctgactaccttcaggagaagctcccccaatctgtagtatctgtcgggttgactgttttctcgaaattcatcgacaaggacaaaatattacatgagcaatttgttaaaggatgcagtgcagatataggctacttagttggttttgatacaattgctaggatctttgatgaaaaatattatcatcctttaaaaatcagtgatgtaatggagagcttcatgtcgggatctcaattatattgcttggcgagaggcgattgccatctcagtgctgaatcgcaactaagatacgccagtgacatccttgagggaaaattcgaaccggtaataccaagagaatggggcgctaggattcatgttatgcaaaatgattatccagcattaagaaatgtttcatcatccgagattaggaacaaactgaagaatgggcaagtggagagtttgaaagacgagttgccattgtgcatatacgattatttgatcaataataagacaatatttgattga

SEQ ID NO: 1529 - DNA, 777 bp, Saccharomyces cerevisiae
atgcaaaaaattttcagaccattccaattaacgagaggctttacctcttccgtaaaaaacttcaggcaatggagactgattgaaacaaggaagattgccaaacaaccgaactaccaagttggtgatgctaaacctttacatatgccaaaagaaagaaagaaatttccagattacaagtatggggaatctaatatcttcaaacagagtaacaaaggtctatatggtggatctttcgttcagtttggtaacaatatttctgaaagtaaagccaaaacgaggaagaagtggttgccaaatgttgtcaaaaaaggtctctggagtgagactctgaacagaaaaatcagtatcaaaatgaccgctaaagttttaaaaacaatcagtaaagaaggagggattgacaactatttaacaaaggaaaaatctgcaagaataaaagaattagggccgaccggatggaagcttcgttatagggttttaaaaagaaaagatgaaatagagaatcccccacataaggatgcacctatcatagaaatggctggtggtaaaaaggccaaaatttactatgatgaaatagtaaacggctcaccaagaaaaatatcagttggaagaagaagattgatgtcatttttatatcctttagagaaattggaatataggtcagtagggaaggacctgaactacaaaaaatttgtcgagttatttgccgacgttccagtcaaggatatcctagctagattagaggatcataaattcgacttatccaccatcaccgtataa

SEQ ID NO: 1530 - DNA, 777 bp, Saccharomyces cerevisiae
atggatgacgatcacgaacagttggtcgaagaactggaggccgtcgaggccatctatccggatcttctctccaagaagcaggaagacggaagcatcatcgttgtgaaagtgccgcagcatgaatacatgacactgcagatctccttcccgacacactacccctccgaggaggctcctaatgtcatcgaagttggtgtctgcacttctttggctaagcgcgatctctacgataccaagtaccttcagcatttgttccaggaagtgatggactctgttttccaccgcggatctgtctgtctatttgacttcctcacagaactcgacggtgtcttgtacgttgaaccagaggaggagacagaaccggtccagcagagtgacattcccacagaccccttcgagggctggaccgcgtcggaccccattactgatagaggctcgactttcatggcctttgcagcacatgttacctccgaggaacaagcgtttgccatgctagacctactgaagaccgactccaagatgcgtaaggcaaaccatgtcatgagtgcatggcgaatcaagcaggatggctctgcggcaacatatcaagattccgatgatgacggtgaaacggccgccggctccagaatgctgcacctcatcaccatcatggatgtgtggaacgtcatcgttgtggtggcccgttggttcggcggtgcccacataggtcccgaccggtttaaacacatcaattctacggcaagagaagctgttgtcagggccggcttcgactcgtaa

SEQ ID NO: 1531 - DNA, 777 bp, Saccharomyces cerevisiae
atggcacccaagaaatccactaccaagaccacaagtaagggcaagaagcctgcaaccagcaaaggcaaggagaaatcaacttccaaggccgctatcaagaaaaccacggcaaaaaaggaggaagcttcctccaagagttacagggagttgatcattgaagggctcacggctttgaaggaacgtaagggatccagtcgtccggcactcaagaagtttatcaaggaaaactacccgatcgtcggatccgcaagcaactttgatttgtacttcaacaatgccataaagaagggtgtggaggccggcgattttgaacagccaaagggacccgctggtgctgtgaaactggccaagaagaaatctccagaagtaaagaaagaaaaagaggtcagtccaaaacccaagcaagccgccacttctgtgagtgcaaccgcatcaaaagcgaaagccgcatccacgaagctagcgccaaagaaagtagtgaaaaaaaaatcgcctactgttaccgccaagaaggcctcttcgccttcttcattgacctacaaggaaatgatccttaaaagcatgcctcaacttaatgacggtaagggctccagccgtatcgttttaaagaagtatgtcaaggacactttctcctccaagttgaaaacaagctcaaattttgactatctgttcaatagcgctatcaagaaatgtgttgaaaacggcgagttagtgcaaccaaagggcccctccggcattattaaactaaacaagaagaaggtcaaactctccacgtaa

SEQ ID NO: 1532 - DNA, 777 bp, Saccharomyces cerevisiae
atggctgccggtgtcccaaaaattgatgcgttagaatctttgggcaatcctttggaggatgccaagagagctgcagcatacagagcagttgatgaaaatttaaaatttgatgatcacaaaattattggaattggtagtggtagcacagtggtttatgttgccgaaagaattggacaatatttgcatgaccctaaattttatgaagtagcgtctaaattcatttgcattccaacaggattccaatcaagaaacttgattttggataacaagttgcaattaggctccattgaacagtatcctcgcattgatatagcgtttgacggtgctgatgaagtggatgagaatttacaattaattaaaggtggtggtgcttgtctatttcaagaaaaattggttagtactagtgctaaaaccttcattgtcgttgctgattcaagaaaaaagtcaccaaaacatttaggtaagaactggaggcaaggtgttcccattgaaattgtaccttcctcatacgtgagggtcaagaatgatctattagaacaattgcatgctgaaaaagttgacatcagacaaggaggttctgctaaagcaggtcctgttgtaactgacaataataacttcattatcgatgcggatttcggtgaaatttccgatccaagaaaattgcatagagaaatcaaactgttagtgggcgtggtggaaacaggtttattcatcgacaacgcttcaaaagcctacttcggtaattctgacggtagtgttgaagttaccgaaaagtga

SEQ ID NO: 1533 - DNA, 777 bp, Saccharomyces cerevisiae
atgggcagtagatcggagaatgtgggaacagtgactagagaaggctccagagtggaacaagatgatgtcctcatggatgatgactctgactcatcggaatacgtggatatgtggatcgatttatttcttgggagaaaaggccatgaatatttctgtgatgtcgatcctgagtacatcactgatcgttttaatctgatgaacttgcaaaagacagtttcaaaattttcctacgtggtacaatatattgtggatgatttggatgatagtatcctagagaatatgacacatgcccgtttagaacaattagaatcagattcccggaagctgtatggtctcatccatgcacgctacattataactatcaaaggattgcaaaaaatgtacgctaagtacaaagaggcggactttggaagatgtccccgtgtgtattgtaatttacaacagttgttaccggttggtttgcatgacattcctggtatagattgtgtcaagttatattgtccatcttgtgaggatctttatataccaaaatcatcgagacatagttccattgatggtgcatactttggaacaagttttccaggtatgtttttgcaagcatttccagatatggtacccaaacacccaactaaaagatatgttccaaaaatatttggatttgaattacataaacaagctcaactgacaaggtggcaagaactacaacgactcaagttagttgagaaacttgaatccaaagatgttgatttgacgaaaagtggtggttttaaaacctaa

SEQ ID NO: 1534 - DNA, 777 bp, Saccharomyces cerevisiae
atgggttccagaagatacgattccaggacaacaattttctcccctgagggacgtctatatcaggttgaatacgcgctagaatccatttcacatgcaggtaccgcaattgggattatggcatctgatgggattgttcttgcagcagaacgcaaagtcacaagtactttactagaacaagacacctctaccgaaaaactttataagttaaacgataaaattgcggttgccgttgctggactgactgcagatgcagaaattctaataaatacggctagaattcacgctcaaaattaccttaaaacctataatgaagatataccagtagaaattttggtgagaaggctaagtgatataaaacaaggttacacgcaacatggtggtttaagaccatttggtgtgtcctttatctacgccggttatgacgatagatacggttaccaattgtatacatctaatccatcgggaaactatacagggtggaaggctattagtgttggcgctaacacatcagcagcacaaaccctacttcaaatggactacaaggatgatatgaaagtcgatgatgccattgaactggctttaaaaacgttatccaaaactaccgacagtagcgcgctgacttatgacaggttggaatttgctactatcagaaagggtgctaatgacggagaagtgtatcagaagattttcaagcctcaagagataaaggatatattggtaaagactggtattaccaagaaggatgaagacgaagaagctgatgaagatatgaaataa

SEQ ID NO: 1535 - DNA, 777 bp, Saccharomyces cerevisiae
atgttagaagcaaaatttgaagaagcatcccttttcaagagaataattgatggtttcaaagattgtgtccagttggtcaatttccaatgtaaagaagatggtatcattgcacaagctgtcgatgactcaagagttctattggtctccttggaaataggtgtcgaagccttccaagaatatagatgtgaccatcctgttacgttaggtatggatctaacctcactaagtaaaatcctacgttgtggtaacaacaccgatacattaacactaattgctgacaacacaccggattccatcatcttattatttgaggataccaagaaagaccgtatagccgaatactctctgaaattgatggatatcgatgctgatttcttaaagattgaagaattacagtacgactccaccctgtcattgccatcttccgaattctctaaaattgttcgtgacttgtcccaattgagtgattctattaatatcatgatcaccaaagaaacaataaagtttgtagctgacggtgatatcggatcaggttcagtcataataaaaccattcgtggatatggaacatcctgaaacaagcatcaaacttgaaatggatcaacctgtcgacttgacgttcggagctaaatatttattggacatcattaagggctcctccctttctgatagagttggtatcaggctctccagcgaagctcctgctttattccaatttgatttgaagagtgggttcctacagtttttcttggctcctaaatttaatgacgaagaataa

SEQ ID NO: 1536 - DNA, 780 bp, Saccharomyces cerevisiae
atgagctacaattatttgaaggcagctagaaaaattatatgcattgggcgtaattacgcagcgcatatcaaagagctgaacaattcaactccaaaacaaccgttttttttcctaaaaccaacctcgagtattgtgacaccattgtcttcatcattggtcaagaccactagacctgcaaactcgactttcaatggtttaaatgaagacggaactaaccccgggcccatttttatcccacgcggtgtgaaggttcatcacgaaattgagttggcattgattgtgagcaaacatttgtccaatgtcactaagatgaaacccgaagaagtctatgactctattagtggtgtagctctagcattggatcttacagcaagaaatgtccaagatgaagccaaaaagaaggggctaccttggactataagcaagggttttgacaccttcatgccaatctctgctatagtctcccgcgagaagttctcatcctacaaatcaaacttacaggatattttcagagtcaagtgctctgttaacggacagttgagacaagatggtggtactaacctcatgttgcacccactccataaaatactgcaacacatatctaccatgatatctctggaaccgggtgatatcattttgactggtacacctgcaggtgtaggcgagttaaagcctggtgaccgtgttcactgtgagctattgcagaataatgacaatattgtcgacatgaacttcgaatgtgaaaatcggccgggaccatatgaatttagagaaacataa

SEQ ID NO: 1537 - DNA, 780 bp, Saccharomyces cerevisiae
atgaggtatgtttgataagatatatacgtatatttatatatcactcttctgagaaagtatgccatagaatgaggatcactaacaaagaaaatgtcaatgaacttcaaagatatcgtttaatgaaacagtagctctaaaagaaggatcgagacagatgttatgaaactgttgatgagtgatcatcaagtggatttaatcaatgatagcatgcaagagtttcatgtaaagttcttgggaccaaaggatacaccctacgaaaatggggtttggaggttacatgtagagttgccggataattacccatacaagtcgccaagcatagggttcgttaacaagatattccatcctaacattgatatcgcatcggggtccatatgtttggacgtaattaactctacatggtcgcctttatatgatctgataaatatagtggagtggatgataccaggtttattaaaggagcctaatggtagcgatcccttgaataacgaagctgccacattgcaattacgagataaaaaactgtatgaggaaaaaatcaaagagtatatagacaagtatgctacaaaggaaaagtaccaacaaatgtttggcggagataatgatagcgatgacagtgatagcggcggtgatttacaagaagaggacagtgattctgatgaagatatggatggcactggtgtttccagtggcgatgatagcgtagatgagttaagcgaggatctaagtgacatagatgtcagtgatgacgatgactacgacgaagtcgcaaatcaataa

SEQ ID NO: 1538 - DNA, 780 bp, Saccharomyces cerevisiae
atggacggatattgggatgttgtagtgtcgtccttgcaagacatatacaatgccaacgaggtcattccctttgatgatgagctgcaaacaaaaaaactaaatttccttaatatgtcaaaggatcagctgcaattgcatctcaacactttccaagaacacatggaaaacgtcaacagagtgcaccgaatccttgacaatgtacgttccaatttgtcgttgatgttgaatcagtcacgagaggaaaagagtgaggaaaatactgaagatgcagaagaaggagaagggacacgcatggcattgtcgcagggcaagaaagctgtggggaaagttggcagatcgtactggaccagcgaatacaacccaaatgcacctattttggtgggctcagaggttgcctataagcccagaaggggcagtgccgacggcgaatggatacagtgtgaagtactcaaagtcgtagcagatggtacacgatttgaagtgagagatcctgaacctgatgaattgggcaactcaggcaaggtgtataaatgtaatcggaaagaactactgttgatcccgccaggctttcccactaagaactacccgccaggtactaaggttctggcaagatatcctgaaacgaccactttttatcctgcaattgtcatcggaaccaagagggacggcacttgcaggcttcgatttgatggtgaagaggaagtggacaaagagacggaagtgactcgccgtctagtgctgccttcgccaacggctttggcaaacctagcaaggaaatag

SEQ ID NO: 1539 - DNA, 780 bp, Saccharomyces cerevisiae
atggagccagagagcataggcgatgtggggaaccatgcccaggatgatagtgccagtatagtgtccgggcctcgcaggcgttctactagcaagacatccagtgcgaagaatatacggaactccagtaatatctctccagcatcgatgattttcaggaatttgttgatactggaggatgatttaagacgccaagctcacgaacaaaagatactgaagtggcaattcactttgttcttagcgtctatggccggtgtaggcgcatttaccttctacgaactttatttcacttcagattatgtcaagggcctccatagggttattttgcaattcactctttctttcatttccattactgtagttctttttcatatcagtggacaatatagaagaactatcgtcattccaagaagattttttacctctactaataaagggattaggcagtttaatgtgaagctagttaaagtacagtctacgtgggacgagaaatacacagattcagtaagatttgtgagtcgaacaattgcttattgtaatatttattgtttgaaaaaatttctgtggcttaaagacgataatgccattgtgaaattttggaaaagtgtcacgatacaatcccaaccgaggatcggagctgtggatgtgaaattagtcctcaaccccagagcatttagtgcagagattagagaaggatgggagatttatagagacgagttttgggccagggaaggtgctagaagacgcaaacaagcgcacgaactccgacctaaatcagaatga

SEQ ID NO: 1540 - DNA, 780 bp, Saccharomyces cerevisiae
atgttcagaaagagattagtgaacaaaagctcttctgatgaaaagaaccagaaaaagaggcagaaaattaattttagcgaagagaaactagtggccagcgatgaagaaaagggttccagtgacctcatgagcttagccaagagtggaaatagcaggacacttcaactttcacatgagaatgaaggtaaactacagaaaaagggtgaggatttagataaatacactttaacggtcaacgacgacagcactaaagaagatcttctaaactttgagagaaaagagctggctgagaaggcaaagaagaggcgacctagtgatgacaatgagctggtactgaacatgagcggtaaaaataaacgcctcactaaacagattaaccaaccaacgaatatccggaccacggtgctgatggattttcagcccgacgtttgcaaagattacaaacagacgggatactgtggttacggagatagctgcaagttcttacactcgagggatgatttcaagactggctggaagctgaaccaagaatggaatgcggataaagaggactccaaagcggttactctagacttggaaaagataccgttcaagtgcactctttgtaaggaagattacaagtctccagtggtcacaaactgtggccattatttttgtggatcgtgttttgccaaagatatgaaaaagggcaccaaatgctttatatgccacaaggagacccacggcagtgcaaaagtagcatctgacttacagaagatgctaaataaaaggaaaagttga

SEQ ID NO: 1541 - DNA, 780 bp, Saccharomyces cerevisiae
atgtttaatttattaaatacatatattacatcaccattagatcaatttgagattagactattatttggtttacaatcatcatttattgatttaagttgtttaaatttaacaacattttcattatatactattattgtattattagttattacaagtttatatctattaactaataataataataaaattattggttcaagatgattaatttcacaagaagctatttatgatactattataaatatgcttaaaggacaaattggaggtaaaaattgaggtttatatttccctatgatctttacattatttatgtttatttttattgctaatttaattagtatgattccatactcatttgcattatcagctcatttagtatttattatctctttaagtattgttatttgattaggtaatactattttaggtttatataaacatggttgagtattcttctcattattcgtacctgctggtacaccattaccattagtacctttattagttattattgaaactttatcttatttcgctagagctatttcattaggtttaagattaggttctaatatcttagctggtcatttattaatggttattttagctggtttactatttaattttatgttaattaatttatttactttagtattcggttttgtacctttagctatgatcttagccattatgatgttagaattcgctattggtatcattcagggatatgtctgggctattttaacagcatcatatttaaaagatgcagtatacttacattaa

SEQ ID NO: 1542 - DNA, 783 bp, Saccharomyces cerevisiae
atgattttcaaaatattgtgtagtttactactggtaacctccaacttcgcttctgccttatatgtcaatgaaactacgagctatacaccatacacgaagacattaactccaacatactctgtttcacctcaagagacaacattaacgtacagcgatgaaacaaccaccttctacataacatctactttttactctacctactggttcactacctcccaatcagctgctattattagtacacctactgcaagtacacctactgcaagcacgcctagcctaactacgtccacaaatgaatacaccaccacctattctgacacagacaccacctacacgtctactctgacctctacttacataataactctatctacggaatccgccaacgagaaggctgaacagatttccacgagcgtcacagaaattgcttctacagtaaccgaatcgggcagtacatacacctctactttgacctcaaccttattggttactgtatataattcccaagctagtaatacaatagcgacatccacagctggggacgccgcctccaatgttgatgccttagaaaagttagtctctgctgaacatcaatctcagatgattcaaaccacatccgccgatgaacagtactgtagtgcgtctaccaagtatgttacagttacagctgctgcagttaccgaagtggttactactacggcggagcctgttgttaaatacgttactataactgccgatgctagtaatgttacaggttctgctaacaacggtacccacatttaa

SEQ ID NO: 1543 - DNA, 783 bp, Saccharomyces cerevisiae
atgctttgtcgcaatactgccagaacgggctgtaaattctttcgtttatatcattcgaaccctatcgaacatgttaaaccaattcatattaaacctttaacttatggaaaagaatcaccccagtataaagtattgtcactagctctacaaaagtttgttcccgagcacggtttctctgaaagatccattgttgaatctttaaatgagctcggctatccttcctccatgatctcttcaataggtgctcccaactcgccctcgtttttccattcttccaccgctgtcatggaactgataaagtttcaattggtagataaaaggtatcgtttaactgaaggaatcaaccctgacgtaactccacaatacaaactaccctcattagaacatttgctgttaaaaagattggagatggacaagccaatcggtgggcatttgtcggaactaatgtcacaattggctattccaagcgcctttctctttgaaactgcaattcctgaactacacagattgtccgatgatatgatttacttttccaacgaaaaggaccaccatgattctgcatggtatgctaagagattggctgtttcgagcacctacattggttcaaagttatttatggctcaggataaatcccacaattacaaagaaacgtttacttttgcaaaggataaattacatagggtcatgcgtttgggtgagtactataacaatactgaagagtttgcctggtatacgttaatgtctacggtaaatttaatcaaatctcaattagttaggggttaa

SEQ ID NO: 1544 - DNA, 783 bp, Saccharomyces cerevisiae
atggtgtcgttagacgatatactaggtatcgtgtatgttacgtcatggtcgatatcgatgtatccaccgataatcaccaattggcgccataagtcagcgagcgcgatatcgatggattttgtcatgttaaatacggcaggttactcttacctggtcatatccatatttttgcaattgtactgctggaaaatgacgggtgatgagtctgacttgggcaggcccaagttgacgcaatttgatttctggtattgcctgcatgggtgcttgatgaatgttgtcttattgacccaggtggtagctggagcgagaatctggcgatttccaggtaaaggtcaccgcaagatgaatccatggtacctaaggattttactcgcatcactggccattttttcactgctaaccgtacaatttatgtactccaactactggtacgattggcataactcaagaactctggcgtattgcaacaatttgtttttactcaaaatatcgatgtcactaatcaagtacatcccacaagtgacgcataactcgacaagaaaatctatggattgtttccccattcagggtgtgtttctagatgtcactggcggtatcgcctcgctgctccaattgatttggcagttgtctaacgatcaaggtttcagtctggatacgttcgtgacaaattttggaaaagtgggactgtcaatggtaactttaatattcaacttcatctttatcatgcagtggtttgtatatcgatctcgaggccatgatctggcgtcagagtacccgctgtag

SEQ ID NO: 1545 - DNA, 783 bp, Saccharomyces cerevisiae
atgttcttaactagaagtgaatatgatcgtggtgtaagcacattttccccagaagggaggttattccaagttgagtattctttggaggccatcaaattaggatctacagcaattggtattgccacgaaagaaggtgttgtactaggtgtggagaaacgtgccacctcaccactattagaatctgattctattgagaaaatcgtggagattgatcgtcatattggttgtgcaatgagtgggcttacagcagatgctcgttccatgattgaacatgcgcgtactgctgcagtaacgcataatctatactacgatgaagacatcaatgttgagtccttaacgcaatcggtgtgtgatcttgctctaaggttcggtgaaggtgcctctggtgaagaaagactaatgtctcgaccattcggggttgccttgttaattgctggccatgatgcggatgatggttatcaacttttccatgcagaaccatctgggacattttaccgttataatgccaaagccattggttcaggctctgaaggagcacaagcagaattattgaatgaatggcattcttctttaactttgaaagaagctgagcttcttgttctaaaaatcctaaagcaagtgatggaagagaaacttgatgaaaataacgcgcaattgagttgtataacaaagcaagacggattcaaaatatatgataacgaaaaaactgctgaattgataaaagagttgaaagagaaagaagctgcagaaagtccagaagaagcggatgttgaaatgtcataa

SEQ ID NO: 1546 - DNA, 783 bp, Saccharomyces cerevisiae
atgtttgtactgatagataatgtcctcgcctaccttcttgaacaagacgacctatttgtaaccgcacgcttcgctatccagggccaaattgtctcaagaagagttaacaaaatacatatctccaacatcacagacgtccttctacaacaattcataagtcacacactgccctataatgacaatatcgtcccaaaaaaaatcctcgacagcatgagaacggccgtacggcagttgctggaagcaactgcctgtgtctctagagaatgccccctcgtcaaaagaagtcaggacataaaaagagcaagaaaacgtctactcagtgactggtataggctcggcgctgatgcaaacatggatgccgtattactagttgttaactccgcctggaggtttctggccgtctggcgacccttcgtaaactcaatccaacatgcaactcaggaattgtatcaaaatatcgcccattaccttcttcatggcaacgtaaatatacagagggtcacagcactactacagctcgtaatgggacaggacgatttactttttagtatggatgatgttctacaagaggtcttcagaatacagctctatttgaataagatgctgccgcacaactctcacaaatggcaaaagccatccccctttgactccgcaaacttactacttaacttcagagactggacaactgacaatgctctcctccaagagttgctactatcctatcccacaattaataaaaacaaacacaaaaatcactccgtccctcgtctaatacaagtttga

SEQ ID NO: 1547 - DNA, 786 bp, Saccharomyces cerevisiae
atgaagacctatcatttgaataatgatataattgtcacacaagaacagttggatcattggaatgaacaactaatcaagctggaaacgccacaggagattattgcatggtctatcgtaacgtttcctcaccttttccaaaccactgcatttggtttgactggcttggttactatcgatatgttgtcaaagctatctgaaaaatactacatgccagaactattatttatagacactttgcaccatttcccacaaactttaacactaaaaaacgagattgagaaaaaatactaccagcctaaaaatcaaaccattcacgtatataagccggatggatgtgaatcggaggcagattttgcctcgaaatacggggatttcttatgggagaaagatgatgacaagtacgattatctggccaaagtggaacctgcacatcgtgcctacaaagagctacatataagtgctgtgtttactggtagaagaaaatcacaaggttctgcccgctcccaactgtcgattattgaaatagacgaacttaatggaatcttaaaaataaatccattgatcaattggacgttcgagcaggttaaacagtatatagatgcaaacaatgtaccatacaacgaacttttggaccttggatatagatccattggtgattaccattccacacaacccgtcaaggaaggtgaagatgagagagcaggaagatggaagggcaaggccaagaccgagtgtggaattcatgaagccagccgattcgcgcaatttttaaagcaagatgcctag

SEQ ID NO: 1548 - DNA, 786 bp, Saccharomyces cerevisiae
atgacaaaggaagaaggtcgtacgtattttgaatctctctgcgaggaggaacaaagtttgcaggaaagccaaacccacttattaaatattttagatatattatcagtattggcagaccctagatcatctgatgatctgcttactgaatccctcaagaagttgcctgatttacacagggagctgataaatagttccatccgcctgcgatacgataaatatcaaacaagagaagcacagcttttggaggatacaaaaactggaagggacgttgcagcgggagtacagaatcctaagagtattagcgagtactattctactttcgaacatttgaatagggatactttaaggtacataaatttactgaagcgactttctgttgatttagcaaagcaggtggaagtgtctgatccatcagtgacagtgtatgaaatggataaatgggttccatctgagaaacttcagggtattctcgagcagtactgtgcgcctgatactgatatacgtggtgtagacgctcaaatcaagaactatctagatcagatcaaaatggcacgtgccaaatttggtttagagaataagtattccttaaaggaaagactctctactttgacaaaggaactaaaccattggcgaaaagaatgggacgatatagaaatgcttatgttcggtgatgatgcacattctatgaaaaaaatgatccagaagatagattcattaaagtctgaaataaatgctccatcggaaagctatcctgtagataaagaaggtgacatagttttagaataa

SEQ ID NO: 1549 - DNA, 786 bp, Saccharomyces cerevisiae
atgacgaagtttattggttgtatagacctgcataatggagaggttaaacagattgtaggtggaacgttaacgagcaaaaaggaggacgttccaaaaactaactttgtatcacaacatccttcttcatattacgctaaactttacaaagacagagatgtccaaggatgtcatgttattaagttgggacctaacaatgacgacgctgcacgcgaggcactccaggagtcaccacaatttctacaagtgggcggaggaattaatgatacgaactgtttggaatggttaaaatgggccagtaaagtaattgttacgagttggctatttacaaaagagggtcattttcaattaaaaaggttagaaagactgacagaactatgtgggaaagaccgcattgttgtagacttaagctgtagaaaaacccaggacggtcgttggattgtggccatgaacaaatggcaaactctaactgatcttgagcttaatgctgacactttcagagaattgaggaaatatacaaatgagtttctaattcacgctgcagacgttgaaggtttgtgtggtggtatcgatgaattattggtttctaagcttttcgaatggaccaaagattacgatgatttgaaaatcgtttatgctggtggggccaaaagtgttgatgatttgaaattagtagacgaactaagtcacggaaaagtagatttgacattcggtagttccttagatatatttggtggtaacctagttaagtttgaagactgctgtagatggaatgaaaagcaaggttag

SEQ ID NO: 1550 - DNA, 786 bp, Saccharomyces cerevisiae
atgacgcaagaattcattgataaagtatcttcctacctgactcctgatgtggacattgcacctatttctcaaggtgcagaagccattgttttcacaacgactactcacccatatctcccaagagcaaaggattctcatcaaaagtatattatcaaatataggccaccaaagcgttatagacatccacaaatagaccaggcactaacaaaacatcgtacgttgaatgagtcgcgtttattggccaaattatacttgattccagggctatgtgtccctcaactgatagcgtgtgatccatacaatggattcatttggttagagttccttggagaagatcttcccggagggcacggttttagtaacctaaagaacttcctttggatgcatgaccaagatccatatagtgatcttgtagcaactacactacggaaagtggggcgccaaattgggttgttgcactggaatgactactgtcatggtgatttgacaagttctaacattgttctcgtgcgagatggtgcgagatggacgcctcatttgattgatttcggtctgggctcagtttcaaacctggtcgaagataaaggcgtcgatttatacgtcttagagagagctattttaagtacacattcgaagcatgcggaaaaatacaatgcttggatcatggaggggttcgaagaggtctatcgtgaacaaggtgcgaaaggtgccaagaaactgaaagaagttaccaaaagattcgaagaggtcaggttgcgtggtcgtaagagaagtatgctaggataa

SEQ ID NO: 1551 - DNA, 786 bp, Saccharomyces cerevisiae
atgagtgaaacacgagaatctaatgaaagtacagtttcgtctttacaaaccaaacttttgctcaatgacggaatatccgaaaacaacaagaaaaatgttatactgctgaatcaaatagtgccgtttattctgaatacttcacattatatgacggatctaatgtatgtcttgtattatctggctcaaaagcaggaagacgaagtattaaaccattctggcacatttatttcacacaaaaaagaactccttgcactaaagagtgatatttgtgaactaatttacgatttaaggacaggattccgcttattattggatagttgtgagttagatcactttgaaactcctggaaaatgccggcatttgatcgagaaggttctagtcacctccatttatggagtgaacaggtatattttccaggaattaaacagattaaatgtcgattttaaagatgaatttatattacaaatgcaaaattgtttatcaggattcgttaatctctacaaatttttgaacaagatccctatgagtaaacaacagtcacagatgaacgatttacagatgaagatcttagttaatgtgttacagaatgaattgttacccatttggaagtttcagttagatcttttgaattgtaaactatttaacgagctctctaaggataagggcctgattaatatatatagaaaagctacgaacgatagtgttattgatgttagcaagggtgaaccattcatcagatatgttaattggctaaaggaccaaattattggtgaaatgacggtttaa

SEQ ID NO: 1552 - DNA, 786 bp, Saccharomyces cerevisiae
atgcctcaaaacgattatatcgagcgtcacatcaaacagcatggtaaaagattagatcacgaagaaaggaaacgtaagagagaggcaagagagtctcataagatttctgaacgggcccagaagttgactggttggaagggtaagcaatttgctaagaagagatatgctgaaaaggtatcaatgagaaagaagattaaggcacatgaacaatctaaggtcaagggttcatccaaaccattggataccgatggtgatgctttgccgacatatctattggacagagaacaaaataacacagccaaagctatttcttcatcgatcaaacaaaagaggttggaaaaagctgataagttttcagttccgttaccaaaggttcgtggtataagtgaagaagaaatgttcaaagttattaaaacaggtaaatctagatccaagtcatggaagagaatgataacgaaacacacttttgtgggtgaaggtttcactagaagaccagttaaaatggaaagaatcatcagaccaagtgcgttgagacagaaaaaggcaaacgtcactcatccggaattaggtgtaactgtcttcttgccaattttggcagttaagaagaatccacaatctccaatgtacactcagttaggtgttttgactaaaggtaccattattgaagttaacgtttcggaattggggatggttactgctggtggtaaagttgtctggggtaagtatgctcaggtcacaaacgaaccagacagagacggctgtgtcaatgcggttttgcttgtatga

SEQ ID NO: 1553 - DNA, 786 bp, Saccharomyces cerevisiae
atgctgggtttgggccaatctgctcaagcatatgcaagtgatgatgctctcaatatgaaccaggcaaaggataaaacgtacagcgttccagggtgtggcagggcaagcgacctcaaatatcctcatcgtgacggacactcttcgtctcacgaacagcgctctggaattttaccaactgaatgcccaggccctactttaaacaccggtgccggtagcatcggtatcccgggatgtggcaaagtcacaaatagagtggtcagtgactataacaaaaacgctaggtctacgctagccaattttgatagtagtaaaatgaccgaggcaagaatgaacagcaagaacgtgccgattggttgtcaagacacctctgatccgcacttcaatgggcctatcgaccaacatgttcccggtgcaggttcacctcaaagtcaacctcatcacatcgacgcgtggaacagcgtttcttctcgccgtgccgataataacaaccaagacatgatggacccccaaacggcttcctcagacaggtacaatgagaaaatgatgagagaagaaaatagcggcgtctctgcttcttcttacaccactaaagtgcagggatatcccgcaagtattccatcattcaatcaggaaactgaggaaaaggaaacctacgcctacggtgtgggtgatcggcacaatgtcccaagaaaccaaattatggatgagactaatccttcggctaacgttctaaacgctactgatcatagtatttcgcaccctgagaataaggtcttgcataagtag

SEQ ID NO: 1554 - DNA, 786 bp, Saccharomyces cerevisiae
atggcaccaagtatagcaacggtaaagatagccagggacatggttttgccattacgtatatttgtcaatagaaagcagatccttcaaaccaatgataagactagcaataagtcgaatgccactatatttgaagcaccattattatcaaataactccataatctgcttaaaatcaccaaatacaagaatatatttatcgcaacaagataagaagaatctttgtgacgagatcaaggaggacctgttattgattgtttacgaactagcgtccccggaaatcatcagttccgtactcagcaaaataagagttggtcattctactgatttccaaatcaacgttctgcccaaactttttgcaggtgccgatacggataatgcggtaacttctcacatccagtctgtgacaaggctggctaaattcaaatacaagttgcactacaaacataagtgggagctcgacatattcatcaacagcattaagaagatcgccaatttaaggcactatttgatgtttcaaacattaacattaaacggtttctcattaaatgcaggacccaaaacgttattagctaggaaaatagaaaaacagccccaggtacctaatttgttaatagaaaatggggacgctgatgccctggatacaccggtggaagaggatataaaacctgtaatagaatttatgtacaagcctgttattaatttaggtgaaattattgatgtacatgtgttgcataggcctagaagacataaggtacgtacccagtcgaagcaaccccaggaggaatga

SEQ ID NO: 1555 - DNA, 786 bp, Saccharomyces cerevisiae
atggcaggtttatcgttcgacaattatcaaagaaataatttcttagcggaaaactcgcacacacaacctaaggcaacttccacgggtaccaccattgtaggcgtaaaattcaataacggagtggtgattgcagcagatacaagatcaacacaaggtccaattgtcgcagataagaattgcgcaaaattgcatagaatttcccccaaaatatggtgtgctggtgccggtaccgccgccgatactgaggcagttacgcagttgatcgggtctaacattgaattacattccttatatacctcgagagaaccaagagtggtctcagctttacaaatgctaaagcagcacctatttaagtaccaaggtcatattggtgcttatttgattgttgcaggtgtagaccctacgggatctcatttgttctccattcatgcgcatggttctactgacgtgggctactacctttctctaggatctggttctctagcggcaatggctgtgttggaatcacactggaagcaagaccttacgaaggaggaagccataaagttggcctctgatgcaatccaggctggtatctggaatgatttggggtctggttctaatgtggatgtgtgtgtcatggaaataggtaaagatgcagaatacttgaggaattacttgactccaaatgttagagaagaaaagcagaaaagctacaaattccccaggggtacaactgctgtgctgaaggagagtattgtcaatatttgtgacatacaagaagaacaagtcgatataacggcttga

SEQ ID NO: 1556 - DNA, 786 bp, Saccharomyces cerevisiae
atgtcaaataccgtaagagccatttcaccagatataacactattcaacaagacattgacattccaagaaatctcacaaaacactagagaggctgtcatatacattcatggaggtgcatggaacgatcctgagaatacgcccaatgattttaatcaattagccaataccatcaaatcaatggatactgagtcaacggtttgtcaatactctatagaatacaggttatcaccagagatcacaaatccaagaaacttatatgatgctgtgtcaaatataacaaggcttgttaaagaaaagggattaacgaacattaatatggtgggacattccgttggagctacctttatttggcagatattagctgcactcaaagatcctcaagaaaaaatgagtgaagcgcaattgcaaatgttgggacttttgcagatcgtgaagagagtatttctattggatggtatatactcgttaaaggaactgttggtagaatacccagagtatgattgttttacaagacttgccttccctgatggtattcaaatgtacgaggaagagccctcgagagtaatgccttacgtgaagaaagccctttctcgcttcagtattgatatgcacctagtgcattcttatagcgacgagttattaacgttaagacaaactaattgtttaatttcttgtcttcaggattatcagttaagtttcaagttgtatttggacgatttgggtttgcataatgatgtttataagaatggtaaagttgcgaagtatatttttgacaatatttgttga

SEQ ID NO: 1557 - DNA, 786 bp, Saccharomyces cerevisiae
atgtcaactatgtcaacgcctgccgcagaacaacgcaaactcgtcgaacagctgatgggcagggacttcagtttccgccacaacaggtattcgcatcaaaaaagagacctcggactacacgatcccaagatctgcaagtcataccttgttggcgagtgcccctacgacctgtttcagggcaccaagcagagcctgggaaaatgcccgcagatgcatcttaccaagcataaaattcagtacgagagagaggtcaagcagggcaaaacgtttcccgaattcgaaagagaatatctggccattctatctcggtttgttaatgagtgtaatggccagatatccgtagcactacaaaatctaaaacacaccgctgaggaacgaatgaagattcagcaggttaccgaagaactagatgtcttggacgtgcggataggcctaatgggacaagagattgattctttaattcgtgcagatgaagtcagtatgggtatgctacagtcagtcaaattacaagaactgattagtaaaaggaaagaagttgcaaaacgtgtacgaaacattacagaaaacgtgggccagagcgcccagcaaaagttacaggtttgcgaggtgtgtggggcatacctatcgcgtttagatacagacagaaggcttgctgaccacttcttggggaagattcatctgggatatgtcaagatgagagaggattatgatcggctaatgaagaataaccggacaactaacgccagcaagacagctactacactacccggaagacgctttgtgtag

SEQ ID NO: 1558 - DNA, 786 bp, Saccharomyces cerevisiae
atgtcagatatagaatcattgggagaggcagcaggtttatttgaggagccagaggattttcttcctcctccaccaaaacctcattttgcagaatatcaaaggtcacacatcacaaaagagtccaaatcagatgttaaagacatcaaactccgtctcgttggaacgtcaccactttggggtcatctcttgtggaatgcaggaatatacaccgcaaatcacttggattctcatccagaattaataaaggggaagactgttttagaattgggtgctgctgctgctttaccttccgttatttgtgctttgaatggggctcaaatggttgtttcaactgattatccagatcctgatttaatgcagaacatcgattataatataaagtctaacgttcctgaagattttaataatgtcagtacggagggttatatttggggaaacgattattctccattgttggcacatatcgaaaaaataggtaacaataatggaaagtttgacttaatcattttaagtgatttagtcttcaatcatacggaacatcacaaattacttcaaacaacaaaggatttattagctgagaaaggtcaggcgttggtagtattttcaccgcatagaccaaaattgttggagaaggatttagaattcttcgaattggctaagaacgagttccatttggttcctcagctaattgaaatggttaattggaaaccgatgtttgacgaagacgaggaaacaatcgaagtcagatctcgtgtttatgcgtactatttaacacatgaaaagtag

SEQ ID NO: 1559 - DNA, 786 bp, Saccharomyces cerevisiae
atgtctgcaaaacagcaactacgtatattagttccggtgaaaagggtagttgatttccagatcaagcctagagtaaataagaccttaactgggattgaaaccagtggaatcaaattcagtatcaaccctttcgatgatattgctgtcgaagaagccatcagaattaaagaaaagaacaagagtttagtagaatctacgcatgcagtttctattggctccgccaaagctcaggatattctaagaaattgccttgctaagggaatagacacctgtagtttaattgactctgtgggtaaagaaaacatagagcccttagcaattgctaaaatcttaaaagctgttgttgaaaagaagggttctaatctggttttgatgggaaagcaagccattgatgatgactgtaacaacaccggtcagatgttggcaggtttattaaattggccacaggcaacaaatgcggcaaaggtggaattccttgataatggtagagttcaggtaacaagagaaattgacgatggagaagaagtaattgaagcttccttaccaatggttattactacagatttgagattgaacactccgcgttacgtaggactgcccaaactaatgaaggcgaagaaaaagcctattgaaaaattggatatagcaaaagattttcctgaaattaatattgaacctcagttaaagatagtgtcgatggaagagccaaagactaagtcacctggtgtgaaattgaattctgtggatgaattgattgaaaagttaaaagaagttaaggccatttaa

SEQ ID NO: 1560 - DNA, 786 bp, Saccharomyces cerevisiae
atgtttagtagaatttgtagcgctcaattaaagaggacggcatggacccttcctaagcaggctcacttgcaatcacagacgattaaaacatttgccacagcacctattctgtgcaaacaattcaaacaaagtgatcaaccaagactaagaataaactctgatgctcctaactttgatgctgacacaacggttggtaaaatcaatttttacgactacttgggcgactcttggggggtcttgttttctcacccagcagatttcacccctgtctgcaccaccgaagtcagcgcattcgccaaattgaagccggaattcgacaagagaaatgttaaattgatcgggctttcagtggaagatgttgagtcccacgaaaaatggattcaagacatcaaggaaatagcaaaggttaaaaatgttggtttcccaataattggtgacacttttagaaacgtggcattcctatatgatatggtagatgccgaaggattcaaaaatatcaatgatgggtcactgaagaccgtgaggtctgttttcgtcatcgatcccaagaagaagattagactgatttttacctacccttccaccgtcggaagaaacacttctgaagtgttaagggtaatcgacgccttgcaattgactgacaaggagggcgtagtaactccaattaattggcagccagctgacgatgtcattattcctccctctgtctccaatgatgaggcgaaggctaaatttggtcaatttaatgaaattaaaccctatttaagattcaccaagtcgaaataa

SEQ ID NO: 1561 - DNA, 789 bp, Saccharomyces cerevisiae
atgaattggaagtcgtacgtttttcccggtggtcatccaccagctgcgttgaccacaggccttgtggtatttctaaccgctatttacctgttaagttttatttttgccctaagggaagacctgtcgttggcgccagagtcattgttcaaactgcaaatgagcaggctatcgctttatcctttaattcacctatcattgcctcatttactgttcaatgtgctagccatctgggcacccttgaatctcttcgaagaaacgcatgggactgtgtacacaggtgtttttttgaacctgagtgctctatttgccggaattctgtactgtttgttgggtaagttgctatatccagaagcattagttgcaggcgccagtgggtggtgtttcaccttattcgcatactatagttttaaagaatcacagatccgccctagaacaaggatctttcgcacagactactcaattccgacattatatacacccctagtactattagtcgcaattgccgtcgttatacctggctccagtttctggggtcattttttcggcttatgtgtcggttacgccataggctacaaggaatcgtggtttaacaagatcactccaccaggatggatcatcaccaaaatcgaaaaaagtttagacggtttaattcgattaataccttggggaattaagtattacagagatgaggatatcgacagaactaaagattacgaaccgttaatgtccacagaaacaccattgcctctccacaatgacaactccggcactgtcctagggactgcctag

SEQ ID NO: 1562 - DNA, 789 bp, Saccharomyces cerevisiae
atggactttttgaatgatgatgaactagacttagatttaccggtaaccgcagaaatatcgaaagagttattcgcaacagaaatagagaagtatcgtgaatccgagactaatgggaccgatgttgataactttgatgtcgacagattcctagtgcagaaaaatttccattaccttcctctcgattcccttattagagatttgtctggactttcacaaaaaatggtacaaacattattagaacaaataagaagtaactacgacgactatctgactttttccaatacctatacagatgaagaaaatgaaactctaataaatttagagaaaacacaaagtgatcttcaaaaatttatgactcaattagatcatttgataaaggatgacatcagcaatacacaagaaattataaaggatgtcctggaatacctaaagaagttagatgagatttacggctctctgcgtaaccattcacaattgacagaagcgctctcacttggaaagagattgagtaaatctctccatgaaatgtgcggtatagaaccattagaagaagaaatttgctctggcctgattgagcagttgtataagttgattacggcatctcgtcgaatattggagtcttgtgctgattccaattcaccatatattcatcatctgcgcaatgactatcaagaccttctgcaagaatttcaaatctcactgaaaatcttgaccgaaaagtgtcttgaaaacccatcaagcctgcaaaacctatctttgacattagtctccattataaaaacggcatag

SEQ ID NO: 1563 - DNA, 789 bp, Saccharomyces cerevisiae
atgtgtggcatttttggctattgcaattttttaattgagaagacaagaggagaaatcatcgacactttaatcgaagggttacaggcattggagtacaaggaatatgactccagtggaatttcgatccaaggtgatgagctggagtctctcaatatttataagcaaaccggtaaaataagcagtttgaaggaagaaatcgacctttacaatcttaataagaacctgccctttatttcgcattgtggcattgcccatactaggcgggcaacacatggagggctaagacgtgcaaattgtcatccacataactcagatccatctaatgaatttgttgtggtacacaacggggttattaccaacttcgctaatttgaaagccttattgatggcaaagggctatgtgttcaaaagtgacactgataccgaatgtattcctaaactgtacaaacacatttatgatacaagcattgaactcgggtacaacctcgatttccatgtattaacaaatttagtacttaaagaattggaaggctcttatggtctgctatgcacttcttctcattttcccgatgaagtggttgccgcaagaaagggttccccgttagttattggtgttaaaggtaaaactgacatggacgtaaactttgtcgaggtggaatatttggatcaagaagaagactacttgaagcttaatactcaaaccaagagttctggtaatgtcttggctgccgcacctgtaaaatataacacttgtttaaggaagtcaccccccttcgttcacaatacctga

SEQ ID NO: 1564 - DNA, 792 bp, Saccharomyces cerevisiae
atgaggaattttttcacgttattttttgcagctatattttcgctaggagcacttatattagccattgttgcatgcgcaggatcaacgaaaaattacagtcccataaataaaatttactgtgcagaattggatctgtcgcagatgaaggtatcgacggtgctcccttctttgagttctgctacgctatcttcgttgggcctgccctcatatataaatatagggctttggtcgtactgtacagtggactcctcgcataacatccaatcatgttcttcgcctcacggtatccagaattttaacctatcgtcattagtgtatgacaatatcaacaacaatgaggctctggagcttatggattccgtggccagtgttgttttgcccgaaaaactaaaaagtaaaatgacatactacaacaatttggtcaagtgtatgttcattaccattcttattggtattgtcttgacctttgtgaatctagtgttcaacgtattgcgctggatcatccacataaggccgctaacgtggtttggtgcctttttttcatttttcgcctttgccgccctattagtcagtataggttcgtgtttgggcacttactcatacatcaaatacatcctaaagcataactatagtgattacggtatttcaatgagcattggtaggaactaccagggtttgatgtggggggctgtcgttggagcattactgaatttcattctatggtgtagcgtgagatcgaggcccaccgtcatctatgcgaacgctccaattgaggaaaaaccattgatttga

SEQ ID NO: 1565 - DNA, 792 bp, Saccharomyces cerevisiae
atgatcgctacctccagagccgtaaacatgaataaagaatcaaaacacaagaaggctgttgccaaaccatgcagagagagacaaacttcagttacaagagccatgagaccagctgtagcacgtgatcctcgcagactttcgacgtcgtcgtctccttcttcgtcaccaatgtcagcacagagaaggctttcgagggaagaaataataaacgaaatggaaaaggagcaagacgctattgtagtaagacttctacgggaaattgaaactttaaaagaagaaaactctaggttaaaaaatcaactgcaccatccggtcccggctagaaggtcgtctccatttttcgaaggcgagtctgccatcctagatgatgatgactgcaattatggttacaccctcgacactccaaagctaaagctcacagatggtgcatccagacacaccgtacttcccttaacacccaaggactccatgacccacatttcccattccgccagaaggtcaagccggaacgcttccatatctaacggaacaagcatctcagacacgattttccccattgagactaaaatccactcagcaccaacaacaaacagaaaccttccctccgccgatcttccacatcacactcttcttccacgttctctaagcggcatttcgtctagcgatttaaccgaatccggtgctcttcttcatgacaggagaaggcgttcttccaattacagtctcgatggctcaaactctttaaaggctgatctcatggcaaagagattccaaactggttcattgaaatag

SEQ ID NO: 1566 - DNA, 792 bp, Saccharomyces cerevisiae
atgccacgattgacggttggaacgaagaatatgttgtatcctttgcaaaaaacacttgcagtaggaagttgcaagccagagcaggttccaataagatcactagcctcagtggtggagagttcctccaaaatactcgacaaaagcggcagcgatcgcgaagtagatataaacgtaagcgagaagatttataagtggacaaaggcgggcatagagcagggaaaggagcatttcaaagttggaggtaacaaagtctactttcccaaggccaggatcatcctcttgaggcccaacgcgaagcacacaccgtatcaagcaaaattcatcgtcccaaaatcgttcaacaaactggatctcagagactatctttatcatatctacggcttaagagcaatgaacattacgacgcagctgcttcatgggaagtttaaccgtatgaacctacagacgacgcggtttagagaaccgcagatcaagaaaatgactatcgagatggaagaacccttcatttggcccgaagaaccccgtccggacgaaaactccttctgggacagcaccacgcctgacaacatggaaaagtaccgtgaagaaagacttaactgcttgggctcagacgccaacaaacccggcacagcattcgacggagtcgtggggccttacgaacgggtggcccagccttttatacctcgcttcttaaaacgagagatagacaataagcgagagcgtcacgccgccgaactgcagcgcgcagataaactaattgccctgaacaggtacatagaagatctacattag

SEQ ID NO: 1567 - DNA, 792 bp, Saccharomyces cerevisiae
atggaaggtgaacaaattatggagtatgttcaagagacaccgatcattccaaaaaggattatccattattcgattccaaaacaaatgatcacaaagcccgctccccatgtcgagatgacgttggtagctaatacttttcgggacatggacttgccgcagcatccggttatccatgattgttggcaaaataaagagtactcaactcaaagatattcaggaaatgtggctcaacagagattaagttttgaggaacatccaaatgaagagtgtcaaaattctgttgggttaatcaagagagtgagtactttctttaaaaagaggccattgtctcgaaagaatagcataaagtcaatcggtgacgtaaaatcggaggcacgtaaccggggagaaggcctcctgggtgaagttgataatcttaacgagcagaatgtccgagaaaacctgactagtgaacatgaaaagagtcctgaaggagattccaaaaggtatggcctgttctcctttgaagagaccccccctatacaagtgttggagcagggcaatatcaattctgagctttcttcatttaaaaacacttctttggcggaaaacaaacgctcttctgacagcttcgtttcgttaaaaccgggtgaagatgaacatagccctttagagattagtacgtgtggtaatttgactgaaagagaggatttgcaatctggcgaagaacggtttgactcagcagcccaaaatataaaggtagcttcgatgaaggaaaaaaaaaaaatcttcaaagggaacaaaacagattaa

SEQ ID NO: 1568 - DNA, 792 bp, Saccharomyces cerevisiae
atgggcaaggttattttgattacaggtgcctcccgtgggattggcctgcaattggtgaaaactgttatcgaagaggacgatgaatgcatcgtctacggcgtagcaagaacggaagctggtctgcagtctttgcaaagagaatacggtgcagacaaatttgtctatcgtgtcctcgacatcacggacaggtctcgaatggaagcgttggtggaggaaatccggcaaaagcatggaaaactggacggtattgtcgcaaatgcggggatgctagaaccggtgaagtccatctcccagtccaactccgaacacgacatcaagcagtgggaacggctgttcgatgtgaactttttcagcattgtctctttggtggcactgtgtttacccctcttgaagagctcgccatttgtaggcaacattgtcttcgtcagctctggagccagtgtgaaaccatataacggatggtcggcgtacggctgctcgaaagccgcattaaaccactttgccatggacattgccagtgaagagcccagtgataaagtgcgtgccgtgtgtattgcaccgggcgtcgttgacacgcagatgcagaaagatattagggaaacattgggtcctcagggcatgacacccaaggctctcgagaggtttactcaattgtacaagacttcgtcactgctggacccaaaggtgcctgcggcggtactagcgcaactcgtcctgaaaggtattcccgactctttgaacggtcaatatctccgctacaacgatgagcgactggggccggtgcagggctag

SEQ ID NO: 1569 - DNA, 795 bp, Saccharomyces cerevisiae
atgaagatacaaacaaatgctgtaaacgtccttcaacggacgtccgcttacttgaaatcaggattgttgaaagaaacacctgcgtggtacaacgttgtagcgtctatcccaccatcaaccaagtttacacgtgaacctcgttttaagaatccttccaatggacacatcataggaaaacttgttgacgtaacagaacaaccgcatgccaacaataagggactttacaagacaagacccaactcgagcgacaaaagggtgggcgtgaaaaggctgtacaggccacctaaactaacatacgttgaggataggctcagatcgctcttttacaaacaacatccatgggagttgtcgagacctaagattttagtggaaaacgaaattggtgatgaaaactacgattggagccatatgcttcagataggaagaccactcgatggtgaaagtgttatccagcgaactatgtacttaatcaaaacgaagcagtatggggacatggtcgaagcatatgaccatgccagatatgaattctatgcgttgagaatgcaagaagaaacagagcagcaagtggctttggaagaagcggagatgttcggatccctctttggagtttctgccattgaacatggtatacaaaaggaacaagaggtcctagacgtctgggaaaagaaggtagttgaagaaactgaactaatggcagcaaggacaagtaaccctgcagggtcgtggaaggacgacactacattgaatacggcgcaagaagaagaatccaccacttccgagaacctccacttctag

SEQ ID NO: 1570 - DNA, 795 bp, Saccharomyces cerevisiae
atggctaaatttttgaaagcaggtaaagttggtacgtaaatttaacagagcaaacgctctaattaagatatcgaataaaaggggactttcaggtgcataagatgggaaattgtacaatctgagggacaaacaatatggaaagcagtacatgattgtattgtcattgtaggaggtaccaattgtgccagtaaaaaagagagggcccggggagcaccacattcacgaccaatcgtgtcgatctgcaaaaaaggcacatggaaaatgtaatttatcagtgttcaacactgagttgaacagatagctatctaatcaatgttaactttccagggaacaaaaagctaaatccacttctcttttatttcaaaatatcattagaaatagaaaaatttactaacaaattttcgtattatcgtagctgtcgttgttcgtggtcgttacgctggtaagaaggttgtgatcgttaagccacacgatgagggttctaaatctcatccattcggtcacgctttggttgccggtattgaaaggtacccatcaaaggtcaccaagaagcacggtgccaagaaggtcgctaagagaactaaaatcaagccattcatcaaagtcgtcaactacaaccacttattgccaaccagatacaccttggatgttgaagctttcaagagcgttgtatctacagagacttttgaacaaccatcccaacgtgaagaagccaagaaggttgtaaagaaggcatttgaagaaagacatcaagctggtaaaaaccaatggttcttctccaagttgagattctaa

SEQ ID NO: 1571 - DNA, 795 bp, Saccharomyces cerevisiae
atgtcgtcactgcttaaattacattgtattagaccattgccgcaaaggtcggtctggctctctggctacaagcagaaagccagatgtattcacagttccgctgcaaacggggactttatgtcatggttcaagaggaagaagcaagaagagcaccaagagcctgtcaaggacaccaaacagttgataaaggatattgaagaaggcactaacgaggcttcctctcaatcctcttccaataacaaaaacagattggagctaataccagaaaattttattggcgaagggtctagacggtgtaagagacagaaggagttgaagcttgcggtctcctctgcgccattcaatcagtggttatccagggataagattacgtctgataatcagttagatgatatgatattgcaggcaacggaaaaaacattgggcaaagtagaccaggacgtccaattctctgatttggtagctaaatttcagttcaccaaatttttgcaatctaaatctggctatctaattcctgattatgaactgaccactttaagcacacccttgcagtttaaaaggtatattaaggaaaaaattttgccatctgccaacgatcctaaactcgcttataaagaagctgagccaaatgctatccacccattttctgataattacgcgtcaccaaacatatatgttgttaacgatgttacttctaaagagcaaaaaagtaaatatgatactattatgaaagaaattcaaaagttagaggatgatgcaacaagaaaagctttggaaacagcaagatccgcttag

SEQ ID NO: 1572 - DNA, 798 bp, Saccharomyces cerevisiae
atgaaccaaaatggtgataagaacgaaggcaagttgtttcaactaccgtcattgccgccctggaaaacaccaaggttcaacaaagccaactttaacaattttaccacaccgctacggaaaaggtcgacaagggtaataaatgatgattcgatgcccataacaggcgaagtactagaggagaggactgcagatgatctctatgggataaatatggacgtagacgaagtcgactatctgaatactttgagccacatcgaggaagaaaagcaatacgattattcaccgttttgtgagcgcaatacgctaagggaaagtagaattgacagttttttgaaagccgaaagggcagcacattgtcttgtgtttcataaggtgggccatctagacggcatagacagctatcgacccgatattgacatcatgtgcggcgaagaggctaataaatatgacagtgcgaatccggagggcaatggttcaatgttgttagagagtgtacctggatgcaacaaagaagacctggagaggttatcaaggcgagaatttgtaacaaattcgaaacctaatatgagacggttggatgacataataaatcatgaaacgaacgccttaaaaagtttctggaacgactcaggattagtcaattcactccaaagtcatcatttgcatgaagagtaccttcttttgcaagaagaattaaagaatgtgtacaagattaaatgccatgacagagtgccaatagaaagtctacgcgataagtgcagaagacactatagcaacgaggatagttcgtttctctga

SEQ ID NO: 1573 - DNA, 798 bp, Saccharomyces cerevisiae
atgagtggcacgaggtgtttgctaggcgtcggactaccagttgatgtgactgctacggaaactttgactcatgatgaacaaggaccaggtgtagagccaggaccgtgttcgcgaggaagttctatagatggtctgctgccctcgttgctcggtccacatgatgatgtggatgacgattcggcggcttttcacaagtacatgacactatcgcgagatggcgcaggcgccatccatgctccgtcattagtcgaagacgcctcaaggaacgacgacgacgacgatgatgaagacgacgacgacagttccatgtcgcgagacctatccaaggctctagatatgtcatcgtcatcatcgtccagcccgcgcgttcaaagtcggcggcaccgtagttctgtgagcgcaatatctgcaatcttacaccaaggaaaatctggccgcgaagacataactggaagccttagcgttccggcagaacaagaaaaactcagttttcttgccaaagcctcgagtattttctttcgaaggaacagtatgcccagagacaaacatacgcattcagtatgtcccgctagccgcccagattccgagagatttatcgtcacatctgcagccgcgcagtctttacgccgccaacaacaactggaagacgctcagtacgctcgagttattacaaactttcgtactataggatggtgctctcccagcgagatagagtctgtggaatataaacggtccttgatcaatgcggagtgggacgaaaagatctcgcttttgtctcacgcgcaatgctataaataa

SEQ ID NO: 1574 - DNA, 798 bp, Saccharomyces cerevisiae
atgagttgggaaggttttaagaaagctatcaacagagctggtcacagtgtgataattaagaatgtcgacaagaccattgataaagagtatgacatggaagaacgtcgttataaagttcttcaaagagcaggtgaggcattacaaaaggaagccaaaggtttcttggactcattgagagctgtgacagcatcacagactaccattgccgaggtcatctctaacctctatgacgattcaaaatatgttgctggtggtggttacaacgttggtaactattatttgcaatgtgttcaagattttgatagcgaaactgttaagcaattagacgggcccttaagagaaaccgtactagatccaataacaaagttttcgacgtatttcaaagaaattgaggaggccataaaaaagagagaccataagaaacaagacttcgatgctgcgaaggcaaaagttcgtagattagtggacaaacctgctaaagatgcctctaaactgccaagggctgaaaaagaattgagcttagctaaagatattttcgaaaatcttaataaccaattgaaaactgaactaccacagttagtttcattaagagtaccttactttgacccaagttttgaagctttaatcaagattcagctaaggttctgtactgatggttacactcgtttagcgcagattcaacaatatttggaccaacaatcaagagacgactatgccaatgggttattagacactaaaatcgaagaactattaggacaaatgacaagcctagatatttgtgcgctcgggataaaataa

SEQ ID NO: 1575 - DNA, 798 bp, Saccharomyces cerevisiae
atgcagccaatttcaataaaagatgtggaaagcgatcaagggaaagtttacattgttaatgccttaaaagatctcgtatgcaagtgccttttagaattcgtggacattcaaattgaaagttttatgtatccggacgatccaaagtgttttacaaggatatttaaagggaacaagatagtcaacgaagcatcagataaagattcgaaagtgagaagttacccatcttcattgggtgttggacactctgctttgtttcctttgatatacataagacaaaaaaccaactccttgcggtttttgaatgatccaaagcaattaccaacaccactggtcgatgatatgaacgcaaaattcaaaggcatcattaaagtttatgaaaatctcattcacttgtaccattcatatcagacggtggattgcaataacatgaatcagcaaaagcttttgggtgatctggtcagtcggggtaatttcatgcttgatatcctccacgggtatgttactattgcatcaacaatagtacgggacagtaaggatgccaatatcttgatagacactgttaatcggttcatccacgataccatattattccacaagcgcataatacataattccaacgcttacacagagtaccatgtaatgaaacgtggcatgcaaagaaaccagagtgaggaaacgttagttgaacttgaattccgaatactggatgtttctgatgttaatctggacaatgaatttgatgactttttacagcatagaaaaacgtctcttaaaataactcatagaagggttatatga

SEQ ID NO: 1576 - DNA, 798 bp, Saccharomyces cerevisiae
atggattataaggaagaacagaagcaggaactagaagttttagagtccatttatcctgatgaactgaggatcataaacgatgaatacccaaagattaaatttgaagtagccattaaattagagctggatacaggtgattctacttctgttttaaccaaagagcacactataatcgccgaattcaagttaccagaaaactaccctgacgaaccatgcctgatttcattggaagctcaagaagtagccctcaatgacaacgaagaagataacgaggaagatgaagacgaggttgaatatgacgaccatggtaataaagtactgaaaaagtttgaaaacctgccagatttaataagctttaaggggtacttgcctgaattaaccgtacaattagaatcgcaaatcgaaaccgatatgttattgggtatgcaaatgtgttttgcattgatttcatccataaaagaaagatgtgagcaatggtatagtgaacaattgaataagctcgagaagcagtacgagctggaagcacaagaacgtgaaaagaaggaacaggccaagttccatggtactaaagtcacaagagaatcgtacttggaatggaggtctaaatttcgccaagaactgaaactggatgaaagagaccaggtgagaaggatgaaggctcatcatgggaagctaaccggtaagcaaatgtttgaacaaggcgtggtgggcacaggcgacgagtatatggaagaggatgacgcgagtgtagatgacgtagccaagggacttgccaagaccgaaatagcaaatcaataa

SEQ ID NO: 1577 - DNA, 798 bp, Saccharomyces cerevisiae
atggcaaaccaaaagcaaatgagaactcaaatactaatcacggacattcctagtggcaaatttactagtaaatggcctacacaactggaaaaaactttattcaaggagcaatttccaaatttacaaagtcacttgcagtattacacgccgttgccatttttaaacagaattataatcatatttgataatgaagatgacacgctgcaagtgtttaagttcttacaggaattgttagctaaggagaatagcggtccgatgaagttatttgtaactgagtcccttttaaataatcaacatccgcgatctcgttccacggatgatgctgtttcgttgcaagataataacttggcacttttggaggatcatcgcaacaaaccgctcttatctattaatacagatccaggagtcactggagtagacagttcatccctcaataagggaggctcttcattatctccggataaatcatctctagaatcgcccacaatgttgaagctttcgacggattcaaagccatttagttaccaagaaccgctaccaaagctttctaggtcgtcttcttcaacttcgaacctctcattgaacagaagttcacagacatcattaccttcacaactagaaaataaggataagtcagcgtcaggcaccaaatgccttttcgcctctaagccactaggattgaccattgatacttctactagaagtaatgctgcatcgtgtaccgaaaatgatgtaaacgctactgcctcaaatcctccaaaaagtccaagcataacggttaacgagtttttccattag

SEQ ID NO: 1578 - DNA, 798 bp, Saccharomyces cerevisiae
atggtgttcggtcagctgtatgcccttttcatcttcacgttatcatgttgtatttccaaaactgtgcaagcagattcatccaaggaaagctcttcctttatttcgttcgacaaagagagtaactgggataccatcagcactatatcttcaacggcagatgttatatcatccgttgacagtgctatcgctgtttttgaatttgacaatttctcattattggacaacttgatgattgacgaagaatacccattcttcaatagattctttgccaatgatgtcagtttaactgttcatgacgattcgcctttgaacatctctcaatcattatctcccattatggaacaatttactgtggatgaattacctgaaagtgcctctgacttactatatgaatactccttagatgataaaagcatcgttttgttcaagtttacctcggatgcctacgatttgaaaaaattagatgaatttattgattcttgcttatcgtttttggaagataaatctggcgacaatttgactgtggttattaactctcttggttgggcttttgaagatgaagatggtgacgatgaatatgcaacagaagagactttgagccatcatgataacaacaagggtaaagaaggcgacgatgatattttaagctccatctggactgaaggactactaatgtgtttaatagtttctgcgttgctattgttcattttgattgttgcactttcttggatatctaatttggatatcacatatggtgcgttggaaaaatcaacaaacccaataaaaaaaaacaattaa

SEQ ID NO: 1579 - DNA, 798 bp, Saccharomyces cerevisiae
atgtcagcagacgaaacggatgcgaaatttcatccattagaaacagatctgcaatctgatacagcggctgcaacatcaacggcagcagcttcacgcagtccctctcttcaagagaagcccatagagatgcccttggatatgggaaaagcgccttctccaagaggcgaagatcaacgggttacaaatgaagaagatttgtttttgtttaacagattgcgggcatcacagaatagagttatggactccttggaaccacaacaacagtcacagtatacatcttccagtgtcagtacgatggaaccatctgccgactttactagtttctctgcagtgactactttaccgcctcctcctcatcaacaacaacagcaacaacagcagcagcagcagcagcagcaattggtggttcaagcccagtacacccaaaatcaaccaaacttgcaaagcgatgttttaggaaccgctatagcagagcaaccattttatgttaatgccaagcagtactaccgaattttgaaaaggcgatatgcaagagctaaactagaggaaaagctacgaatatcaagagaacgaaagccatacttacacgaatctcgacataaacatgcgatgcgaagacctcgtggtgaaggtgggaggttcttgacagccgctgagatcaaagccatgaaatcgaagaaaagtggggctagcgatgatcctgacgatagtcatgaggataaaaaaatcactactaaaataatacaagaacagccgcatgctacttccaccgcagctgcagcagacaaaaaaacataa

SEQ ID NO: 1580 - DNA, 798 bp, Saccharomyces cerevisiae
atgtctctttcggtcgccgaaaagtcgtacctatacgattcactagcaagcacgccttcaattaggcccgatggaagactacctcatcaattcagacctatagaaatatttactgacttcctaccaagttccaatggatcgtccagaattatagctagtgatggaagtgaatgtatcgtgagcattaagtccaaagttgtggatcatcatgtggagaatgaactacttcaggtcgatgtagatatcgcaggccaaagagatgacgcgctggtagtagagacaatcacttctttactgaacaaggttttgaagtctggtagcggagtagattcctcaaagttgcaattgacaaaaaagtacagcttcaaaatatttgtcgatgttctggtcatttcatcacattcacacccagtttctttaatatcctttgctatttattcagcgttgaactccacatacctaccgaaacttatttcagcttttgacgacttagaggtggaagaacttcctacgtttcatgattacgacatggttaagcttgacattaatccgcctttagtgtttatattggccgttgtaggcaacaatatgctattggaccctgcagccaacgaaagcgaagtggccaataatggcctaatcatttcctggtctaatggtaagattacatcacctatcagatcagtagcattgaatgattcaaacgttaaaagctttaaacctcatttgttgaagcaaggtcttgcaatggtggagaaatacgcccccgacgtagtacgatcactggagaatttataa

SEQ ID NO: 1581 - DNA, 798 bp, Saccharomyces cerevisiae
atgtcttgggacgacgaagctatcaatggttctatgggtaatgatgacgccgttttgatggactcatgggatgctgaaattggtgatgacgaacctgtcatgcaatcatgggatgcagaagaggaagaaaagaagcctgccccaaagccaaaaaaagaacaaccaaaaaaggttaaaaaagggaaagaatcctccgctgacagagccctattggatattgacacattggatgaaaagacacgtaaagaattaatcaaaaaggctgaaatggagtctgacttaaacaatgctgcagatttgtttgcgggtttaggtgttgccgaagaacatccaagggctcgtgctttacaaaaggaacaagaggaacaagctctaaaaagacccgcctttaccaaggacacacctatcgaaacacatcctttgtttaacgccgaaacaaagagagagtaccaggatttaagaaaggctcttactgctgctattacaccaatgaacaaaaaatctccgctgaactactcctcatcgttagcgattgatttgattagagatgtagcaaaaccaatgtccatcgaatctataagacaaacagttgctactttgaacgttttgatcaaagataaggaaagagaggagaggcaagctcgtctggcccgtgttagaggtggtactgctactgggggtgctggtaagaagaaagtcaaaggtaagaccaatttgggtggcgcatttaagaaagatcaagatttcgacctagatggccccgacgattttgaattcggtgatgacgactttatgtaa

SEQ ID NO: 1582 - DNA, 799 bp, Saccharomyces cerevisiae
atggtatgtgaaagagatattaaacataagatgtgaaggaaacagaagagaacaatatttgaggaatgaattcggatgaaattctagtagaagaaaaaagcctaaaataaaaagaaagaaaggaaaataaagcagtaatcaacctctgacatttgataggagtatgcgtttccgcaaaatcaacaaatcatgcattaaactggtaacggagactttaaagacgtgcaaagaaagcaattaatttttagatagggaattgaaaggctctgtatagcagaaaatttgagatctactgtggagataagcatatggtgttgagttatgggtaatctaacaataatagaaacttatagcagttgaagatggcggatcatgatgccggatactgctgggtaatgatttatccttctttttttggagcacaaatgctcactttttcctgtctcctctaacttttctgatgtatcctacccaaccctacagttttcaaattactaacatcaatttttttgtgaaacgactttcgttttcgtttctatttatttcattacaggttttagttcaagatttgttgcacccaactgctgcttctgaagccagaaagcacaagttaaagactttggttcaaggcccaagatcctacttcttggatgtcaaatgcccaggttgtttgaacatcaccactgttttttctcatgctcaaactgctgtcacttgtgaatcatgctctactgtcttatgtactccaaccggtggtaaggccaaattatctgaaggtacttctttcagaagaaagtaa

SEQ ID NO: 1583 - DNA, 801 bp, Saccharomyces cerevisiae
atgaactatttagaaggcgttgggtcaaagaaaggaggtggtggtatagcctcagaatctcagtttaacttacaacgaaggaaagaagtcgaatcattacttagtaaaggcgaaaatgtcccgtacactttccaagatgaaaaggacgatcaagtaaggtccaatccgtacatttacaagaatcattccggtaaactggtttgtaaactatgtaatacaatgcacatgtcgtggtccagcgttgaaaggcatttgggtggtaaaaaacatggtttaaatgtgttaaggcgtggtatcagtatagagaaaagttctctagggagagaaggccaaacaactcatgatttccgacaacaacaaaagataattgaagctaagcaatctttaaagaataacggtacgatccctgtttgtaaaatagctaccgtgaaaaacccgaagaacggttcagtaggtttggctatccaggtaaattatagcagtgaagtcaaagaaaatagtgtcgatagcgatgataaggctaaagtccctcctctcattaggattgtatctggtttagagctatcagataccaaacagaagggaaaaaaatttctcgttattgcgtatgaaccctttgaaaatattgctattgagctacctccaaacgaaatattattcagcgaaaacaatgacatggacaataataacgatggagtagatgaattaaataaaaagtgtacattttgggatgctatatcaaaactttattacgttcaatttttctttaaacaagccgaacaagaacaagccgatgtatga

SEQ ID NO: 1584 - DNA, 801 bp, Saccharomyces cerevisiae
atgaatcacgatcctttcagttggggcaggcccgcagactctacttatggtgcttacaatacacaaattgcgaacgcaggcgcctctcccatggttaatacacagcaaccaatagtaacaggtacttccgtcatatcaatgaaatatgataatggggttatcattgcagcagataatttaggttcatatggctctcttctaagattcaatggcgtggagaggcttattcccgtgggtgataacaccgttgtgggcatttcaggtgatatttctgatatgcaacacattgagagattattgaaagatctagtcactgaaaatgcgtatgacaatcctctagcggatgctgaagaagcgctcgaacccagctatatttttgaatatctagctaccgtcatgtaccagcgaagatcaaagatgaatccactttggaatgccatcattgttgctggtgtacagtctaatggtgatcaattcctaagatacgtaaatcttctaggtgttacgtattcgtctcccaccttggccacaggttttggggcacacatggcaaacccactgttaaggaaagttgtagatcgagaatctgatattccaaagaccactgtacaggttgctgaagaggcgatcgtaaatgcaatgagagttctttattatagagatgcccgttcttctagaaacttctcactggccataattgataagaacacaggtttaactttcaagaaaaacttgcaagttgaaaacatgaaatgggacttcgccaaggatattaaaggctacggtactcaaaaaatttag

SEQ ID NO: 1585 - DNA, 801 bp, Saccharomyces cerevisiae
atgagtgaaaagaagaaagttctaatgctacatggttttgtccaatccgataagatattttctgcgaagactggaggattacgaaagaatttgaagaagttaggttacgatttatactatccttgcgccccacattcaattgataaaaaagcgttattccaatcagagtcagaaaagggtagagatgctgcgaaggaattcaacacctcagcgactagtgatgaagtatacgggtggttctttagaaatcccgaatctttcaattcctttcaaatagatcaaaaggtgtttaactatttacgtaactacgtgctagaaaatggaccatttgatggtgtcattggattcagccaaggtgcaggtcttgggggctacttagtcactgactttaacagaatattaaatcttactgatgaacaacagcccgctttaaaattttttatttcatttagtggattcaaattagaagatcaatcctaccagaaagaatatcataggattatccaggtgccctctctacatgtaaggggggagttagatgaagttgtagcagaatctagaatcatggcattgtacgagtcatggcccgataacaaaaggacattgttggttcatcctggagcccattttgtcccaaactcgaaaccattcgtatcccaagtttgcaattggatccaaggaattactagcaaagagggtcaagagcataatgcccaacctgaagtagatcggaaacaatttgacaaacctcaattggaagatgatttgttagatatgatcgattccttgggtaaattgtaa

SEQ ID NO: 1586 - DNA, 801 bp, Saccharomyces cerevisiae
atgcttgttttcaaaaggggtattcacgtagtacctaaactaccaaattctaaggccctactgcaaaatggagtgcctaatatactcagttcttcgggattcaagacggtgtggttcgactaccagcgatatctatgtgataagctaacgctggcgacagcgggacagtctttggaatcatattatccatttcacatattgctgaaaactgcaggaaatccattacagtcaaacatcttcaatttggcgtcctctatccataataaccatttattcgtggagaacattctaccttctgctgttgaacatggcactaactcgaacgccgttgtgaagacagagccttctaggctttttttatccaaaatcaaagattcattcaacggcagcgattgggaagtagtgaaggaggaaatgatttaccgtgctgagaatgaagtcttgggacaaggctggttatttctagttgaaaacaatgagaaaaaactcttcatattaacgagcaataataatggtacgccgtattattttcccaggaaccagtcatttgatttaaacagtgcgatatccatcgatgaatttgctaccttgaaacaaatgaaagaactgataggaaagtctactaagttgaatggtaaggttcaagactggaccatgcctataatctgtgtcaatctgtgggatcatgcttatttacatgattatggcgttggtaaccggtccaaatacgtgaagaatgttctagataacttgaattggtcagtggtaaataataggatattctctggtatatcgaagtaa

SEQ ID NO: 1587 - DNA, 801 bp, Saccharomyces cerevisiae
atggcattgcatcagtatttatcagagacttatgggcccacgaaacccaaaaataagacgaaaaagaagaagaaagagtcaaaatcagacgctaactcagacaaaacttctttgatagtaaaagaacggctaagtacactgcaacaagaacaggagaagtcaggagttgcttcattcagcaagtttgacaaacaaaaaagcaagaatatatggaagaacctggaaacaaacgagctttcccatgcaataacacatccttccgcatcgtcaattactggcaacgaaagcaagaacgatctaaaggaaatcagggctcaagagccacttgtcacagtagcagacaaatcgaaaacacgaaaaaccatatacagagacgctcaaggtcacaagattcaggaagattccaagatagacgattctagttttagtcgatctaaatatgaagatgagaaagccgcggaaagagagcaatacctgaaaaatttgaatatgggagacgtgcaaaagcttggaataaatgtagatgcacatgataagaagaaaaatcaaactgcctcgagtctgacgatagaagaccctgcaataacatttacacatgacaaagaaagaactgtaaaaacatctttactgggccgcaagctttatgataagccagcacctgagaacaggtttgccattatgcctgggtcaagatgggacggtgtccacagatcaaatggctttgaagaaaaatggtttgctaagcaaaatgagatcaatgagaagaaagtgcaaagctacaccctacaggaggattattga

SEQ ID NO: 1588 - DNA, 801 bp, Saccharomyces cerevisiae
atgttcttaagaagcgttaaccgtgccgtcactagaagcattttgactacgcccaagccagccgtagtaaaatcatcgtggagagtttttactgttgctaactctaagagatgtttcacacccgctgcaatcatgaggaaccaagagacccaaagagtaggtgatattttgcaatctgaattgaaaattgagaaggaaacgttaccagagtcaacgtcgttagactcatttaatgactttttgaacaaatataagttctcattagtagagacacccggtaagaatgaagctgaaatagttagaagaaccgaatcaggcgaaacagttcatgttttttttgacgtagctcagattgctaatctgccttacaacaacgcaatggatgaaaataccgagcaaaatgaagacggcattaatgaggatgattttgatgctttatcagacaactttgccaacgttaatgttgttatttctaaagaaagcgcaagcgaacctgcagtctcatttgaattactaatgaatttacaggaaggttcattttatgttgatagtgctactccatacccctcagttgatgctgctttgaatcagtctgctgaggccgaaataacaagagaattggtataccatggcccacctttttcaaacttggacgaagaactacaagaatctctggaagcttatttggaaagtagaggtgtcaatgaagagctagcctctttcattagtgcatattccgagttcaaagagaataacgagtatatttcttggttggaaaagatgaagaagtttttccactaa

SEQ ID NO: 1589 - DNA, 801 bp, Saccharomyces cerevisiae
atgttgaacgtgctattgagaaggaaggccttttgtttggtgacgaagaagggtatggctactgccacaacagctgcagctacgcatacccccagattgaaaacttttaaagtttacagatggaatccagacgagccaagtgctaaacctcatttacagtcatatcaagtggatctgaatgactgtgggcccatggtacttgatgcgctgttaaagatcaaagacgaacaggattctaccctaacttttagaagatcatgtagagaaggtatctgcggttcatgtgccatgaacattggcggtagaaacacgctagcttgtatatgtaagatcgaccagaacgaatccaaacaactcaagatctatccattaccccacatgtttattgtcaaagatttggtacctgatttaactaacttctaccaacaatacaaatctatccaaccttacttacagagatcatcgtttccaaaggatggaacggaagtgctacaaagtattgaagatcgtaagaaactggatggtctttacgaatgtattctgtgtgcatgctgctctacttcatgtccatcgtactggtggaaccaagaacagtatttgggccctgccgtgctaatgcaagcctaccgttggctaattgactctagagaccaagctacaaagacaagaaaggccatgctaaacaactccatgtcattgtacagatgtcacaccatcatgaactgtactagaacttgtccaaagggcttgaatcctggtttggctattgctgaaattaagaaatctttggcatttgcctag

SEQ ID NO: 1590 - DNA, 803 bp, Saccharomyces cerevisiae
atgggtaaaggtaagccaagaggtttgaactccgctagaaagttgcgtgtccacagaagaaacaagtatgtacaattatagaagattgcactatggttgaaagattttcataataagtagaagaaaggatcggccattgctaccatgaaatgagttggaagcttgaaaaagtaagggagaataattttgcaagaaactagggtagggctacttaatttattatagccatttgaattcatcagcttttaggaggagaaaggccattttgcgaattttgaataagaaagtccacaagtgatgaaactgaaaatctacaatgaatttctgccatctcagataatgaattcactacgagaacctcatttactaacaaatttattaatctttttgatgaaactatgttttgtcaaaagttaatcgtttaaaacagccgttgggccgaaaacaactataagaagagattattgggtactgccttcaagtcttctccattcggtggttcttctcacgccaagggtattgtcttggaaaagttgggtatcgaatccaagcaacctaactctgctatcagaaagtgtgttagagttcaattaatcaagaacggtaagaaggttactgctttcgttccaaacgatggttgtttgaactttgtcgatgaaaatgacgaagtcttgctagccggtttcggtagaaagggtaaggctaagggtgatattccaggtgttagattcaaggtcgttaaggtctctggtgtctccttgttggctttgtggaaggaaaagaaggaaaagccaagatcttaa

SEQ ID NO: 1591 - DNA, 804 bp, Saccharomyces cerevisiae
atgagcatcgaatactctgttatcgttcccgcttaccatgaaaagctgaacatcaaacccttaacaaccagattgtttgccggcatgagccctgaaatggccaagaagaccgagttgatctttgtcgatgacaactcacaggatggctccgttgaggaggtggacgccctagctcaccaaggctacaacgtccgcatcatcgtcaggacaaatgaacgtggtctatcctccgccgtgcttaagggtttctacgaggccaagggtcagtacctggtatgcatggacgcagacctacaacaccctccagagaccgtgcccaagttgttcgagtctttgcacgatcacgcctttactctgggcaccagatatgccccaggtgtcggcattgacaaggactggcctatgtacagacgcgtcatttcctccactgctagaatgatggccagacctttgaccatcgcctccgaccccatgagcgggttcttcggtctacaaaagaagtacctcgaaaactgcaaccctagggacatcaactcgcaaggtttcaagattgccctcgagcttctcgccaagcttcctcttccaagagaccctagagtggcgatcggcgaagtgccattcactttcggcgtgagaacggaaggtgaatccaaactgtcaggtaaagtcattatccaatacttgcaacaacttaaggagctctacgtcttcaagtttggcgccaataaccttatccttttcattactttctggtccattctgttcttctacgtttgctaccagctataccatttggtcttttaa

SEQ ID NO: 1592 - DNA, 804 bp, Saccharomyces cerevisiae
atgagctgcctggtgttgccattagtaagcgtagggaatataccacaattgagtattgactggctgctgaattcacaagcaaatgaatgggaatatttggaggcgttagattcgaaatacctagtggaatttgtgggaccattagacagaccagaggatggtagcgactcgctatataaagacgctgatatgaagtatagcagcgctttggaagttttctacaataagaagcgaggactttttgccatacagcaacgaacaccactcgtgtccgttaactatctgaataatttcatcgtagagatcatcttgccgttcttgagcaagtataatatatcggaaatatgcatttgggactctctatatgcaatggaggatgaaaatggtgtgattgtacgtccacaggaggtatattcgctcggagagttttatttcgacgatgaagctgagcttttatcgaacctccatctaaacgatcaagagtcgatggtcaataactggttacattttactcctaccagtttccaagacaagatatccgttgatcagccgatcttcaaaatacttttccaaatactgaatgcgtcgcagaggcctaaagccctccgcagcattaagtactgtagttgtttggccaatgagggggacaactcattagattctcaacagttcttacaatggataatctctcaaaaagttatcaaaaacgcgccaccaattgtaaagtttgtcaggcctatatcatggcaaggtgcatacggaatggcggatgcaagagataaatttgtagatttatacaattga

SEQ ID NO: 1593 - DNA, 804 bp, Saccharomyces cerevisiae
atggatatggaaatcgaagattcaagccccatagatgacctgaagttacaaaaactggataccaatgtttattttggaccctgtgagatattgacacaacctattcttttgcaatatgaaaatattaagttcatcattggtgtcaatctaagtactgaaaagatagcgtcgttttatacccagtatttcaggaactctaattcggtagtcgtgaatctttgctcaccaactacagcagcagtagcaacaaagaaggccgcaattgatttgtatatacgaaacaatacaatactactacagaaattcgttggacagtacttgcagatgggcaaaaagataaaaacatctttaacacaggcacaaaccgatacaatccaatcactgccccagttttgtaattcgaatgtcctcagtggtgagcccttggtacagtaccaggcattcaacgatctgttggcactctttaagtcatttagtcattttggaaatatcttggttatatcatcacattcctatgattgcgcacttctcaaatttcttatttccagggtgatgacctactatccactagtgaccatccaggattctttgcaatatatgaaagcaaccctgaacatatccatcagtacatccgatgagttcgatattctgaatgataaagaactgtgggagtttggccaaacccaggaaattctaaaacgtaggcagacgagctcagtcaagaggagatgtgtcaatttaccagaaaactctacgatcgataacagaatgcttatgggtaccacaaagcgaggtcgcttttga

SEQ ID NO: 1594 - DNA, 804 bp, Saccharomyces cerevisiae
atggatgtcgatgagaggttgcatcaagatgaaaatcaaacccaccctttttcgcaaaagaagtcaagcagtttcttgataaaggaaaaagctgctacaaaatccaaggatcttgaacatataaggcttcgtgacctaaatttcaatcatagaaaaaagctagatgacaaaaaattggcaaagcaaatcccagttaaggcaaatttcaagaagcctaacgaaattgaagctcgcgctaacctaaattcaaatgaattaacagatatcaaccttgactatataccggattccccatctatagagaaaatatcagggcctgaggattctattgttgtaacgccaagaaatatcatacatttacaatctgattcagatattattctcgaggaatgcgagcataattatgactgtagccctttttaccgtctgttcaactacgaaaatagaattgagcccgatgactacgaggctattataaacgctataataactgacgaaattgctggcacatatccggttttcgaacgggaattagagtaccaagaactgaaaagtcttgtcagaaagcgagattatattatgtattatttcttgtcaagggattatcgggggttttttcagttgaaagaggaacgtactttattttataggtacccttcaattgcgtacactagcccgttgaggtatctggataatggatctgaaaccgagcagtttaccggggatgatgatgaggagctccaatcatttgattttgaaaacacatcatctgtgaggactttagatagtaatatatggcgttag

SEQ ID NO: 1595 - DNA, 804 bp, Saccharomyces cerevisiae
atggccttgaacgataatcctatacccaagtcagttcctctacacccaaaatcaggtaagtacttccataatttacatgcccgagacttatcaaatatatatcaacaatgctacaaacaaattgatgagaccataaatcaattagtggattctacatctccttccaccatcggcattgaagagcaggtcgcagatattactagcacctacaaactcctctcgacatacgaatcggaatccaactcatttgacgaacatattaaagatttaaaaaaaaatttcaaacaatcctcagatgcctgtccgcaaatcgacctttctacctgggataaatatcgtaccggagaactcaccgctcccaaattatctgaattatatctaaatatgcccacaccagagcctgcaaccatggttaataacacagatacactcaagatactaaaagtgttgccgtacatatggaatgatccaacttgtgtaataccggatctgcaaaaccccgcagacgaagacgatctacaaatagaaggtggtaaaattgaattgacttgtcctatcacctgcaaaccttacgaagcaccattgatatcaagaaaatgtaatcacgtcttcgatagagacggcattcaaaactatttacaaggatacacgacaagagattgcccgcaagcagcgtgttctcaagtcgtttcaatgagggattttgtaagagaccctattatggaactaaggtgtaagatcgccaagatgaaagaatctcaggaacaggataaaagaagtagtcaagccatcgatgttttatga

SEQ ID NO: 1596 - DNA, 804 bp, Saccharomyces cerevisiae
atgtcaaccagtcgtgaagattctgtgtacctagccaagttggctgaacaggccgaacgttatgaagaaatggtcgaaaacatgaagactgttgcctcctctggccaagagttgtcggtcgaagagcgtaatttgttgtctgttgcttataagaacgttattggtgctcgtcgtgcctcttggagaattgtttcttctattgagcaaaaggaggagtccaaggagaagtccgaacaccaggtcgagttgatttgttcgtaccgttcgaagattgagaccgaactaactaagatctccgacgatattttgtccgtgctagactcccacttaattccatcagccaccactggcgagtccaaggttttctactataagatgaagggtgactaccaccgttatttggctgaattttctagtggcgatgctagagaaaaggccacaaacgcctctttagaagcatacaagaccgcttctgaaattgccaccacagagttacccccaactcacccaatccgtctaggtttggctcttaacttctctgtcttctattatgaaattcaaaactctccagacaaagcctgccatttggccaagcaagcttttgacgacgctattgctgagttggacactctgtctgaagaatcatacaaagatagcacacttatcatgcaactgctaagggacaatttaaccttatggacttcagacatgtccgagtccggtcaagctgaagaccaacaacaacaacaacaacatcagcaacagcagccacctgctgccgccgaaggtgaagcaccaaagtaa

SEQ ID NO: 1597 - DNA, 804 bp, Saccharomyces cerevisiae
atgtcccaaggtagaaaagctgcagaaagattggctaagaagactgtcctcattacaggtgcatctgctggtattggtaaggcgaccgcattagagtacttggaggcatccaatggtgatatgaaactgatcttggctgctagaagattagaaaagctcgaggaattgaagaagaccattgatcaagagtttccaaacgcaaaagttcatgtggcccagctggatatcactcaagcagaaaaaatcaagcccttcattgaaaacttgccacaagagttcaaggatattgacattctggtgaacaatgccggaaaggctcttggcagtgaccgtgtgggccagatcgcaacggaggatatccaggacgtgtttgacaccaacgtcacggctttaatcaatatcacacaagctgtactgcccatattccaagccaagaattcaggagatattgtaaatttgggttcaatcgctggcagagacgcatacccaacaggttctatctattgtgcctctaagtttgccgtgggggcgttcactgatagtttgagaaaggagctcatcaacactaaaattagagtcattctaattgcaccagggctagtcgagactgaattttcactagttagatacagaggtaacgaggaacaagccaagaatgtttacaaggatactaccccattgatggctgatgacgtggctgatctgatcgtctatgcaacttccagaaaacaaaatactgtaattgcagacactttaatctttccaacaaaccaagcgtcacctcatcatatcttccgtggataa

SEQ ID NO: 1598 - DNA, 804 bp, Saccharomyces cerevisiae
atgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaa

SEQ ID NO: 1599 - DNA, 805 bp, Saccharomyces cerevisiae
atgacattgttaaataccctcagcaacttcggtgggacatggccgcggttaatcattatgtccatgatcaactacttcaccgtgtatcagtgcactattcctggcacaaataaagtatacgtaactcacggcggcagcatgcaagcgtgcaccgagcttttgaatggcaccgtgaccatcctgcgtgacggctattacatcaccaatctcatatgtattgtagtcggacttttcctatattttggatatttgaaaaggaaaatcctccatttacaaagtctgccaatcagttcctggagatgtacgtaacgacccctcaaacaagaattgtacgacattacgttcaagaaaattttaacgagtatcgtaatatttacaagatctttttatgtactacaggaagcagaaacaaaatgagtatcaataccagtgtaaatctgttaatgagaatcatcacattatcccagttttttccatgcaagggaaaaatatactatacgacatttctatactttaattatcaattaaggtcatctttctgtacgaaaactaaccacgattgtcactaacgacgtgtcccttacccgacgcagctgctgatagcgtaccgcacaggcacagccagctcttctgtgattggcagagaggggtccttcctgcggaagacgccgcaaaggcacatatgactaaccttttttttttcgcaattaattttctaatagtttttcattttttttttacaattttggcagttacgtctcgagctatttattataagagtcagaattggcgcagggagtgttaa

SEQ ID NO: 1600 - DNA, 807 bp, Saccharomyces cerevisiae
atgaagccgaacaatcgaacttgtgatgtaattaccaacaaagatgaatctcttcctgcacttttgctgcctgcactgaacagttacacctgtgacgattcattgctaaaaggacaaatttcaagcaatggcagatatcaaccattcgggttttctgattgctctttactgccaaagcgtttaaacattcaggcagggcaaggatctatgccagtttcttcgattcaatgtgcagaccacagttatagtaattggcaaaaagaatccgaaaagactaagcttcccaagcttggttgcccaacagagtacactgaatactataaaactgtttcttccggcgaaacaaccgattcagcggttgtttcatctatagcaacgaacagactcaaaagaaaacgtcagagggacggcccaagttgtgactcttgtaggataaagaaaataaaatgcaatgcaacaatcattatctttttacaggataggaacctaatttcatcaatttcttcaaatttgcattatacactttcccaagacgacataaaccagtttcgaatgaagtttttcaggaaactgcctgacgtgatgggcacatatgaagtcataaaacaccttgataaaatagtccttttcaaagcctgcacctcttgcagtagaagaaaccaaaaaaatggaaagtgtcttttttcgagaggatttacaaaatctgatatgaacgtatttcccaagataaatagtaaacttaaagacaaaagtatcttcgagatgactgtcgatgattatgttgccgctggcttccaaaccctttag

SEQ ID NO: 1601 - DNA, 807 bp, Saccharomyces cerevisiae
atgactagtttagatgacagtgtgctgacaaaaaaaaatatagcactattagacaacgccaccaactatattcgccccgccatagattattttcatttcaaatttaactatgatagcttggacgtgtccactacctggcgcttgttgctgaaaatgcgcaagcataaattattaaggttacccagttgctcttctgaaaatgagtttgactatagcatatatatggctaggttgtatcattgtatatggaggaggtggtccataaagcacttcaatttagatgaatacaaaattgatccactaagcataaactggaataaagaaatagacgttactgttctttacggacctgatctggttggaatacatgaaagagagcaacctactccaacggactttcctatggggaatataaaggaacaagggaagcaattattggatgtaagaaaggagggaagtgcttcttcattgctgaaaaaaggcagcgtattttactcaaaaggtaaatggctctctcagcgttcaatatcattcgatgacactgttcgtaggcgagatattgacaaacgtgggagatttcgtgaatcatgtgttctaataaatgatgtagaacaattccaaaactattccattgtctgggacgagagtagacatcgctaccgtcggcaggcacttccagacacgtacgattacgagcatctctatcccaatggcgacgaaactcctcggaacacgcctcacgacaatataataattcatcaaaacttgcatagcattacggaaggctcttatatctatataaagtga

SEQ ID NO: 1602 - DNA, 807 bp, Saccharomyces cerevisiae
atgctgatagtattattcttaacattattttgttcggtagtgttccgaacagcttattgtgatgtggccattgtggctccagaacccaactcagtttatgatttatctggtacaagtcaggctgttgtcaaagtaaagtggatgcatacagataacacaccacaggaaaaggattttgtcagatacacgtttactctgtgttcgggtaccaatgccatgatagaagcaatggctactcttcaaacactcagtgcgagtgatctgacagacaacgagttcaatgcgataatagaaaacaccgttgggacggacggtgtttacttcatacaagtctttgcgcaaacagctatcggttacaccattcattacactaacagatttaaactaaaagggatgattggtacaaaagccgctaatccgagtatgataaccattgcaccagaggcacaaacaagaattaccacaggagatgtgggtgccacgattgattctaagagtttcaccgttccctacaacttacaaacaggtgttgtgaaatatgctcccatgcaactccaaccggctactaaggtaacagcaaagacatggaaaaggaagtacgcgaccagtgaggtaacgtattactacactttaagaaactccgttgatcaacatactaccgtaacaccagggtggtcatacataattacagctgatagtaactatgctacgccggcccctatgccggctgataatggcggttggtataatccacgcaagagactctctctgactgcaagaaaagttaatgctttgaggcacagataa

SEQ ID NO: 1603 - DNA, 807 bp, Saccharomyces cerevisiae
atgggtttacctgaagttaactttcttcgaaaaaactgcatacttgtggagttaaaattattctatcaaacagtatacccaccgaaggaactatattggaataaccgaataactgcagaattgagtacattctccaatattaagtatgcaaggccgactttcgcagtaaataatggcacatttcagagaacaagaccgaaattagacttggtactggcttcatctgatattcgtaagctggctacggttttatttaatttaaaagctctcataatgaatacgaagggtgaggaacccactctaaccacgatgactagtgtccaaacgaacgaagagaaaaatgataacctggaacagaaatattcaagtctgctagatagatggaatgggaaagtagaagtgcatgattctcctttccttcaactccaacgggacagcaaccttttgtttgctgagaggccggtacgttacgttagcactacagaaggtgaaggcgtggacatatctagtgaagagtttttcaggttagaggaagaacagtgccgaaggaattatgatgttttggtcgatgaacattctacaccatcagtcgggatgaaagacggccaatacggaccaaatataattcactttgaaccgtcgctgtaccacacatattcttctctaccaatgagtatgaaattttggttaaatggtctagaagacgacgaaacgacgatgatgaacattgatgagaagtcagccgaaaatctggatatattattacatggtttcaaaggattttcgaacaagcgcgttaaaggatga

SEQ ID NO: 1604 - DNA, 807 bp, Saccharomyces cerevisiae
atggtattggaagctacagtgttagtgattgataattcagagtactctcgcaatggcgactttcctaggacaaggtttgaagcccagatcgactcggtagagttcatatttcaagccaagagaaacagcaatcctgagaatacagtgggtcttatctctggtgctggcgccaaccccagggtgttatctacgtttaccgccgagtttgggaagattcttgctggactacacgacacgcagatcgagggtaagctgcatatggccactgcgttgcagatcgctcagctgactttgaagcatcgccagaataaggtccaacatcaaaggattgtggcatttgtgtgtagcccaataagtgattctcgagacgaattgatcagattggcaaaaacactgaaaaagaataatgttgccgtggacatcatcaattttggagagattgaacagaacacggagcttttggatgagttcatagctgcagtgaacaaccctcaagaagaaactagtcatttgcttactgtgacgcctggccccagactgctgtacgagaacatcgcatcttcacccataattctcgaagaaggatcctccggtatgggcgcctttggtgggtctggcggtgattccgatgccaatggcacatttatggacttcggggtagacccatcaatggacccagaactggcaatggccttgcgtctgtctatggaagaagagcagcaaagacaggaaaggttaagacagcagcaacaacaacaagatcagcctgagcagtctgaacagcctgaacaacaccaagacaaatag

SEQ ID NO: 1605 - DNA, 807 bp, Saccharomyces cerevisiae
atgtcctctacacatagtaataatgtaggacatccccaatcttctccacaaggtccactaacggaacaacaaagagcacaacagcaatatcaaatttttgagaattcattaccaaaagtaagtcaatctgtgtatcagatgctgttgaacgagatggttcctctagctatgggcattgagaggcaaatatcaggcgatgttatcagttctgatagcaatgtaacttccgaaaatggtaacatcaacaatatgataaagagactgaagatagaggaacatcatacagtagatatcatacgttctcataacttgatacatgagctgtataaggcggatgaagaggaaaaagaaaaggttttagcaagactgaggaatattgggtttcaaatcggattgaagctgtcagagttattgatattttctaacaacccaaatttaaaattcaaggaaatggaccttctattaataatgaagttcatttgtagggatgtctggaaacaaatatttggtaaacagatcgataatttaaaaacaaaccacagaggaaccttttaccttcttgattatgactatcgacctattcaatcattttctttggaggaagatgcaaaaaacgaggagttaaaaatgatagaaccgtttttggagatacctgtgggaattattagaggcgtgttgtcttccttaggttattcatctgaagaggtcatttgcttggcgtcttttatcgacaggccaacagataggcctaaaacagcttttcccaagggagttagcttccatgttcaagtcacaatgccgcagtaa

SEQ ID NO: 1606 - DNA, 807 bp, Saccharomyces cerevisiae
atgtctagtagtaaattcgaagaggtcatcaacaagatcatcaatgacagccctccaggagaattaagggaagtatacgacgatctaatcaagatcacaagtgaaaactccaaaaatactattttggatgctattgagaattacaacgtgcagaattgcatccctatagaagtcaacgggaactctgtaattatttccaaatacaacaaggaaggagcaaagttttttgatcccgtaaattccgtaatattttcagttaaccatttagagcgcaagggccttgacattgaaccatatgagttcacgcatgcaaagatagagaaagggcaattgaaagaactgcacgataaattgcacgaatatcttcttcagagctttccaggtgatgtcagttttgctgtttacccagtccctgaggaaataagtaaaatttctattattattgttagcaccaaatataatccaaacaatttctggaacggccattggagatcaagctacatctacgatttggagaccagggagttatccggtcaaatctctacgcaagtccactattacgaagacggtaacgttagtttccaatctgggaaggatatcaatcaatctaacgttgatgacgttgtttgcacaataagggatattgagacgaatttcgaaaatgatctagatctttcatttttcgacttgaacgaaaaacagtttaaggccttaagaagaagattaccagtcacgagatccaaaattaactggggtagtgcgattggcagttatagattgggtaagaatgcggcagaaggcaaatga

SEQ ID NO: 1607 - DNA, 809 bp, Saccharomyces cerevisiae
atggtatgttaatatggactaaaggaggcttttaaggacacgtaatattgagtcgacatgcgcaataaagtcatacaataaataagttaaagaaaacatatgacgatattttcagacgatatggaactgcgataccgaaaaagtggtgtgattgaaatgatactcatgttttggctatagttgcagtggctttccaaaaaattgggagttaaaatgcctatagcagtatcaccggagattcagtctcttgtggatcttctttttgcatagttgaacaagggataatatggcgccatgaactgcctctacacattataatgtgtttttgatatcagtatactaacaagttgaattgcatttacaaactttttattttgtattgcttttcgtcattttaatagggtagagttagaaccaagaccgtcaagcgtgcttctaaggctttgattgaacgttactatccaaagttgactttggatttccaaaccaacaagagactttgtgatgaaatcgccactatccaatccaagagattgagaaacaagattgctggttacaccacccatttgatgaagagaatccaaaagggtccagttagaggtatctctttcaaattgcaagaagaagaaagagaaagaaaggaccaatacgtcccagaagtctctgctttggacttgtctcgttctaacggtgttttgaacgttgacaaccaaacttctgacttggttaaatctttgggtttgaagttgccattatctgttatcaacgtttctgcccaaagagacagacgttacagaaagagagtttaa

SEQ ID NO: 1608 - DNA, 810 bp, Saccharomyces cerevisiae
atgaaaagcattttcaaggttagaggatgtgtatcgcatgctgctcaattttgccaaaaaagaaccgtggtgagtaccggcactagtaacaccgcaacagccggtgcagtgaggaaaagtttcaacagtaccgaaaccaagcctgtatttgcaacaaaatcggaagctggcaatggaagccacatgaaggaatattcaagcggcattaactctaaactcggcgggacccctttggaaacccgcagcaccgccgatgattctttgaacaatagttataagcaagtcaagggagacattgactggtatacttcatggtatggcctaggtatgaagccctttgaagcaaaagtgcaaaaggatctaatcgagcctctggaccctaaggatatagaaatcaagccagatggtttgatatacttgcctgaaattaaataccgtagaatactgaacaaagcttttggcgcaggcggttgggggctagtgccaagatcacaaacaatagtgacatccaagctggtcactagggagtacggtcttatttgccatggtcaattgatcagtgtggcaagaggcgaacaagactatttcaacgaagccggcataccaactgctacagaaggttgcaaaagtaatgcattaatgaggtgttgcaaagatctcggcgtcggttctgaattatgggaccctgttttcataaagaaattcaaagtggatcattgtactgagaagtttgtggaacatgttaccaccaagagaaagaagaaaatttggttaagaaaggacagacaagttgaatatccttataaatag

SEQ ID NO: 1609 - DNA, 810 bp, Saccharomyces cerevisiae
atgaagacagaaggaataaaaagcccatcggcaaaataccatgatatggcgggctcccagagaatccctcacaagaacccgcacattcaaaaagtggctgttttgcaaagtaagcccaataaggaagatgcgctaaatttaataaaggaaatcgcacataaagtttcctatctaatgaaggaaaatcacttcaaagtgaccaacttggtggagttttacccacgtgatcaaagactcctgggaatgaacgtcaaccatggatctaagataatgttacggttaagatgctccacggatgagttccaatttttacccatggagtgtataatgggcaccatgctgcacgaattaactcacaatttattcggtccacacgacaaaaagttctacaataagctagatgagttgattggaaggcaatgggttattgaacaaagaggtttgtacgacacatttttggggaacggtcaacgtctcggtggaagagcaaacttacgttcaaatagatatcctatgacaggaataagtactaacacagggatagtgagaaaaaggggcaaaggtgtgaagttagggagtttgcatccagagggtatatcatctatagatagaggtaattccccgagagagttggcggcttttgcagccgaaaggagatatagagatgatcgctggtgcggagagacgaagaataacaaagatcaaataataagtgataatattagcagctccttagaagttgtaatccttgatgatgatgacgaggtactcccgggagatactcttatcgaagttattgatctcacttaa

SEQ ID NO: 1610 - DNA, 810 bp, Saccharomyces cerevisiae
atgaagtggttgttgtttccggcaagaatcgtagctcgcactcgcccaaacctcttctcgctgtacagaagatccgtttcacagtacttacgtcctcgaaccatccaaaacctgcaatcaatggcgcaaacacccgaacttaaaaccaagctgttcaaacccttggtctggatcgactgcgagatgaccggtttagaccacgtgaatgacagaattatcgagatttgctgcatcatcaccgatggacacctggcacccgtcaaagcggccgatggccaaggagactcgcattatgagagcgtcatccattatggtcccgaggtgatgaacaaaatgaacgagtggtgtattgagcaccacggtaatagcggtctcaccgccaaagttttggcaagtgagaagactttggcccaggtagaagatgagctgctcgagtacatccagcgctacatcccagacaagaacgttggcgtcttggcaggcaatagtgtacatatggaccgcttgttcatggtccgcgagtttcccaaggtcattgatcatctcttttacagaatagttgacgtcagtagcatcatggaagttgcccgcagacacaatcccgctttacaagcacgtaatccaaaaaaagaagctgcccacactgcttatagtgatatcaaagagagcatagctcaattgcaatggtacatggacaactacttgaagccaccacaggaaacagagtcggtcgagtcaatcggatctgaacagccggagtcaccatcttcatctacctcatctttgaaaagacaacgcaccgatttttaa

SEQ ID NO: 1611 - DNA, 810 bp, Saccharomyces cerevisiae
atgacacatttagaaagaagtagacatcaacaacatccatttcatatggttatgccttcaccatgacctattgtagtatcatttgcattattatcattagcattatcactagcattaacaatgcatggttatattggtaatatgaatatggtatatttagcattatttgtattattaacaagttctattttatgatttagagatattgtagctgaagctacatatttaggtgatcatactatagcagtaagaaaaggtattaatttaggtttcttaatgtttgtattatctgaagtattaatctttgctggtttattctgagcttatttccattcagctatgagtcctgatgtactattaggtgcatgttgaccacccgtaggtattgaagctgtacaacctaccgaattacctttattaaatactattatcttattatcttctggtgctactgtaacttatagtcatcatgccttaatcgcaggtaatagaaataaagccttatcaggtttattaattacattctgattaattgttatttttgttacttgtcaatatattgaatatactaatgctgcattcactatctctgatggtgtttatggttcagtattctatgctggtacaggattacatttcttacatatggtaatgttagcagctatgttaggtgttaattattgaagaatgagaaattatcatttaacagctggacatcatgttggatatgaaacaactattatttatctacatgttttagatgttatctgattatttttatacgtagtcttctactgatgaggagtctaa

SEQ ID NO: 1612 - DNA, 810 bp, Saccharomyces cerevisiae
atgggttggttttgggcagatcaaaaaactacgggcaaagatattggtggggcagcagtatcatccatgtcagggtgcccagtcatgcacgagtcgtcgtcgtcgtcgccaccatcctctgagtgccccgttatgcagggagataacgatagaataaacccgctgaacaatatgccggagttggcagcatccaaacagcctggccaaaagatggacttgcccgttgatcggaccatctccagcatccccaagagtccagacagtaacgagttctgggagtatccttctccacaacagatgtacaatgctatggttagaaagggcaagattggcggtagcggcgaagtcgccgaagatgcagtggagtccatggtgcaggtccacaactttctaaatgaagggtgctggcaggaagtgctcgaatgggaaaaaccgcacacagatgaaagccacgtgcagcctaagttgctgaaattcatggggaaaccgggcgtattgagccctcgtgctcgctggatgcacctgtgcggcctactgtttccgtcccattttagccaagaactaccattcgacaggcacgactggattgtactccgaggcgagcgcaaagcggaacaacaacctccaaccttcaaggaagttagatacgtcttggatttctacggagggcccgacgacgaaaacggaatgcctactttccacgtggatgtccgtcctgccctagatagtctagacaatgctaaggaccggatgacccgtttcttggaccggatgatctcgggtccgtcctcttcgtcctccgccccttaa

SEQ ID NO: 1613 - DNA, 810 bp, Saccharomyces cerevisiae
atggtgcttagtgattcgttgaagctgccctcgcctacactttcagctgctgctggagtggatgattgtgacggagaggaccaccccacgtgccagaattgtttcactgtcaaaacgcccctatggagaagagatgaacacggtactgttctctgtaatgcatgtggcctcttcctgaagttgcacggggaaccaaggcctatcagcttgaagacggacaccattaagtcaagaaataggaaaaagctgaataacaacaatgtgaacactaatgccaatacccattctaacgacccaaataaaatattcaagagaaagaagagactgcttacaactggtggtggttcattacctacgaataatccgaaggtttctattctggaaaagtttatggtgagcgggtccattaagccactgttaaaaccaaaggaaaccgttcccaacacaaaggagtgctccacgcagcggggaaaattttctttggacccctgcgaacctagtgggaaaaactacctctatcagatcaacggttcagatatatacacgtcaaatatagagctgacaaggctgcctaatttgtcaacattattagaaccctcacctttttcagattccgctgtaccagaaatagaactaacttggaagctacataatgaggaggaggtaatcaaattgaagaccaagataagcgaattggagttggtgacagacctatacaaaaagcacatattccaactgaacgaaaaatgcaagcaactggaagtggaactacactccagagcttcagtacaatctcacccacaacattaa

SEQ ID NO: 1614 - DNA, 810 bp, Saccharomyces cerevisiae
atgtccactgaattaaccgttcaatccgagagagctttccaaaaggtatgaatttagcgataatgtctcaagggatttaaagaaattttacctaaagtaactttgctgatatatatcgtctgaggaattgtttagaatagatgaaaacttagcaggtatcctattgaattcttagcatgtttattgttacgactaatagaatttgccagtcaaaatttacaatatttgcgttaattaactacaaaaccggcggtgccgaaggcttgataaaggtagcacatttttatactgattcattacgtttacgatagttgattgggtaaaatttctttttatttcacttatgcgaataacttactaacctttgtatcatcctttttttagcaaccacacatcttcaacaacccaaaggttaagacttccaagagaaccaagagatggtacaagaatgccggtttgggattcaagaccccaaaaaccgctattgaaggttcctacattgacaagaaatgtccattcactggtttagtttccatccgtggtaagatcttgaccggtaccgtcgtctccaccaagatgcaccgtaccattgtcatcagaagggcttacttgcattacattccaaagtacaacagatacgaaaagagacacaagaacgttccagttcacgtttccccagctttccgtgtccaagttggtgacatcgttaccgtcggccaatgtagaccaatctccaagactgttagattcaacgttgtcaaggtctctgctgctgctggtaaggctaacaaacaatttgctaaattttaa

SEQ ID NO: 1615 - DNA, 810 bp, Saccharomyces cerevisiae
atgtcgaagttcctacagggatcaatatttagcatatcaaaacttcatgttagatattcttctactcggccttttctagtggctcctagtattgctaacagtataacaaccgaggctccagcgattaatcactcacctgaactggcaaatgcgagaaaatggctaccaaaaagatgcggtttaattactcgtaagaagggaatgatgccttattttgataaatctactggtgaaagaagcgccgctactatattagaagttaataatgttgaagtaataatgcatagaacttcggaggtcaatgggtacttcgcgtgtcaagtagggtacggatcaaggcatttgtctaaagttagcagacaaatgcttggtcatttcgcttctaaagttgttaacccaaaagagcatgtggccgaattccgagttaaagatgaaaagggattaataccacctggcacattattgaaaccctcttttttcaaagaaggccaatatgttgacgtcagatcagtcagcaaaggcaaaggttttactggtgtgatgaaaaggtatggattcaagggtttgagagcatctcatggtacatctattatgcatagacacggtggttcttatggtcaaaaccaagacccaggtagggtactgccaggaagaaagatgcctggtcatatgggaaacgagcatgttactatccaaaatgttaaagttttgaaagtcgacgatgaaaataatgttatttgggttaaaggctctgtggctgggcccaaaaacagtttcgttaaaattcaagatgcaatcaaaaaaacttga

SEQ ID NO: 1616 - DNA, 810 bp, Saccharomyces cerevisiae
atgtctttcactaaaatcgctgccttattagctgttgccgctgcctccactcaattggtttctgctgaagttggacaatatgaaatcgtcgaatttgacgctattttggctgatgtcaaggccaatttggaacaatatatgtccttggcaatgaataatccagactttaccctaccatctggtgttttggatgtttaccaacatatgaccactgctactgatgattcctacaccagttatttcaccgaaatggactttgctcaaatcaccactgccatggttcaagtgccttggtactcttctagactggaacctgaaatcatcgctgctttacaaagcgcgggtatcagtattacctccttaggtcaaaccgtttccgaatctggttccgaatctgccactgcttcctcagacgcttcttctgcttctgaatcctcttcagctgcttcttcttctgcttctgaatcctcttcagctgcctcctcttctgcttctgaatcctcttcagctgcttcttcctctgcttcagaatcttcttctgctgcctcctcttctgcttctgaagctgctaagtcttctagctctgccaagtcttctggctcttctgctgcttcatctgctgcttcatctgcttcttccaaggcctcttctgcagcttcctcttctgcaaaggcctcctcttctgcagaaaaatctactaatagctcctcctctgctacctccaagaacgctggtgcagctatggacatgggcttcttctccgctggtgttggtgccgctattgccggtgccgctgctatgctcttatga

SEQ ID NO: 1617 - DNA, 813 bp, Saccharomyces cerevisiae
atgacgatgcgaacaaataagaaaaataagagttctaatatcaaaatgatcagaagagtaaggcataatttgtacaaccaaaaccaaggaaagctgatagtaccgaattttttttttttttggcacgatatgaatagcagtggggataatgctgggtttgagtggtggagacggaccatgcagtacaagactggtataggcttgacaccggaggagaaaactcgatacgaagacgactctaaagctcgagaactaaaaaaggaatgtctgaaatgttatgagtatcgagattggatgcttaaatactctcccacagttcgctttatggtacaagctattacgaaacttaataagggtagcgacagtaaattcgacgattcgaagatcatctgcgattactgtcccgactggaagggcggtggctttcatcctgaattgggaatcctattgtgccagaacaggttacgtgataagtggcatttagaggatacgctttcgcatgaattaattcattatttcgatgatctaaaatggcaaatagattggttaaatctgaagcatcatgcatgttctgaaatcagagcctcttcgttaagtggggaatgcaggttttgggaagagttcaagagaagagggtttaggacaggattccatgtggcaaggggacaccaagattgtgttagaaggagggcaataattagtgtttcggggaaccccaactgccaaagcaaagaacatgcagcaaaaattgtagatgaagtttgggacagttgcttcgccgatacgagaccgtttgatgagatttacagatga

SEQ ID NO: 1618 - DNA, 813 bp, Saccharomyces cerevisiae
atgagtaaccaacacagccctcagccattttgtttggacaccaaattggtgaaactattagaagagctccaggagggaaagcaattcaacaataaaaacatattcccggaaaaagcattatatttgaagctcgctcttgattattctttcttcagaaagaatttactagagttttgcgtccaccttgacaagataaaaggagtcattagaccaaactatgacactatatatattttgtgcctgttggaggtggatctcctcaatctggtatttaccgacaatatattggaaatatgtttgcccaggtttgtttcaagggaggacttgagggtttttaataatactttttacacatatcacgataaccgcctacgtattctccaagaagacttttctcaattgttcaaaaaaatcaaaactaaggcttctgtactatgttttacagttgaggaaatttttctgacaaaccaagaaattttacctcaaaactcaacagtggcagaactgcaaaagagcactaataaagtacagacaaatgggccgcaacggcacgatttcatagtcactctagaaataaaactgaacaaaacacaaatcactttcctcattggagctaaaggaacgagaattgaaagcttgagggaaaaatcaggcgccagcataaaaataatacctattagtgataaaatgactgcacatgaaaggaaccaccctgaatctgttcaacaaacaatactaatttcgggtgacttatactcaattgcattagccgtcaccagtatagagtctgcattaattactttggatttatag

SEQ ID NO: 1619 - DNA, 813 bp, Saccharomyces cerevisiae
atggcaacacacacgagcaagagacgtattcatcgctgggaaaacaatgagttgtcagaggaaaattccacaataatatactttcctgcccgcggtttgatgtggacacattttcctttcgttttagggatttgtttagagttcgtgggttatgtgttgaaaatagtctttatcaatagcccctcgatttcgactttcattgctcaatcggtgcttctattgatagcaccttcactttacgcccttagtatttttatgttgttcagcaaaatggcacgtctaattcttatggaggcatatatgttaattcctgcgaaatttagtacagtttctttcgtagtggcagatatgattgggcgtgtcctacaggctgtaggaggtgggttgttatcctcatggaacagcaggaatactgggcgtatcctaattattgtgggtcttttcattcagatattttgttatacctttttaacgttcagtcaactttttcttcactataaaatgaaggcaacgcctagtaaaattgtgcgggatagtaatgaatggttccagtacaattttatacttttagctgggatattgctggttaatggtagaaccattgtcagagtagtacaatttctaatgggcttacaaagctatataggtcagcacgaatggtgcctttacgttttcgatacagttctaatgtttttactacctttgattttcctagcaacctttcgcgcaagaaatttgttcaagctgcaggataaatctgtcaatattcaattaaacaaattattagacaaggaatctgtgtctgaagattaa

SEQ ID NO: 1620 - DNA, 813 bp, Saccharomyces cerevisiae
atggctatcgaaaatatatacattgccagacatggttacaggtcaaactggctaccaaagggaccatatccaccaccgcccaccggtattgataacgatgtcccgctttcggaacacggtgttgaacaggcacatgaactggcgaactatatctctaaattagatgtcaaaccagaaatgattttctcctccccattttaccgctgtttagaaactagtaaacccacagtggaggctttaaagattccattatatgtcgatcgtggtgtaggagaatggtataagcctgatagacccattatcccggagcctgctactcatgaagttatgagtaagttttttccaagcatgatctctccagactgggaacctagtattattcctagtaataagggtgaaacagaagaagatatttttgagaggtgccataaattctggcctgtctttattgacagagtggagagaaaatttccaaatgtaaagaccattatgatagttacccacgcagccactaaatccgctcttggtatgaacttgttgaaattctccagtgccaaagagcccattgataacaaaggcacctttataagaaatggaagttgtgctattgataaatttgagctggtgaaaggagaaaatgaaagtataccatttgaagagagagagtggaaacttacaatgaatggcaacacctcctttttaactaatggggaagaaatgaattggacgtttatgaatgcctttgaggctggttcagacgctgatatcaaagcgagaagagcagctgagagcggaaaactaaaaatggagtga

SEQ ID NO: 1621 - DNA, 813 bp, Saccharomyces cerevisiae
atgtccagaactattccatttctatttaaattagtcaacagggcagtaattttgcctacggcaggttttacattaggagttggtgcgtttgtaaaggcgtggcccgatgatgccggtgttctatcattgaatgatccgcaaacgccagcggagttgattagtgcgaccaagagccgccaacctatggagctgcagagggttgacatcctcgctcaaatcgagaaaagcgaggtttacaacaagttggcccaggatgagaagatgcaccatgtcttattcagtgagaaaataccaagcgggcatagggaatatcatgtaggacaaggcctcttgttcggcaaggggaagcttgaaattgatcctttggtgttccatgatgtgaatcacggtgaattaaccgtgatttatcacttaggtgctgagttagggaatcgagacggtaacgtccataagggcttgttgtcattgttgctggatgaagcattgtgctattgtggcttccctttgttgcctagtaaaagaggtgtaactgcaaggctgtcgctagagttttttgaggacattcctgtagatactacgattatactaaaagcaaacgtcaaagagattaaaggcagaaagtgtatcattgagggacacttggaacagtttccgttggaagtttcttctcgaaatggaactagaagttggaacttaccacatatttggggtttcaaccataagcaggagatggcaaaaaaatttgccaaggccaattgtattctcgttgagcctacttggttcaaatattttaaatggcttgatatgttttga

SEQ ID NO: 1622 - DNA, 815 bp, Saccharomyces cerevisiae
atgtccaccgattctattgtcaaggcttctaactggagattagtcgaagttggccgtgtggttttgatcaagaagggtcaatccgcaggtaaattggccgctatcgtcgaaattattgaccaaaagaaggtatgttaaatccggaaaacctatcatcgatttgaggagggaaatgaacgaggaatgagatttaggctacgaaaaagtgctggcaaatatccaatccgttaccatggatgaagctacttgtaaacgataagtaaatgtgaaaatacacattgcgatagagatacaaaaaagtctttatttccctgttggagtggcctatagtggattatttatttattttgctagcagcttacctagtttcagaaaggtgatgacccatatttgcgcagttaattcttaaagagcctgaccatgtttcctcaaatattaaaccatgccttccatcgttttgaaaaaatttcgtttactaacaacttttatgaataatttttttaaattatttgttataattattataggttttgattgacggtccaaaagctggtgttccacgtcaagccatcaacttgggtcaagttgtcttaactccattgacctttgctctaccaagaggtgctagaactgctaccgtttctaagaagtgggctgctgctgctgtctgcgaaaagtgggctgcttcatcttgggctaagaagattgctcaacgtgaaagacgtgctgctttgactgactttgaaagattccaagttatggttttaagaaagcaaaagagatacactgtcaagaaggctttggctaaggcttaa

SEQ ID NO: 1623 - DNA, 815 bp, Saccharomyces cerevisiae
atgtccactgattctattgttaaagcctccaactggagattagtcgaagtcggccgtgtcgttttgatcaaaaagggtcaatccgcaggtaaattggctgctatcgttgaaattatcgaccaaaagaaggtatgttgaacctaaaacccaccgtggacaaactgaggaggaaattgtaaggaagagaaagtccccgtatgttcagggaccgccaacgacttcctgattcatgcctgaatagtgaaacatgttaaacaatgagtagatgctgaaatatgcaatgggacagagggccggagatgtttctattctttttttgcataaacaacagtgaaatttctacatattttgttactggcaaactccttccctggcagttaataactcccatacttaagaagataacttcagcacatgtagccatacctcctcaattgccaaataatcttttcctgttttcaaagtatttcaatttactaacaacttttatgaataattttttaaattattcgttataattactataggttttgattgatggtccaaaagctggtgtcccacgtcaagccatcaacttgggtcaagttgtcttaactccattgacctttgctctaccaagaggtgctagaactgctaccgtttctaagaagtgggctgctgctggtgtttgcgaaaagtgggctgcttcatcttgggctaagaagattgctcaacgtgaaagacgtgctgctttgactgactttgaaagattccaagttatggttttaagaaagcaaaagagatacactgtcaagaaggctttggctaaggcttaa

SEQ ID NO: 1624 - DNA, 816 bp, Saccharomyces cerevisiae
atgaaagtttccgataggcgtaagtttgaaaaagcaaactttgacgagtttgagtcggctctaaataacaaaaacgacttggtacattgtccctcaataactttatttgaatcgatccccacggaagtgcggtcattctacgaagacgaaaagtctggcctaatcaaagtggtaaaattcagaactggtgcaatggataggaaaaggtcttttgaaaaaattgtcgtttccgtcatggtcgggaaaaatgtacaaaagttcctgacgtttgttgaagacgaaccagatttccagggcggaccaatcccttcaaagtatcttattcccaagaaaatcaacttgatggtctacacgttgtttcaagtgcatactttgaaattcaatagaaaggattacgataccctttctcttttttacctcaacagaggatactataatgagttgagtttccgtgtcctggaacgttgtcacgaaatagcgagtgccaggccgaacgacagctctacgatgcgtactttcactgactttgtttctggcgcacctattgtaaggagtcttcagaaaagcaccataaggaaatatgggtacaatttggcaccccacatgtttttgttactacacgtagatgagctatcgattttttctgcataccaagcaagtttacctggcgaaaagaaagtcgacacagagcggctgaagcgtgatctatgcccacgtaaacccactgagataaagtacttttcacagatatgtaacgatatgatgaacaaaaaggaccgattgggtgatgttttgcatgtgtgctgcccaagttga

SEQ ID NO: 1625 - DNA, 816 bp, Saccharomyces cerevisiae
atgagcagtcgtgtgtgctaccatattaatggtccctttttcataatcaaattaattgatccaaaacatttgaactctttaactttcgaggattttgtatacattgcactattactgcataaggcaaacgatattgattctgttttgtttactgttctacaaagctcaggcaagtatttctcctcgggaggtaagttttcagcagttaacaagctaaacgatggagacgttacaagcgaagtggagaaagtctcaaagctggtatctgctataagctctcctaacatatttgtggcgaacgcatttgcaatccataaaaaggttctggtgtgctgtttgaatggaccggccatcggacttagcgcatcgctagttgctctttgtgacattgtttactcgcaaaacgattcagtatttcttctttttcccttcagcaatctcggttttgtcgcagaagtgggaacttctgttaccttaactcaaaaactgggtataaattctgcaaacgaacatatgattttcagcacaccagttctatttaaagaattgataggaactattattacaaaaaattatcaattgacaaatactgaaacattcaatgaaaaagttcttcaggacataaagcagaatttagaagggctttatccgaaaagtgtactaggtatgaaagaattgttacacagtgaaatgaaacagaagcttatcaaagcacaagcaatggagactaacggaaccttgcctttttgggcaagcggcgagccattcaaaagatttaaacagcttcaagagggaaacaggcgccacaagttataa

SEQ ID NO: 1626 - DNA, 816 bp, Saccharomyces cerevisiae
atgccttcgctaacccccagatgtatcattgtcagacacggtcaaactgaatggtccaagtcaggccagtatactggtttgacagatctaccgttaacgccctacggtgagggccaaatgttgaggaccggtgagagtgttttccgcaataatcagtttttgaatccagacaacatcacttatatcttcacctctccacgtttgcgtgccaggcaaactgtggatttggttttgaaaccattaagcgacgagcaaagagctaagatccgtgtggtggtagacgacgacttgcgagagtgggagtacggtgactacgagggaatgctgactcgagaaatcattgaattgagaaagtcacgcggtttggacaaggagaggccatggaatatctggagagatgggtgtgagaacggtgagactactcagcaaattgggttgagactttcccgcgctattgccagaatccagaacttgcaccgcaagcaccagagtgagggcagagcatcagacatcatggtctttgcgcacggacatgcattgcgttattttgctgctatttggtttggactgggtgtgcaaaagaagtgtgagacgattgaagaaattcaaaatgtcaaatcttatgatgacgacacagttccatatgtgaaattggaatcttacagacatttggtagacaatccatgtttcttactggacgccggtgggattggtgttttgtcatacgctcaccacaacattgacgaacctgcattggaattagcaggtccatttgtctcaccaccagaggaggaatcccagcatggcgatgtgtaa

SEQ ID NO: 1627 - DNA, 816 bp, Saccharomyces cerevisiae
atgctctctcatatcgttgagtatgaatgccaatacactgatcagctttacaagaaacgtaaaatctggcacgatggtagactgaaatactttcagttaaacaacagattcatgctttatacggaaaaggataacgttttgttagctagtgaatttaaaataaattcaaaagagctgaaagcaattctaaatccagaaggttttgatattgaagaacataggatttttagtcagtttttggtgattatttcaaatattattgaggagtacgatagagatattcaagtggcagcaacgcatgttagggcatatccttcaaatttgtcggtgcaaaaacaacgccctcttatctcagacaatgcaccaagtttgaatcatatctcaactgcgagagaagttcattcgaacataaaagtcacaactcccaatcgcaagcagacagaggacaatgccaccaagggaggattcaacatcagcaaacttactctgaaggtcaataagcctttcaagaagcccaagaggatattaagtactaatgtggtaaatgaatcaaatagaccgagcataaggagccaaaagattcaggaagtgacaccacaactacacgaaacaaacacaagcactaaagtgcagacagccggaaaagttgcgttgaataatgataatattgcgcaaggtaattacgccacgattaccgaagaagctaaagtcagagacggttccgacagaaagaaagatatggcgaacctatccaaaagtggtaaaaggagagtgggcgggatacgaagaattgttcacgaacccctcggaatttga

SEQ ID NO: 1628 - DNA, 816 bp, Saccharomyces cerevisiae
atgggtttggcagctacaagaaccaaacagcggtttggtttagaccccagaaatacggcatggagtaacgacacctcgagattcgggcaccaatttctagaaaagtttggatggaaacccggtatgggtctggggttatcccccatgaattcgaacacttcgcatatcaaagtgtcaattaaggacgacaacgttgggctcggtgctaaattaaaacgtaaagacaaaaaagacgagtttgataatggtgaatgcgcagggttggatgtcttccagcgaattcttggtaggctgaacggaaaggaaagcaaaatatcagaggaattggacacgcagagaaagcagaagattattgacggaaaatggggtatccattttgtgaagggtgaagttttagcaagcacgtgggatccaaagactcacaagttaagaaattactccaacgcgaagaaacgaaagagggaaggagacgatagcgaagatgaagatgatgacgacaaagaggataaagacagtgataaaaagaagcacaagaagcacaaaaagcataagaaagacaagaaaaaagacaagaaggacaaaaaggagcataagaaacataaaaaggaagagaagagattgaagaaggaaaaaagggcggaaaagaccaaagaaacgaaaaagacgtcaaaattaaaatctagtgaatctgcatccaatatccccgatgcggtaaacacaagactatcggtgcgctccaaatggataaaacaaaagagggccgcgttgatggactccaaggcactgaatgagatctttatgataacaaacgactaa

SEQ ID NO: 1629 - DNA, 816 bp, Saccharomyces cerevisiae
atggtatcgaagacttggatatgtggcttcatcagtataattacagtggtacaggccttgtcctgcgagaagcatgatgtattgaaaaagtatcaggtgggaaaatttagctcactaacttctacggaaagggatactccgccaagcacaactattgaaaagtggtggataaacgtttgcgaagagcataacgtagaacctcctgaagaatgtaaaaaaaatgacatgctatgtggtttaacagatgtcatcttgcccggtaaggatgctatcaccactcaaattatagattttgacaaaaacattggcttcaatgtcgaggaaactgagagtgcgcttacattgacactaaaaggcgctacgtggggcgccaattcttttgacgcaaaactagaatttcagtgtaatgacaatatgaaacaagacgagctgactagtcacacatgggccgataaaagtatccaattgaccctaaaagggccatctggctgtttgaagagcaaagatgatgacaaaaaaaatggcgacggcgataatggtaaggatggtgacagcgaggggaaaaagccagctaagaaggcaggcgggacttcgtggttcacttggttattcctatacgctctactgtttacattgatatacctgatggttgtatcattcttgaataccagaggaggctcttttcaagatttccgtgctgagttcattcaacgttctactcaatttctcacttccttacctgaattctgcaaggaagtggtttcgagaatcttaggcagaagtaccgcccaaagaggcggttatagcgccgtttaa

SEQ ID NO: 1630 - DNA, 816 bp, Saccharomyces cerevisiae
atggtgagctatggaagtcatagtagtgaggtttcgaaagttcttaaaacgccgaagtttgtgcttaggtatggaaatgtatccagcaaacaacgttttgccctaaagcggaagataaattacaaactacgtgaaagcaaatatcaagaatacttgaatgaatacaacaccttcgtgctttacgactgggaaaacagtggcgctggtagtcttgtcgattcttcctacaatctcccctctttatggaaggaattcataacagagggcatatctaaaggagcaataaacgacaaactaccgacagtctttatgaagaggaagttgacaaactcagcgttgggtcactgtttgggacttgatttcctgactgatccgagcgagtcagaacatgaatacaggtgcatgtttcagacagttcaggacatcccatctctctcgcaactgatcttattcaacagcatgccaaacgttccagtaagattgaaattgcataccattggtataaatataaatttcggctgcaaacgttccctgataagcaacggtggtgatcaagacactgaaatgagcgaagcagtctcttatatccagcctttattggaagaatcctcgagaatgtaccgcaatttaaactactggaagctgttaaaaatagcacgaaataacaagaaggatgaaccgttggatcagagcacgcgtatcaagtcgcaagttaagcttttactgagtcaattggcgacgaaccgaattacctcaccttccgtcacggatcatgggggtcacaactggctcatattcaccagaagacggttgtaa

SEQ ID NO: 1631 - DNA, 816 bp, Saccharomyces cerevisiae
atgtctcgagttgcacagctcgactcgatagcgcttgataaagaattgtatggacagttttggtccgagttcaatgcagcattcaatacgagtgaacacaaagaggaatgggagttggcactgaacacagttgtgtttatgtgcgcgacgaggttcctgccacactatggctctagctgtacgtatggatccgcactcagtggcgtggtttttcagtgcaggaaacgcaccttgtatgtcgtcactgtcttggcagggtacgtgtggaagaagatcacacatattatttttaatgggccgcactgtgggaaccagatgatgtggctgaagctgtacaaatgggttaatttattgtatcacggctgtgatgtaaccaacttcctgaggtttctagcagcggaagggcccaatgcgagggcgtttttgtcgccgttataccgggcttttaatgtccattccacaaggttgattcgggatggttctgcaattgcctctgaattttattcgaactctgtattcgctgggttagaataccagaatagacaattgctatggaatgcactattagaactcttttccaatacactacttacgaaaagaggactcttgacctttgttaaaaaaccaccaaggtctcgttctacgactacttataagacagtttgcccccgttgcggcggttttccaaccaacccataccagatcgcttgttgtcgtgcgaactactgttacgtgtgcgttgtaaaggcgttggagtggtctatgtgcgatgcctgtggatcctctgggagactgaccgcctcaccagtgtactaa

SEQ ID NO: 1632 - DNA, 816 bp, Saccharomyces cerevisiae
atgtcttttgatattaattggagtacattggaatctgacaatagactgaatgatcttataagaaaacatttaaattcatatttacaaaatacgcaactaccaagctacgtaagtaatcttagggtactagattttgatctgggaaaagttggtcctgctataacactgaaagaaataacagatcccctagatgagttttatgattcaattagagaggaggctgatcaagagacggaggaaaataatgacaacaaggaggacagcgaacatatttgtcctgatcgtactatagctaatcatgaaggacctaaagatgattttgaggcgcctgtggtgatgccatcccccaacgatatacaatttttactagaggtcgagtacaagggtgacttactcgttacgattggtgccgaccttgtgctgaattatcccgtagaaaaatttatgactttgccagtaaaactttctatcagtgatatcggtctccattccctttgcattgttgcatgtttatcaaagcaactatttcttagctttctgtgtgatgttagtgatcctgcactggatgacaaccaaactgttttagatcctaaggggccaattctggcagctactaagccattggagcgaatatccattgtgagaagtatgaagattgaaaccgaaataggggaacaatatcagggacagggctcagtattaagaagtgttggagaactagaacagtttttgtttacgatattcaaagattttttaagaaaggagttagcatggccaagttggattaatctggatttcaacgatggtgatgagtaa

SEQ ID NO: 1633 - DNA, 817 bp, Saccharomyces cerevisiae
atggtatgtcgaacttgtactgaaccagcagaaattgaaacagactgcaagtaagctctattccggttatagcattatgggtggctgtataaatacaatacaatcacgggagaaatttccaacaaaaaagatctagtgatacgtttggtgccacaagtttaaaatacaaattggttaaaggactttacggctaaaacacaagaattgcaataatgctaatatttattctgtgtattcctcagtaacgtaagatcagcgagaacaaattcccagggttggaaagaataaaaaaaaaagtactgctgtaatgtttctggattatttttctgattaattgttctgtttagattactaacgtattctgctaaaaatgactggtgagctttgcttccattcattttattttttatagtctgacgctgtcactattcgtaccagaaaggttatctccaacccattgttggccagaaagcaattcgttgttgacgtcttgcacccaaacagagctaatgtctccaaggatgaattacgtgaaaaattagctgaagtctacaaggctgaaaaggacgctgtctccgttttcggtttcagaacccaatttggtggtggtaaatctgttggtttcggtttggtctacaactctgttgccgaagctaagaagttcgaaccaacttacagattagtcagatacggtttggctgaaaaggttgaaaaggcttccagacaacaaagaaagcaaaagaagaacagagacaagaagatctttggtactggtaaaagattggccaaaaaggttgctcgtcgtaacgctgattaa

SEQ ID NO: 1634 - DNA, 819 bp, Saccharomyces cerevisiae
atgagaaacaggcagaatcaaaagaactggactaatttaagaggtctattgtccgttgaagagagagaaaaactagaaaatttacggcttgaactagtatgtatgcaagctgctaatagtattccacatgacccaccggaaatcagtagtctggagacggaattgatttgcttaacaacgaacacaaaagattgcaaaccagtgaggttccacagtgatttacttttaaagaagcacaaatacaatgaaattaagaaaatatttaaggaaattttggaaaacattgaagcatatcgcgatgagttcactaaaaatcaaacaaaaataaacttacttcttgccgatgacgcaagagctagcctgcgtaatagatcgctcgatttttctgatttaatgccttcgagtataattaaggacgtacaggttttagccaatatggaagccaatgttgttgtcatgaaaaatgcgttgaaaacgaagttggttggagagaaaagtgtgcctgttgcttcttctcctatatccagcataattcctcgaacttctaggaataaaaaaacctccccatcaaactatcaccattcggtactttcacatcggaaatcaaatgaatggaatcaggtcagttcaactgagtataagagaacactgttattgaatataaaatataatgatgattttaaagctaccatagtgccaagttttgaaagttgtttatgctcgaggtcatatttcctccgcgtaaaacttcattttgataaaggtgttggatctgctgaaattgatatcccagttcaagttaaaaactcttttatttga

SEQ ID NO: 1635 - DNA, 819 bp, Saccharomyces cerevisiae
atgagagactataaattagtagtattgggtgctggtggtgtcggtaaatcctgcttaaccgtgcagtttgtacagggagtttatttggatacgtatgatccaacgatcgaagattcttacaggaaaaccatcgagatcgataacaaggtattcgacctggaaattttagatacagcgggtatagcacaatttactgcaatgagagaattatacataaagtcaggaatggggttcctgttggtatattcagtaacagatcggcaatctttggaagaattaatggagctaagagaacaggtccttaggatcaaagattccgatcgcgttccaatggttctaataggtaacaaggctgatctaatcaatgaaagggtaataagtgtggaagaaggtatagaggtaagcagtaaatggggtagagttcccttttatgaaacaagcgctttgttgaggagcaatgtggatgaagtgttcgttgatttagttaggcaaatcattcggaatgaaatggaaagtgttgcagttaaagacgcaagaaatcaaagtcaacaatttagcaaaatcgagtctccatcaaccaggctccctagttctgcgaaacaggatacgaaacaatcaaacaataagcaatcatcaaaaggtttatataacaaatcttcacaaggacaagctaaagttaaacaatctactccggttaatgaaaagcacaaaccgtcacatgccgttccgaaatctggttctagcaacaggacaggaattagcgctacttcacaacaaaagaaaaagaagaaaaacgcttccacttgcactattctatag

SEQ ID NO: 1636 - DNA, 819 bp, Saccharomyces cerevisiae
atgatattcaatctacctgttagtgtgctgctttatttttctttgatatgggcaatggagcctagtttcgtaagaggtaagaacgtcgtcaacttaattactttcaaagattcaaatggcaagctgcacaagcggttagcaccagaggaaataccgccccggctacataattctcaagtaaattcttatccattaggatataagggaatgcgtgacttttcaagacccgcagtgaatttagatgatattttagggacacagcaaagaaagcagcaagagtttttggctgaattgtctcctttatccttagaatcaaagttgtcattagtgaacgaggtccaaatatttgcaagctatgtgcgaaatgatgttgaaacatataacaaagtaagtgaccccaacgaagatttgattattattgcaccaacgaacagggctgtctctcagcttactttaaaaccgtggcaatttccgaataatattgataagcttgaaagtgatggtgccaccgagaaggaacttgatacggcaatacaagagaatatctccaaatttgtgagatctcatattgtagtgtacaatgatgataaaaattcctacaagaaggtgagtccaggatgtacgctcctgcagagtattgacttcacagaaagcaagaaaagcgattcggaaactggtggtgatattttactcaaaaaagaaggagaagtatattatgtagcttcctccagagacgagaaatttcatgccgtcgagagcattgaaaatggaagcaatggtgttattttgatggttgatttcaccctggtgggtccttag

SEQ ID NO: 1637 - DNA, 819 bp, Saccharomyces cerevisiae
atggttaaaacgactgaagtagtaagcgaagtttcaaaggtggcaggtgtaagaccatgggcaggtatattcgttgttgaaattcaagaggatatactcgcggatgagtttacgttcgaggcattaatgagaactttgccattggcgtctcaagccagaatcctcaataaaaaatcgtttcacgatagatgttcaaatctatgcagccagctgctgcagttgtttggctgctctatagtaacgggcttaaattttcaagagctgaaatttgacaagggcagcttcggtaagccattcttagacaacaatcgttttcttccatttagcatgaccatcggtgaacaatatgtagctatgttcctcgtaaaatgtgtaagtacagatgaataccaggatgtcggaattgatatcgcttctccgtgcaattatggcgggagggaagagttggagctatttaaagaagtttttagtgaaagagaatttaacggtttactgaaagcgtctgatccatgcacaatatttacttacttatggtccttgaaggagtcgtatacaaaatttactggaactggccttaacacagacttgtcactaatagattttggcgctatcagcttttttccggctgagggagcttctatgtgcataactctggatgaagttccattgattttccattctcaatggttcaataacgaaattgtcactatctgtatgccaaagtccatcagtgataaaatcaacacgaacagaccaaaattatataatatcagcttatctacgttgattgattatttcatcgaaaatgatggtttataa

SEQ ID NO: 1638 - DNA, 819 bp, Saccharomyces cerevisiae
atgtctcgcgttggtgtcatggtattaggacctgcaggtgcggggaaaagcacattttgtaattccattatatcacatatgcaaactgtaggacgaagagctcatattgtaaatttagaccctgccgcagaagctaccaagtatgaatttactattgacattagagatttaatttccttagatgatgtcatggaagaaatggatttgggccccaatggtgcgctaatatattgcttcgaatatcttttgaaaaatctagactggcttgacgaagagatcggggatttcaacgatgaatatttaatctttgactgtcccggtcaaattgaactctacacgcatatccctgtcttaccgaacatagtgcgccatttaactcaacaactgaatttcaacctttgcgccacatatcttttggaagcgccatttgtgatagatagctcaaaattttttagcggtgcactatctgctatgtctgcgatgattctattggaactaccccatatcaatgtgttgagcaaactagacttgataaaaggcgacatcaataagaaaaaactgaaaagatttttgaatcccgatgcaatgttattaatggaaacggaaggaatgaatcaagcatccaaccctaaatttctaagactgaaccagtgcatagccaacctcgtcgatgatttcggtatggttcaatttttacctttggaatctaataatcctgacagtatagaaaccatattatcgtatgtcgatgatataacacaatgggcagaaggacaagaacagaaagagcctaacgaccaaatagatgtcgaagaatag

SEQ ID NO: 1639 - DNA, 821 bp, Saccharomyces cerevisiae
atgcaaatgtatgcaccatatccattctaaacatagtttttcgaacgttcagagcttaaagggacaattattttagaaactgaatttttacccagtggaataacatcgtatctgtaaagtctacaaaattttttatccatcaaaaattaaaacaaagaaaactgccaaactgaatatgaggaactttcctctctaggaatgacttagtgaatgtacagtgacttgtggaaaatatgattagattttgagcgggtgatgcgacttaacagtctcattgcctaagaaatatccaaatttgtggttcatgctctcccccaagatatgacgatgagagctcgtttaaaattttgtcttcttccgaacagttatgaaaaaactattacgtgtttttatgatatccttactaacttgtcatttttttataaaattatttttttaacagttttgtcaagactttgactggtaagaccatcactttggaagttgaatcttctgacactattgacaatgtcaagtcaaagattcaagacaaggaaggtatcccacctgaccaacaaagattgatctttgctggtaagcaattggaagacggtagaaccttgtctgactacaacattcaaaaagaatccactttgcacttagtcttgagattgagaggtggtatcattgaaccatctttgaaagctttggcttccaagtacaactgtgacaaatctgtttgccgtaagtgttatgctagattgccaccaagagctaccaactgtagaaagagaaagtgtggtcacaccaaccaattgcgtccaaagaagaagttaaaatga

SEQ ID NO: 1640 - DNA, 822 bp, Saccharomyces cerevisiae
atgaccgttcccaggaatcgtcccatggcaccatttggcaccattatcaaatcaagaataaaacaaccccagttttattggtttataggccattttttaaccatctttaactttatacaatttcatctttcaatcacgtccaaacaaaaccaattgtcatgctatagaagatcattattttacatatccgttacatatgccatcgttctttaccagtttttcaaaagtgaccagttaaagttcaattttacgcttttgcgccaagagatgaagaaattggataatttgcagtattttgccatgctattcatactttttctcttatcacagtttaacatcataatcagcggctcgttatacagtcccgttatcttttcaatctttcacttcctgaactattttaaggaaaaccttttgccatttttgcctttgataccacttaatttgaaaaatttgttgaactccaaaataacggtattcatccaaaactacaatggatttttcttacagatggcgcaagtatttgagattatctgcggcctacgtgtgggcctcttcttagtgcccttcaattttttcttgttgttggtaagaagagcaaacgtgtcgtttgaggtagtgggtacaatgttggcaggactaacctatgtatggtttttcaaattaaggtacctacaaagtgaatctatgaggcagatatttaaacaatatgtccttaggttggatgcatatgtcagccgtactttgcccccatattgttcccgtttatggaacggctataagaatttcgttatgacagtgttttggaagatacctgtgtag

SEQ ID NO: 1641 - DNA, 822 bp, Saccharomyces cerevisiae
atgcctagattagaagagattgacgatttcaatgatatcgacgaccttgatatggaattggccgagttagatccatctttgaggacgccgatcgctcccaagataacgcctaaggttgtaaggagccaggaccaagagaaccctgcatttttacctggcacgaataacaacagtaatagcaacaacaatagtagcaacgaaaaagagcagttgagttttattaacccaaaaactggtaaggttgaacgttcggaggctatttcgaagaaagatttagaagaagtcaaaagattccaagtactctatccatgttactttgacataaacagatcacataaggaagggagaagggttcctaaggagttggctgttgaaaatcctttggctaaaactatggcagatgctgtccgtgaattgggaatattatgcatttttgaaggtgaaaaatgtcacccacaagattttggtaatcctggtagaattcgtgtacttttcaaagaaaatggacaattaattggcgcagccactaaattcaaaggtggaaagaggcaattaatgaaagctgttggggagtatatgaaaagacatccaactactattgaatctttaagggagattccatatggccctgatttcgacaatattgaattcaaaaagattccacgtgtaaagggattcaaaatgaatgagattgttccgctgcatagtccgttcttgatgggccacccaatgacaaaatctgtttacgaaactcctaagattacagcggcagaaaagtcgttcaagccaccaaaaaataagtacaaagtagttagaagatga

SEQ ID NO: 1642 - DNA, 822 bp, Saccharomyces cerevisiae
atggctgcgcagaatgcctttgaacaaaaaaagagggcaattttgaatgagatagactcaacccaaccagatttgtcaccaaaaggcactatagatgaactatgccttccaataattgatcttatcaacgcaagcgctgatatggtgacaacttcatcgtgttccggtagagtcagtgtattcttggaaggtactaagtcatataacggggaggtcaagataggtggtaagggacaaggcggtaaatggctttacgtcactcatgatcgtgagaaagttattggctggttagatgagttgaaatcaaaaagtgagttttcttttgaactatctggcaaggagataccaacagagaaagtaacggggagtatcagatatatactttataagtatgagcctttcatattgcacgttaaatgcagagactttcaagcagcatccaagttatacaacacagccatgtcttgtggtttcagagaaagtgggattggttcgaacaatctggtcgcaatcagaataaatatcaagctggacgtaccgctcggttatttagatgagacttcaggcactttgaaattttttgtaactccagaatacgtaagcgttctggattctttatcgttaagcaaattcgatgagaataccaggaaaatgcaagcactatatgatagaattgaaaaagaactcataaattgtgcgccggatgtaaattctaaggtcaatataacgccaatcgaaacaaaggaagagaggagagaacgaaagaaaagagaaggtatggagagacaacgtcaacttaagagcccacaaaatgtgctataa

SEQ ID NO: 1643 - DNA, 822 bp, Saccharomyces cerevisiae
atgggtagtgttcaacgacaagatttggtcctattcagcgaccaatcagtgcttcctgcccactttttccaagacagcaactctcataacttattcttcatcacccatcaatcctgtactcaaccactatggatgataaacgcactagtagaaacgcacgtgttaggttccccaagttcccttaatgaatcttcttcatcgatgctaccttcgtcaactcgctcccatgcagtccttgcgtcgtttatccacgaacagaactattttacaaattcattaaacaagctaaagatcccatctaataactacaatgttttagacttcctgtccgacttcatcgttaataatatccataataagccaagagacaaaatactaagtgacgtactcgcaaagttctccgctgctatacaaaataacccaactgacaccattgttatcatcgaacaaccagaattactgttgtcgctagtaagcggcctaacttgttcagaattaaacaataagttcatcacacctcttttgaggcaatgcaaagtgctaatcattgtttccaattcggacatatttaatatagatgaatacgatgcttctgttcattcctcgaatctgcaaaatttctacaaatcttcctttatcaaatcaatgattaatttgaacttgaatcctctgaagaccggttttgcaaaggacgtaaccggctcattgcacgtttgcaggggcggcgcacccattgcaacttcaaacacaagcctacacgtcgttgaaaatgaatacctatatctgaatgagaaggagtcaacaaaactattttatcgctaa

SEQ ID NO: 1644 - DNA, 822 bp, Saccharomyces cerevisiae
atgtatgtttctaatgggaaagacacttgccagttgttggggcccgtgtctctttttgtccagacattgatgggtatgacagccgtgattgtgttattggtgaaaagaaactatgagcatccaaggagaaaaatgattgtgtggagttatgacattggaaaacaaatcatcggctctcttggaatccattttttgaatctaggcatcagcatactgaagaaaagacgaaggtcactcttcgcaatcactgcaaaaggcaatgatgatgaggatcaatgcgattggtattttcttaacttactcctggatactactgttgggattcccattctttggttgtgcttatacataattgaaaaagtgctaaaatccttacacttccaaaacattgaaagtggtaattattttccatctaaaaccgttgggagccaccccagaaaacccttattctctgccttcgtgaaacagctgcttatattcattgttgggctgggcgtgatgaagttctgcgtgtttctaatactaaactacttagaagacttggcatactggttcgccgatcttatccttggctggtcagattcatggccaaactttcaagtttttctggtcatgtttgtctttcctatcttactgaattgcttccagtacttttgtgtcgacaatgtcatcaggttacattctgagagcctaacgataaccaatgcagagaattttgaaacgaacacattcctaaatgacgaaattcctgatttatcggaagtctcaaatgaagtgcctaacaaggataacaacatttccagctatggtagcataatatag

SEQ ID NO: 1645 - DNA, 822 bp, Saccharomyces cerevisiae
atgtcatatttgccgacttattccaacgacttgccagcaggcccgcaaggccagaggaggcgtaataatggtaatgaaaacgatgcaagacaaggctacggtcagcaatctgtgccgatggtaatcaggaggcttttcaaaacgccaaagaatttagatctcgagacagccagctgggaaatgttccatttgattttccatccaagaaaagcttatagatcaatatattatcagcgacagacgaaaaatcagtgggcgagagatgatccttcctttttcatcttccaaatagccttaatttcactcagttctattatttggtcgatttataattcaggtttcaacaacgacagtgatatgggggccttgagcattataggtcattttttcaaaagtttggtaatgatggtgattttagattttttcatatttggatttattatggcaactattttttaccttttgttgaataggtcacattttaaattcaaatcgagccaaaatagtgtggtagagtgggcttattgtttcgacgttcattgtaattcatttttaatcatcctactgtgcctatacttcattcagtttttactactgcccataattaatttacaaaactggatttccttactcattggtaattcgttatattgttttgctattggccattactttattttaaccttttatggatacaaccagttgccattcttgaaaaatttgaactttatacttttaccaacattaggattatcgataatctatttaatcagtttatttggcatcgacttatccaagaaattaagcttttacaattattaa

SEQ ID NO: 1646 - DNA, 822 bp, Saccharomyces cerevisiae
atgtccaacccatttgatttgttaggtaacgacgtcgaagacgctgacgttgtcgttttgccaccaaaggaaatcgtcaagagcaacacttcctccaagaaggctgacgtcccacctccatccgctgacccatccaaggctagaaagaacagaccaagaccttctggtaacgagggtgctatcagagacaagaccgctggtagaagaaacaacagatcaaaggatgtcactgactctgccaccaccaagaagtccaacaccagaagggccactgaccgccactctagaactggtaagactgacaccaagaagaaggttaaccaaggttggggtgatgacaagaaggaattgagtgctgaaaaggaagctcaagccgatgctgctgctgaaattgctgaagacgctgcagaagctgaagacgctggtaagccaaagaccgctcaattgtctttgcaagactacttgaaccaacaagctaacaaccagttcaacaaggtcccagaagctaagaaggttgaattagacgctgaaagaattgaaactgctgaaaaggaagcttacgttccagcaaccaaggtcaagaacgtcaaatctaagcaattgaagaccaaggagtacttggaatttgatgccacttttgttgaatctaacactagaaagaacttcggtgacagaaacaacaacagcagaaacaacttcaacaaccgtcgtggtggtagaggcgctagaaagggtaacaacactgctaacgctactaactctgctaacaccgttcaaaagaaccgtaacattgacgtttctaacttgccatctttggcttaa

SEQ ID NO: 1647 - DNA, 822 bp, Saccharomyces cerevisiae
atgtcccaaactcgtgaagattctgtttacctagctaaattagctgaacaagccgaacgttatgaagaaatggtcgaaaacatgaaggccgttgcttcatcaggtcaagagttatctgtcgaagaacggaatctattgtcggttgcttacaagaacgtcatcggtgctcgccgtgcttcatggagaatagtttcttcgatcgaacaaaaagaagaatcaaaggagaaatctgaacatcaagttgaattaatccgttcttaccgttctaaaattgaaactgaattgaccaaaatctctgacgacattttatctgtgttagattctcatttaatcccttctgctactactggtgagtctaaagtattttactataagatgaagggtgactaccaccgttatttagctgaattttccagcggagatgcaagagaaaaggcaaccaactcctctttggaggcttataaaaccgcttccgaaatcgccacaactgaattgcctccaactcacccaattcgtttaggtctagctttgaatttctccgtcttctattacgaaattcaaaactctcctgataaggcttgccacttggccaaacaagcctttgatgatgctattgctgagttagatactttatctgaagaatcatacaaggatagcactttgatcatgcaattattaagggacaacttgaccttatggacctctgatatttctgaatctggtcaagaagatcaacaacaacaacaacaacagcaacagcaacagcaacaacagcaacaacaagctccagctgaacaaactcaaggtgaaccaaccaaataa

SEQ ID NO: 1648 - DNA, 822 bp, Saccharomyces cerevisiae
atgttgattactgagacctttcatgatgtgcagacatcatacggcaccactctgcgtatatacgtatattctcctaagattgcaggctatccacaagctaagtttcctggggtgattctgtacagtgaaatttaccaagtgacgggtccggttcgtcgttttggtcaaagaattgcgtctgaaggttacgttgtggtggcacctgccatataccacaactttatgggccctgaagcgttgccctatgacgtgcagggtaccgatattggtaacgagtacaagatcaagaagccgttagaatcatacgatgaggacaacaaactgtgttgcgatctacttttccagttaccccaattcgatggtaagagaattggttccacaggaatgtgtttaggtggccatttggcttttagagcgctcctggacaaaagggttacctgcgcaacctgcttcttccctaccgacatccattccagaaccttaggtcttggccagaacgataactctttggaacgtgtttcgaaggagttgggtaataaccaagaaatggttttgatcttcggaactgcggacacccatgtcgacccgcaaggccgcgatctaatcagaaagaccctcagagaccacggagtaaagtttacgttcttggaaatcctggctgcccagcatgcgttcatccgtgacgagttcagcaagggcaggttcgactccgctatcactcaaagttgtctcggcttcttgttcgagcagttcaacagaaaattgagaatcgatttgggtgaatttgtcgatgacaatacacctttggagcacgtttgttaa

SEQ ID NO: 1649 - DNA, 822 bp, Saccharomyces cerevisiae
atgtttggagtcaaggatgctatattcaagattaaacgttccattgcaggcacagattcttctgattccactgcttacacaacggcaagtgaatcttcacctcaattaaaagattcccataacccctttcgaaataaaacgacatccgagagaactatagttgaggagggctctctaccaccggtgagattgaatggctacttgccctcaactaaaaataaacttcttactcctgaaatgtgcgatgaaataagaacattaatgcccacgaggatacagttgtacaccgaatggaaccttctatatagccttgagcaacatgggtcttcattacactccctgtatagtaacgttgctccagatagcaaggaatttagaagagtggggtatgtattagtaataaaggatcgtaaaaacggaatctttggagcttacagcaacgaagcttttcatcctaacgaacataggcaatacacaggaaacggggaatgttttctatggaagctggataaagtacctgatgttaatatatccgaaaaagaagaatctgagcaagaaggtaaagaaggtaaggaggaaggggataaagaggagagatggaggttttcaggttatccttacactggagttaacgaatttgctatatactgtacatctgaatttctttcaatgggtgcaggtgatggtcattatggtcttttatgcgatgacggcctactccatggtgtttcaaacccttgtcaaacatatggcaatgaagttttgagtaaggagggcaaaaaattttctatagtagctttggaagtatggcgtgtaggatag

SEQ ID NO: 1650 - DNA, 824 bp, Saccharomyces cerevisiae
atggtatgtttgatcgccggaggcatcttttctcattattgctaaaacaagatgtaatactaacagggtattttgctactaccatcaaatagaacgctctttacaaccatgctgtgaagcaaaaaaatcaactacaacaagagttggccaggtttgaaaagaattctgtgaccgcccctatttctttacaagggtccatctctgcaactctggtctcactggagaaaacagttaagcaatatgcagaacatttaaacagatataaagaagatactaatgcagaggaaattgatcctaagttcgctaatcgactagcaactttaacacaggatctgcacgactttactgccaagtttaaggatttaaaacaatcctacaacgaaaataattccagaactcagttgtttggctcaggagcatcgcatgttatggactccgataacccctttagtacatcagagaccatcatgaataaaaggaacgttggtggtgcgagtgcaaatggtaaagagggctctagcaacggtgggggactaccgttgtaccaagggctacaaaaggaacagtctgttttcgaaaggggtaacgctcaattagattacattctagaaatgggccaacaatcattcgaaaatatagtggaacaaaacaaaattttatccaaggtacaagatagaatgtcaaatggcctaagaacattgggtgtttcggaacaaactatcacctctatcaataaacgggtgttcaaagataaactagtcttttggatcgcgttaattctcttgatcataggtatttattatgtgttgaaatggttaagatag

SEQ ID NO: 1651 - DNA, 825 bp, Saccharomyces cerevisiae
atgagggaaggtgattctaattcaaaaaaatctgcggatgttgctgtcctctccatcatccttacgggttcgaccttaacattgatctacacatataaaaggtatttaactcaattcaaaagaacaaatgatataccgcgaagaatatttcgtaaacactggctttatggtaaagtcacgtctgtaggtgacggggacaactttcatttctttcacatgccaggtggtataagaggtggatggggatggttacgacccgtcccacaaatgatcaagaatgattctacggcagaaaagcttgttggagatagcagaaatatgaggtttttcaatttcaattggattacgcatgggaggtccaccaaaagtaaaatacaaaaagctaaaagccagttcttgaagctaaatgtaccttacaaaaataggaaaaacctgccaactattcctataagattatgtggaatcgatgccccagaaagagcacatttcggtaacccagctcaaccgtttggtaatgaagctttaatttggttacaaaaccgaattttgggaaagaaagtatgggtcaagcctttatctatagatcagtacaaccgttgtgtagctcgagtgtcatactgggactggtttggtgggtggaaagacttaagcttagaaatgctcaaggatggattagcggttgtttatgagggtaaagtaaacacagaatttgatgatagagaagataagtatcgatattatgaatttttggcaagatctagaaaaaagggactgtggatccagaataaatttgaaacgcctggtgaatataaaaaacgtatttga

SEQ ID NO: 1652 - DNA, 825 bp, Saccharomyces cerevisiae
atgagtgaagttgcaccagaggagatcatagagaatgcagatggatctagatctatcattacatacaagattgaagacggtgtcaagtataagattactcagaaagtaaaagaggttaaagtattggaaaaagtccataaatctgttgcagaaagaaaaaactggcataaatatggctctgaaaaagggtctccagcaggtccaagtgctgttacagcaagattgggtgaagaagtagaattaagattgagtaggaactggaaacaagctgaagaagaaagaatacaaaaagaaaaggcaagtctcacaaagaccggtctacaatgtagattatgtggtaacgaccatatgaccatgaactgtccattcaagacaattttaagtgaactttcagcattagaagacccagccactaatgaaggcggtgtcgaggccgccagtgaagagaaggcaggccaagttggcggagctggttccatcccagggcagtatgttccaccttctcgtcgtgctggtgcaagagatccttcatccgatgcttacagagactctagagaacgtgatgatatgtgtactttgaagattatgcaagttaatgaaaatgccgatgaaaatagtttgagagaagagttattgttcccattcgcacccattccaagagtttctgtcgttagaaacaaagaaacaggtaaatcaagaggtctcgcctttgttaccttttcgagcgaagaagttgccgaacaagctttacgtttcttggatggtaggggttatatgaatttaattttacgtgttgaatggtccaaacctaaggttaaggaatag

SEQ ID NO: 1653 - DNA, 825 bp, Saccharomyces cerevisiae
atgatacgtcagctcaattattggtcaaggaaggcgtatctcatttacccctttcaagtttttgtaggcgcattattatcaatagtagtatcttcagaaacattaaaccatcaaaaagagacatgcgctctattgaaatcgtccaatattttcaatgttatttttgcatacaaagcgaaccaactgtggccatttttattctttagtttggcttttctgcaaatatacttccactatctagcaagaatggatatattgcctttaccaatatcaagtaccgaaactagctcttcctatttaacatatactaaccattggcctctgctcaaaaatagaataatcagtattatgatcactcaatatgcttgcaagttcgttctaaaatatctattattgtttttgaatttccaatttatcgatcatgttttcatttggacagggggagaatgcagttctggtagtaaaacgacatcagctgaaaagtgccgtctagaaaatgggaaatgggatggtgggtttgacattagtggacacttctgctttcttgtgagtataagcatgattctttggatggaacttcacttattcagtagatttgttcaagctgaagatatgttttgggttgtgaataagtgggtacgagcttgccttgccattgtttgcgctgtcctagtaatttggatatgtattctctgggttaccgctatttattatcatactatcttggaaaaagtgttaggttgccttatgggtttcatatgccctgttttcatataccacattctacccaaaattgggatactacacaattacttatatctatga

SEQ ID NO: 1654 - DNA, 825 bp, Saccharomyces cerevisiae
atgatctctgtcatggcggatgagaaacataaggagtattttaagctatactactttcagtacatgataattggtctatgtacgatattattcctctattcggagatatccctggtacctaggggccaaaacatcgaatttagtcttgatgaccccagtatatcaaaacgttatgtacctaacgaactcgtgggcccactagaatgtttgattttgagtgttggactgagtaacatggtcgtcttctggacctgcatgtttgacaaggacttactgaagaagaatagagtaaagagactaagagagaggccggacggaatctcgaacgattttcacttcatgcatactagcattctatgtctgatgctgattataagcataaatgctgccctaacaggcgccttaaagttgattataggaaacttgaggcctgactttgttgatagatgtatacctgacctccaaaagatgagtgattcagattctttggtttttggcttggacatttgcaagcagactaacaaatggattctatacgaaggcttaaaaagcactccaagcggacattcaagtttcatagtcagtaccatgggctttacatatctttggcaaagggttttcaccacacgcaatacaagaagttgcatttggtgccctttattagctctagtagtaatggtttcaagggttatcgatcacagacatcattggtacgatgttgtctctggagctgttctagcatttttagtcatttattgttgctggaaatggacatttacaaacttggcgaaaagagacatacttccttcaccggttagtgtttag

SEQ ID NO: 1655 - DNA, 825 bp, Saccharomyces cerevisiae
atgcaggttaaatcgattaaaatgagatgggagtctggtggtgttaattactgctatctattgtccgacagtaaaaataaaaaatcgtggctaatcgatccagcagagcctcctgaggttctgccagagttgactgaggatgagaaaataagtgttgaagcaattgttaatacacatcaccattatgaccatgcagatggtaacgctgatatcttgaagtatttaaaagagaaaaatccaacttcaaaagttgaggttataggagggtcaaaggactgcccaaaggttacgataattccggagaatttgaaaaagttacacctaggtgacttagagattacttgtattaggacgccctgccataccagagactctatctgttattatgtgaaagatccaacaacagatgagcgctgcatttttactggcgatacactatttaccgctggttgcggtaggttttttgagggtacaggcgaagaaatggatatagctctgaacaattctatcttagaaactgtgggcaggcagaactggagtaaaacgagggtttatccaggacacgaatacacaagtgataatgtaaagtttgttcgtaagatttacccgcaagttggtgaaaataaagcattggatgagttagaacaattctgctccaagcatgaagtcacagcagggcggttcactttgaaagatgaggtagaatttaatccattcatgagattagaagatccaaaggtccaaaaagctgccggagatacgaataattcatgggacagagctcaaattatggataaattgagagctatgaaaaaccgtatgtag

SEQ ID NO: 1656 - DNA, 825 bp, Saccharomyces cerevisiae
atgccaggtgtttccgttaggtacgtaaaaatgacatatcataatgattattactatatgtttcgagtggttagatggaaataaaacgcagtcattccagcagcatagacacgcaagcaaagtacttcttcgtcaagttaaatagcacccatggttaaatcaatgatatatcaactgtcccataataattgaaacaaaatattgatcaaatttcgcgaatgagtgcaatgtgtaaatatatggaagaagagggagattaagggtagtggtgctatttgctctttgttattactaggatttcaattccttccgataagttctcatgaaacgtaatggttaatgaaagtattttttttaaactgtatcatttactaacaataacttttttgttttgattttgttttctacagagacgttgctgctcaagatttcattaatgcttacgcttctttcttgcaaagacaaggtaagctagaagttccaggttacgttgacattgtcaagacctcttctggtaacgaaatgccaccacaagatgccgaaggttggttctacaagcgtgctgcctctgttgccagacacatttacatgagaaaacaagttggtgttggtaaattgaacaaattatacggtggtgccaagagcagaggtgttagaccatacaagcacattgacgcttccggttctatcaacagaaaggttttgcaagctttggaaaagattggtatcgtcgaaatctctccaaagggtggtagaagaatctctgaaaacggtcaaagagatttggatcgtattgccgctcaaactttggaagaagacgaataa

SEQ ID NO: 1657 - DNA, 825 bp, Saccharomyces cerevisiae
atgccctcgttagccgaattgaccaagtcgttaagcatagcctttgaaaacggcgattatgccgcgtgtgagaagctcttgccccctatcaagatcgaacttatcaagaataaccttttaatacctgacttatccattcaaaatgacatctatttgaatgatttgatgattactaaaaggatcctggaagtaggtgcccttgctagcatccaaactttcaattttgacagcttcgagaattacttcaaccaattgaagccttactactttagcaacaatcataaattatctgaatctgacaagaaatcgaagctgataagtctgtatttgttgaacttattgtctcagaataacacaaccaagtttcactcggaattgcagtatctagataaacatatcaagaacttggaagacgattcacttttgtcttaccctatcaaactagacagatggctcatggaagggtcgtaccagaaagcatgggatcttctgcaatctgggtcgcagaatatatcagaattcgactcttttaccgatatcctaaaatcagctataagagacgaaattgctaaaaataccgagctatcctacgactttctccctctctccaacataaaggctttgctctttttcaacaacgaaaaagaaactgaaaaatttgcactagagagaaactggcctattgtcaactcgaaagtttacttcaataaccaatcaaaggagaaagctgattacgaagatgaaatgatgcatgaagaagaccaaaagacaaacattatcgaaaaagcaatggattatgccataagtattgaaaatattgtgtaa

SEQ ID NO: 1658 - DNA, 825 bp, Saccharomyces cerevisiae
atggaggagagtaagacaaaaagaaaagaggatcgcatagatttgaagaatacaccgcctcagaagaagtcaaaaagagattcaacaaatgacgaaactgcacgcacatcactacgttcaatcatgcccaggggttataaaatgatggaaaacatgggttacaaagaaggagaaacattaggtagtaatgaaagtgccctaaaagagcctattaaggtagaaatcaatacaaaaaggaggggaattcgtgcagaaaagcccgacccatcaacaatgaatgacatgcagatgagtgaacaacgatttataaaaagagaaagtgaaatgaaaaataataagcggttaaaaaaaatttggtataggatccaaaaagttgcttttgaaatgatgggtgattccgatttatacaatccaggcgaagatccgagagactttaacgtactttggagatcttacgttatgcaactaaatgaggaagtagcaaaaaatgacctaaataatcacagtaacaatgataatgaagataagaataatatgataccaatggtaaatgaaagtttggaggcttcgcctgcaataaaaggtgaaaagtttggacgtccttctacattaatagattgtgatacttcaattatcggtagtcgcattacaaaagacacagaacttgctgaattagaagaattgagcattgaaaaaagaataacaaaattgaatatattcctgaggtccgagaagtactactgttttttttgcggaatcaagtataaggatgaaggtgatctctacgagcattgcccaggagtgaatgaagacgaccacaaatga

SEQ ID NO: 1659 - DNA, 825 bp, Saccharomyces cerevisiae
atggattttaaagcaagtgggacaaagtttaagaaaactggcaagaaggtagtgcctgctaaagcgtttgaagaaattgttcagacaaatagagatgttctgaaaaaatcagcattcctctcagatttacttgaaaatttacaaccgcacctcaataacattaagaaaatacgatgtgttgcaattggaaatttcaaggaggattttcctgcgacgtaccaattcgctcttctcctagagattactgattatataaaaagtgaggatgaaagggatgtcgttgtttccctgtatgatccaatatttactaaagaagagatacagtacttgaaaagtttaggaagcaaatggctgatagaggaagaattttcagagaacgatgcaattgattatgaatcggtattatatttccttccccatgctcctttggatttaactgagaacatactatcgtcacagcgaccacacttatggctggcaaataatatgatatcacacaccgatagatacaccaaagcaaaactttgtgaaaactatcctaatttaagcaagctagttcattacttgcagactaacgctccgccagaagttaaaaaagcacatgatgtagatggttttgcaacattcattccaaagagaaaaagaaaaaacagaaacaactcctctaaactcaaggtcacaccatctgatatagactatgattcaatagcaccgaagtttaagtcctgccaaatactcaccgattttgatgaaggaaagtatttgaaggaaaaaccctggatcaattccttctctgacttgacgttacatgctatagagtactaa

SEQ ID NO: 1660 - DNA, 825 bp, Saccharomyces cerevisiae
atggcaagaagacctgataaccaaaatccagaaggtgaaaatctacgaatcaaaagggtaagactagagtcggtcaggcagaacgatgaggaggaagaaaatgaagtatcgagaacacaaaatatcgtcacagataaccgccatgacagcccagaggccgtagtcgaaatcattggagagcgagctcttgagaatacttctgaggaagatggtgatgatgatttatctctctttagagcacttgaagaagatccaggtagcgaccataacaccagtaacaacgattctgggaatcatgacagggaaacaatgcataccgaagagccagaagcaagttctggtaacaatatcacattaacgaataatgttgaagaattgcacacaatggacgttctttcacaaacagcaaacactccgagtgcttccccgatgcttgacgcagcaccgccgacaacgaaacctggaacaaatagtaaggaacaaactgttgatttaactgcagatgccatagacttagacgctgaagagcaacaagtgttgcaaatatcagatgacgactttcaggaggaaaccaaagaagcacccaaagagtatggtgcagccaaggactatcgctgcccgatttgttttgaacctccagagacagccctcatgacgttatgtgggcacgtcttttgttgtccatgcttatttcaaatggttaatagctcaagaacatgtagacagttcggccattgcgctctttgtagaagtaaagtgtacttaaaggatgtgaggttaattattctaaggaaaaagcaagtcaagaagaaggtaaaaagctag

SEQ ID NO: 1661 - DNA, 825 bp, Saccharomyces cerevisiae
atggctaacggtacgtgaaaggggtgatatcctgtttaaaaccatttagttattctttttttcagatggagactgtgatcgggtagcgcatgatgttattattggaattttattttttttgcaactttgaagcactcctaactatattgcaatagtgttatgagatgctacttatgtttgtaaggccatgaaattctgtaatacggagttaaaatttctgcaataaagcacttcaatgctattgtgttatagaggctctgcgctcacccttaatactgtatcatctgtaataaagaatgtttatcttaaaaggattgtaactaaatggttgttagatagtgactcattcgtttattttttaataatcgaaaaagcagaagttctgtttactaacaactatacctcttatcatgtatagaccttgttcaagctcgcgataactctcaagtctttggtgttgccagaatctacgcctcctttaacgatacctttgtacatgttaccgatttatctggtaaggaaactatcgccagagttactggtggtatgaaagtcaaggccgacagagacgaatcatctccatacgctgctatgttggctgcccaagatgttgccgctaagtgtaaggaagtcggtatcactgccgttcacgttaagatcagagctactggtggtaccagaaccaagaccccaggaccaggtggtcaagccgctttgagagctttggccagatctggtttgaggattggccgtatcgaagacgttactccagtcccatcagactccaccagaaagaagggtggtagaagaggtagaagattatga

SEQ ID NO: 1662 - DNA, 825 bp, Saccharomyces cerevisiae
atggtcaaatcgctacagctagcccatcaattaaaagacaagaaaatactactaatcggaggcggagaagtcggcttgacaaggttatataagctgatacctacaggttgcaagctgactttagtatctcctgacctacacaaatccattattccgaagtttggaaaattcatccagaacgaggatcagcccgactacagagaagacgctaaacgctttatcaatccgaactgggaccccacgaagaatgaaatttacgagtacatccgcagtgacttcaaagacgaatacctcgacctagaagacgagaacgacgcgtggtacataataatgacctgtatacccgaccaccctgaaagcgcaagaatatatcacctttgtaaggaaagattcggtaagcagcagctggtcaatgtggcggacaaacctgatctctgtgacttttatttcggcgccaacctggagataggagaccgtctacagattctgatctctaccaacggcctttctccgcgctttggcgctctagtaagagatgagatccgtaacttattcacacaaatgggggatctggcgctggaggacgctgtcgtcaaactaggtgagctgagaagaggaattaggctgctggcaccagacgacaaggatgtcaagtaccgcatggattgggccagacgctgcacagacctcttcggcattcagcactgccacaacatcgacgtaaaacgtctgctggatcttttcaaggtcatgtttcaagaacagaactgttccttgcagttccctcccagagaacggttgcttagcgagtactgctcgtcttga

SEQ ID NO: 1663 - DNA, 825 bp, Saccharomyces cerevisiae
atggtgaaagtaactgcagcttgtatcataattggtgatgaagtgctgaatggaaaagtagttgatacaaattccactttttttgcgaagtattgctttgatcatggaattcaattaaaagaaattgcaactataggggatgatgaaacccagatcgtagatactgtgagaagattagtcaaaaattatgattttatcatcagtacaggtggaatcggccccactcatgacgacatcacttacgaatgtatggcgaaaagctttaatttgccttgtgaactagatgaagaatgcaaagaacgaatgaggcataaatctgaccctgaagcaaggcttgatgcagatgctctaaaggcgcattaccaaatggcaaccatgccaaaaggcacaaacgtcaaaaattattatgtgtgtgatgacttgtgggtacctatttgttctatatctcacaaaatgtatatactacccggtatccctcaactatttgcaaggatgctgaaagcgttcactcccacgttgaaaaaaatatataatttggacaaggatccacgtgagtatgttcgttattttgtcagaacacacctaactgagtctcaaatttctaaagagctaaagttgattcaggatgaatcaacaaaagtttcagaagccattaaaataggctcatacccacattttggtatgggattcaatacagttagtattttgggtgaaaagaaagacgattcatatctgaagagtattgtcaatagagttgttaataacctcgagggagaagtaatttcttctgaacttgaaaacaagttctcgaaccaggagagctga

SEQ ID NO: 1664 - DNA, 825 bp, Saccharomyces cerevisiae
atggttgagtcaaatgatattataaaaagtgggctggcagagaaagcactaaaggctctaattttacaatgtgaagagaacccatctttaaaaaatgataaggacatacacataatcatcaacacgggcaaaaaaatgggcataaacagggacaacatcccccgtattattccattaacaaagtacaagctatttaaaccaagggacctaaacatattactcattaccaaggatccctctgccttgtatagagaaactttgacgaaagacgagcatacgtcggaattattcaaggaaattataagtgtcaagaacttgagacgtagattcaaagggagtaaactgacccaactttataaagattttgacttggtcgttgccgattacagagttcaccacttacttccggaggttcttggtagcagattttatcacggtagtaaaaaattgccatacatgatccgcatgtcgaaagaagtaaaattgaagcgtcaacaaatggtcgaaaaatgtgaccccatttacgtgagagcacaattgagaagtatatgtaagaatacctcatacattcccaataatgacaactgcttaagcgtcagggtcggttatattcaaaaacactccataccagaaattttgcaaaacatccaagatacaataaactttctcactgataaaagtaagagaccgcaaggcggcgtcattaaaggaggaataatatctatatttgtcaagaccagtaacagtactagtttgcctatatatcagttttcagaggctagagaaaatcagaaaaatgaagatctgagtgatattaaattgtaa

SEQ ID NO: 1665 - DNA, 825 bp, Saccharomyces cerevisiae
atggttgcgcctactgctttgaaaaaggctactgtgacacctgtaagtggacaagatgggggcagtagtagaattataggaataaataataccgaaagcatcgatgaggacgatgatgacgacgttctgttagatgattccgacaataacacagcaaaagaagaggtagagggcgaagaaggtagccggaaaacgcacgaatctaagaccgtagtggttgatgaccaggggaaacctcgcttcacttcagctagcaaaacacagggtaacaaaataaaatttgaatcgagaaagatcatggttccaccacacagaatgacacccttgaggaacagttggacaaaaatttatcctcctttggtcgagcacttgaagctgcaagtcagaatgaatttaaagaccaaatccgtagaactaagaacgaatcctaaatttaccacagaccctggtgcgttgcaaaaaggggccgattttatcaaagcctttaccttagggtttgatcttgacgattctatcgcactattgaggctagatgatttatatattgagacttttgaagtcaaagatgtcaagactctaacaggtgaccatttgtcgagagccatcggtcgtattgccggtaaagacggtaaaacgaaatttgcgattgaaaacgctacaagaacaagaattgtcttagctgactctaaaatccacattttgggcgggttcacccacatcagaatggcaagagaatctgtggttagtttaattttgggttcccctccaggtaaagtttatgggaacttacgtaccgttgcatctagattaaaagaacgctactaa

SEQ ID NO: 1666 - DNA, 825 bp, Saccharomyces cerevisiae
atgtcagccgtaggtccaggtagcaatgcaggtgctagtgtcaatggcggatctgctacagccattgctactcttttacgcaaccataaggagttgaagcaaaggcagggtttattccaggccaagcagacagacttcttccgttacaagagatttgttagggcactgcattctgaggagtatgccaacaaatctgcaagacagccagagatatatccaactataccttctaacaagatcgaagaccagcttaagtcacgtgaaatctttattcaacttataaaggcacaaatggtgatcccagtgaaaaaattgcatagtcaagaatgcaaagagcatggattgaagccaagcaaggactttccgcacttgattgtttcgaataaagcacaattggaagccgatgaatactttgtttggaactataaccctagaacctacatggattacttgatcgtcattggtgtcgtgtccatcatattggcgctcgtatgctacccattgtggccgcgctccatgagacgcggctcctattatgtgtctctgggtgccttcggcatcttagcaggcttctttgctgtcgctatcctgagattgatattatatgttttgtcattaattgtctacaaagatgttggtgggttctggatctttcccaacctgttcgaagattgcggtgtactagagagttttaagccactttacggttttggtgagaaggatacttatagttacaaaaagaaactgaaaagaatgaagaagaaacaagccaagagagaaagcaataagaagaaagccatcaatgaaaaagccgaacaaaactga

SEQ ID NO: 1667 - DNA, 825 bp, Saccharomyces cerevisiae
atgtcggcggctatcgaaaaagaaaccggaatgttggatgtaggaaagcactgtgcatattgtagacaactagacttcctacctttccattgttcgttttgcaatgaagatttctgctcgaaccatagacttaaggaagatcaccactgtaggtggttgctagagcatgaagaagttcataaaactgaaaaaagtcctagcaaaagccgggatggctcaagttctaacgatgaagcatatttcaagagtctgttacctgagagggccagtgttagaatccagagagtaagtgaaacaagagagcctttgagaggttctaacactgccaaagtgagctctactttgaactcaaagacattagacaaaatatttaagttcttccaaaggaatgagaaaagaaagagcaataacaaatcaaaaaagaatttcggttcctcgtcgaataagataattcaattggctaatctcaagaaaattgctaaaggtgaccccaagattcctatgcaaaataggatttacatttggtgttacttggtggatggtgatgagacggatatagccaaggaggatacaagaatgccattatacattaacaaaatgtggcctgtgggtagggccatggactatttgtctatccagctaaacgtgaaatctagcacactaactaattcaagttctaatgacaaatttcaactatgcaaattgaaagagggtaaacaagtttcattttataatattggcgcttccttaagagtcactaatgagatcaaagatcttgatactctgtatttagtacacaataacgccgacgaaaaatctaattaa

SEQ ID NO: 1668 - DNA, 828 bp, Saccharomyces cerevisiae
atgacatcgtctgcttcttctccacaggatttggaaaagggtgtgaacactctagaaaatattgagacgctcccccagcagggttcgattgcaggcgtttcgcagggcttccctaatattcaagagatatactccgacagagacttcattactctaggatcctccacctacaggcgcagagatttgctcaatgcactagacagaggggatggggaggaaggaaactgtgcaaagtatactccgcaccagttcgctaatccggttcctttgggtctcgcatcgttttctctgtcatgtctagttctgtcgctaattaatgcgaacgttcgcggcgtcactgatggtaaatgggcgctaagtttgtttatgttttttggtggtgccattgaattgtttgccgggttattgtgttttgtcattggggacacatacgccatgactgtgttcagttctttcggcgggttctggatctgctacggttatgggctaacagatactgataatttggtcagcggctataccgatcccacaatgttgaacaatgtcattgggttcttccttgcgggctggaccgttttcaccttcttgatgttgatgtgtacattgaagagcacgtggggtttgttcttactattgacgtttttggatcttaccttcctactactgtgtatcggcaccttcattgacaacaacaatctcaaaatggccggtggctattttggaattttaagtagttgctgcggttggtattcgctatactgttctgtggtgagtccttcaaattcttatttagccttcagggcgcacacaatgccaaatgctccttaa

SEQ ID NO: 1669 - DNA, 828 bp, Saccharomyces cerevisiae
atgccaccgctagtatttgacatagatcacatcaaacttctaaggaaatggggtatttgtggtgtgttatctggaactttgcctactgcagcacagcaaaatgtatttttgtcggtacctttgaggcttatgttagaagatgtgctgtggctgcatttgaacaatcttgccgatgtgaaattaataagacaagagggagatgagattatggagggaataacattagagcggggcgccaaactatctaaaattgtcaacgatcgtttgaacaagtcatttgaatatcagagaaagttcaaaaaggatgaacacattgcaaaattaaagaaaatcggtagaatcaatgataaaaccacagctgaagaattgcaacggcttgataaatctagcaataatgaccagctaattgaatcttctttgttcattgacattgctaatacctctatgattttaagagacatacggagtgattcagacagcttatcccgcgatgatatcagtgatttgttatttaagcagtacagacaggcaggaaaaatgcagacctatttcttatacaaggcattgagagatcaagggtacgttttgtccccaggtggacgttttggtgggaagtttatagcataccctggtgatcctcttcgtttccattcacatctgacgatacaagatgcgattgattatcataatgagccgattgacctaatatccatgataagtggtgcaagactaggaacgactgtgaaaaaactttgggtcataggcggtgttgcggaagagacaaaggaaactcatttcttctcaatagaatgggctggatttggttaa

SEQ ID NO: 1670 - DNA, 828 bp, Saccharomyces cerevisiae
atgtcacgtcctgaggagttggcaccaccggagattttctataatgatagcgaagcacacaagtacacgggttcgaccagagtgcagcatatccaggcgaagatgacgctgagggcgttggagcttttgaatctgcagccgtgcagtttcattctggatatcgggtgcgggtccggactgtctggggagattttgacgcaggagggagaccatgtgtggtgtggtttggatatatcgcccagcatgcttgcgaccggtcttagtagagagctggagggcgacttgatgttgcaggatatgggcaccgggataccgttccgggcgggctcgtttgacgcggctattagtatcagtgcgatccaatggctgtgcaatgcggacacttcatacaacgatcctaaacagcggttgatgaggtttttcaacacattgtatgctgcactgaagaagggagggaaatttgtggcccagttctacccgaaaaacgacgaccaggtggacgacatactgcagtctgccaaggtggcagggttcagtggcgggcttgtggtggacgacccagagtctaaaaagaataagaagtactaccttgtgttgagcagtggggccccaccgcagggggaggagcaggtgaatttggacggtgtgaccatggacgaggagaacgtcaacttgaagaaacaactgcgccagcgcttgaagggaggcaaagacaaggagtctgccaagagtttcattctaagaaagaaggagctcatgaaaagacgtgggaggaaagttgcgaaggactccaagttcaccgggaggaaaagaagacacaggttctag

SEQ ID NO: 1671 - DNA, 828 bp, Saccharomyces cerevisiae
atgtctagtcgtaaaaaagtcagagtattactgctcaagaataaaactgtccccattgataaatatgaattggagtgtaggagtaaggcgtttgaacccatattcgtaccgcttattaaacatacacatgtaattcaagattttagaaatgttttgaataccatcccaaactatttgaatactatcaattacattattattacctctcaaaggactgtagagtcattgaatgaagcgatcattcccacattgacaagtgaacaaaaagctgcattgctcagtaaaacagtttatactgtaggccctgctactgctaacttcatcagaagatcaggtttcattaatgttaaaggtggagaagacgctggtaatggttcaatccttgctgatataattattgatgacttgagtacggatattaaggcatgcccaccaagtgaactattatttctcgtgggtgaaattagaagagatatcatcccaaagaaactccatagcaagggaataaaagtaagagaagtggttacttataaaactgaagaattaagcgacggttttaaaagattcatacacgccatgaaagaatgcgatgaggatgaagtattctcggactgggtggtagttttcagtccccagggaacgaaagaaattactcagtatttgggtgacagtaaccgcctaccaggttcccatctacgggttgcgtccatcggacctaccactaaaaaatatctggatgataatgatgtaacctctgatgtggtcagtccaaaaccggaccccaagtcgctattagatgctattgaattataccagcgccataaataa

SEQ ID NO: 1672 - DNA, 828 bp, Saccharomyces cerevisiae
atgtctgaaaaaccacaacaagaggagcaagagaaaccacaatcaagacgtaattcatttgctgtgattgaatttactccagaagtcttggacagatgtttaaagcaagtggaattctacttttctgaattcaactttccatatgacaggttcttgcgcacaacagcggaaaaaaacgatggatgggtccccatcagcaccatcgccacattcaaccgtatgaagaaatatagaccagtggataaggttatcgaagcactacgtagttctgaaattttggaagtatctgctgatggagagaacgtcaagagacgtgttcctttggacctaactgctgccagaaatgccagaattgagcaaaaccaacggactttggctgtaatgaatttcccacatgaggacgttgaagcttcccaaattcctgaattgcaggagaacttggaagcctttttcaaaaaattaggtgaaatcaaccaagtgcgtttgagaagagatcacagaaacaagaaatttaatggtacggtcttggtggaatttaagacaattccagaatgtgaagcttttttgaaatcgtattccaatgacgatgagtccaacgaaattttgtcatatgaaggtaagaaactgagtgttttgacgaaaaaacagtttgatttacagagagaggcctcgaagtccaaaaacttcagcggtagatcaagatcctttaacggccataagaagaaaaacttgcctaaattccccaaaaataagaagaaaaacggcaaggaagagtcaaaagaggactcttctgccattgccgatgacgatgaggagcacaaggagtga

SEQ ID NO: 1673 - DNA, 831 bp, Saccharomyces cerevisiae
atgcgtttacaaagaaattccatcatatgtgctttggtgtttttagtctcatttgtgctgggagatgtgaatattgtttcccccagctccaaggcaacattcagtccaagtggtggtactgtctctgttcccgttgaatggatggataatggggcatatccctcgttaagcaagatttcaactttcacgttcagtctttgtactggtcctaataacaacattgactgtgtggccgtacttgccagtaaaattactccaagtgagctaacacaagatgataaagtttactcttacacagctgagtttgcttcgaccttaactgggaacggtcaatattacattcaagtttttgcccaggtggacggtcaaggttacactatccattatacaccaagattccagttgacttccatgggcggtgttacggcttatacatatagtgccacaactgaacctactccccagacttctattcaaacaaccactacaaacaacgcccaagccactactattgacagtcgttcatttactgttccgtacaccaagcagactggtacgtcgcgtttcgctccaatgcaaatgcagccaaatactaaagtgaccgctaccacatggacaaggaaatttgccactagtgctgtgacatattactctacctttgggtcattgccagagcaagcaactacgataactcctggctggtcttatacgatatcatcgggagtaaactacgctactcctgcatctatgccttcagataatggtggttggtacaaaccatccaagagattgtctttgtctgcaaggaaaatcaacatgagaaaagtatga

SEQ ID NO: 1674 - DNA, 831 bp, Saccharomyces cerevisiae
atggctaaacaatcattaggtatgtgcacaaatgctaaatcactgaaaccctgtagagctggaattgaaaatatagtttgtaccttttgcctgagggcagaatgactcaatgttatcttaattcgattagaaaaagaaggtgcgttatccaaggttgaaacttgtaaactatttaggtgatgtctcataactgcaaccactggaaaatgacgcaaatatcaaaataatagggagataaagtctcacgacatgaaaaaatcatagaattattgttcaatttatctagccgtatcttaccttatggaaaaagtgtgaatatgtttttctaaatcgagcttcccggaaattacactatattatgcatccgtgatacatctgaaattcaatactttctccaaggtcctgcttactaagagggtaagatttgttgaaactcgaaatactaacattattttcattattttagacgtttcctccgacagaagaaaggctagaaaggcttatttcaccgccccatcctcccaacgtcgtgttttgctatctgctccattatctaaggagttgagagctcaatacggtatcaaggccttgccaatcagaagagatgatgaagttttggttgttcgtggttccaagaagggtcaagaaggtaagatttcatctgtttacagattgaaatttgccgttcaagttgacaaggttaccaaggaaaaggtcaacggtgcttccgttccaattaacttgcacccatccaagcttgtcattactaaattacatttggacaaggacagaaaagctttgatccaaagaaagggcggtaagttggaataa

SEQ ID NO: 1675 - DNA, 831 bp, Saccharomyces cerevisiae
atgggtactagcatagtaaatctaaaccaaaagattgaactgcccccaatccaggtcttattcgagtcacttaaccgagaaaatgaaacaaaaccccacttcgaggaacgcaggttatatcaacctaatccttcatttgttcctagaacaaatatagcagttggtagcccagttaacccggttccagtatcatcccctgtttttttcattggtccttctccacagagaagcattcagaatcacaacgctattatgactcaaaacatacgtcagtatccagttatatataataataaccgagaagttatatctacgggtgagagaaattacataataactgtaggggggcctccggtaacttcttcgcagcccgagtatgagcatatctcaactcccaatttctatcaagagcagagactggcacaacctcatccggtaaatgagagtatgatgataggtggttatacaaatcctcagcctattagcatttcccgaggtaaaatgctatccggcaacataagtacgaactcggtccgcggatctaataatggatattccgcaaaagaaaaaaaacataaggcacatggtaagaggtccaatttaccaaaggccaccgtttcaattctaaacaaatggttacatgagcacgtaaacaacccttacccaaccgtgcaggaaaaaagagaactgctcgcgaaaactggtctaactaaacttcaaatttccaattggttcattaatgctaggagaagaaaaatattttctggccagaatgacgcaaataatttcagaagaaaattcagttcttctacaaatttagctaagttctga

SEQ ID NO: 1676 - DNA, 831 bp, Saccharomyces cerevisiae
atggttgaatcagatgaagatttcgcacctcaagaattcccacacacggacacagacgttatcgtaaatgaacacagagacgaaaatgacgggtatgcctcagatgaagttggtggcacattaagcagaagggcctcaagtatattttctataaatacaactccattggccccccctaatgctactgatatccaaaaatttacaagtgacgaacatcatttcagcatgatgaggaatttgcatatggcagattacattactatgctgaatggattttctgggttttactctattgtaagttgtctgagatttacgcttacaggtaaacctcattacgtccagcgtgcccatttctttattttattgggtatgtgtttcgatttccttgacgggagagtagcacgtctgagaaataggtcttccttaatgggtcaagaactggactctttggccgacttggtttcctttggtgtggctccggctgcaattgcttttgccattggatttcaaactacattcgatgtcatgattttatctttctttgtcctttgcggcttagcgagattagcaaggtttaatgtcaccgttgctcaattacccaaagattctagcacaggtaaatctaaatattttgagggattgcctatgccaaccactctagctttggtgttgggtatggcatattgtgtcagaaagggtttaatttttgataacatcccattcggcatttttagagaagaccaaatattggaatttcatccaattattctagtattttttatccatgggtgtggaatgatttcgaagagcttgaaaattccaaagccatag

SEQ ID NO: 1677 - DNA, 833 bp, Saccharomyces cerevisiae
atgggtatgttataaccataattcctaatggtgaataaaatcaggaccaataaagaaaagctaatttgatttttattgtcaatgaaatttcataatcgtcatgaatgcataaacagacacacctagcaactgtataatctgcgcctaaaaagggcgtatacacaaaactaaacgatgcgcaataaaagttcagcagtcagcaatgaaaccgagatatgcagcaacagagtatcatatgcatggaggatcctttctgtttttctgataatatgctctgaaaaagctccaaacagcacagtagcctatttgtgaagctcaaaaaaggcttctatttccctcgctatcttcagattgtgcagtgatattctttgaggaaggaaacgtagaggggataagttggataactgttatttcttttcaatatgctagattttgcttaccaccttactgattttttctaataataaacttttttactaacattagtacgatgtctcatctatttcttctatttagttaacgttccaaagaccagaaagacctactgtaagggtaagacctgtcgtaagcacactcaacacaaggttactcaatacaaagctggtaaggcttccttgtttgcccaaggtaagagacgttatgaccgtaaacaatctggtttcggtggtcaaaccaagcctgttttccacaagaaagctaagactaccaagaaggttgttttgagattggaatgtgtcaaatgtaagaccagagcccaattgaccttgaagagatgcaagcacttcgaattgggtggtgaaaagaagcaaaagggtcaagctttgcaattctga

SEQ ID NO: 1678 - DNA, 834 bp, Saccharomyces cerevisiae
atgaaattgcacggctttttattttccgtattatcaacatgcgtcgtcattttaccagcgttggcctacagtgaagctgtcacgatggtcaagtcgattgagcagtacttcgatatctgcaataggaatgattcttacacaatgataaaatactacacttcttggtgccaacattgtaaaactctggccccagtatacgaagagcttggtgagctatacgccaaaaaagctaataaagatgataccccaattaacttccttgaagttaactgtgaattcttcgggccaactttatgtaccgacttgcctggatttccaataattgaactggtcaaacctcgtactaagcccttagttcttccgaagctcgattggtcgtctatgaaatttcatgaaagactatggcaaagaatcaagacgtggttcaacaatcctaagtaccaactggatacgtctagggttgttcgttttgaagggagtaggaacctaaagagtttaagcaactttatcgatactgtaagaagtaaagatacagaagaaagattcatagaacatattttcgatgattctaggaattgcaatgaagaattacgttctcaacagcttctgtgtaaagctggtaaagaatactactctgatactttatctaaattatacggtgacgtgaatgggctggaaaaggaaaggcgaagactagaagctttaattaagcaaaatggagatgacttgagtaaagaagttaaagaaaaactgaaaatcattcgtctacaattgagcctattatcacacatagaagaccagttagaagataccagtagtcatgacgagctttga

SEQ ID NO: 1679 - DNA, 834 bp, Saccharomyces cerevisiae
atgaataaagaagaattattgggttttctactagatgacagtattgatagccaaaaaagatgcgtcacggatcagcaggcctactctaattggttaaagaatgataatgatgaacgtacggcccatgaggaaagctcttcacaaagtacgatagccgcattgaataagaagaagcagacagaagctgctcaagaagatatagaagaactgttaaacggcttagaaggcattattggaggagccgacccccgtaatctcaagagtaagtcaaagaggaaaaccaaaaagggcggatcgaaaccaagggaagaaaacgtgaatacggagaaacatattgtaatgctcgaggtagaagattttagtgatatgagcacccacgaagatgtcaacggagcaagtccgtcgccaaatctggaccggtcgaagaagaatgagaagcgaaggaaaaacgccaaggagctgtcatacgatgaactaaaagacaaactagaagttaccactcgcaaatcacgtcttgagtgcaaagacttgaaaaagaaagttcatgggctcgaaagaaggaaccttgaacttgaacagcgtttagaagagctgaagattgagaaccagactttgatagagattaacaataaactgttgaaaaacactaatgaggatgagattaacaagagccagaggaacaaggagaaggaccgaaagcggagggaaagaagaacggcaaggagaaaagatgaaagaaagcaggaaaaaaagcaggaaaaaaagcaggataataaaacatctcaatcttttccttcctcaactgacatgaatggacagcctatagaattttga

SEQ ID NO: 1680 - DNA, 834 bp, Saccharomyces cerevisiae
atgataccaaagcttatagtttttggaggcaatggatttttaggtaaaagaatttgtcaagaagcagtgacttcgggctaccaagtcgtttctgtgtcaaggtccggtaaagctcctcatagcaatgaattaaatgataagcaatggatgcaggaggtccaatggaccgctgctgacatttttaagcctgattcttaccatgaattattgaataatgctactaacgtagttcattctttgggaatcctcctagaaaatgaaaattataagcaaactctatccaaatcccctacatatgattcaaaatcacgccttctatcttttggtgcaggtccaaatcctttaaaaaaaagcagtccttattttacttatgaaatgatgaataagcaaagtgctattattttggcagatacatttaaacaaaaaatcctaaagaaaagcaaaaaggagcaagaaaaagcaaatcaaagatcttttacgtatatttccgccgataaaggtttcccattgattcctagtggctatattaattcgaaaagagaggcggagattgaactagaaaaaatgcagagatatttcaggcctattattgtgagacccggttttatgttcgatgagcacagaaatgcaattggaccacggtcttttattcatactgcacttgaactactttactgcggtaacaaatttctattgagaaataagctgcagcttttgaacgacttgattaggccaacagtatccactcagcaggtaagcaaatccgtcctgaaaaatatcgaaaacccagattttaaaggggtagttacacttgaggaaatacttaaagcataa

SEQ ID NO: 1681 - DNA, 834 bp, Saccharomyces cerevisiae
atgcagtgtaacacaagtatagaagatggtttagatgggggcgacataactttcccatcctacagccctgaagcggaggctcaaaacagattcttaccaagaagtgagttcccctctgtgaggcaactcgtgatttcgaaacaaaaaagcagaagaagaagagaagaaaatgtatttgtgggaaaaatggaggacgtacttgtaaaatggaggccacctgcatcttcacatcgtggcgcaattgaagctattaatggcacgcatccatatcagcttagcacagcacaattcaactcgagaagatcggatccatttggttcaacaaagagagatgaatccgtgcgttccattgtagaatcgtttaccgattggtggaaacgcaattccaaaatgttttttcgtgacgaggaagaaggtgtacgaaccgaacacagtgcgagtcaagatgaccaagagttgcagcttttcgaagaagatctcttctcatttcacctaagcccaaatgatatgtcaaccaggaacagcgaacatcaagtgcaaacaccggtgcttttcccgtacgaagctcctactcgaacaaaacaaaacccagcagaaagaaaagtcattgaaattggggacggcgaagaactctctatctatcgagatgtttattccaatcctattcctgtcagctacctagataccttaaacttgaaccactccatgtctgtacggcaaacacaacagcaacaacaacagcggcaacagcagcagtatgtagactcttcatcggcatttcaatgctgtacagactccaattgggcgagaatatttttttgccaccacgattag

SEQ ID NO: 1682 - DNA, 834 bp, Saccharomyces cerevisiae
atggcttactctttaacaaggaaattgctgaaggattggaaatattttatgcgccatcctgagaagacccaaggtctttttcatgtaaggccacatgattcagacttacatctttggcacgtggtaatgtacgagcccaggacttctttggaagtatatctactactttatattggcggaaacgaccaggatccatatatcatcatgaaatgtctgtctccaaattgttgctttccaattaacagaacggtttcgatgacacacttaaactatcttttattgaaagacttgggattacaggatttacttttccacatatggcaaccgctttttcatattcaagcaacggaagacttacagtattcaccgtcaacggtaaaattcaacagggcgtggaataggattatatataaggactttaaatcttattttccggaactgataggtactttacaaccaggtgattactctatagtaaagagctattccaaaaatcataatatcagcaatagtaatggtggcagtgtcaatgaatttatgtcctcttacaatgctcaaagccacacctttcacgcacaagacaacagcaagaacccttatactaacagcagcataggaaagtctagtatgttatctactctcaacaataataacgttaacaaaaggacacatgactacaatgctatcgactttatgaccaaaaacttacttgcatgtgatgatgacagtattcatccggtcgtaagttctaaaaggtcaagaacgttggcatgtccagatgaaacgaacgataatcgcggtagtgagcattacacaaagaggaaaaaaatctaa

SEQ ID NO: 1683 - DNA, 834 bp, Saccharomyces cerevisiae
atgggtttacctaaatcggcatataagaagttactcatagattgtccaacgagagtcattaataaaaactgtgcccaacgagtcaaagatgtttctccgctcattacaaacttcgagaaatggtcggataagcgcaagaagctctatttcaaagatgaagaggaaatggtggggcagttccatttggaaaatttcaatttaaaaaataacttatatggtaggcttttagcttctccaatgagagcagaaaaaatctcaaaattaaaatcgtgtagagaattactaattccattgaaagtggtaccatcaactggcaaagatcagcatgctgataaagataaactaaaactggtacctacactagattattccaaatcatacaaaagctcgtacgtattgaattcagcctccattgtacaagacaacttggcggctgcgacgtcatggttcccaatctcggtattgcaaacatcaactccaaagagcctagaagttgattcctctacatttataacggaatacaatgctaacttgcacgcatttataaaagcaagactttcagtgataccgaatgttggaccttcttcgataaatcgtgttttactcatttgtgacaagagaaaaacacccccgattgaaatacaagtagttagtcatggtaaagggctaccaattacacagtctgtctttaaccttggttatctccacgagccaactctagaagctatcgtgagtaaagatgcagttactaatggaatttacctggatgccgacaatgacaaggatctcatcaaacacctttatagtacattattgtttcattcagttaactga

SEQ ID NO: 1684 - DNA, 834 bp, Saccharomyces cerevisiae
atggttggtatttacagaatacttgcttcgttcgtcccactcctgggtcttctttttgcattccatgatgatgacatgatagatactgttacaatcatcaaaactgtatatgaaacggtgacatcaacttctactgcacctgcacctgccgctacaaaatctgttagtgaaaagaaactggatgacactaaactaacacttcaagtaattcaaactatggtatcatgtttttctgtaggtgaaaatccggccaatatgatatcctgtgggctaggagttgtaatcttaatgttttcattaatcatcgagcttatcaacaagctcgaaaatgatggtatcaatgaaccgcaaaggttatatgacctaattaaaccaaaatacgtcgagctaccttcaaattatgtgaatgaaaaaatcaaaacaacatttgaacctctcgacctatacttaggagtaaatatgaatacttcaggaagtgaactaaaccaaaactgtttgattctcaaacttggcgagaagacggctctgcctttcccaggcttggcccagcagatttgttatacaaaaggcgcttcaaatgagttcacaaattataaattatcggacatacagggcaatttaaacgaaaacagccaaggaattgctaatggcgttttccagaaaatatcaaacattagaaaaatatcaggtaattttaagtctcagctttatcaaatttcagaaaaaatcaccgacgaaaattgggacggttctgctgtaggcttcactgctcatgggagagaaaaaggcccaaacaaatctcaaatatcggtttcattttatagggataattaa

SEQ ID NO: 1685 - DNA, 837 bp, Saccharomyces cerevisiae
atgagagcaccaccttcaccgagaaagtccaaatctggtcattttttttacctatattttcgactgtgtcaactgttcagtggccggaaattaaagaggaggtggcatgtccacaaacttcacattcaccaatataatactcgctggaacttgagccccctctccgaaatacacattgaggacatgataaatgaaccgtctggactatgtccaggaagttccaaaaagaaaccactactgattgcaaggtttcccaagggttgccaagaatcaccaagggtatatgtactgcaaaggaacaatttgtctcgtttaaaattaagcaaaagaaaatatgccctaaggttctatcacaatgaaatttttggcaataatttaaagagaaaagacggaagcatccacaaagttgaacaccaacagtgcgcagaaaccgttagaaagatcaagaaagtcacagcaaaccatgctgatgttaaaataatatttcacgataaaaatactataagaagtgacaaattagggggtaggagtaataagatgcagactaggcctagtgttcttgaagaggatgtagaagaagaagtctcttcggtatatatcagattttgtgacgaccattccctgagagttaaagattatcactctttgcacaggcattctaaaaaatcttctaaagaaaaacgaaataatcaggagattggaaaatctaagttgcttgggaagctttttgaagaggaaacatcgcgtcaaaacaaaggtgtagagaagaaactagatacgattgtgatacagaaatttcaaaattatcctattgtctccttctctcgtgtcatttaa

SEQ ID NO: 1686 - DNA, 837 bp, Saccharomyces cerevisiae
atgagtgtattaagatctacatgccttttcttccctccaagatccttgttgatatcatttaacaagcggcgattattttcaacttcgaggttaattttgaataaagaaagtgaaactacaaagaagaaagataaaagtaagcagcaagattttaatcctcggcacctgggtgttgctgccgaaatatttatcccctcggcttacaagaaccttccaaatgtatttgctcatcctctcattgttgcaaatgcattgatcagaagactttacacgtttggtttgaactctgttcaagtcgcattgtttcgttttcaatcaggcattaaaccttcttttttactctggaaaaacaaagccatagagacgtatatcaatgtaaacacgtcatttgctcataaaaatttgtcggacatcaaagggttagtttcattatgggttcaggaagctctcgaggctaggtcccgtcaacttccaggtaatgcaacactggactggcagttgataaagtttaatgcagttcctaaactagtctcagtgcaaccaatcatgattcccggaatgccgttagagcatttacagttggtttacaaatttgatacgaagcaaagactaattaaagtcaatcagcaaactaagaagactgagacgttagaccgtgacgttgtagactatattgcctttttgtgtgatgctacaactaatgatatgattttaatgggatctttgtttgaaagtaaaccaaatgataaattaccgaaaagctacgaggacgatgctaaagttgccatacacagaatgaaagttaacggtgatatatatcgtttacctccaagctaa

SEQ ID NO: 1687 - DNA, 837 bp, Saccharomyces cerevisiae
atgcattatttgcctgttgcgatagtaacaggtgccactaggggtataggcaaggcaatatgtcaaaagttatttcaaaagggtttaagttgcattatacttgggtctactaaagaaagtatagagcgcaccgcgatagatagaggccaattacaatcgggattatcatatcagcggcaatgtgctatagcaattgattttaagaaatggcctcactggcttgactatgagtcatatgacggtatcgaatatttcaaagatagaccgcccttgaaacagaaatattccacattgttcgacccatgtaacaaatggtcaaataatgaacgccgctactacgtaaacttattgattaactgcgcaggcttgactcaagaatcattaagtgtaagaaccactgcatctcaaattcaggacataatgaatgttaactttatgagccctgtgacgatgacaaacatctgtattaagtatatgatgaagtcgcaaaggagatggccggaactcagtggtcaatctgctcgacccaccatcgtaaatatttcctccattctacactccggaaaaatgaaggttccaggtacatctgtttactccgcctctaaagccgcactgtccagatttacagaagttttagctgcagaaatggaaccaagaaacattaggtgttttacgatatctccaggtttagtcaaagggaccgatatgatccaaaatttgccagtggaggctaaagaaatgctggagagaaccattggggcaagcggtacaagcgcacccgctgaaatagcggaagaagtctggtctctatacagtagaactgctttggagacgtaa

SEQ ID NO: 1688 - DNA, 837 bp, Saccharomyces cerevisiae
atggagacctccaactttgttaaacaattatcgtcgaacaacagaaaaaccagggtaaatgcactcgaagcgttaaagaaatatctaaccgctaaacagttcaaggagaacaaacaaatagaattcaataaactttggaagggtctttactatgcaatgtggttcagtgaccgtcctagacctcagcaacgtttagccaatgaattaggtgaattgcatggattatattttgatcctaaggacaatagcactgcagatgagttgaccacaaacgataaagcatttataaagtttagcagagggttttggaaggtcatgtgctttgaatggtttaacattgacagatataggttggataagtatcttctattgataagaagggtattattcagtcaattgaagtatttgcagtccagaaactgggacaaaaaattagtcgacgagtatattaagaaagtgttgaggtggttacctctgagtggaagtccaaaggtctacacagggattccaattcatatcgtcgatattctgctggacgaatgggaaagattgcttaaagatggagatgaagacgatgaagacgaggaaaacaaagaggaagagatgcgcaaaattgcagagagcgcaaaaaaaacgccactagccgatgttatcgcaattttccaagatatcgtggcagattacaataacagtaaggtgttgagagagaagatcaaagaagacctattcagtgacaccagacttgtttcctgggatattcttgaaggcgaaacgcaacataatgattccagtaacgaatctgaagaagaggaagaggaagagtggaagggattttga

SEQ ID NO: 1689 - DNA, 837 bp, Saccharomyces cerevisiae
atggcgaagactatcaaagttatcaggaagaaggaccccaaaaagaagaacctatccgatcctttagcaaaacaaaaactagtttggaaaatcggacacgttttaactttagtttttggtttattattttctatcacgtatttctaccatgtcctaatcttcttcaaatatcgttcctggaagtggttgttcttaagggtcaataaaaattactcgtttattcaaagtaagagatggtacatgaaacttttgagttggagcccacaggtaatgtaccgtttgtcattaattggcgtatttatgtctgagtccgtcacaatgcaacagaactgggttggacttaaccctacttggaatgaccttttgtcctctgagaactttcatacccttttgattgcctgtttatggttctttggtggtggtaagtctttttacaagattttgccttacatgattttaagttatctacacctaactaaaatgaactacgaattgaatgctaacaaagaagaaaagatccctttaacacccaaagacagaaaaatgctacacttacttgcgtactctgaattacttgttatcttagcgctaacactagacactatattgtttaagacgggtacatccggatttatgctcgtcatttatgttggtatttattggttgaggttgaacttctctccatacgcacaagtggctgttttggagttacttgtcaagtttgaaaaatacgtccccaaaaaatatagagacaaatggcaggttataaagaactttatttatatgaaaatgaaggagcacgaaaagagaacagaagaagttgccagatacgcgtaa

SEQ ID NO: 1690 - DNA, 837 bp, Saccharomyces cerevisiae
atgtcgcaagagtttgtggaagactattcacgtacagggtcctcagacgacgaggatagtggagcttatgacgagtggattccatcgttctgttccagatttggtcacgagtacttctgccaagtcccgacagagtttatcgaggatgatttcaatatgacctcgttatcccaagaggtaccccactaccggaaagctctggatttgatattggatttggaggctatgagtgatgaagaagaggacgaagacgacgtggtggaagaagacgaagtggatcaagagatgcagagtaatgacggtcatgatgaaggcaaaaggagaaacaagtcgccagtggtgaacaagagtattatcgagcacgcagcagaacagttatacggattgatacatgcaagatttattctgaccaagccaggcctgcaagcaatggctgaaaaattcgaccacaaggaatttggaacgtgcccccgttactattgtaatggcatgcagttgctgccttgtgggttgagcgatacagttgggaaacacaccgtaaggttgtactgtcccagttgtcaggacttgtatcttccccaatcatctagattcctgtgcttagaaggtgcattttgggggacaagcttccctggtgtgttcttgaaacatttcaaagaattggaagagtatgtggaaaggaaaagtaaagagtcctacgagttgaaagtttttgggttcaggataaatgatgaggcagtatctggtcctagaatgaagtggttgagacaatatccatccacggaggaggactgggaagaatttgccaaatgcgagttcgagacaccggcggtttaa

SEQ ID NO: 1691 - DNA, 837 bp, Saccharomyces cerevisiae
atgtctgaaagaaaagctattaacaagtactatccaccggattacaacccactggaagctgaaaagctatccaggaaaatggctaaaaaactgaaaaccatgaataagagccacgcatcgattagattaatgaccccatttagtatgaggtgtttggaatgtaacgaatatattcccaaaagcagaaaattcaatggtaagaaagagctactgaaggagaagtacctggactccattaagatatatagactaaccatttcatgtccacgttgtgccaattccattgcatttagaacagaccccggtaattcagattatgtaatggaagtggggggcgtaagaaactatgtccctcagaaaccaaatgatgacctgaacgctaaaacagctgtcgaaagcatagacgagacactgcaacgcttagtgagagagaaggaaatggagcagaacgagaagatgggtataaaggagcaagcagatgacaaaatggatttgctggaaaaaagactagccaaaattcaacaagagcaagaggatgatgaggaacttgaaaatttaaggaaaaaaaaccttgaaatgagccagagagctgaaatgataaaccgcagcaaacacgcacaacaagaaaaagcagtaacgactgatgatctggacaacctcgtagatcaggtatttgacaatcacaggcagcgtaccaataaacctggcaataacaacgatgagaagagaactccgttgtttaatcctacatccactaagggaaaaatacagaagaaaagctctgtgcgtacgaatccgttagggatagttataaaacgaggaaagtctctcaaatga

SEQ ID NO: 1692 - DNA, 837 bp, Saccharomyces cerevisiae
atgtttagtgcattaggtaaatgggtccgaggctctcgcaatgataaggactttgtgacgaagtataccgcagatttatcacaaataacttcacagatccatcaattagatgtcgcgttaaagaaaagccaatccatcttgagtcaatggcaatcaaatctgaccttttatggtattgcgttaacggtattggccctgagctacacatattgggagtaccatggttatcgaccataccttgtggtgactgcgctactatgcataggctcgctaatcttgttcaaatgggcattaaccaaactctatgcattttataacaacaataggttacgcaagttggcaaaactccgtgcaattcatcaaaagaaactggaaaagttaaaggaagagacccactataatgctacaagctcaatcatccaacggttttcttccggtgaagatcaaaacgacgatgccatggtacttctagatgatgaattaaatgctaaataccaagaattaaacaatctaaagacagagctagaaaaatttaagaaggaaagccatgtaaagggcctaaagaaggaagacagcgatgcatggttcgacaaaatcatcagcgtactggcaggcggtaatgaattggactcaacaagttcgctctctcccttcaaaaaaatcatatgtccacagtgtcattggaaatccaattgctacagattggccagtaagccaatcatctttatctgtcctcactgtaaccacaaaatagacgaagtaaaggaaagagaagacgccattgaagcaaaacaaccggcacagccttcgcagtcggagaaggaaaaaacaaaatga

SEQ ID NO: 1693 - DNA, 837 bp, Saccharomyces cerevisiae
atgttttcaaggctttctttgtttcgaagggcagctctggctcctgcccctatgagaatgtcttttaggactatttatcaaaaaaccgaggatgaattgcccagaaggatcgtcccaaagctagccacattttattcggcgaatcctaaccatgaagatcgtattaatcgactcgaaagacttctaaggaaatacataaaactgccatctcagaacaacaatgaagcacaacaaacaaaagctccttggatttctttcgatgagtacgctttaatcggcggtggtacgaaattaaagcctacgcaatatactcagctactgtatatgttgaataaacttcacaacattgatcctcaacttactaatgatgaaatcacatccgaactatcccaatattataaaaaaagttcaatgctttccaataatatcaaaatcaaaactttagatgagtttggaagaagtatagccgttggaaaaaggaaaagttccactgcgaaagtattcgttgttagaggtacaggtgagatattagttaatggtcgacaattgaatgattacttccttaagatgaaagacagagaatcaatcatgtatccacttcaagtgatcgaatcagttggaaagtacaatatttttgcgacaacgtctggaggcggacctacgggtcaggctgaatcaatcatgcacgccattgcgaaagctttggttgtgttcaatccattattaaaatccagactacataaagctggcgtcttaacaagagattacaggcacgtcgaaagaaagaagccaggaaaaaagaaggcaagaaagatgccaacatgggtcaagagatag

SEQ ID NO: 1694 - DNA, 838 bp, Saccharomyces cerevisiae
atggctcaacgtgttactttcagaagaagaaatccatgtatgttactgaactatttttttgagttttcatgaaaacttattatgaacttattatgaacttattttgaactttcattgtgggaaaatgaggttaaaaggcgaacgagtgctatttagagaagcgtaccacttagaaataggaagaaccagatcatcgataggggaatcaactatgcaagaactttcaaatatattggcatgacattaaaacattagacagcatgaacgaacagtatccagtaatgtggacagcaataagttgacttcagtttctaagtggaagaccttggtcgacccaaatggaaaatgaatttttctccgctgttgaaagattgaaatgagataatattcattcagcaacgccgaaatacttttcatatggagcaatcccactcaagttcttaaatcataggataataaagaagtgattactaacattaatgggaaaattttctctttactacgtacagacaacacccgttctaacaaaatcaaggttgttaagaccccaggtggtatcttgcgtgcccaacacgttaagaagttggctactagaccaaagtgtggtgactgtggtagtgctctacaaggtatttccactttgagaccaagacaatacgctactgtctccaagacccacaagactgtttccagagcttacggtggttccagatgtgccaactgtgtcaaggaaagaatcgtcagagctttcttgattgaagaacaaaagattgttaagaaggtcgttaaggaacaaactgaggctgctaagaagtctgaaaagaagtctaagaaataa

SEQ ID NO: 1695 - DNA, 840 bp, Saccharomyces cerevisiae
atgaacgccaactctaccacgacagcaatcggcctcaccagccccttcgaaaagctgtccttcttccctcattcgtctaatttaatactggctcatttgcatgagatcatcttcagcttcgtcttctaccagctcgcattctccgttgtcgcaccgttcttgaataaagtggtctttcgcaagcactacaccacgatccgtgacccactgctgaaaattgatttcaatgtccacaccgtctcgatgatccaggctgtcgtctcgaacaccgtcctgttgcccaccctcacgacgccaatgcattataatgttgtcacctacacagattcgtacagttcaatggtatcttccctcagcgcagggtactttatctgggacttgactatgtgcgtgcgttacttcaagctttatggtctcgagttcacgggccacgccattggctccgtatatgtgatgctgttgtccttaagaccgttctgccaaccctggatcggcaggttccttatctacgaggcctccactccctttgtgaacatcaattggttcatcatgcaatgtaacgccaagagcaagaactctatccctctgtggtttaatgtcgtcaatggccttttgctcatgactgtgtttttcgtcgtcaggatttgctggggctccatcgcatccgctctcttattcaggcagatgtggaaggtaagagacgagttacccaagttttctgctgtcacgatgatgtcgctgaacattttcatgaaccttttgaacgtgctttggttcaagaagatgattagaatcgccaagaaacttgcaaaaccagccccaacgtcgaagctagactaa

SEQ ID NO: 1696 - DNA, 840 bp, Saccharomyces cerevisiae
atgcagggcacttttaaaaggttttaccatcccacgcttacgcggatgtccttcttggataaattcctcaagcctatgatggcaacggcttccccaaaggaataccagatcaaacaactggtcaagccaataggcttaacacaagcaccaaggaaaagcaccaaatactcccaggggaactctttgagggatatgtttgattcggaaaagacaaaccacagagttaaagagttggccgttgaattcagcaaatctggactttatgacgtgcaagtcttccaaaagacaaaggggaaattgtttatagctccagtttcatattggaaagaagataaagctttgttttttcctcatttgataggaacggcaatggatggtacgaaacaacagaatatcgaggatatgttaaggggtaaaaccagtatagtgaggttatttagtacagcatctggcgataagttgagtagttcatacttccaaggaatcgtagacgataacaaaaaaactgactacttgactgaagctgatgcgcgtttaagtttaaatgacagtaacgtccaaatcatcgaggtcaatcttgtagaaaacgctgtgaaaagtgctctagtgaaaacgcttgctcgttgggccaatcgcgttccatcctggcgccagccattttatttcgaatgttctagaggccaatggccattttccgtcagggaagagctcttttgcaataatgtcttttctggatacgtctttcttgtggaccagcagttaaaaattaggtgggcagcttgcggggaggctactccatctgaaaaggaagcattgtggaagtttgccaaacgtctgtga

SEQ ID NO: 1697 - DNA, 840 bp, Saccharomyces cerevisiae
atggagataaaccaagcggctgaaaaagaacaggagtatgttcacaaagtgtataatgagatagctccgcatttctcgcaaactagatataagccatggcccatagtgactcagttcttgaagactcgcccaatgggttccatcggtatcgacgtcgggtgtggcaatggaaagtacctcggagtgaaccctgatatatatattatcggttcagatcgctcagatggtcttattgagtgcgccagaggaataaacccatcgtacaacttactggtggcagacgggctgaacttaccacacaaaaacgaaacatttgacttcgccatctcaattgctgtagtgcatcactggtctacaagggagagacgtgttgaggtgatcaggcacgttctatcgaagctacgtcagggcggacaagcattaatatattgttgggctctagaacagggcagctcccgtagaggttaccatgaaggtatggagcaagatgtctttgtcccctgggttcttcccaagagtaaatccaaaccaaaaactaaatcaacgccgcctgctaaagtcaagacaaggccaaagccaaacttaatgaatattcccccaaaggagcgttccgaatacttgcagcgctggaaggaggaacagcaacgcagtaagtctcttgatgataacgacgagaagcaacaacaagatcaagaacaggaaagagaagaggtaaaataccgatactatcacttataccgagagggcgaattggctgaggattgccgccaagctggggctgccgttcatagtgagggcttcgagcgcgacaattggtgggtggtggcccagaagagatga

SEQ ID NO: 1698 - DNA, 840 bp, Saccharomyces cerevisiae
atggataaagaggtaagtgaattggtagtgttgcagctaatacacactttaatttccaacaagaatgaagaactggttaggaacgggggaggaatcaacatgattgggaataatcttcgaatatcgctagtcaagttgactaacgaaatacaaaacaatttgctaatcaacgagctgacaaatttaagaaggcaaagcaacgtggcaaatggaaacaggaaactgggcatcaacgatatcctgaccatagttaagaatttattcccagagtacagaacaacactaaacgatggacaacttagtctacacggtttggaaatgcatgatatcgagaagctccttgacgaaaagtacgatcgattcaagaaaacgcaggtcgaacaaataaggatgatggaggatgagatattgaagaacggtataaagaccggtgcatcgcaactgcaaccacatgcaaatgctggcaaaagtggatctgctggtaccagtgctactataactacgactacgccacacatggcgcattcaatggacccaaaaagagaaaaactattgaaattatacagagataccgttctgaataaattggaaagtaaaactgggaattttcagaagctattcaagagtcccgatggtagcattatcaagaatgagataaattacgaagacataaagaacgaaacgcccggcagcgttcatgaactgcagctgattcttcaaaagagcataacggacggtgtaatgcgaaaggtcattggtacggacgactggaaattggctagacaagtgcagtttgaattggatgatacggtgcagttcatgagaagagcactagagtaa

SEQ ID NO: 1699 - DNA, 840 bp, Saccharomyces cerevisiae
atggatagaactcaaacgtttattaaagactgtcttttcacgaaatgcctggaggaccctgaaaagccctttaatgaaaatagatttcaagatacgttgttgctactgccaactgatggcggattgacttcaaggcttcagagacagcaaagaaaatcaaagctaaatcttgacaatttacaaaaggtctcccagttagagagtgcagacaaacagttggaaaaaagagattaccaaagaatcaacaagaactctaaaatcgcattaagagagtacatcaataattgtaaaaaaaatacaaaaaaatgtctgaaattggcatacgaaaataaaattactgataaggaagaccttttacactacatagaggagaagcatccaacgatatacgaatcattaccgcagtacgttgattttgtaccgatgtataaggaactatggattaactatattaaagaacttttgaacattacaaaaaacttaaaaacattcaatggatcattagcattattaaaactatctatggcagactataatggtgcgctgttacgcgttacaaagagcaaaaataagactttaataggccttcaaggcattgtgatctgggactctcagaaattttttatcatgattgtcaagggcaatataatagacgaaataaaatgcattccaaaaaagggcacagtatttcaatttgaaatcccaatatcagatgacgacgattcggcattgagatatagtatactaggcgataggttcaagtacagaagtgtggatcgtgcaggcaggaagttcaaaagtcgtcgttgtgatgatatgctatattatatacagaattag

SEQ ID NO: 1700 - DNA, 840 bp, Saccharomyces cerevisiae
atggtagagttgacaattacgggtgatgatgatgatatattgagtatgttttttgatgaggagttcgttccccatgcattcgttgatatactcttatcaaatgccttaaacgaagatcagattcaaacgcaatcagtatcctcattgctattaaccaggttggatttttacacaaagaaccttacaaaagagttggaaagcaccatatggaatttggataaattatctcaaacgttaccaagaacttgggcatcttctaggtatcacaaagaagcagaacagaacgattcctcattgtattctactgaatccttaaaatcatcgaagcttgaatattacttagatacgttggcaagtgctgtaagagcattagaaacaggaatgcataatgtaactgagaaactaagcgatctagataacgaaaataatcgcaataccaatgtgaggcaacaactgcaaagtttaatgttgattaaggagagaattgaaaaagtggtatattacctggaacaagttaggaccgttacgaatatttcgacagttagagaaaataatacaaccagcacggggacagatctttcgataacagattttagaacatcattgaaagcattagaggatacaatcgatgaatctttaagctctgcgattgataacgaggctaaagatgaaacaaacaaggatttgattgggagaattgattcactttctgaactgaaatgtctgtttaaaggcctagataagttctttgctgagtatagcaacttttcggagagcataaaatcaaaagcacaaagttatttatcaaccaagaatattgacgatggtatgatatcataa

SEQ ID NO: 1701 - DNA, 840 bp, Saccharomyces cerevisiae
atggtagctgtatgttcgttaatctcttttagccacccacccatatgctttttgttttgttagctaaaataatactaacttacgactctattctcatcattaaataaccaacagacagtaaaaagaaccatccgtataaaaacccaacaacacattctgccagaagtgccaccagtagagaattttcctgttcgtcaatggagtatagaaattgtattattggatgatgaaggaaaagaaattcccgctacaatttttgacaaagttatttaccacttgcacccaactttcgccaatcctaacaggacatttactgacccaccatttagaattgaggaacaaggttggggtggatttcctttagatataagcgttttcttgttggaaaaagcaggtgagcggaaaataccacacgatttgaactttctacaagagagttatgaagtggagcacgttatccagattcctctcaataaaccacttttaacagaagaacttgcgaaaagtggatctactgaagaaacgacggccaatacaggcaccattgggaaaagaaggactaccacgaacacaactgcagaaccaaaggcgaagagagctaagacgggcagtgcatctaccgtgaaagggagcgtggacctagaaaaattagcgttcggattgactaaactaaatgaagatgacctggttggtgttgttcaaatggttaccgacaataaaacaccagaaatgaacgtgacgaataatgttgaagagggtgaatttataattgacttgtatagtttacctgagggattattgaaaagtctatgggactacgttaagaaaaataccgagtaa

SEQ ID NO: 1702 - DNA, 840 bp, Saccharomyces cerevisiae
atgtcaattgtttcactgttaggcatcaaagtcttaaacaacccggcaaagttcactgatccatatgagtttgaaatcacttttgaatgcttagaatctttaaaacatgacttagagtggaaactaacctatgttgggtcctctcgttctctagaccatgaccaggaattggattccattctggtaggccccgttcccgtaggtgttaataaatttgtgttttctgctgaccctccctccgccgagctgattcctgcgagtgaattggttagtgtgactgttattctattaagttgttcttatgacgggagagagtttgttagggtcggttactacgtgaataatgagtacgatgaagaagagttaagagaaaatccgccagcaaaggtacaagtagatcatattgtaagaaatatactggctgaaaagccaagggtaacaaggtttaacattgtttgggataatgaaaatgaaggggatttatacccacctgaacagcccggcgtagatgatgaagaggaggaggacgatgaagaagaagatgacgatgaagatgatgaagacgacgaagatgacgatcaagaagatggagagggagaggcggaagaagcggcagaggaggaagaagaggaggaagagaagactgaagacaacgaaacgaatcttgaagaagaggaggaagacatagaaaatagtgacggcgatgaggaagaaggagaagaagaggtggggtctgtagacaagaatgaagatggtaatgataagaagaggaggaaaatagaaggggggtccacggatattgaatccactccaaaggatgcggcacgttcaacgaattaa

SEQ ID NO: 1703 - DNA, 840 bp, Saccharomyces cerevisiae
atgtcatcaagacccgctaataaccaaggccccccaaacctccctgccagagataagtcgctcgtgcaaaggttcatggcagtagccaagagcttgcagtttgcatggtttaccggtcattccgtcgtattgatcagctccattctttacctgctcaagatgtcagaattttattacagatcggcatatctcggtgtcatcgaatctttcggtatcatcatttaccagcaatttttcacccgcaatgaaccattgcagactcaagatgccgctgccactaaggcttccataaaatcacgcgttgctggactcctaaagagtgaagacgtgctttatttggttttggccaacttctggttgttcactccaagattttcattcagcttaatcccatttttcgcgtttgctgtattccatgttttaatctacgttgaaaaagttctcttaccaaaagtcttccacctttccagtaaagattcaagtaagatcctcagcttcatcgacaagtttgttgttcagtacaatgacttgtgcatgcactgggtcggtactgctgagctgcttattttcattttggtccttttcagagccattctgtgcttccaaaggtcttggatcatacttgttgtgtacgccatctttattaagttaagatacgaaaactccaagtacatgaaagccgcctttgctcaatggagagttagaatggacgggatcataagccacccatctatcccaccattcgtcaaaagagcttataatgcaattaaaatgagcttgatccgcttgtctgagtaccgcttaagcggtgccccacaagtgaccaagaagcagaattga

SEQ ID NO: 1704 - DNA, 840 bp, Saccharomyces cerevisiae
atgtgtgaatacagcaaggctcttcatattctgctcaagtcgccagtaacggatgacataataaaattcttaacagacacaacattgagggttgttccttcaagcaactaccccacgcctcccggttctccaggagagaaacacctcacaaggctgccatcgctaatgacttttatcactagattggtcagatacaccaacgtctacacacccactctgctcaccgctgcgtgctatttgaacaaattaaagcgtattctgcccagggacgctactggtctcccctcgaccatccatcgcattttcttggcctgtttgatactgagtgctaagtttcacaatgactcttctcctttaaacaagcactgggctaggtacaccgatggtctctttacactagaggatatcaaccttatggaaaggcagttgttacagctgttgaactgggacctcagggtgaacacagaagatttgatcctagatctgcagcctctattagagcccatcaagcaagacttggcaagatccagcgaccaaaggaagagaattaacatgatgatgtccatgaacagaaggacttgtgctggcacgagtcctatcagatcaaacaacagattcaaactctacgaaaaacagagaaacgtgtcgatagcatccgatttaagttctgctactctagtcgacagttgtaatgatctaagaaggctaaaagatgtaaccaacatagcgaacaacacagtcgctaacacgaattacgtcaggacggtagagaaatggaacgacaatgtcaacaggcaaagttgggatctggaacagatcatgagtcaacatgggttttaa

SEQ ID NO: 1705 - DNA, 842 bp, Saccharomyces cerevisiae
atgtctttagttgtacaagaacaaggttccttccaacacattttacggtatgttttacgagtacagtgcagatatgttgagagagtttcacattacatgggataatagcttaatattgcgattgaaaatatgtgagtgcactccgatggaataataaacgtcacgggttaccaaatacgaggccgaattaactctacgctactataaaaattatcactagattttaaagtaatacacagtttattggaaaatacaatatatgactcaatgcgaatttaaaaatttcagtcaatacagcttgacaaattcatatttatcgtccctccatgttcgtacgccattccaaaatgatgcgccatgttgaaaatttctcgaagaacctagcagtggtgtgaaataaattactaacaataagatgtacaattttttgtgcgcccattacaatcagtttgttgaacaccaatgtcgatggtaacattaaaattgtttacgctttgaccactattaagggtgttggtcgtcgttactccaacttggtctgtaagaaggctgatgttgatttgcacaagagagctggtgaattgacccaagaagaattggaaagaattgtccaaatcatgcaaaacccaactcattacaagatcccagcctggttcttaaaccgtcaaaacgacattactgatggtaaggactaccacactttggctaacaacgtcgaatccaagttgagagatgacttggaaagattaaagaagatcagagcccaccgtggtattagacacttctggggtttacgtgttagaggtcaacacaccaagaccactggtagaagaagagcttaa

SEQ ID NO: 1706 - DNA, 843 bp, Saccharomyces cerevisiae
atgaaatccaaaacgtggattttcagggatgtcttatctagtcaccgaaccaaagcgtttgatagtttactttgtaggagactccctgtatcaaaggcaacgaagcatcttcaactgggagaacatttcctgttcttcccaccatcattcgaaaaattggatagagatggttattttaactatcaaaatcctgcaagtttgctaggaaaccctgatttacgctaccgtagaaggatttggggacaaggagagcttgttcagtatttaccagtcaccttagaccaggagtatacatgccacgaatcaatcaaatacgtaaaaaaaatacgagatgaacatgttgtctgtattgaaagaacccttttacaagaaaggcccgaaaatgtgtcgagtccaatggacatttgcttattcgagagaagggtattaatgtacaccaattcacccgcaaacaagactgcagtcaagatgcccgtaggagaggagaactataagatcttaaaaaattttactgttactgatatggatattgtagcttatggtcagatgtctttgaatccgcaccgaattcattgggacaaagagtacagtcgctatgttgaaggctacgacgatattatcatgcaaggacccttctcggtccaattactacagaaatgcatccaaccttttctcgaacaaccaatcagacagttgcgataccgcaatttgaattatatatatccaaacactactttgagcatatgtcagtctttaagctcttcgagcggaatgtacacatttcaaattagggacctccagaaagccaacttagtctacatgaaagctgatgttttctgttga

SEQ ID NO: 1707 - DNA, 843 bp, Saccharomyces cerevisiae
atgaaggcgctagttgaagagattgataagaaaacttacaatcctgacatatatttcacgtcattggatcctcaagcacgtcgatatacttcaaagaagattaataagcaaggcacaatatccacctctaggcccgtaaagcgcataaactactcactggcagatttagaggccaggttatatacttcgagatctgagggagatggcaatagtataagcagacaggatgaccgaaatagtaagaattcccattcatttgaagaaaggtacacacaacaagagattctccagtcggacaggaggtttatggaacttaacacagaaaatttctcggatttaccaaatgtaccgactttattaagtgatctcacaggcgtaccacgagatagaattgaatcaacaaccaaaccgatctcacagacctcggatggtctctctgcattaatgggtggttcttcttttgtaaaagagcattccaagtatggtcatggttgggtgcttaaaccagaaaccttacgggaaatacaattatcgtataaatctacaaaactacctaaaccaaagaggaagaataccaatcgtattgtggcgttaaagaaggttttaagttcaaaaagaaatttacattcgtttttagattctgcgctgctaaacttgatggataagaatgtcatttaccacaatgtttacaataaacgatacttcaaagtgttacccctaattacgacatgctctatttgcggtggctacgatagtatttcaagttgcgttaattgtggaaataagatttgttctgtaagttgttttaaattgcataatgaaactaggtgcagaaatagatag

SEQ ID NO: 1708 - DNA, 843 bp, Saccharomyces cerevisiae
atgacaagatctccctggaagcgcctactatggttgaaacaggagtacccagataattatacagatccaagttttattgagttgagagcaagacaaaaggctgagagtaaccagaagtctgatagaaaattatcagaagctgctcgcgctcaaattaggttggattttataagtttctaccaaaccatattgaacacttctttcatttacatcacttttacatatatttactattatggcttcgatcctattccgccaactattttcctttcatttataacattgattatatcaaggacgaaagtcgaccctctattgtcctcattcatggacgtaaagtcttcgctgattatcacatttgcaatgttgactctctctccagtcctcaaatctctttctaaaacaactgcatctgattccatatggacattgtctttttggctgaccctatggtacattttcgttatttcgtcaacaaagtccaaagataaaccctctaacctttccaccaatatacttgtcgcccttgttgctgtcctatcatcgaggctttcgaccacaatcgacgtattctgttttcttttaatttgtattcagttgaatatcattctacccacttatttatcggtgacgaataaggtagtaccaataatttcaaatattattgtatactcatttttgaatgttgctctaggttggatttatatgctgttgattttctttgcttcagtattttatattactgttttacctaagtggttcatctactggaaaatcaattatcataaacgggataacgatctactaagtacatgggatgcaagaacaccaatattggattag

SEQ ID NO: 1709 - DNA, 843 bp, Saccharomyces cerevisiae
atgactgttgaatatactgcatccgatttggcaacctatcagaatgaggtgaacgaacaaattgccaagaataaagcacatcttgaatcattgactcatccaggttcgaaagtgacatttccgatcgatcaagatatttctgctacacctcaaaacccgaacttaaaagttttcttttttgatatcgacaactgtctctataaatcatccacgagaattcacgatcttatgcaacaatctatactgaggttctttcaaacacacttgaaactatcacctgaagatgctcacgttttgaataactcttactacaaagagtatggacttgccataaggggacttgtaatgttccacaaagtgaacgcactggaatataaccggcttgtggatgattccttaccactacaagatatcttgaaacctgatataccattaaggaatatgctgttgagattgagacaatcgggaaagattgataaattgtggcttttcaccaacgcttataaaaaccacgcaatacgttgcctgagattgttgggtatagcggatttatttgatggattgacatattgtgactactctaggacagatacgctggtctgcaaaccacatgttaaagcatttgaaaaagccatgaaggaaagcgggttggcaagatacgagaatgcttattttatagatgacagtgggaaaaacatcgagacaggtatcaaattgggcatgaaaacatgtattcatttagttgagaatgaagtaaatgaaattttggggcaaacaccagaaggcgctattgtcattagtgatatattggagttaccacacgttgtgtccgacctgttctaa

SEQ ID NO: 1710 - DNA, 843 bp, Saccharomyces cerevisiae
atgagcgatagagatcagatagaacctgtcacaaatgcattagatgcagaaagtgattctagtgatgattttgggaatttttcagatgcctcagttgaaaatgacctctataaccagaattctactttaacgacgtcttccgaatctgtagtagataactgcttgaataagatactaccaaagggagaatttgacctggaagaagaaaccataaagaatgactgtttcaagctgagcaaacttattgaagatgaacgaccccatgtcatttatgaacaactcgtacaattagatcctgtgttacagccattcatatggaataaatctcatatacgcagaaacttgctccacattttgagattatcggataataatggctctgagggtgttggtacgaagagggaggaagaaccgttgaatgatgagttgttcaaaaggatatgcgatgcagtggagaaaaatgagcaaacggctactggtctcttcctgagggataatttcaaaattgactatacaccaccaatgactttaaaatctcttcaaaaggaagaggagcgtgagcaagagcagcatataccgcaattgcttatggcagattttactagtatggatgaagaatctttacgccaataccacgatacattgtgtcaatccattgactttttggttagtaaatcaagatcattgaagaaacaacagcgagacctcctaaaggataagacaacttttgaaaatgtagtgacgaatttgacaggacatacccaaagactacagcgagacgaaattgcattgtataacaaaaagcgaaacaaaaagaaaaggttcagttgggtaggatactaa

SEQ ID NO: 1711 - DNA, 843 bp, Saccharomyces cerevisiae
atggaaccagaagatacccagctgaaagaggacattaaaaccacagtaaattacataaagcagcatggtgttgagtttgagaacaaactgctagaagatgagagattctcattcatcaagaaagatgacccactccatgaatactacaccaaactcatgaatgagccaacagacactgtcagcggtgaagataatgacagaaagagtgagcgagagatagcaaggccgccggattttctgttctctcaatatgatactggaatatcccgaagagacatggaagtaatcaaattgacagcacgctactatgcaaaggataaaagtattgttgaacagatgatttcaaaggatggtgaagccagattaaactttatgaacagctcacatccgctacataagacattcactgattttgtcgcccagtacaagcgagtatattcttttactggtcaagaaatcaagaaaagtaagagaaccattttagataattgttttgagagaacacagtattgggaatttgagaaagataaagaccgggaacatgataagctcgtagagttgtgcaaaatacaatttgcagccattccatgggataaatttactcaagtggcaaaattttctatccctgaagacacagaaatcttcgaaggctctctagatttagaacagatgaggctgcgaagagtacaaactggtattaagttattcgatagtatcaagccgacaaatgaagaagaaaagatagtatccgaccaaggtaagcaaaaaggaggagatagtaagggcaaaaagcgtaaaattagagctgtgggagagacaaggttaaagaaaagtaaaaaataa

SEQ ID NO: 1712 - DNA, 843 bp, Saccharomyces cerevisiae
atggctccatctggtatgtgaactgcaatattaatagcacgagaaaattgagaggaagatagatgggaactagtagagttgatattgatgagatacgaaaaccacacgtaaataaactatccgacgacaagaatagtgcattaaggacttgattaagatatggtgagcaacgtaattatcgggctcaacagtttattagcaatcgttttgatagaagcgttgatgctgtggaagttgttctttttactaccaacagccattaacaaatccattagagtgttcgttcgtttttctgctcagattcaagaaaattattccatcctcattatacttttttcttctatttcgtgctccacgtcgaggtatcaaggaacatagtttactaacattaacgaattcatctcctatgaatttactttttgtatagctaaggctactgccgctaagaaagctgtcgttaagggtactaatggtaagaaggctttgaaggtcagaacttctgctaccttcagactaccaaagaccttgaagttggctagagctccaaaatatgcttccaaggctgttccacattacaacagattggactcatacaaggtcattgagcaaccaatcacttctgaaaccgctatgaagaaggttgaagatggtaacattttggttttccaagtttccatgaaagctaacaaataccaaatcaagaaggccgtcaaggaattatacgaagttgacgtattgaaggttaacactttggttagaccaaacggtaccaagaaggcttacgttagattgactgctgactacgatgctttggacattgctaacagaatcggttacatttaa

SEQ ID NO: 1713 - DNA, 843 bp, Saccharomyces cerevisiae
atgggaaatatgataaagaaggcatctttaatagccctcctaccgctgttcaccgccgcagccgctgcagctactgatgcggagacatctatggaatctgggagttcttcacatttgaagtcttttttaatgtccgtttctatgattgggctttctgaaattggtgacaaaaccttcttgatcgcagccttgatggcaatgcgtcacaaaagagttctggtgttctcagcagcagctacctccctcgctattatgaccatcctttctggtgtggtgggtcattcagccgttgcttttctttctgaacgctatacagcattttttgcaggtattttattcttagtgttcggttacaaattgactatggaaggtttggagatgtctaaggatgcaggtgttgaggaggaaatggctgaagtggaggaagaaattgccattaaagacatgaaccaggatatggatgatgttgaaaaaggaggcgacactgcgtatgataaacagctgaagaacgcttcgattggtaaaaaaatagtgcacaggattcgcgaattagcatcatttatgttttccccagtttgggttcaaattttcctgatggttttcctaggcgagctaggtgaccgttcacaaattagtattattgccatggctactgacagcgactattggtatgttattgcaggtgctgttattggtcatgccatttgctctggattagcagtggtgggtgggaaattattggcaacaagaattagcataagaacaatcactcttgctagctcgttgttattcttcattttcgccttgatgtatatatatcaagcattcacaactcaggattga

SEQ ID NO: 1714 - DNA, 843 bp, Saccharomyces cerevisiae
atgtcgcaagaaattaggcaaaatgagaaaatcagttatcgtattgaaggaccattcttcattattcacttaatgaaccctgacaatttgaatgcactagaaggtgaagactatatttatttaggagagttactagaactagcggacagaaatcgtgatgtatattttacaattatacaaagcagtggtagatttttttccagtggtgctgatttcaagggtattgcaaaagcccaaggggatgataccaataaatatccttcggaaacaagcaagtgggtgtcaaattttgtcgctagaaatgtttatgtcactgatgccttcatcaagcattccaaagttttaatttgctgtttgaatggaccagcaatagggttgagcgcggcactggtagcgttatgtgacattgtgtacagtataaatgacaaggtttatttgctatacccctttgctaacttaggactaattaccgaaggtggtacaacggtctctttgccattgaagtttggcacaaatacgacgtatgaatgcctcatgttcaacaaaccattcaagtacgatataatgtgcgagaacggatttataagcaagaattttaacatgccatcttcaaacgctgaagcgttcaatgcaaaggtcttagaagaattgagggagaaagtgaaagggctatacctgcccagttgcttagggatgaaaaaattgctgaaatcgaaccacatcgatgcattcaataaggctaactcagtggaagtaaatgaatctctcaagtattgggtagatggagagcccttaaaaagatttaggcagctgggctcgaaacaaaggaagcatcgtttatga

SEQ ID NO: 1715 - DNA, 846 bp, Saccharomyces cerevisiae
atgaaagctaggaaatcgcagagaaaagcgggcagtaaaccaaatcttatccagtctaaattgcaagttaataatggttcgaaatcgaataaaatagtcaagtgtgataaatgtgagatgtcatattcctcgacatcaatagaagatcgcgccatccacgagaaataccacactttacagctgcatggacgtaaatggtcgccgaattggggttctatagtatacacagagcgaaaccattcaaggacggtgcatctatcaagatcgacagggacaataacgccattgaactcctcacctttgaaaaaaagtagtccgtctattacccatcaggaggagaagattgtatatgtgagaccagataagtcgaatggtgaagtccgagccatgacggagataatgacactagtgaataacgagctgaatgcgccacacgatgagaatgtcatttggaacagtaccacagaagaaaaaggcaaagcgtttgtatacataagaaatgacagggcggtcggaataataattatagagaacctttatgggggcaatggtaaaacatctagtcgtggacgttggatggtttatgattctagaagattggtacagaatgtgtaccccgattttaagattggcatatcgagaatttgggtgtgcaggacagcaaggaagttgggtatcgcaaccaaattgattgacgttgcaagagaaaatattgtttacggtgaagttattcctaggtaccaggtagcatggtcgcaacccacagacagcggtggaaaactggctagcaaatacaacggcattatgcataaatcaggcaagttactattgccggtatacatatga

SEQ ID NO: 1716 - DNA, 846 bp, Saccharomyces cerevisiae
atgaagaaaacaatttacaaagtcctcgtaagtttttatcaatatgtcggtttaggtaaaaagttccatcctagccacgatacagtattaattattggcggttcttcaaatgagttaggcatcgagctctgcgagacatttatagaagattatcatacaaaggttataaatattgacactatagacagtattaatggaaaaaacgcaaggagaagtgaaaaactgtatacttttatttcttgcaaagatttcagtgacataaaatgtcttgaggaatccatgctttaccttcaaaatttagaaataattcctacagtgctcattaacaacatgcaggagggaatcgaatcgactcttctcaaagaagacaaatttttgagacttgatgaagagtctttaaatgaattcgagaaaatcgtgaggtataatttacaaagtgtaatattgataactaagttctgcttgagtaacatttttccaaaggttcaagctgaagctcaagaaaaagcaaaggggttctatattgtcaacatatcatcggtattgacgttaaaaccgtgcaaatcaggaacacattttattacatcgaaatgtggtataaactctttccacgatggaataacctcagagcttaaattgaaagatagtaatttgaatgtaaaaacgctgattgcatatttacccagttttgaaagtgaagcacattggaagagactttccccgagtatctcgaaacatctcgtccactgtctacttgagggaagatatggtgatacaattctcgaaagcaaaagatcaattggtgatattcttttgataactggtttcaaaagctcttttacttaa

SEQ ID NO: 1717 - DNA, 846 bp, Saccharomyces cerevisiae
atgaaggtaaatttaatgttgaaaagagggcttgctactgcaactgcaactgccagttccgctccccccaagattaaagtcggagtactactgtcaagaatccctataattaaatcagaattaaatgaactagagaaaaaatactatgagtaccaatcagaactagaaaagagactaatgtggacgtttccggcatatttttatttcaaaaagggtactgtagcagaacacaaatttctatccctgcagaaaggacctatctccaaaaaaaatggcatttggtttcctagaggcataccggacattaaacatggcagagaaagaagtactaagcaagaagttaaactttctgatgacagtacagtagcatttagcaacaatcaaaaagagcaaagcaaagacgatgttaataggcccgtgattcccaacgacaggataacggaagcagataggtcaaatgatatgaagagccttgaaagacaattgagcaggaccttatatcttttggttaaggataaaagcggtacttggaaattccctaacttcgatctttctgatgaatctaagccgttacacgtacacgcagagaacgaattgaaattgttgagcggtgatcagatatacacttggtctgtttctgctacgcccataggtgttttgcaggacgagagaaataggactgctgagtttattgtgaagtcacacattttggctggaaaatttgatttggtggcgtcgaaaaatgatgcattcgaggattttgcttggctgacaaaaggtgagatcagtgaatatgtaccaaaagattactttaacaaaacagaatttcttttagcggataattga

SEQ ID NO: 1718 - DNA, 846 bp, Saccharomyces cerevisiae
atgagtaatcattctgaaatcttagaaaggccagaaacaccatatgacataacttatagagtaggtgtggcggaaaataaaaactcgaaatttcggaggacaatggaagatgttcatacgtatgttaaaaactttgcttcaagattagattggggatatttcgcggtgtttgatggacatgctgggattcaggcctccaaatggtgtggtaaacatcttcatacaattatagagcaaaacattttggcagatgaaacacgagatgttagagatgtattgaacgattcattcctagccattgacgaagaaattaatacaaaacttgtaggaaatagtggatgtactgctgctgtttgcgtattacgttgggagcttccggattcagtttctgatgattcaatggatttagcccaacaccaaagaaagttatatacagcaaatgttggtgattctcgaatagtattgtttagaaacgggaacagcataagactgacttatgatcataaggcatctgacactttggagatgcagagagttgaacaagcaggtggcctgataatgaaaagtcgtgtaaatggtatgctggcagtgacgagatcgttaggggataaattttttgatagtttagtagtgggcagcccatttaccacgagcgtagaaataacttctgaggacaaatttttaatcctagcgtgtgatggattatgggatgttattgatgatcaagatgcatgcgaattaatcaaggatattactgaacctaatgaagctgcaaaagtcttggttagatatgctttggaaaatggcacaacagataatgtaacggtcatggttgtcttcctctaa

SEQ ID NO: 1719 - DNA, 846 bp, Saccharomyces cerevisiae
atgcaagtcatcggacgtggtggggcaaatatactgattgattatggggatcctacgtggttgtggcgatgctgcatccgttggcccgatctgttatcatcaaataattcttatacaatcaaaaacatcagttatattaaagattatgtagaacctcttctacatggcttgctttgcccgatgtatctgattgacgtcgatatagaagctataaggccaattctcagtgactttattctaaatttagacgataaggtagtcaaagttatcaaaattaaaaatctcaccaataatacctcaaatctgatattaaataaccactttttaaaatcttattgttcacaaaatctgcaaacagttattttagaattgaagcctaaatggttatactatgatacagattactgtaggaactgtactcataatgcatttaagggtagaggcactaagtactgttacaatcaattactaatgaatccagcacacttggaattaatatttggagaatgtaatatatttccggttaagtttaaagatgccatgcatgagtacttgcgcaatgacaataacattttcaagatcctttatgatttacagaaaaaacttacaaagaacacaactccaataagtgacataaaatcaatcaacgatgtaaacgatgagcatctgctactcatgacactcagagacgtgacatgtttcattgaatggaacagtgctgaaaatgcgttgcacgtgaatataatagatgtagatctaaagccaaaagaaaaatggacccattggacaaaaacttacagccagttgacatcaagccaaaaaatttatcatacttcaaataaataa

SEQ ID NO: 1720 - DNA, 846 bp, Saccharomyces cerevisiae
atggcactacgatttttcaacgatatatctagagatgtcaatggcctattcaatagggacttttttcacaccaaccccctctctttgaatatttcaacaaccacggaaaatggtgtgaattttactctgaaggcgaagcagggcgtgacagaaggccccatccaaactagcgtagaaggacggttttatgacaggaaggagggagtgtcgctatctcagagttggtcgaaccagaacaggttaaatacaagaatcgaattttccaagatagcacctggttggaaaggtgatgtcaacgcatttttgactccccaatccatcaagaacgccaaatttaatttgagctacgcccaaaaatcgtttgcagcaagaacttctatagacatcttgcaacctaaggactttgtcggaagtgttactttgggccaccgcgggtttgttggcggcactgacatcgcatatgacacagctgcgggtttatgtgcacgctatgctatgtcaatcgggtatcttgccagagaatattcgtttattttgtctactaacaacaggcaatgcgcaactgcttcattttttcaaaacgttaaccgctatttgcaagtgggaactaaagccactttacaatcgaagacaagttctaatatgaacattgaatttgttaccagatacgtaccagattctatttcgcaagttaaggcaaaaattgcagattcaggcctgactacattgtcgtacaagcgaaatttgaataaagatatttctttgggtgtgggtatgtctttcaatgcgctacaactgactgaaccagtccacaaatttggctggtctctatcgttctcgccctga

SEQ ID NO: 1721 - DNA, 846 bp, Saccharomyces cerevisiae
atgggtttatatcaagcaaagaatgatgagggaagtgatccgaaaagcagcagcaagattgacgatttgatagaaaatgaggcagaaatcatacgactaatcaaggaagatggcaagttactgatagacaatggcgatggtagagatatccataacataattcaagaagacaagctcctcagtgtagaatttaacgaagtactaaagcgatttcacggggaagaaaagtcagatattcctcggaaggagtttgatgaagacgaggatgacggatatgattctaatgagcaccatcaaaagactatagaagtaatgaacacactaaatcacgtcattaataaagaggtgattcctcccgaaaactttagccacgtcgttggggagatataccgtagcagtttcccacgacaagagaacttttcgtttttgcatgaaagactaaagttgaaatccatcttggtactaattccggaagaatatccgcaggaaaatctaaattttttgaagttaacgggtataaaattatatcaagttggaatgagcggtaataaggagccatttgttaatataccgtctcatctactgacaaaggcactagaaatcgtgttgaatcctgcgaatcaaccgatactgatacattgtaatagaggcaaacatagaacggggtgtttgattggttgtataagaaaactacaaaattggtcgctaacgatgatttttgatgagtacagacgtttcgcatttccgaaggccagggcgcttgatcagcagttcatcgagatgtatgacgatgacgaaattaagaggattgctagtaaaaacaactggttgcctctacaatggtaa

SEQ ID NO: 1722 - DNA, 846 bp, Saccharomyces cerevisiae
atgtccgaatatcagccaagtttatttgctttaaatccaatgggtttctcaccattggatggttctaaatcaaccaacgaaaatgtatctgcttccacttctactgccaaaccaatggttggccaattgatttttgataaattcatcaagactgaagaggatccaattatcaaacaggataccccttcgaaccttgattttgattttgctcttccacaaacggcaactgcacctgatgccaagaccgttttgccaattccggagctagatgacgctgtagtggaatctttcttttcgtcaagcactgattcaactccaatgtttgagtatgaaaacctagaagacaactctaaagaatggacatccttgtttgacaatgacattccagttaccactgacgatgtttcattggctgataaggcaattgaatccactgaagaagtttctctggtaccatccaatctggaagtctcgacaacttcattcttacccactcctgttctagaagatgctaaactgactcaaacaagaaaggttaagaaaccaaattcagtcgttaagaagtcacatcatgttggaaaggatgacgaatcgagactggatcatctaggtgttgttgcttacaaccgcaaacagcgttcgattccactttctccaattgtgcccgaatccagtgatcctgctgctctaaaacgtgctagaaacactgaagccgccaggcgttctcgtgcgagaaagttgcaaagaatgaaacaacttgaagacaaggttgaagaattgctttcgaaaaattatcacttggaaaatgaggttgccagattaaagaaattagttggcgaacgctga

SEQ ID NO: 1723 - DNA, 849 bp, Saccharomyces cerevisiae
atgaacgtttgcaagttgaaagaaatagtaccactatttccgagatcgtcctttacagatggtgtagtaagtacaggaaaaagtttccgaagctgggacacctgcatggacaataaagcatgtaaaattattgcgattgttggtattgttttggcctgtattcttgtgatttggttgattgggggcttactgacatgtttcaggcaaggggtaacaggaataggtcagttcatttgttggtgttgtcgttgttctaatgacagaaatggaaacaatacaatgccggtaaatgagggttttagtagagttaatatgggcgtggctcctccttctactgtgatttatcagcctattcaacaacctgaaagtgcgtattatagaaacgatgcgaagaatgatacattttacgacgaagtcaaaactcccagtaatgaggtgtatgaattagaggaagatttcgatttggaaaaacaaaaagagaaaacaaggaaaaaacaacagaaggaaagaaataaagaaggacgcagccctagtagggtggcccctctagtgtatgaagaagaaaatttcgaaggtagcagccctcagccgcaatatgatgctagaaattcgtttatccaaaatgcggccaatactggtagcaacaacgctcatgttgcttcacaatctccaatttttgacatcagcgattatggcgagaactattattacgataataataacatcaataataacctccagggaaacagttacaatactccctcctctaatcatagaagtccatatccaaccgaaaattatcaatcatatcagggatataaaccaaaccaaagcgatagatattactaa

SEQ ID NO: 1724 - DNA, 849 bp, Saccharomyces cerevisiae
atgagtattgacaacaagttgtttgttactgaagaggatgaggaagacaggacgcaggaccgtgctgatgttgaggatgaatctaacgacattgatatgatagcggatgagaacggaacaaacagcgctatagctaatgagcaagaggaaaaatccgaagaagtaaaagctgaagatgatactggtgaagaagaagaggatgacccagtgatcgaagagtttccattgaagatctccggagaagaggagtcactgcacgtgtttcagtatgctaatagaccaaggctagtaggacgcaaacctgctgagcatccgtttatctctgcagcaagatataaacccaagtcgcacctatgggaaatagatattcctttggatgagcaggccttctataacaaggataaggctgagagcgaatggaatggggttaatgtccaaacattaaaaggcgtgggtgtggaaaacaatggccaatatgcagcatttgtcaaagatatgcaggtttatttggtacctattgagagggtagcacaattgaagccatttttcaaatatatcgacgacgcaaatgtaacaagaaagcaagaggacgccagaaggaaccctaatccttcatcacaacgcgctcaagtggttaccatgtctgtaaagagcgtcaacgacccttcgcaaaacagactcactggctccctgctggcacataaagtcgccgatgaagaggctaatattgaattgacctgggcagaaggcacgtttgaacagttcaaagatactatcgtgaaagaagctgaagataaaactttagtagccttagagaaacaagaagactatatagataatctagtttga

SEQ ID NO: 1725 - DNA, 849 bp, Saccharomyces cerevisiae
atggatccaagtttagttttagagcaaacgatacaagatgtgtccaacctcccatcagaatttcgttacctcttagaggagatcggttcaaatgatttgaagctcatcgaagaaaaaaagaaatacgagcaaaaagaatcacaaatacacaaatttataagacagcaaggctcaataccgaaacatccacaggaagatgggcttgacaaagaaataaaagaatcacttttgaaatgtcagtctttgcaaagagaaaaatgcgttctggcgaacactgccttgtttctaattgctagacacttgaataagttggaaaaaaacatcgctttattggaggaagatggtgttctagcccccgtggaagaagatggagacatggatagcgctgctgaagcctctagagaaagttcagttgtgagtaacagtagcgtgaaaaagagaagagctgcatcaagctcaggatccgttccacccactttgaaaaagaaaaaaactagtcgaacatctaaactgcaaaatgaaattgacgtttcttcaagagaaaagtctgttactccagtgagcccaagcattgaaaagaagattgcaagaacaaaagaattcaaaaacagtagaaatggtaaaggccaaaacggttcccctgaaaacgaggaagaggacaaaactttatactgcttctgtcaaagagtttcgtttggagaaatggttgcatgtgatggacccaactgtaaatatgaatggtttcattatgattgtgtaaatttaaaagaacctccgaaaggaacatggtactgtcccgaatgtaaaattgagatggaaaaaaacaaactgaaaagaaaacgtaactga

SEQ ID NO: 1726 - DNA, 849 bp, Saccharomyces cerevisiae
atggctgaatcccatagatgtatgttaaaactgatgacgagaagacattaaaaatattttgtgctagtaatttggaattttcaagtgaaacgttgataataaaggaaaaagcgacttcagaaaagctaccagatcatatacgtggtgactaaaatgtgcaagaatatagaaagtgtaagatgaatgcaaaactcagatttaacaccagacagctaaagggtccaagtagaacaaatcaagtataccagaactatatctaagttttatctttataataaaagagtctactatcgtttctgggtaacttataaaataatttgcagtatcgaaatttacgagatcacatttaccatcgatatccaatttgactgttaaaagctctaaattatggcattcttcgacaatggagaagcctaagcttgatgatgaagtcgcataactcttcgataatacagaatttgctagctcaataataaccaccatctaagatgatcattaaatactaacattttgttttgggattttattccttttttttttttagtgtacgtcaaaggtaagcacttatcctaccaaagatccaagagagtcaacaacccaaatgtctctttgatcaagatcgaaggtgtcgctactccacaagatgctcaattttacttgggtaagcgtattgcctacgtctacagagcctccaaggaagtcaggggttctaagattagagttatgtggggtaaggttaccagaactcacggtaactctggtgtcgttagagccaccttcagaaacaatttgccagccaagaccttcggtgcttctgttagaatcttcttgtacccatccaacatctaa

SEQ ID NO: 1727 - DNA, 849 bp, Saccharomyces cerevisiae
atggtagcagacttaactaaaggtatactgaaatggaaatcaagaatagaatttgatgccgttggaagcagttcctattacgaagagttaaagggcttacctccccttgcatcccataaaaaattaacacaggctgctatcttcaatagcacgaagtatgagttattacaagtaaaaaaagacattctgtccatctatgaagttgtaagtagggacattgacgaggaacgcaatcagatgcagcaaattgaacttcaacttaaaaagtcgttaaaaaaggtagaacatagttacaaaaacgtcttaaagcaaagggcttctactaattgtatcaatggaaatgatcgtctattggccaatgcggaaaaaaaaattggctcgttaaatgaagaactcgcatgtgtcaatgatattgtttcagatattgttaacaatttgaccgcattgaatgcaaacctcccgaagaaggcacaattattgaaagatgactcaataaatgtggcacattatccacttctttttgatttcctgcataaatcttgcccgaagagtattatcgctactagtgaagctagcattcacgaaaatgcctcgccctctcctcttttagaacacgatgaattaccagcagagagcataaatagtttttacggggagaacgagctacagagtgattctttagctccacttcaaactcatgacgataacatatctagttgcaaaaaaatactacccccaaaattcaacacaacaagtggcccttcaattgaaactaattttgaaaatattagcgcagatggcctcacatacaccaaatgttctttaaaaaactcaatatctttgacttaa

SEQ ID NO: 1728 - DNA, 849 bp, Saccharomyces cerevisiae
atggttcctaagttttacaaactttcaaacggcttcaaaatcccaagcattgctttgggaacctacgatattccaagatcgcaaacagccgaaattgtgtatgaaggtgtcaagtgcggctaccgtcatttcgatactgctgttctttatggtaatgagaaggaagttggcgatggtatcattaaatggttgaacgaagatccagggaaccataaacgtgaggaaatcttctacactactaaattatggaattcgcaaaacggatataaaagagctaaagctgccattcggcaatgtttgaatgaagtctcgggcttgcaatacatcgatcttcttttgattcattcgccactggaaggttctaaattaaggttggaaacttggcgcgccatgcaagaagcggttgatgaaggattggttaagtctataggggtttccaactatgggaaaaagcacattgatgaacttttgaactggccagaactgaagcacaagccagtggtcaaccaaatcgagatatcaccttggattatgagacaagaattagcagattactgtaaatctaaaggtctcgtcgtcgaagcctttgccccattgtgtcacggctacaaaatgactaatccagatttattaaaagtttgcaaagaggtggaccgtaatccaggtcaagttttgattcgttggtctttacaacacggttatttaccactaccgaagactaaaactgtgaagaggttagaaggtaaccttgcagcctacaactttgaactgtcagacgaacagatgaaatttcttgatcatcctgatgcttatgagcctaccgattgggaatgcacagacgcgccataa

SEQ ID NO: 1729 - DNA, 849 bp, Saccharomyces cerevisiae
atgtctgacagagaacaaagcagcggcaacaccgcttttgagaaccctaaggcactcgattcttccgagggtgagttcatctctgaaaacaacgatcagagccgccactcgcaagagtccatatgcaaaatatatactgcgggcaaaaacaacgagtatatttacatcggccgtcaaaaatttttaagggatgatttgttcgaggcattcggtggtactctgaatcccggtttagcccccgcgccagtccataaattcgcaaatcctgctccactaggactttccggttttgccctcactacgtttgtcctatccatgttcaatgcaagagcccaaggcatcactatccctaatgttgttgttgggtgtgccatgttttacggtggcctcgttcaactcattgctggtatttgggaaatcgctttagagaacactttcggtggtacagccctgtgttccttcggcggtttttggttaagcttcggtgctatatacatcccttggtttggaattctagatgcctataaggacaaggaatccgaccttggaaatgcgctagggttttacctcctaggatgggcactcttcaccttcggtctttccgtctgcaccatgaaatcaactataatgttttttgccttattcttcctcttagcagtgaccttcttacttctatccattgcaaacttcacaggcgaagttggcgtcactagagctggtggggtccttggtgtgatagtagccttcattgcctggtacaacgcttacgcaggtattgccacaagacaaaactcgtacattatggtccatccattcgcattacctagcaatgataaggtgttcttctaa

SEQ ID NO: 1730 - DNA, 851 bp, Saccharomyces cerevisiae
atggctgaatcccatagacgtatgttatgaaattactatatgatgaatgttgccgtggaataggctgattcgagcttagaagacattattgatattcgataaaacatgtgttatagttggggcccgcacttgttggacaactgttattaaagagtatgaatatattaaatagtgcatggttttgcgatgagaagaacagaatgaacaagtttcataggaaaaaaattcaaaagagaaaggtattataaatgatcagtttaccttctagggaaagaagaaggagataacctacctgatatgaaattccaccaagtagtaggaggcaccaggaaatgcatttttacatgaaactgcgcgtgccagaaatgttaagatagcgtatatatatgtcatttgaggtcgcttctgacataactgcgtccctttccatcatgggctcaatgaaatgtcgaattatttcactctgcaacgtgctcatgaaagtacaaccttactaacagctttatttatgaattgacaaattctattctacttttattttgatagtatacgttaaaggtaagcacttatcctaccaaagatctaagagagttaacaacccaaatgtctctttgattaagattgaaggtgttgccactccacaagaagctcaattctatttgggtaagcgtatcgcctacgtttacagagcttccaaggaagtcagaggttccaagattagagttatgtggggcaaagtcaccagaactcacggtaactctggtgtcgttagagctacctttagaaacaacttgccagccaagactttcggtgcctctgtcagaattttcttgtacccatctaacatttaa

SEQ ID NO: 1731 - DNA, 852 bp, Saccharomyces cerevisiae
atgaaccagatactaaatgcacaaaggctgatacaattatcacaatttcaccctaaactgaagaatatatggtaccttgttgcggccgccacgttcagtgtttgtaatgagccacaggaaatacctaaattataccactatgccatgctactgagtaatgataatgcacacatgtatagattcacattagcttcccaaaccattgacttactgcgctcagaattaccaatgagaaaaactttgatcaatgagaattaccaacaacctacttttttccaaaagcaattgacagcaaaatttagagaagttattcttaaaacaggacctctggccggccttccaagagcgatcaatggcctgactatgctaaaggaaactactccggacattttagtaccgcacttagacccaatagacccgtgggaggctgccatgggaaacagttctcccctttcggaaacctctatgagaaggaagcatgacaagacaatccaggaaagagatcataccatacagaacggcttacggcattggaattcaatatacaacaaagtctcaacccgcgtggtaaacaatctaaactcttcgtacccagacttatggtattatacactggtccatgtatatggccctttgtttgcctttgatgagatactatctgcgcaagagacaagtttagtgataattgcttctttggttccacaagatgttaatcctcaattgcgtgggcatttgaaaggtgccttgaatattggttgtgataaggaaactgtggaggcagtgagaggattggctatactaatatctcagtggtgtggtgttagttggaaatctggtgttgtaaaattgtaa

SEQ ID NO: 1732 - DNA, 852 bp, Saccharomyces cerevisiae
atgaatagtaaccgatgccaaacgaatgaggtgaataaatttattagtagtacagaaaaggggccttttacgggcagggacaatacgctctcttttaacaaaatcgggagcagactgaattcaccaccgattctgaaggataaaattgagctgaaatttctacaacactcagaagatttgaatcaatcacggtcctacgtaaatattcgtcctagaaccttagaggatcaaagttacaaatttgaagcgccaaatctaaatgacaatgaaacttcttgggccaaggattttagatataacttccctaagaatgttgaaccgcccatcgaaaatcaaatcgcgaatcttaatataaacaacgggctacggacatctcagacagattttcccttaggcttttattcacagaaaaactttaacattgcttccttccctgtggttgaccatcagatattcaagacaacaggtttagaacatcctatcaacagccacattgattctttaattaatgctgaattttcggaactggaagccagtagtttggaagaagatgtccatacagaagaggaaaattcaggtacgagtctggaagatgaagaaactgccatgaaaggtttggcttccgatataattgagttttgcgataataatagtgccaataaagatgtaaaagaaagactaaacagttcaaagtttatggggctgatgggcagcattagtgatggttctatagttttaaagaaggataacggtacagaaagaaaccttcaaaaacacgtaggtttttgttttcagaattcaggaaactgggctggtcttgagttccatgatgttgaagacagaattgcttaa

SEQ ID NO: 1733 - DNA, 852 bp, Saccharomyces cerevisiae
atgattcaaatggtgcccatttattcatgctccgcattacttcggagaactataccgaaaaggccattctatcatgtgttatcagggttaactgtacgctttaaggtaaacccgcaattaaattacaatcttttcagagatctcactaggagggaatatgctaccaatccgagtaaaactcctcatataaagagcaagttgctcaatattcccaacattttgactttatcacgaataggatgtacaccctttatcggactcttcattataacgaataatttgaccccagcattaggtttgtttgcattttccagcatcactgattttatggatgggtatatagcaagaaaatacggcctgaaaaccattgcaggaaccatattagatccacttgcagataaactactcatgatcacaacaactttggcattatctgtaccatccggccctcagattataccggtatctattgcggcgataattctgggtagagatgtgctactagccataagtgctttgtttatacgatatagcactttaaagttgaaatatcctggtcgtgtggcatggaattcctattgggatattgttcgctatcccagcgctgaggtcagaccttcccaactatcaaaatggaacacgtttttccaaatggtatatcttggatctggagtattattacttttatatgagaaagaagagggctgtgaaaaaaccgaggaggatttcgaagatagaaaacaggactttcaaaaggcctttagctatttagggtatgtaaccgccacgaccacaataatgagcggagtatcctacgcattaaagagaaacgcttttaaacttttaaaatag

SEQ ID NO: 1734 - DNA, 852 bp, Saccharomyces cerevisiae
atgccaggacacgaattggaagacgtaataaatcaacgtttgaacctatatgatgtattagaattaccgacccccctggacgtccataccatctacgatgatttgccccaaattaaacgcaaatacaggacccttgccctgaagtatcatcctgacaaacacccggacaatccatcaattatacacaaattccacttattatcgaccgcaactaatatcctcaccaatgcagacgtgagaccccattacgaccgctggttaattgagttcctacggaaaacaaacgacattgaaagaaataaacttatacaaaagctggaagaatctgaatcgagtacgatacccaccaccacaccacatcctgatttattgcaaatccaacgccacggcgagctactcaggaaactaaaacatttcaacttgccctatggtgactggaaacatctcaacacacaagaccaagaaaatgcttcgcaacatccgtattacgattgctctactttgagaattgtccttgacaacttcctgcaatcaaataataaatcaaactgcttatctcatttgcgcaatcaagtattcatcacgctaagtgctaatgaaatctacgacatctacttctctgaaagaaacaactactcgaaggatgattcaatcatcatatatactgtattcgatactcccatcacagcgcagcacgtattccgaaactggtcaagtgggaacctcatacccacggtcaaggatatttcgcccttgatcccgctacattactactctgattttaatttggagacggaactgaatgacgatattgcaagactggtctctaatgaacctatcctactcgactag

SEQ ID NO: 1735 - DNA, 852 bp, Saccharomyces cerevisiae
atggttcaagctatcaaattaaatgatttaaaaaataggaagagaaaaaatgtggaggaagaaaatggcagtgacgagtctgaaattgacattagtagcaccgattcagaaaatgaagaagagcaaaatggagaagaagagatcgtaaatattgacttcgattttttcggtggtaacccagaagttgattttcatgctttaaagaatttactgcgtcagttatttggtcctcaagaaagtaccaggattcaactaagcagcttggcagatttgatcctaggttccccaaccaccacaattaaaacagacggcaaagaatctgatccatactgttttctttcattcgttgatttcaaagctaatcatctaagtgattatgtcaaatatttacaaaaagtggacatgagactttccactttcttcaaaactatgattgatagtggtaataaaaattgtgctttggttctcagtgaaaggctgattaatatgccaccggaagtcgttccacctttatacaagattacgttggaggatgttgccacggcacttggcgatgacaaacattatgacttctatatcatcgtcaccaggaagtatgaagtaaattttgacactgacgatgataccgactctggtaagaggaataaaaacaaagacgaaagatccaaaaaaagggtgaaggccgatgaagtagactactttcatgaggaggaccgattttttgaaaaatatgccaagattcacttcgaatcagaagctaaaaagggtgttatcagctcatacatgattcttgatcacgaaggccttgtcaaaagtatcgatgaattggaaacagaaatttccacttggtaa

SEQ ID NO: 1736 - DNA, 852 bp, Saccharomyces cerevisiae
atgtcctttttcgacatcgaagcacaatcttcaaagggtaactcccagcaagaaccacaattctcaacaaatcaaaaaacgaaggaattaagcaatttaattgagacattcgctgaacaatcccgcgtgctggaaaaggaatgcaccaaaattggttccaaacgggactccaaagaactaagatacaaaattgaaacagagttaataccgaactgcaccagtgtaagggataaaattgagagcaacatcctcattcaccaaaatggaaagttgtctgctgatttcaagaacctgaaaacgaagtatcaatccctacaacaatcatacaatcaaaggaagagtctgttccctctaaaaacgcctatttcaccaggaacatctaaggaaagaaaagacatccatccgcgaactgaagccgtgcgacaagatccagagtctagttatatttctataaaagtaaacgagcagagtcctttactgcataacgaaggacaacaccaattacagctgcaagaagaacaagaacaacaacagcaaggattgtcccaagaagaactagattttcaaacaatcattcaccaggaaagatcccaacagataggacgcattcatacggcggtacaagaagtcaatgctattttccatcagctcggttcattagtgaaagaacagggagaacaagtaaccaccatagacgagaatatctcgcatttacatgataacatgcagaatgcaaacaaacaattaaccagagcagaccagcatcagagggaccgtaacaaatgcggtaaggtcaccctaatcattataatagttgtgtgcatggtggtattgcttgctgtattaagttag

SEQ ID NO: 1737 - DNA, 852 bp, Saccharomyces cerevisiae
atgtctcaaagaataattcaaccaagcgcatctgaccaacaattcccaggtaaatctgatggatatgaatatactgttgggcctaagcaagcgataacaagcgaagcttcaacaacatacattccctctagaatatactcagagtctctacttttcaaaaggcaagaagcgtctttatcagcaatggctttcttgttccaggaaatgatttcacagttgcatagaacatgtaaaactgcaggcgattttgaaactaaattaagtgactatggccacaatattggaattcgtctattagaactgctgaattttagggcttctgtatctcctagttctcttcccagagcatctgctttcctttcacaaaatgaatcttcttcaaagttatcaaatgcgtcaaattccccgggcatgttggctaactccagcacagcgacttctgcatctgccaatgaacgactccaagaaaagcaaacagaatcattgtctaactacattacaaagatgaggcgccgtgatctgaaaattctcgatatactgcagtttatccacggtaccctatggtcatatctttttaatcacgtaagtgatgatttggttaaatcttcagaacgtgacaatgaatatatgatagtagataacttccccactttaacccaatttatcccaggtgagaacgtttcttgtgagtacttcgtttgcggcattatcaaaggattccttttcaatgctggatttccatgtggcgtgacagcacatcgaatgccccaaggcggacatagtcaacgaaccgtttatttgatccaatttgacaggcaagtgcttgacagggaaggtttgagatttggctga

SEQ ID NO: 1738 - DNA, 852 bp, Saccharomyces cerevisiae
atgtctcctccagtttacagcgatatctccagaaatatcaatgacctattgaacaaggatttctatcatgctaccccagctgcctttgatgtgcaaacaacaaccgccaatggcattaagttctcattgaaggctaaacagcctgtcaaagacggtccactgtctactaacgtggaagcaaagttgaatgacaagcaaaccggcttgggtctaactcaaggctggtctaacacaaacaacttgcaaaccaaattagagtttgccaacttgacccctggtctaaagaacgaattgatcacttctttgactccaggcgtcgccaagtccgccgtcttaaacactacgttcacacaacctttcttcaccgcaagaggtgcctttgacttgtgtttgaagtcaccaacatttgttggtgacttaactatggcccacgaaggtattgttggtggcgcagagtttggttacgatatcagcgccggttccatttctcgttatgccatggctttaagttatttcgccaaagactactccttgggcgctacattgaacaacgagcaaataactaccgttgacttcttccaaaacgtcaacgcctttttacaggtcggtgctaaggctacaatgaactgcaaactacctaactccaatgtcaacatcgaattcgccactagatatttgcctgatgcatcttcccaagttaaggctaaggtgtccgattccggtattgtcactttggcttacaagcaattgttaagacctggcgtcactctgggtgtcggttcctctttcgatgctttgaagttgtctgaacctgttcacaagctaggttggtctttgtccttcgacgcttga

SEQ ID NO: 1739 - DNA, 852 bp, Saccharomyces cerevisiae
atgtctgaatcatctatttcttcttctaaaccatctgtggaattgccacaagcaacctggtcgcatctgcaaagatacccagctttatccaagtttattaaatatgcggaatctctgccacctgtggagagattgatttccttcaacctcgttgttttgggatctgtgaaccagtgggtttccgaatcgtccagctctcctcgtctggtgaagcaagttgttgctgctgggaaggaaggggccttcaagttggacgagttagttaacctcttggtgttcaaggagggtgtcgacggcttgctgtacaattggaaatcacattccaacacgccagggatctggctggtgtggttcttcgtcgactacgtcgccaacatttctaatactctgttgagggagttcctgatcaagccattgcacttgcaaggttctaccgcatcgaaggagatcggctcttccggtgaggagaacaaggtcactgatgcttcttctttgccccacgtggcagagttgtcttcaacgaccagaggtatgtcgcaggagatccagtccaaggtcaagtcgaactatatcgacccaaccaaggacctggctaaagaaaagtacgacgccatagtgaagcccacaactgacaagttgcagtctgtgtacatcgacccaacaaagactaagcttaacgaaacctaccaacgcttcaccactgtctatgaaaacaatctaagtaaatctgaaagcgtccctaaagccattgtatccaccgggttggacttgggcaatgccaccattgagaagctaaaggcctcaagagaagaccaaaccaattctaagcccgcggctgtgtcgaccaattag

SEQ ID NO: 1740 - DNA, 852 bp, Saccharomyces cerevisiae
atgtctgacaaggaacaaacgagcggaaacacagatttggagaatgcaccagcaggatactatagttcccatgataacgacgttaatggcgttgcagaagatgaacgtccatctcatgattcgttgggcaagatttacactggaggtgataacaatgaatatatctatattgggcgtcaaaagtttttgaagagcgacttataccaagcctttggtggtaccttgaatccagggttagctcctgctccagtgcacaaatttgctaatcctgcgcccttaggtctttcagccttcgcgttgacgacatttgtgctgtccatgttcaatgcgagagcgcaagggatcactgttcctaatgttgtcgtcggttgtgctatgttttatggtggtttggtgcaattgattgctggtatttgggagatagctttggaaaatacttttggtggtaccgcattatgttcttacggtgggttttggttgagtttcgctgcaatttacattccttggtttggtatcttggaagcttacgaagacaatgaatctgatttgaataatgctttaggattttatttgttggggtgggccatctttacgtttggtttaaccgtttgtaccatgaaatccactgttatgttctttttgttgttcttcttactagcattaactttcctactgttgtctattggtcactttgctaatagacttggtgtcacaagagctggtggtgtcctgggagttgttgttgctttcattgcttggtacaacgcatatgcaggtgttgctacaaagcagaattcatatgtactggctcgtccattcccattaccatctactgaaagggtaatcttttaa

SEQ ID NO: 1741 - DNA, 852 bp, Saccharomyces cerevisiae
atgttactaaagtgtgtttgcagagccggcataatatctatcaaaggaatctttcctcgatggtactccaattctcaaaaagtggccaatttggggcaaataacagattatttagtggttaaaggtgttcccaatttgttacaaaaaatgttcaaggagtcagtgttggcggataacgttgtttttagactatttccaacatcgcatccatatattccagtgttacatggaaaatcaaaatacatggcttctttgaatgcaatgcgaatgatagtacgaaagtttatcttgggcgatgaatgtcgcttgcatataagttcagtaaagactctaacatcgacatcgcatgatgaagaagttaaatctgctcttcagagttataataccataacatgtaatgacaaattggtgatcaaatggcaaagctgcataccggaagaccattgcaagattaccaaattagaaattaatgacagattgaaagaggagaaacgaggcaatggtgcaggcggttcattttcaatgaggtcggtaccagtcatagactacattttacatcctacagccaataatttgaaccaaagtgttatctctgagtaccttgaaaatgcagctgaaaggtcaatggaaaataaggtcaacgaaactcaaaattccaaagaagatgagaagaagaaaaatgatggcgacggtaaaagaagtaaaaaaaagagattatcccggctgattaagggaacattcatattcgaatttaacgaagaaaattcgaaaattctggttcataccattgaagatgttgaactgatccattacgagaagaaaattgccactcgcggtgcatttgcatgttaa

SEQ ID NO: 1742 - DNA, 854 bp, Saccharomyces cerevisiae
atggtatgtttgagatgaacaaaataataaagactgacaactgcagaacagagaggatcatagcaacctagtgcaagaaagagcctcgaagcgttaaacttttggaacgtaattcatccgttggctatgtctattcaatacagttagaatacgaaagctgtaatcaagtatatcggattattcgcaagcaaagaatcaaggaaaagaaagtgaaaatagcatacatctttaaattcagaggttttgctgaattttaatagggaagtttacgttatgattgttggccgtagatcgcctagcgtttgaccaaatttaattctcctaatttttttattgtaaaaaagccttccaacgaaataaattagttattggttttttttctctgttacgagggatatatgatgcctgtgcttgttagttcattataagtgctaataaaatactaacgttaataaaaatttggaatattatttcattttttatcctattaataggccggtgttaaagcttacgaactaagaaccaaatccaaggaacaattggcttctcaattggttgacttgaaaaaggagttggctgaattgaaggtccaaaagttgtccagaccatctttgccaaagatcaagaccgtcagaaagagtatcgcctgtgtcttgaccgtcatcaacgaacaacaaagagaagctgttagacaattatacaagggtaagaagtaccaaccaaaggacttgagagccaagaagaccagagctttgagaagagctttgaccaaattcgaagcttcccaagttaccgaaaagcaaagaaagaagcaaatcgctttcccacaaagaaagtacgctattaaggcttaa

SEQ ID NO: 1743 - DNA, 855 bp, Saccharomyces cerevisiae
atgctttactccagagaatcaaggacaaccgtccttttccttgcgttggttacctccctaaccgtactttgtcactcggtcgatgtaacaactgtatttactacgtcaacaatcaccgaaatcacaactgtgactgccgcaccgcaaccacaaaacaaagcggaaaccgctttgaatactgctactaacataattcaaaccatgcagtttcttttcaactgcgcaccatttaagtggaagggtcctttgaaaataacttcttgtgcgctgaactttattgtcctactactcaccgcttggggctatcttctgaagtatctgcaggaaaataagctgaatagcgatgctgatatggaaaaaatggtaggactgggatttggggaaatggtcggcagaatcttcggaaagggtgtcgggaaagcttttactaaaatggatatcactcagaaactagtgtacccgttcgaaggaagcaaccggcagaaatgtctactcatgaccgtcggagaaaactcgatagtgccattccacgatttgtttacagagatatgctttgaccagtacactctggactcgctatcccaccacaaccatgggagtatttcgattttagatgctggatcagtgagcgccttggggttcgcggatatttcatcgaaaatgccctctgtaagcgaactatacacactttttggagattatacgatagaagtactgggcggcatcactaaactggcttcaactcttaacagagaggactggcagggggaaagaaacgggttcgcggttttatcgagagaccggcctaaccagacgttactaagcgtccatatgtactcttcaagcttgctatag

SEQ ID NO: 1744 - DNA, 855 bp, Saccharomyces cerevisiae
atgaatactttttttctttccttgctaagtggcgccgctgctggtacctctacggatttggtttttttccctatagacacaattaaaaccaggcttcaagctaagggtggattctttgctaatggaggatacaaaggcatatatcgtggtttgggaagcgctgttgtagcatcggcgccaggtgcttcacttttctttattagttatgattatatgaaagtaaaatcaaggccatatatcagcaaactttactcacagggatctgagcaattgattgatacgacaacgcacatgctttcctcttccattggtgaaatttgtgcttgtcttgttcgagttcccgcagaagtcgttaagcaaaggacgcaagttcactctaccaattcttcctggcagactttacagtcaattctacgaaatgacaataaggaaggtttaaggaaaaatctttatagagggtggtctaccaccattatgagagaaataccgtttacttgtatacagtttcctttatacgagtatctaaaaaagacttgggcaaaagccaatggccaaagtcaagtggagccatggaaaggggctatctgcggttctattgcgggtgggatcgcagcagctacaacgacaccattagatttcttgaaaaccagattaatgctcaacaaaacaaccgcctcacttggaagcgttattattaggatttacagagaggaaggtcctgctgtatttttcagtggagtggggccccggacaatgtggatcagtgcaggtggtgctatcttcctaggcatgtatgaaactgttcattcgttattatcgaaaagtttcccaacggctggagaaatgagagcgtaa

SEQ ID NO: 1745 - DNA, 855 bp, Saccharomyces cerevisiae
atgacaggatctttaaacagacactcacttttgaacggggtaaaaaaaatgagaataatattatgcgatacaaacgaagtagttaccaatctctggcaggaatctataccccatgcatatattcaaaatgataagtatctttgtattcatcatgggcaccttcaatctcttatggattcaatgcgtaaaggtgatgcaatccatcatggccactcttacgcaattgtttcacctggtaactcgtatggctatcttggaggagggttcgataaagctttgtataattatttcgggggaaagccctttgaaacatggttcaggaatcagcttggaggaagatatcacacggtcggatctgctacagtggttgacctacagcgatgtcttgaagagaaaacaattgaatgtagagatggtattaggtatattattcatgttccgaccgttgtagccccatcagctcctatatttaatccgcagaatcccctcaagacagggtttgaaccggttttcaacgccatgtggaatgccttgatgcattctccaaaagacattgatggtcttattattcctggattatgtactgggtatgcaggtgtaccacccattatcagttgcaagagtatggcctttgcgttaagactatatatggcgggagatcacataagcaaagaattgaaaaatgtgctgatcatgtattatttgcaatatccgtttgaaccttttttcccggaaagttgcaaaatagagtgccaaaaactaggaatagatatcgaaatgctgaaatcctttaatgtagaaaaagatgcaatagaattgctcattcctagaaggattttgaccttggatttataa

SEQ ID NO: 1746 - DNA, 855 bp, Saccharomyces cerevisiae
atgactccttccaccccaccaaggtccagagggactaggtaccttgcgcagcctagtggcaatactagttctagtgccctaatgcaaggtcaaaagaccccccaaaagccttcacagaacctagtccctgtcactccctcaacaactaagtcttttaaaaatgcgccattattagcacctcccaattcgaacatgggtatgacctctccatttaatgggcttacgtctcctcaacgctcgccgtttccaaaatcttcagtgaagaggacactattccaatttgaaagtcatgataatggaacagtaagggaagagcaggaaccattgggtcgtgtaaataggatattgtttcccacgcagcaaaatgtggatatagatgcagcagaagaagaagaagaaggagaagttcttcttccccccagcagacctacatctgccaggcagttacatttatcacttgaaagagatgagtttgatcagacacatagaaagaagattattaaagatgtacctggtacgcccagcgacaaggtgataacatttgaattggcaaaaaattggaacaacaactctccgaaaaatgacgccaggagtcaagaaagtgaagacgaggaagacatcatcatcaatccagtgcgggtgggtaaaaatccctttgcatcagatgaactggtcactcaggaaattagaaatgaacgtaaaagggcaatgttgagagaaaacccagatatagaagacgtaataacatatgtcaataagaagggagaggtggtagagaaacgaaggttaacggatgaagaaaagagaagattcaagccaaaggcattgtttcaatctagggatcaagagcattga

SEQ ID NO: 1747 - DNA, 855 bp, Saccharomyces cerevisiae
atgatagcggattcatcagttttgaaaaagcacacagcaatcaagagaagtacgagaataatatcgctaacactcgttttgcttggcgtatttagcttcttactacttacatggaatgactccttggaattctacaactctgctgaccctagcgaaaacaaaaaaaatagtgaggaagaaagtgaaaagaagttcgtttacaagttgccaaacttattaaagacagcagacagttttctaagtaatgaaaatgaactaaatttccaaaaagtcaaagaagaaatttcaaatattcaaagcgaggttgaagtcgacatcccagaaccctcatccaaagctacatcaaaattttcttcaagatcgttccaaactgataatgtcgtgacggcgacgaccacaacaacactaaatccacggtcatcttctctggccttgcagaaaaactgcgatcacaaaaaattcgaccctagaacagattttctagatataataagaacctctccagcggtattattcattaaatcatcacaagcagactccattttcttaaaaaatctattacaaagagaatttgagatttcacccgaattggccactgttgatttggaaaaacactctcatggctatgaattagaaaagtatatcaaacaaaataaactaaatatcgatactagtgctgccttggaatccattcagtcgccttatttatttttgaatggtatttccgtgataaatcgtggaatggtgagagatataatcgaacctcattcgaagggattgctactacctcttctaaagtctgaagcgcgtggcaacttgctggtagaaaaaaaagacatcccttctaattcttaa

SEQ ID NO: 1748 - DNA, 855 bp, Saccharomyces cerevisiae
atggctattgatgctcaaaagcttgtggtggtcatcgtgatcgtggtcgtgcctttgctcttcaagttcattatcggaccgaagaccaagcctgtgctggatcccaaaaggaatgacttccaatcatttccgctggttgaaaaaaccatcttaacgcataatacttcgatgtacaagttcgggctacctcatgctgacgacgtactcggtttaccaattggtcagcatatcgtaattaaggccaatatcaatggtaaggatattaccagatcgtatacgcccacatcgttggatggagatacaaagggaaactttgaattactagtgaagtcttaccccacaggtaacgtttctaagatgattggagagttgaagataggtgactcgatccagatcaagggccctcgtgggaactatcattatgagagaaactgccgttcccatctagggatgattgctggtggtactggtattgcgcccatgtatcagatcatgaaagctattgccatggaccctcacgacactaccaaggtctctctagtctttgggaacgtccatgaggaggatattctgttgaagaaggaactggaagcgttggtggccatgaagccttcccaatttaagatagtttactacttagactctcctgaccgtgaagactggactggtggtgtaggatacattaccaaggatgtcatcaaggaacacttgcccgctgctacaatggacaacgttcaaattttgatctgtggtcctccagccatggttgcctcagttagaagaagtaccgtggacttggggttcagacgttccaaaccgctttccaagatggaagaccaggtgtttgtgttttaa

SEQ ID NO: 1749 - DNA, 855 bp, Saccharomyces cerevisiae
atgtcgaatactattgtgatagtctatttgggagctaacagaatcgaaattggaagaagtgctgatgcgtgtccacaagaaattatcgcctggaaaacaggtagtattaatgaaaaaaatagggaagaattgaaaaaaatatttgaacattacttccaaatttgcaacatcttgggaaatcgagaagtacaagtgttgatactagaagatatcttcatttctgtagtagagaaaagaattatttgtagcatcttgtttaaggaatttgactgcgctcacgtttcgtttgtccccagggccattgtgcactgcttatcctgtaatacaaggaatgccatagttatagatataggtaccaattatactacatgcgtacctattttcgaccttagacctttgcaacagttcataaaatactcaaaacgaggcaaaagacaggttgagtcaagaattcctctcccgggcagtctctacatgccaatattttttgacgaagaatacaactctaaaaattgtgaagtagatgaaaccccggtaataaatcttgtcaaaaatattgtagagtcacttcctatcgacttgagaaggccactgagagaaaatatcattatagtaaacattgaagaggcgtatgaaacagtaataaggaatttattcaagttaaaaatggatacgtccaaaatccagtttcctaaaaattactggcaggctggttctgcatgcgcgaaaatacttctgcactataaggggagcaacattgtaggaatagaaagagatgagttttataacaatcctcatattgctcctgattggtttgattattacttcagaactggagtgaagcgcttacaatag

SEQ ID NO: 1750 - DNA, 855 bp, Saccharomyces cerevisiae
atgtctgtccaagatactaaagcggtagagttttctatgggtcacatcagatcatcctctgtatccctggtagcagaggctacttcaaacacgaatagtgaagacaaattatctaaggtccaactctacgaagatttgtgccggtacgaggatacattgagtaagttggtggaatctgtagatcgtttcaaaccaaaccttgatattgccaaggatttgatcagaactgatgaggccttgtttgaaaacgtcaaactgttagctgaatatgacaatatctaccgcaacttacagaagattgacaaagactctgaagaactagattctaaaaccaggaagatattggaaattctaaatgaatgtcatgacgagttaaaagcactaccgatgcttgaacaagtagagttcgagaaaaacacaattttacagcaaagatcgaaaatcaattcgacagagttgttggattatgccaccaaactctccaagtttaccaaaataccaccaacgttcgacaagggagctgtgggacccaacaattttatatggcccgcagaggatgccctacgaagaggaatgcttgctatggcctcattacatagtaaagagctaactagaatacccggtgaagaagtagaagaaacagaagtaccgaccgtaccgccatctcaaagtgaagaacaaaaagggcagatggccaagaaagaaggtacaccaaagacagactcgtttatatttgatggtactgctaaagaagttggtgatgaggcagacaataccaaagataaagaaaaggaagaaaataatgatgatgccctagatcttgatcttgatctgtttgatccggacgacttctag

SEQ ID NO: 1751 - DNA, 855 bp, Saccharomyces cerevisiae
atgttgtggaaagtttctaagatgttcttgggtggcttggtagcgctaacaacaatatcggttgcgaccctttatcactaccaaaatcgcctagtctacccatcatgggctcaaggcgccaggaatcatgttgacactcctgattcccgtggaatcccttatgaaaagctaaccctaattacacaagaccacattaaactcgaggcatgggatatcaagaatgaaaactcaacaagtactgtgttgatcttatgtcccaatgccggtaatattggatactttatactaataattgacattttctatcgtcagtttggaatgagtgtatttatttattcgtatcgtggttatggtaactcagaaggttcacccagcgaaaagggtttgaaattggacgctgattgtgtcatatcgcatttgtcaacggattctttccattcaaagagaaaactagtattgtatggtagatctctaggtggtgctaatgctctttacattgcttcaaaatttcgggatctatgcgatggcgttatactggagaatacatttttgagtattcgaaaagttatcccatatattttcccccttttgaaacgctttacgcttttatgtcacgaaatctggaattcagaaggccttatgggaagctgtagttcagagacgccattcttgtttttaagtggattaaaagatgaaatcgttccacccttccacatgaggaaactgtacgaaacatgtcctagttcgaacaaaaagattttcgaatttccacttggttcacacaatgatactattattcaagatgggtactgggatataataagagattttctaatagagaagggttttatctaa

SEQ ID NO: 1752 - DNA, 858 bp, Saccharomyces cerevisiae
atgaaaatcaatgtatcccgtccattacagtttttacaatggagttcatatattgttgttgcatttctgatacaattgctaatcattcttcctttatcgatcttaatatatcacgatttttacctaagactattacctgccgattcctctaacgtagtcccccttaatacgttcaacattttaaatggcgtacaatttggtacaaaattcttccaatctattaaaagcattccggtaggtacagatctgccgcaaacaatagacaatggcttatcacagttaatccccatgcgtgacaacatggaatacaagctcgatctaaacctacagctttattgccagagcaaaactgaccatttaaatttagacaatttgttaattgatgtttacagaggtccaggcccgctattgggtgctcctggaggaagtaacagcaaagatgaaaaaatctttcacacttctagacctattgtctgcctcgcactgacggattccatgtcgcctcaggagatcgaacaactaggcccatcacgtctagacgtttacgatgaagaatggctaaatacaataagaatagaggacaaaatatcgttagagtcttcatatgaaacaatctcggtgttcttgaaaacggagattgcccaaagaaatctaataatacatccagaaagtgggattaagtttaggatgaattttgagcagggattaagaaacttgatgcttcgaaaaagatttttatcttatattattggcatttcaattttccattgcataatatgtgtacttttttttatcacaggttgcactgcattcatttttgttagaaagggtcaggaaaaatccaagaaacatagctga

SEQ ID NO: 1753 - DNA, 858 bp, Saccharomyces cerevisiae
atgaagtttttactgcagcaaataagaaatatgcatgttaagcctataaaaatgcgatggttgacaggtggtgtcaattatagttatttactaagcactgaagacaggagaaactcatggctgattgaccctgcagaaccacttgaggtgtcgccaaaattaagcgccgaagagaaaaaaagtattgatgctattgtcaatacacatcaccattatgaccattcgggggggaacctagcgctttatagtatcttgtgccaagaaaactcaggtcacgatattaaaataattggtggatctaagtcctccccgggtgtcactgaagtacccgataatttgcagcagtatcacttgggtaacttaagagtaacatgtattaggactccatgccatacaaaagattccatatgctattatatcaaagatttagaaacaggtgagcagtgcatcttcacaggcgacactttattcattgccggttgtgggaggtttttcgagggcacaggaagagatatggacatggccttaaaccagataatgttaagggctgttggtgagacgaactggaataaggttaaaatataccctggtcatgagtacaccaaaggcaatgttagctttatcagagcaaaaatctattccgatatagggcagaacaaggagtttgatgcgttggaacagtattgcaaatctaacgagtgcaccaccggtcacttcaccctgagagatgaactaggttataacccattcatgagattggatgatcgtgccgttagactagcagtcggcgatactgctgggacttatcccagatccgtagtgatgcaagagttaagaaagcttaaaaacgctatgtaa

SEQ ID NO: 1754 - DNA, 858 bp, Saccharomyces cerevisiae
atgcgttcttcggtatatagtgagaacacttacaactgtatacgaacatcgaaggagcacctaacagaaagaaggagggtcgccatggcgccaatgttccaacatttcttaaacttatgcgtggaaaaatttcctgaatccatcgagcacaaggatacagatggaaacggtaacttcaccaccgctattttagaaagggagattatctacatccccgaagatgacactgacagtattgacagcgttgacagcctcaagtgtataaactacaagctgcacaaatctcgcggcgaccaagtgctggacgcctgtgtgcaattgatagacaagcacctgggcgccaagtatcgccgggcctcgcgcattatgtacggcaacaggaaaccatggaaggcaaacaaactcgcagagatgaaaagcgccggccttgtgtatgtctgttactgggacaacggcgtgctaggtgcatttacttcattcatgcttacagaggagacgggtctcgtcgaaggtgacgctttacacgaggttagcgtgcccgtgatatacctttacgaagtacatgtagctagcgcgcaccgcgggcatggaatcggtcggcggctactggagcatgcactgtgcgatggcgtagctcgacacacccgccgcatgtgcgacaatttcttcggtgtagcactcaccgtattcagtgataacactcgggcccggcgactatatgaggcgcttgggttctaccgcgctccgggatcacccgcaccagcatcacccacaattcgtcacacgcgacatggtgggggacgtgtagtcgtgccctgcgatccgctttattacgtatattgccttcacatgccgtga

SEQ ID NO: 1755 - DNA, 858 bp, Saccharomyces cerevisiae
atgctatccgtagtagcgatcccgaaaatatgtgtcacaggtcctgcaagaagatgcttttttcatactgcaaaaaaactatacgcagatgactataaaccagcagctatgtcctccaatgcaccttcgctaacaaaagaccaagccaaaaaaagagagttgaaaagattggtacaacgaaaggccgaggcaaagagaccagctacagcaagcccattgtacatgcctgttacaaaggcactaagatatttacgcgcagcagaagttggcagaccgcaatcgcaacagacaattaatttgactacattggtagtcggtgaaagaggtacagcgcctttatccggtagcgtgacatttcctaagcctttgagatatatcaaaattgctgcctttaccaacgacgaaagtaaattggaagagcttcgtgagaaatacccaaatcatttgattggcggagcagatcttgttgccaaaattaaaagcggtgaaattagcgttgattttgacaaagcatttgcaactcctgatattgttccagctttacaatcgcaggtggccaggatacttggtcctcgtggggttttaccctctgtcaaaaaaggtacggtgagtgatgatataagctccttacttcaagaaagtctaggatctatgcctttcaggcaaaggggaaactctatcagcattggagtcggcaaatgctacttcactgatcgagaaattttacaaaacattatatccgctagagcggcatttaaaactgctgttgataatcaaaaatctaagaaaccaaatatactgagtaaaaccacattatcaagcacacatggccccggtattgtaatcgattttgcttaa

SEQ ID NO: 1756 - DNA, 858 bp, Saccharomyces cerevisiae
atggagctaagttcaccatcaaaaaaaaccacaacatcgccaataaatataccaggggggaatagagataacctaataatcggaccacattctcacagcttcaagaccgatccattttcaagtaacaatagtagtttgctgtccaaaatatctactaaccccagtttggaaagccctttctcttcgaaatctttactagattgttctcctgtacaagctgtaaagaagtctttagagtcggaagcaaaaacgcatagcctggacgaggagacaaatgaacagactgatgtaaagatcttaaacatagcagactttcccacagatgaactcatactaatgataagtgcgctactcaacagaattataacagcaaacgatgaaactacagatgtctcacaacaagtgtcggatgagaccgaagacgaactcttaactccaatccttgctttctatggaaagaatgttccagagatagctgttgttcagtacttagagagaattcaaaagtactgtcccaccacaaatgatatttttctttctctccttgtatatttcgatagaatctccaaaaattatgggcattcttctgagcgtaatggttgcgcaaagcaattattcgtcatggactccgggaacattcatagattgctcataacaggtgtcacaatttgcacgaagttcttgagtgattttttttacagtaactctcgatacgccaaggttggaggtatttctttgcaagagttaaaccatttagaattacaattcctgatactatgtgatttcaagttattggtttcagtcgaagaaatgcagaaatatgcaaacttgttatataaattctggaacgaccagtag

SEQ ID NO: 1757 - DNA, 858 bp, Saccharomyces cerevisiae
atggatgctgatgaattggaattgaaaggtcatttgaaaaaattgaaaaaagaagaattgcttagaaggaaacagttaaaagagagtaatcttcagaaaagagagcttgaatataataatgcctcaaaaaatacttcaatatatatttctggtcttcccacagacaaaacaacgaaagaaggactcactgagcagttttgcaagtatggaatgataagaaccaatcgagatggggaacccctttgcaagctatatgtgaatgataaaggcgctttcaaaggggatgccttgatcacttattccaaggaagaaagtgttacattagcaatcgaaatgatgaacgagtcgatcttcctgggaaaacagatcagggtcgaaagagcccaatttcaaaacaaggaaggtgacaatatgcacgggaaagaaaatgatttaaaggagttcaacggacctgagcctccaataaagaggctaaaaaaagcgaagtctgaaggggagggggaagtaatagattacaatgacgatgaaagcctagcaaaagctgatcgaacggtgatatttgccaacgtattcaatatttacaaatcatacacaaatgatgatataaatgatattcaggaagatcttttggaaggctgtgaagagataggtcaagtagacagtatatctgtatctcccaataagggggaagcgacggtcgtctttaagaacaataaagttgcattgcaatgttgcaaaatcatgaccggacgttattttgatgggcaaaagttgcttgctttcatttctggagatgagaacacttcaagcacaagtgacaagaatgaggacagcgaagtggaagatgaccttatatag

SEQ ID NO: 1758 - DNA, 858 bp, Saccharomyces cerevisiae
atgtcctccgatttagctgctgagttaggattcgaccctgcactaaagaagaaaaagaagactaagaaggtgatcccagatgattttgatgctgccgtaaacggcaaagaaaatggttcaggagatgatttatttgccggattaaaaaagaaaaagaagaagtccaagagcgtttctgccgatgctgaagctgaaaaagagcctactgacgacatagcagaagccttgggtgaactatccttgaagaagaaaaagaaaaagacaaaggacagcagtgtagacgcgtttgagaaagaactagctaaagctggtctagataatgtggatgctgaaagcaaagaaggcactccaagtgctaattccagcattcaacaagaagttggcctaccttattcagagttattatctagatttttcaatattctaagaactaacaatccagaacttgctggtgatagaagtggtccaaagttcagaattcctcctcctgtttgtttgcgtgatggtaagaagactattttctcgaatatccaagatatcgccgaaaaattgcatagatctccggaacatttgattcaatatctcttcgcagaattaggtacgtccggttctgttgacggtcagaaaagattagtcattaagggtaagtttcaatccaaacaaatggagaatgtcttaagaagatacattttggagtatgtcacttgtaaaacttgtaagagtattaacaccgaattgaagagagaacagtcaaacagactgttctttatggtctgtaaaagttgtggttctaccagatccgtctcttctattaaaaccggtttccaagctaccgttggtaagagaaggagaatgtga

SEQ ID NO: 1759 - DNA, 858 bp, Saccharomyces cerevisiae
atgtctgaattaacagaggcggaaaagcgcaggttactaagggaaaggagacagaagaagtttagcaatggaggtgccagctccaggcttaataaaatcaccgggcaggcaagcagtcatttgaacgcagaatcacctttagacgctcctagcgctgcaaagaccacaccacctgcgagtgtgcattcggctactccagatatcaaagaagatagcaacgtagcgccccaattggacctattgaaacagctcgctgccatgcaaggccaaggtacgggtaaaagtacccctcaggactcctctacgcccgatctactctcactactaagttctatgaacactggcatgcccagtgcagagggtacaccatcgtttggtcaagcggctcctgcagccccgatcaatcaagctgctttggactaccatgattacttgctgaacagactgaaagcctggaccattcttgtgaagtgggtctttttcctactaccctatctatacctaatcacaagaccaaattcctctgtgtggccggcctatgcatttactcaatcagcttggtttgcacctttgcggaacccatcgaatttcactagaatttttgccacgtttgagttcctttccatatccatctactaccagctattgaagaatgtggaacacaagagcaagattaaaaatttacaagataccaataaacttgtcaagttagtttcactggtgcccgagggagtaattcccgtcgccaacctgaaggggaagctaattacccttttgcaatactgggatctattgtccatgctaatcactgacatttcgtttgtgctaattgtcttaggcttattgacgtacttataa

SEQ ID NO: 1760 - DNA, 858 bp, Saccharomyces cerevisiae
atgtgggctcaattatcatatactagaccagaatctcagaagactgacttaacgtcgttgttttccacagatcaagagcaaaatccattaaatgactaccagtaccagatcaatattagggaactggaggagtattacaacaagacgattttaaacgaggataacatacaggaaacaagcagtgaaatatcttcggcagtttcattctctccaccaaaaaatacaaacgctattcaaccggggctactgtatgatccacagttaatgaacccttttctcccatccgctcacctgaatagcacggcacctactacttttaaaaagaaactagaggtacaaataaatccggactatgtcccaaaatcttcacaattaccattaacttcacagaatttgcaacagttgtctcaacaaaagcccaaaaatgatgcttctttttcatcagagaaggaatcctcagctcaacctaaggtgaaaagccaagtgcaggaaactcccaaacaattatacaagacagagctgtgcgaatcattcactttaaaaggaagttgcccttatggcagtaagtgtcagtttgctcacggactcggcgaattaaaggttaagaaatcgtgcaagaatttcaggacgaagccctgtgtgaattgggagaaactaggttattgtccttatggcagaagatgctgcttcaaacatggcgacgacaacgacattgctgtttacgtgaaagctggtacttactgtaacgtctcttcgactagcaaacaatcagacgaaaagagaagcaatggtcgcggctccgccaagaagaagaatctaaatgttaaagtaaaggctttgcagagaatgacctggtga

SEQ ID NO: 1761 - DNA, 858 bp, Saccharomyces cerevisiae
atgtgttcttttcaggttccatctgcattttcttttaactacacctcgtactgttataaacgccaccaagcaagatattacacagcagcaaaactttttcaggaaatgcctgttattgaaattaacgatcaagagcaatttacttacctaactaccactgcggccggcgacaagttaatcgtgctttatttccataccagttgggcagaaccatgcaaagcattaaagcaggtttttgaggccattagtaatgagccttccaattccaacgtctctttcttatccattgatgcggacgaaaactcggaaatttcagaactttttgaaatctcagctgttccatattttatcataattcacaaagggacaatcttaaaagaattatccggcgcggatccaaaggagtatgtgtctttattagaagactgcaagaactcagtcaattccggatcatcacaaactcatactatggaaaatgcaaacgtaaatgaggggagtcataatgatgaagacgatgacgacgaagaagaggaagaagaaactgaggagcaaataaacgctagattgactaaattggtcaatgccgcgccggtaatgttatttatgaaggggagcccctctgaacctaaatgcgggttttcgagacaacttgtgggtatcttgagagaacatcaagtaagatttggcttctttgatatattaagagacgaatctgttagacaaaacttgaaaaagttttctgaatggccaactttccctcaactttatataaatggggagtttcaaggcggtttagacattatcaaggaatccttggaggaagaccctgattttttgcagcatgctctccaatcttaa

SEQ ID NO: 1762 - DNA, 861 bp, Saccharomyces cerevisiae
atgaaagccaagccactaagccaagatccaggctccaagcgttacgcataccgtataaataaggaagaaaatcgtaaggagttgaagcatgtaaagatcaatgaaagttctttggtgcaagaaggccaaaagatcgacttgccaaagaagagatattatcgtcaaagggcgcattccaacccattttcagatcaccagttagagtacccagtatctccccaggatatggattggtccaaattgtacccttactacaaaaacgcggaaaatggacaaatgacaaagaaggtgacgattgctgatattggctgtggattcggtgggttgatgatagatttatcaccagccttccctgaagatcttatcttagggatggaaattcgtgtgcaggttacaaattacgtggaggatagaattattgccttaaggaacaatacagcttcaaaacatggatttcaaaacattaatgtcttgagaggtaacgctatgaaattcttgcccaacttttttgaaaagggccagctttctaaaatgtttttttgtttccccgatcctcatttcaaacaaagaaagcataaggcaagaattatcactaacaccttgctgagtgagtacgcatatgttttgaaagagggcggtgtcgtgtacacaattacagacgtcaaagacctgcatgagtggatggtaaaacatttagaagagcatcctttatttgaacggttgagcaaagaatgggaagaaaacgatgaatgtgtgaaaataatgagaaatgccacagaagaaggtaaaaaagtggaaagaaagaagggtgacaagttcgtcgcttgtttcacaagattaccaacgccagccatattgtaa

SEQ ID NO: 1763 - DNA, 861 bp, Saccharomyces cerevisiae
atgacttacacattggcaattttaggctgcggtgttatgggccaagcacttctttccgccatttataatgctccaaaggcggctgatgaaactgctgctgcattttacccttccaaaattatcacatgtaaccatgatgaacctagtgcacaacaagttaccgatctagttgagacattcgacgaatctcctaacggtattaaagtcgaaagcacttacggtcacaacgtgagcgctgtcgaagaagcttctgtagttcttcttggtaccaagccatttttggccgaagaagtgttgaatggtgtgaagagcgtcattgggggaaagctacttatttccctggctgctggctggacaattgaccaattgagtcaatacactagcactgtttgccgtgttatgacgaacacacctgccaagtacggatatggttgtgcggtggtgtcctactcagctgatgtttccaaagagcaaaagccactggtcaacgaattgattagccaagttggtaaatacgttgagcttccagaaaagaacatggatgctgctacggctttagtcggttcaggccccgcttttgttctcttgatgttagaatccttgatggagagtgggttgaaattgggaatcccattacaagagagtaaggagtgtgccatgaaagttctagaaggaacagtgaagatggttgagaaaagcggtgctcatccatccgttttaaagcatcaagtttgcacaccaggtggtacaactattgccgggttgtgcgtaatggaagaaaagggcgtcaagagcggtattatcaatggtgttgaagaggcagcccgtgttgcgtcacaattaggccaaaagaagaaatag

SEQ ID NO: 1764 - DNA, 861 bp, Saccharomyces cerevisiae
atgcaattcttcaaaacacttgcggccttggtgtcgtgcatatcgttcgtcctcgcttacgtggcacaagatgttcatgtatcattcccctccaccgcaggaaagtctagggtaatgatcggtaaagttgaacccagaataggaatcgatgaaactgttccgactacaatcacagttgaagaccctaacgaggtgattcaagtaaatttcgccattgagtctaccaacaaacccttccagaacaccttattgataggcttacctaataagaacctagaaatggcttttgaacccgaaattaaggacaatggcaagttgtccatgtataaatacaggatagatttagccaagctggatgctgctttgttgcaagaggcttccagatcaccggaaccaataaaggccactttgattctagcgtcatctaccgccaaaccaaaggaaaacttgttcagggaaattctgcaactcaacctgaacttcgatgtagatcactcagattcatctttagttgacaaattcggcattaagccagaaatccatcatatatttcatgccgagccaaagagagttgccaaaccaattgctgtgatttttgttttaattatcttcattaccattttatctttaatagtcacctggttgaattcttgtgccgccgcattcaataacatcccgaccggtgtcactgctgtatatttcctaggattcatcgccacgattgttgggtttgaagttatcttcgctaggtactacttgggtacaagtatttttgaaactctattttcctctttgtacttgggcgctccaggcttactgacatctaccaagttcctgagatcttttggtcaaacaatctag

SEQ ID NO: 1765 - DNA, 861 bp, Saccharomyces cerevisiae
atgcagaatgaaccaatgtttcaggtccaggtggacgaatctgaagacagtgaatggaacgatattttaagagcgaagggtgtaataccagaacgtgcaccttcgcccactgcaaagttagaagaagcattagaagaagcaattgccaagcagcatgaaaatagactagaagataaagacttgtcggatttggaagaactagaagacgatgaagatgaagatttcttggaagcttacaagatcaaaagattaaatgaaatccgcaaattacaggaacgttccaaatttggagaagttttccacattaacaaacctgaatacaacaaagaggttactttggccagtcagggaaagaaatatgaaggtgcacaaaccaatgacaatggtgaagaggatgacggtggtgtctacgtattcgttcatctctcgcttcaaagtaaactacaaagcagaattctgtctcatcttttccaatctgctgcatgcaaattcagagaaataaaatttgtagaaatacctgccaatagagcaattgaaaactatcccgaatccaattgcccgacattaattgtatattaccggggtgaggtaatcaaaaacatgataacgctactagaactgggtggtaataattccaagatggaagactttgaagattttatggtaaaagttggcgctgttgcagaaggagacaacagactgataatgaaccgagacgatgaagaatccagggaagagagaaaattgcattacggtgaaaaaaaatcgatcaggtcaggtattagaggaaaatttaatgtcggcataggtggaaatgatgatggcaacattaatgatgatgatgatggattttttgactaa

SEQ ID NO: 1766 - DNA, 861 bp, Saccharomyces cerevisiae
atggaaacggatagtggtatacctggtcattcatttgtgttaaagtggacaaaaaacatcttttcgcgcacattgcgtgcatctaactgtgtacctagacatgttgggttcatcatggatgggaacaggagattcgctagaaagaaagagatggacgtaaaggagggccacgaggcaggatttgttagtatgagtagaatcttagaactgtgttatgaagcaggagtcgatacggctaccgtgtttgccttttcaattgaaaatttcaagaggagctcacgggaagttgaatcactgatgactttagcgcgcgaaaggatacgacaaatcacagaacgtggagagctggcctgtaagtatggggtacgcattaaaattatcggcgatctctctttgttggataagtctctattagaagatgttcgggttgctgtggaaactacaaagaacaacaaaagggccacgttaaatatctgctttccatatacaggcagggaagaaatcttgcatgccatgaaagaaacaattgttcaacataagaagggcgccgctatagacgaaagcacgttagaatcgcatctctacacggcgggggtaccccctttagatttattgattaggacaagtggcgtttccagattaagtgactttttgatatggcaggcatcgagtaagggcgtacgcatcgaattgctggattgtttatggccagagtttggacctatacggatggcatggattttattaaaattttcgtttcacaaatcctttttaaacaaagagtacagattagaggaaggtgattatgacgaggaaaccaatggggaccccatcgatttgaaagaaaaaaagttgaattaa

SEQ ID NO: 1767 - DNA, 861 bp, Saccharomyces cerevisiae
atggctaagcaatctctaggtatgtttggaggatacgaataacgatagaaaacatgagtgaatttccgtccacgaaaaaatgttaacataaaatgcaagagaacaattaatcgaataatgttaaattattgtaaaacaatgtgtatgatgaggaggaatgtacctaagccaaaaaaaaaaaaaaaaaaaaaaaaaaaaaaagaaacagcttttgcatattcaatccaggcatagggcgactatttagcactcaacgatttttaagcttgtgtattgctgacataaattccggctttagaatccaatattgaaaaacgtgagtacgcagaggagatagaagaaaagtaggaagttaccgtttatattgatttgtgaaatgcatactccgttggatgtggggcaacatagatttaagtgtggatgaaaattatgtgctcattgtgaaaaaaaagttttgcttttactaacaaatttttttattatttgttttcaatagacgtttcctctgacagaagaaaggccagaaaggcttatttcactgctccatcctctgaacgtcgtgttttgttatctgctccattatccaaggaattgagagctcaatatggtatcaaggctttgccaatcagaagagacgatgaagtcttggttgttcgtggttccaagaagggtcaagaaggtaagatttcatctgtttacagattgaagtttgctgttcaagttgacaaggtcaccaaggaaaaggtcaacggtgcttccgttccaattaacttgcacccatccaagcttgttatcactaagttacacttggacaaggacagaaaggctttgatccaaagaaagggtggtaaattggaataa

SEQ ID NO: 1768 - DNA, 861 bp, Saccharomyces cerevisiae
atggctagatacggtgctacttccactaaccctgctaaatccgcttctgctcgtggttcctacttgcgtgtttctttcaagaacaccagagaaactgctcaagctattaacggttgggaattgaccaaggctcaaaaatacttggaacaagttttggaccaccaaagagctattcctttcagaagatttaactcttccatcggtagaactgctcaaggtaaggaatttggtgtcaccaaggctagatggccagctaagtctgttaagttcgttcaaggtttgttgcaaaacgccgctgccaacgctgaagtatgtcaagaatattatatgtttagtaccagatgaaacaagaatgagttgaaattcaaaatgcgcggaaaatccattatgatcaagggaaattgaatatgataaatgaattattcagaaagtcacaattaccagattggaatgaactgtcaagctgaaaagcaactaaggattaccattacgtgtttatgattttgttagaaaaatattgaaaacttgatatttctttccgctagtttcatctttttcaattacttaaccggatcaaaattttttttactaacaacataactatttttattacaggctaaaggtttggatgctactaaattgtacgtttctcatatccaagttaaccaagctccaaagcaaagaagaagaacttacagagctcacggtagaatcaacaagtacgaatcttctccatcccacattgaattagttgtcactgaaaaggaagaagctgtcgccaaggctgctgaaaagaaggtcgttagattgacttctagacaaagaggtagaatcgccgcccaaaagcgtattgctgcttaa

SEQ ID NO: 1769 - DNA, 861 bp, Saccharomyces cerevisiae
atggttattaaagaggactgtatcaataatcttgccaggtggcaggcagacgaggaagctcacagctgttttcaatgcaagacgaacttttcgtttctcgtaagaagacaccattgtaggtgttgtggaaggatattttgttcgtcttgtaccgaaaattttgttaattataataaaaagagagtccatgccttgcagaaaaaaaatagcgacgtggaatcgcctccatatagaacttgtaatgagtgctacgataacctccttcatttaaatctactagtatcctccaccaacagagatgtacgactatcgcaaacttcggtaccaccaaatgcacttgcactttctgcaccagatagcaacactgatgaagacgcggaaatcctggaagattcggtagatcaatccggtacggcatgcaggagcgaagaaagttcacaaaacgaggaggatcacttctgccctatttgtaactcagatctcacacagtttcctgatgaagaagagaccagaaagcacgtagaggattgcatacagagagctgaaaatgcccaacaacatacgaatacgtcagatgcagcagatgactccgtaaaagaaagccctgcctttcaaaatagaatgttagtgtacaagatatcgcctaatacaacagataatgcaattaaggagtgcccgatttgttttgagaatatggaacccggtgagaaagttgggagactagaatgcttgtgtgttttccattataagtgtattaagaactggtttcacaaaagggcgcaaatgactgcagcccagaagggaaatggacatgcttttgttaaaaggaacttttgtcctttccatgatgccgtattttaa

SEQ ID NO: 1770 - DNA, 861 bp, Saccharomyces cerevisiae
atgtcagacatcgaagaaggtacgcctactaataatgggcaacagaaggagagaagaaagatagaaattaagttcatcgagaataaaacaaggcgccatgtgacattttccaaaaggaagcacggtatcatgaaaaaggcgtttgagctttctgttctaacggggacccaggtcctgttgctagtcgtttcagaaacaggtttggtatatactttcagcacgccgaagtttgaacctatagtcacgcagcaggaaggtagaaacctgatccaggcctgtcttaacgcccctgatgatgaggaagaagacgaggaggaagacggtgatgatgatgatgatgatgacgatgatggtaatgatatgcaacgccagcaaccacaacaacagcaaccgcaacaacagcaacaagtattgaatgcacacgcaaatagcttaggccatctaaatcaagatcaggtaccggcaggcgcgctgaaacaagaggtgaagtcacaattgctaggcggtgccaatcctaatcaaaactcaatgattcaacagcagcaacatcacacgcagaattcacaaccacaacagcaacagcaacaacaaccacagcagcaaatgtcacagcaacaaatgtcacagcatcctcgaccacagcaaggaataccacatccgcaacaatcgcagccacagcaacagcaacaacaacaacaacaactgcaacagcagcaacagcagcaacaacaacaacccctcaccggcattcatcagcctcaccaacaggcttttgccaacgctgcctccccctatctgaatgctgaacagaatgctgcctaccaacaatactttcaagaaccgcaacaaggccaatactaa

SEQ ID NO: 1771 - DNA, 861 bp, Saccharomyces cerevisiae
atgtcgaatgcagaggccagcagagtgtacgagattatcgtagagtctgtggtaaatgaagtaagagaggactttgaaaatgcgggtatcgatgaacaaactttacaagacctaaaaaatatttggcaaaaaaagctcacagagacgaaggtaactactttttcatgggacaatcagttcaatgaaggaaatatcaatggtgtacagaacgacttaaatttcaatcttgctacccccggcgtaaattctagcgagttcaatattaaggaggagaataccggtaatgaaggtctaattttgccaaatatcaattccaacaacaacataccgcactctggagagaccaatattaatacgaatacggtagaagcaactaataattcaggtgctaccttgaacacaaatactagtggtaatacaaatgcggacgtaactagccagcctaaaattgaagtaaaaccggaaatagaacttactattaataatgccaatataactaccgtcgaaaacatagatgatgaaagtgagaagaaagacgacgaggaaaaggaggaggacgtggaaaaaacccgcaaggaaaaggagcagatagaacaagtaaaattacaagcgaagaaggaaaaaagaagtgcattattagatacggatgaggtcggttcagaactagatgattccgacgatgactatctaatttcggagggtgaagaggatgggccagatgagaacttaatgctgtgcttatatgataaagtcacaagaacaaaggcgagatggaaatgtagtctgaaagatggtgtggtgaccatcaatagaaatgactacacattccaaaaagctcaagtggaagcggagtgggtataa

SEQ ID NO: 1772 - DNA, 861 bp, Saccharomyces cerevisiae
atgtcgattgttggaaggaatgctattctgaatctaagaatttcactatgtcctctgtttatgggcaaaagatcgtttgtatcctctccggttagcaatagtgcaaaagctgtgaaattcttaaaggctcaaagacgaaaacagaaaaatgaagccaaacaagccactttgaaagcgtcaaccgataaggttgatccagttctgggccgggcggacactccctttataacacgtattatggcagagttaaaagagcctttagttctatcgaaaggttataatattgaagaggtagacaagttccttgcagccattgagtctgctaagcgtgaaagagctgagttgtcaggtttaaatacagaagttgtgggtattgaagacatagaaaaactggaagacagacgtgaagccatcttgagaatattgagcatgaggaactccgagaataaaaatgccattaaaatggctgtagaactcgcacgtaaggaatttgagaggttcccaggcgatactggctccagtgaagtccaagcagcttgcatgactgttcgtatccagaatatggcaaaccatattaaagagcatcgtaaggattttgctaacaccagaaatttgaggatattagtccagcaaaggcaggcaatattaagatatttgaaaagagataatcctgaaaaatactactggactattcaaaaactaggattgaatgatgcggccataacggatgaattcaatatggacaggcgttacatgcaagattatgaattttttggtgataaaatattgataagagattctaagaaagtggcaaatcaaaagcgtaaggagataagaaaacaaaaaagggctacattttag

SEQ ID NO: 1773 - DNA, 864 bp, Saccharomyces cerevisiae
atgacctacactaccagacaaattggtgccaagaacaccttggaatacaaagtttatatcgaaaaggatggtaagccagtttctgccttccacgacattcccttgtacgctgacaaggaaaacaacattttcaacatggttgttgaaattccacgttggaccaacgccaagttagaaatcaccaaggaagaaactttgaacccaatcatccaagacaccaagaagggcaagttgagatttgttagaaactgtttccctcaccatggttacattcacaactatggtgctttcccacaaacttgggaagacccaaacgtaagccacccagaaactaaggcagttggtgacaacgatccaattgatgtgttggaaattggtgaaactattgcttacactggtcaagtcaagcaagttaaggctctaggtatcatggctttattggatgaaggtgagaccgattggaaagttattgccattgatattaacgatccattagccccaaaattgaacgacattgaggatgttgagaaatacttcccaggtctgttgagggctactaacgaatggttcagaatttacaaaatcccagatggtaagccagaaaaccaatttgccttctccggtgaagctaagaacaagaagtacgctttggatatcatcaaggaaacacatgactcctggaaacaattaattgctggtaagtcttctgacagcaagggtattgatttgaccaatgttactttgcctgacaccccaacctactccaaggctgcctctgatgccatcccaccagcttctccaaaggcagatgctccaattgacaagtctattgacaagtggttcttcatctccggttctgtttaa

SEQ ID NO: 1774 - DNA, 864 bp, Saccharomyces cerevisiae
atgcaagctattgccgatagtttcagtgtaccaaacagattggttaaggaacttcaatatgacaacgaacaaaacttagagagcgatttcgtaacgggcgcctcccagtttcaacgtttggcaccatcgcttacggttccaccaattgcgtctccacagcagtttttaagagcacacacagatgattcacgaaacccagactgtaaaatcaagatcgcacatggtactacaaccttagcatttagatttcaaggcggtattattgtggcagtagattctcgtgccactgccggcaattgggttgcttctcaaactgtgaagaaagttattgagatcaacccatttttattgggtacaatggctggtggtgcggcagattgtcaattttgggaaacttggctaggttctcagtgtaggctgcacgagctgagggaaaaggaacgtatatctgtcgcagccgcatccaagattttaagcaatttagtataccaatataaaggggccggtttatcaatgggtactatgatctgtggttacactaggaaggagggcccaaccatttattacgtcgactcagacggtacaagattaaaaggtgacatattctgcgttggttcaggtcaaacatttgcatatggtgttctagactctaactataaatgggatttatccgttgaagatgctttatatctaggtaagagatctattttagctgctgcccatagagatgcttactctggtggttctgtaaatttatatcatgttaccgaggatggttggatatatcacggtaatcatgacgtaggtgaactattttggaaggtcaaggaagaggaaggatctttcaacaacgttattggctaa

SEQ ID NO: 1775 - DNA, 864 bp, Saccharomyces cerevisiae
atgcattacaagaaagcatttctagcatctctattaagtagtattgcgctaactgcgtacgctccacctgaaccctgggcaactttaactccaagctctaaaatggatggtggcacaacagagtaccggacctcattcggtctcgctgttatacctttcaccgttactgaaagtaaggtcaaaagaaacgtcatttcacaaattaatgacggtcaagtgcaagtaacgacacaaaaattacctcatccagtttcgcaaattggagacggccaaatacaagttacaacgcagaaggtgcctccagtagtgtcacatattgtgtcacaaataggcgatggtcaattacaaataactacagctaaaaatgttgtcacaaagtccacaattgctgttccaagtaaaactgtaactgcgacagcaacttcaaccgcaactgctgtttctcagattcatgatggtcaagtgcaagttactatttcttcagccagtagtagttctgtgctttccaagagtaagttagagccaacaaagaaaccaaataatgaaaaagtgatcaaggtgcaagcctgtaaaagttctggcaccttggcaataacgttacaaggaggtgttcttattgactccagtggtagaattggatcgatagtagcaaacagacagttccaatttgatggtccacctccacaggcgggcgctatttacgctggcggctggtcgataacgaagcatggcactttagctattggtgataatgacgtgttttaccaatgtctgtcgggcactttctataacctttacgatcagtctatcgggggccagtgcaatcccgttcatttacaaacagttggtctcgtcgattgttga

SEQ ID NO: 1776 - DNA, 864 bp, Saccharomyces cerevisiae
atggtactgtcaaatgttaaaatcttcagattaaaatcgcatagagccttcagaatcggtcccatgattaaagcagtcgcaggaaatcttttggtaaagagattttatcaaccaaaattagaaagaattccaccggcttcactgcttttgaagcagaaaatacggttagctcaaaatggcagtactacatctacagaaaaccccatttccttctcacagaccatgtccgagatatttagcgtcttgcagccaagtgcaccagatctagatgaagacgaaacaagtggtttgaaacgcgatcatttattaactgagcgtctaaacaacggcgagcttggtgtcattatgaacaaattcttcaatccgtcttcgacacataacaatcagttgatagatacgaatatattacttcagaattttcctaagttaagtggtaatgacttagatttattggattttgccataaatgagaaaatgcgaggaaactggaatgatctaaagcaagatttcattcagttgtggtactacaagtcatttggctttcttggacctcgaactcaatttgtcctgacaaactcttctccgtcagttaggtcccaattcttgaaacttccattcatcgaatataattggtttctcctacaaaataacaaaaacgcaaatatactacctgctgatgtgcaaaacgtggtcaaggtgtttcatcttgatgataaaaggtttacttggaagagcatagatccattcagcaaagctataatttcattcgtcgtttttgtttccatatatgtgtggttggatgaaagtgcaaaacaaaaaacgaaggagctgcccgcacagaagagtactgtaatatcagaataa

SEQ ID NO: 1777 - DNA, 864 bp, Saccharomyces cerevisiae
atgtctaattctgccaaacttatcgatgtcatcaccaaggtggcgttgcccattggtataattgctagcgggattcagtactccatgtatgatgtgaagggtggttctcgtggtgttattttcgacagaatcaatggtgtaaagcaacaggttgtgggtgaaggcactcatttcttggtgccttggctacagaaggcgatcatatacgatgtgaggacgaaaccaaagagcattgctaccaatactggtacgaaggatttgcaaatggtgtcattgaccttgagagtcttacatagaccagaggtcttacagctacccgcaatataccaaaatttgggtctcgattacgacgaaagagtgttaccatctatcggcaatgaggttttaaagtctatagtagctcaatttgatgctgctgagttaattactcagagagaaattatttctcaaaaaatcagaaaagagctttctacgagggccaacgaattcggtattaagttggaagatgtctctatcactcatatgacgtttggtcccgaattcacgaaagcagttgagcagaagcagattgcacagcaagatgccgaaagagccaaattccttgtcgaaaaggcagagcaagagagacaagcttctgttatcagagctgaaggtgaagcagaaagtgctgaattcatttcaaaagccttagctaaagttggtgatggtctgttattgattagaagattagaagcttctaaggacatcgctcaaacattagcaaactcatctaacgttgtctatttaccaagtcaacattctggtggtggtaacagcgagtcttcgggatcaccaaattccttgcttttgaacattggccgttaa

SEQ ID NO: 1778 - DNA, 864 bp, Saccharomyces cerevisiae
atgtctgatgctcaattcgatgctgctttagatcttcttaggaggctaaatcctaccacgttacaggagaatctaaacaacttgatcgaattacaaccaaatttggcacaagatttactatcttcagtagacgttcccctatccacacagaaagattccgccgattcaaaccgggagtacttatgctgcgactataatcgtgatattgattcgttcagatcgccttggtcgaacacttattacccagaactatccccaaaggatctacaagacagcccctttccctcagcccctttaagaaaattggagatcttagccaatgactctttcgacgtttacagagatctctattatgaaggcggtatctccagcgtgtacctctgggacctcaatgaagaagatttcaatgggcacgattttgcaggggtagtgcttttcaaaaaaaaccaatcagatcacagtaattgggacagtatccatgtttttgaagttacaacatctccttcttctcccgacagtttcaactatagagtcaccactacaatcattctgcacttggacaaaacaaaaactgaccagaattctcatatgatgttatccgggaacctgacaagacagaccgaaaaggacatcgctattgatatgtcccgtccattagatgttattttcacatcacatgtcgctaatttgggttccttaattgaggacattgagtctcagatgagaaatctattggaaactgtttatttcgaaaagacaagagatatcttccaccaaacaaagaacgcagccattgcttcctctgctgaggaagcgaataaagacgcacaggcagaggtaatcagaggtttacagtctttatag

SEQ ID NO: 1779 - DNA, 864 bp, Saccharomyces cerevisiae
atgtctgccgtcccaagtgtccaagtatgttaaataatttaaacgatgtcacgaatttgtgagggatattgaaaccatgcagtgagataatttcaatttaagaaccatatcacctgaataagacgggtggggcaagcactagatgcgaatcatagttttagaacaacggatcaccatttcacacgttaaagaccgagtagaaataaccaataaattgtgtgggaaaatattatacttaatttctctgtggagtaaagtaatgagcgtcttttgcggtcttatttattcattcgctccccttgcaatgaattttgaacagaatgctccaaagaggaagtgccagggtacctcacttgtttcacccttttacacagttcataatatttttgaggattttgaatttctgttttactaacatgtgacacgaaatgtttttcatttttggttttataacagacttttggtaagaagaaatcagctaccgctgttgcccacgtcaaggccggtaagggtttgattaaggtcaacggttctccaatcactttggttgaaccagaaatcctaagattcaaggtctacgaaccattattgttggttggtttggacaagttctccaacatcgatatcagagttagagtcactggtggtggtcatgtttctcaagtctacgccatcagacaagctattgctaagggtttagtcgcttaccaccaaaagtacgttgacgaacaatccaagaacgaattgaagaaggccttcacctcttacgacagaactttgttgatcgctgattctagaagaccagaaccaaagaaattcggtggtaagggtgctcgttctagattccaaaaatcttaccgttaa

SEQ ID NO: 1780 - DNA, 865 bp, Saccharomyces cerevisiae
atggaaattgaaaacgaacgtacgtaccgactactttatttttgcaggccggaaatcaagcgatgaatgagacatccttctgttttctatgttgtgcttgaaggggacagacagtcgcttatcttagtgagattgcttactaactgaatttactttgctgctgctagagatttgcacctgcatagcgcagattctgcatcttctcaatagcttaattattacattctcagatgatgataagacggaaactggacaatcttttgtttatattgatggatttcttgtcaaaaagcataacaatcaacatactattgttaatttcgaaacttacaaaaataaaatgaaagtttccgataggcgtaagtttgaaaaagcaaactttgacgagtttgagtcggctctaaataacaaaaacgacttggtacattgtccctcaataactttatttgaatcgatccccacggaagtgcggtcattctacgaagacgaaaagtctggcctaatcaaagtggtaaaattcagaactggtgcaatggataggaaaaggtcttttgaaaaaattgtcatttccgtcatggtcgggaaaaatgtacaaaagttcctgacatttgttgaagacgaaccagatttccagggcggaccaatcccttcaaagtatcttattcccaagaaaatcaacttgatggtctacacgttgtttcaagtgcatactttgaaattcaatagaaaggattacgataccctttctcttttttacctcaacagaggatactataatgagttgagttttccgtgtcctggaacgttgtcacgaaatagcgagtgccaggccgaacgacagctctacgatgcgtactttcactga

SEQ ID NO: 1781 - DNA, 867 bp, Saccharomyces cerevisiae
atgacatcaattggtactggttacgatctttccaatagtgttttttcccccgatggtagaaatttccaagtagagtatgccgtcaaagcagtcgaaaacggtaccacatcaatcggtataaagtgtaacgacggtgtagtctttgcagtggaaaagctcattacgtctaaactgctggtcccacaaaaaaatgtcaagattcaagtcgtagaccgtcacatcggttgcgtttattcaggtttgattcctgatggtaggcacctggttaatcgtggtcgtgaagaagccgccagcttcaaaaagctgtataaaacgcccattcccattcctgcatttgcagaccgtttaggacaatatgtgcaggcgcacactttatacaacagtgttagaccgttcggggtcagtaccatctttggtggtgtagataaaaatggtgctcatctttacatgttggaaccaagtggctcttattggggctacaagggggctgccactgggaaaggtaggcaatctgcgaaggctgaattggaaaaattagttgaccatcatccagaaggtctttcagcaagagaggccgttaaacaagctgcaaagattatctatttggcacacgaggataacaaggaaaaggattttgaattggaaataagttggtgttcactgtcggaaacgaatggtctgcacaagttcgttaagggcgatctgctacaggaagctatcgattttgcccaaaaagaaattaacggcgatgatgacgaggacgaagatgacagtgataacgtcatgtccagtgatgatgaaaatgctccagtggctacgaatgcaaacgctaccactgaccaagagggtgatattcacctagaatag

SEQ ID NO: 1782 - DNA, 867 bp, Saccharomyces cerevisiae
atgactgccgacaacaatagtatgccccatggtgcagtatctagttacgccaaattagtgcaaaaccaaacacctgaagacattttggaagagtttcctgaaattattccattacaacaaagacctaatacccgatctagtgagacgtcaaatgacgaaagcggagaaacatgtttttctggtcatgatgaggagcaaattaagttaatgaatgaaaattgtattgttttggattgggacgataatgctattggtgccggtaccaagaaagtttgtcatttaatggaaaatattgaaaagggtttactacatcgtgcattctccgtctttattttcaatgaacaaggtgaattacttttacaacaaagagccactgaaaaaataactttccctgatctttggactaacacatgctgctctcatccactatgtattgatgacgaattaggtttgaagggtaagctagacgataagattaagggcgctattactgcggcggtgagaaaactagatcatgaattaggtattccagaagatgaaactaagacaaggggtaagtttcactttttaaacagaatccattacatggcaccaagcaatgaaccatggggtgaacatgaaattgattacatcctattttataagatcaacgctaaagaaaacttgactgtcaacccaaacgtcaatgaagttagagacttcaaatgggtttcaccaaatgatttgaaaactatgtttgctgacccaagttacaagtttacgccttggtttaagattatttgcgagaattacttattcaactggtgggagcaattagatgacctttctgaagtggaaaatgacaggcaaattcatagaatgctataa

SEQ ID NO: 1783 - DNA, 867 bp, Saccharomyces cerevisiae
atgagcagagctattactagagcacaattggacaaacttgtgcgtagcattaccaagttctaccctcaaaagtacgcagacaagagctgggacaatacgggtcttctcatcgattgttccactgcacaagtcaccactgccgatgcaaacgctaaaacaaaggtccttttgactgtagacctcacgaagtcagttgctcaagaagctgtggatgctaactgcaacgtaattgttgcttaccatccttttattttcccaagctggaacagattaagcccacatacaaacccacaacacgagacagctataaagctaatccagtacggaatatccgtatactgccctcacactgccgtagatgccgctcgtggcggtgtaaatgactggttggttaggggtttgaacaacggagagaacgtcgcaaagtcttatgccttggaaactgtaagtggcgaaactgacgacttgattggctacggtagattcgtagaattcaataaagacatctctttggagcaaattgtcaaaaatgtcaagcgtgttttacgggttccctatgtacaagtagcatctcttgctgctccatccgcatggaatcaactcaaaatcaaaaaagtcgctgtctgtgccgggagcggttctggcgtgtttaagcaactaaaagaggacgtagacctttactatacgggagaaatgtcacatcatgaagtactgaagtggaaagaaatgggcaagaccgttattgtttgcaaccactcaaatactgagcgtggattccttcaagacgttatgaagggcttgttgcaagatgagggccacgaagtagtcgtaagcaaaatggattgcgatcctttgactgttgcatag

SEQ ID NO: 1784 - DNA, 867 bp, Saccharomyces cerevisiae
atgatggtacccaggattagtgcttcaccagttttcaagaggatatttcttcgatggggatttgtaactttacccatacagaaaaccgtatcccatacactgcgcagggactttagtgccccttgtaggagtatggtaaaatgccttctcctacgacctgggataagtgtgcactcagcacaagacagaaaattttacagtacagaggaaaaaagtagtcagtttgatgaaaataaaagcaaaagtaacaatgggaagaaaaatgagccacacggtattaaaggattaatggctaagtatggttattctgcactgatcgtatatatcctcttaacttgtgttgatttgccattatgttttctgggagtccactcactaggtgaagagaagattaagatctatctgaacagaggtaagcaattgattgggatgggtgagcctgacgaaagcaaagtcattcaagatgttagaaggaaacaggctcatcgcgaagcagtgcaagcagagaatgctgacaaggtggaggacgcatcgaggaaaactttcaatgagagatggcaagagatgaaggacagcacgttgttggccgaattgctaattgcgtatggcatacacaagagtttgatcatcgttagagtacccctgacggcagtgctaacgccatccttcgtcaagcttctgcagaggtttggcatcgacttgatgaagaagcagaaaaaggtattccaaacgatggcctctggtgccaaaataagatacaaagggaacaaccctagcgatttcatcaagaatgagggcacagcgctcgacattacaaagcgcaaaccaagaaccaaaggccagaaatggtttgatggcctaatgtga

SEQ ID NO: 1785 - DNA, 867 bp, Saccharomyces cerevisiae
atgcccagtgtctgccatacaagcccgatagaaaagattatccaacaagggcatcgcatacagaatgattccttaataccgtcaaaacgcaccaagctggcccatacggaattaacagcacactatgccactgaagactcgcatgtggaaaaacactttttgcataatggtagtaattttgacggcattgacaatgtaaggtatcaaaatcaaccctctccattaaccttcattactccaaacaacactgtagattccagtgattgggttccgcagttctcgtctatgaagattgacgattcactagagtttagctcagaatataaaaggttgtattccaattacgagtcacagcagcgcctgaattcaagcagacaacacttaccttttaagaattgtatgataaggaagacaagttgcacttacccacctcaaaagacgcttcgacagcaacgccaaggaaaccgggacaacccaacggatgcgtttcaattcgacgcggagttccaagttttggagagagaaattcaaaaagagcggtacgagcccataacacgtcgggacgagaaatggttcgaccaagatcagtcggaactgcaaaggattgccacagatatagtaaaatgctgtactccaccgccttcgtctgcatcctcctcttctactctttcctcctctgtcgaatcaaaactatctgagtcgaagtttattcagttaatgagaaacattagtagcggtgacgtgactttaaagaaaaatgcagatggaaattccgcaagcgagttattctcatccaacaacggggaactggtcggaaacaggcacattttcgtcaaggacgaaattcacaaagacatacttgattga

SEQ ID NO: 1786 - DNA, 867 bp, Saccharomyces cerevisiae
atggaagagtgtcctatttgtttggcagatgaccaagagggtgaacaatttggatgtttgaacgtttgcgggcataaattccacttaaactgtataagagagtggcacaagtatagtatcaacttgaagtgccccatctgcagggttgaatccacccatttagaagttggcgaagggcaacatgcactttctataaatttgaagatggggtttatgattaagaatgctatcgattatgtgggggccgaaacaactaacgaaagaaatgaggacgatacaggggagcaagaccaagaaatagaatttctcagcgaaaggcttagaggtacgctggtgatggataccattaagataattcagtgcagcatatgcggagacacagatgtttctcgattaagcctgtattgccaagactgcgaagcaatatatcacgaaacatgtctacgcgggctagcttgtgaggtgggcgatcgcaatacgtggcaggagtgcacagattgtagatcaaatgcattgctcgagctgcgcatgggtgctatcagtagccaacttgctagctacgattccaggaattccatgatttttgctggtgagttacgggacaagcacagcgtcaagacacagcagatgtatgaacagatacggaatgccaagcacaaaatccagatgcacgtgcgacgagcactggaccggtacccactgcctctgctgcgcttcaaggatgcctacaagcacgtcaacaagcaagtatcccgcaagttgtaccgtctctctgacaacaagtacctgcctgaccagtacgattacgactctttagcccgaactggagtgcacacagaactcctaatttactgtcatgatgagtag

SEQ ID NO: 1787 - DNA, 867 bp, Saccharomyces cerevisiae
atggcatcaagaaaactgcgtgaccagattgtaattgccactaaatttaccacggattataaggggtatgatgtaggcaaggggaagagtgccaatttctgtgggaatcacaagcgcagtttgcatgtaagtgtgagagattcccttcgtaagttgcaaactgattggattgatattctttacgttcactggtgggattatatgagctccattgaggaagttatggatagtttgcacattcttgtgcagcagggcaaagtactctatctaggtgtgtctgatactcctgcctgggttgtttctgcagcaaattactacgccacatctcatggtaaaactccctttagtatctatcaaggtaaatggaatgtattgaacagggactttgaacgtgatatcattccaatggctaggcattttggtatggctcttgctccatgggatgttatgggaggcgggagatttcagagtaaaaaggcagtggaagagcggaagaagaaaggagaaggcttgcgtaccttttttggtacttcggaacagacggatatggaggttaaaatcagcgaagcattgttaaaagttgcggaagaacatggcactgagtctgtcactgctattgccatagcttatgttcggtctaaagcgaaacatgttttcccattagtgggaggaagaaagatcgaacatctcaaacagaacattgaggctttgagcattaaattaacaccagaacaaataaagtacttagaaagtattgttccttttgatgtcggatttcccactaattttattggagatgacccagctgttaccaagaaaccttcatttctcaccgaaatgtctgccaagattagcttcgaagattag

SEQ ID NO: 1788 - DNA, 867 bp, Saccharomyces cerevisiae
atgtcggaagacgaattttttggtggtgataatgaagccgtttggaacggttccagattcagtgattcacctgagttccaaacgttgaaagaagaggttgctgcagagttatttgaaataaatgggcaaataagcacgctgcagcagtttaccgcgacacttaagtcatttatagatcggggagatgttagtgcgaaagttgtggaaagaattaataagagatctgtggcaaagatagaagaaataggcgggctcattaaaaaggtcaatacatcagtgaaaaagatggatgcgattgaggaagctagcctggataagactcaaataatagcgagagagaaacttgtgagggatgtcagttactcttttcaagagtttcaaggtattcagcggcagtttacccaagtaatgaaacaagttaatgaaagagcaaaagaatctcttgaagcaagtgagatggcaaatgatgctgctttattagatgaagaacaaaggcagaatagctcaaaaagtactcgaataccaggcagccaaatagtcattgagagagacccgataaataacgaagagtttgcttatcagcaaaatcttatcgagcaaagagaccaggaaatcagcaatattgaaagaggtataacggaactgaacgaagtttttaaagatttgggaagtgttgttcaacagcagggtgtgctagttgacaatattgaagcaaatatttatacaacgtcagataacactcaattggcttcagacgagctaaggaaggccatgcggtaccaaaaacgtacgagcagatggagggtgtatttgttgattgtgcttctcgtaatgcttctttttatttttctcattatgaaattgtaa

SEQ ID NO: 1789 - DNA, 868 bp, Saccharomyces cerevisiae
atgcttgttattgttctgcagggcttggcaggttttttatcagtatgcataattgaaggagaaagtatacatgaaaggtttgactaactaagggagaaaacttccatttcttacatagatcatcgccattctatgtcaaaagcgctataataaacttcatcgatctatttacgggctttcatatgatttatttctgctagattttgttggtaatggtctgtacttgtattgcgcgttgcattattgttattcatctctggtgagggaacaactgtctcaaagattcccacttttttatccgttgaatgatgcccgtagtatacctatatccagtttcctcattctaaaagatttttgcgtttcctgttgctgcatgatggttttaaggcagttatactattataggtcaactaaacatatttatcagggcatttccattacttccataataattataagtgtgttccttgtattaggcatatttacatatggctgttccatctctaatttaccgttgaaaaattcaggtaaatttggcgttttctatttggaacacataaattatttgtgggtaatggcaaatctgcttaaatgtttcaagtatgtgcctcaaatgagtataaactggatgggatgctcaacagtaggtttatcatcaaagtttgcattgatatcatttttggctgaatctatcgatttattaggtagactggtaataccgaccaatgcattgttttacgagataccatttaattcaacgcccttttgggtaaaattgatacaatttgtcaccttattggtcatactttgtcaagttcagtatgtttacgtaggacggaaaccacggttgccaaaaggaaaactataa

SEQ ID NO: 1790 - DNA, 870 bp, Saccharomyces cerevisiae
atgaacagagtttcgtttattaaaacgcctttcaacataggggcgaaatggagattagaagatgtctttttgctcattatcatgatacttcttaactacccagtgtattaccaacaaccgttcgaacgtcagttttacattaacgatctcactatatcgcatccttatgcgacaactgaacgtgtaaataacaacatgttgtttgtttatagttttgtcgtgccatctttaaccatattgataattggttccattttggccgatagaagacatttgatttttattttgtacacatctctccttggtttatcactcgcttggttcagtacgagtttctttacaaacttcatcaagaattggattggaagactaagaccagattttctagatcgttgccaacctgttgaaggcttgccattggacactttatttactgcaaaagatgtgtgtacgactaagaatcacgaacgtctgttggatgggtttaggacaactccgtcaggtcattcaagtgaaagctttgcaggactgggttatttgtacttctggctatgtgggcaacttttgactgaatcaccgttgatgcctttatggagaaaaatggtggcctttctaccactgttaggagctgcactaattgctctatccagaactcaagattacagacatcatttcgtcgatgtaattttagggtctatgttgggttatataatggcacactttttctacagaagaatcttcccacccattgatgatcctcttccgttcaaaccattgatggacgattcagatgtcaccctggaggaagcagtcacccatcagaggatcccggatgaggaattacatcctttgtccgatgaaggtatgtaa

SEQ ID NO: 1791 - DNA, 870 bp, Saccharomyces cerevisiae
atgacagaacaagttaacaatgacactaccagtgacactaccactaccattaccacagtttacatttcgaacctgccattcacggcgagtgagcgagacctacatgccttcctaaacaactatggcgccagttcagtgttgattccaacgcagaccgtccgcagattcagcaaaaggcacaatagcaaccctcgcaaaccactaggcatagcatttgcccagttcgcaaacaatactctggctttgaaggccattcaagacttgaacggaaccgttttccaaaatcagaaactatttctaaagttacacgttccttacgaggcagactctactccagacacggatgtaaagaagcccaaagaaaaaaataaggttaagaagacaccagagactgccgcggatacggtttactgtcacgacctgccagacgatataaccgacagtgagatccgtgagttgttccagctctactcgcctcaagaaatctggatttacaggtccaaggtgtacaggagaaagtgtattccttttgctccacaccaaattactgccgctttggtcactttgcaatctgaaaccccaattggggacatttgtgacagtgtggccaagacagctactttgaggggcaaatcgataatagtgaagcccgcttacgtctctaagattcaagaaattaaacaattggtcaaggacaacttaaccaatgcgcgcgacccacctccagcagcattggcagagccagcgccagcgccagcgccagtagagccagcggagcaagtgcaggaagggcaagacaatgcggaaaccaatgatgtcccacctccgcctgcttcgtcttccgatcgtccaaccgtggctgctacttag

SEQ ID NO: 1792 - DNA, 870 bp, Saccharomyces cerevisiae
atggcgaggcctcaaaatcatcgccgcagtaattggacagaaagagacgataatgatgattatctgtttcagcgatttctagaagaatcggaaacgaggcatagtagagagccttcacctgtaaccgagcaatctcagcaagaactacagcaggatgtacagcaagcaatcgatggaatatttaactcccttaggaggaatatgagttctacttcaaatataaatagagcagctaatatggatgcaaccacaaacggaaatggaggaatcaatgcagacactataagagccaccaacgccaatacggccgattccccattcacagcaaggcagcagagccctctcagaacttttcttagaaatttattcattttagattactttattgggctaattttattcccattttccgtatacaacatattaaggagcgggttcaattcaatgaccttttcagagaatgattttataatcgaaatcgtgggatactggaaatttgccaagatatttggttctggtggcacgacattaatagcatataaggatactggtaaattagggttgcttggaaagtttcataacatcattgtattttactcttcacctgtgataaaacatattatgaaaagtagagatggcaatgaacccaacttaaattggataagactaatgttcgctaaagctttcgagctatttgtcaaagtctctaccattctgatctatttagcttatggcgtaagtggtaccgtttacatggttaccgctgggtttttcttcgtattgtgtctattattcactgttattagaagatataaaggtgtccatcgaatgttggtgagccaaaggattacagggccaggcgtattctga

SEQ ID NO: 1793 - DNA, 870 bp, Saccharomyces cerevisiae
atggctctctcttcaaactggcaggcactattagcctccgaaagcaatcctacctccaatggaaagaataagcaatcaaataggaaaatcagaaacgttaagaaagttagcaaaacagtaaatgtcagtagtacaacccaatatgcccctcgaaagcgcaaaaacggcagtaaaattatggacatggtatataacatgaacaaggagattagtaagcatgagaaagacaagctcgagggaaaagtgtttgaattcaacccaaataaagcaaatactagtactactattaaagagccagtaaaagtgggtatttcggaagatactcgtattaatagtaataagagtaaagaaattgggaaatacatcgccatggattgtgaatttgtaggcgttggtcccgagggtaaagagtctgcgttagctagaatatcaatcgtaaattattttggacatgtcgtcctcgatgaatttgttaagccaagagagaaagttgtagaatggagaacttgggttagtggtattaaaccagagcatatgaaaaatgccattacattcaaagaagctcaaaaaaagactgcggatattctggaaggtagaattcttgtagggcacgctttaaagcatgatctcgaagcattgatgttatcccacccaaagtcactactcagggacacttcaagacacctcccattcaggaagttgtatgctaagggtaaaacacccagcttaaagaaattaaccagggaggttttaaaaatttccattcaagaaggtgagcattcttcagtcgaagatgctcgtgccaccatgctattatataaaaaggaaaaaacggaatttgaaaaaattcacagaaacactttcaactaa

SEQ ID NO: 1794 - DNA, 870 bp, Saccharomyces cerevisiae
atggtttcccaatttgctattgaggtgcgtaacctaacgtacaaattcaaagaaagctccgatccgtcagttgttgatatcaatcttcaaatcccatggaatacaagatctttagttgtgggtgccaatggtgctggtaaatccacccttttgaaattactaagcggtaagcatctttgccttgatggaaaaatcctggtcaatggtcttgatccattcagtccattatctatgaatcaagtggacgatgatgaaagtgttgaagattcgacgaactaccaaacgaccacttatctaggtacggaatggtgccatatgagtatcattaatagggatatcggcgtcttggaactattaaaaagtattggattcgatcattttagggaaagaggtgaaagattggttagaatcctggacatcgatgtacgttggagaatgcacaggttaagtgatggacaaaagagaagagttcagttagccatggggctcttgaaaccttggagagttttactacttgatgaggtcactgtggatctcgatgttattgccagagcaagacttctggagtttttaaagtgggagaccgaaaccagaagatgctcagtggtctacgctacacatatttttgacggcttggccaaatggcctaaccaagtataccatatgaaatcaggtaagattgtggataatttagattatcagaaagacgtagagttctctgaagtggtcaatgctaaagttaatggacaagtggcctttgaaaatgacaacaataaggttgttattagtaaagtgaatagtttgcatccattagcactagaatggttgaaacgtgataatcaaattcctgacaaagagattggtatataa

SEQ ID NO: 1795 - DNA, 870 bp, Saccharomyces cerevisiae
atgtctgctcccactatgagatccacctcaatattgacagagcatttgggatatccgcccatctcgcttgttgatgatatcattaatgctgtaaatgaaattatgtacaagtgcactgctgccatggaaaaatatctgctatccaagagcaaaatcggcgaggaagattatggagaagagatcaaaagtggagttgctaagttggaatcacttttggaaaactccgtggataagaattttgacaaactagaactatatgttttgaggaacgtccttcgaatccctgaagagtatttggacgccaatgtttttagattggagaaccaaaaggatctggtcattgtagatgagaatgagttgaagaaaagtgaggagaaacttcgagagaaagtgaacgacgtggagttagcgttcaaaaagaatgaaatgctattgaaaagagttacaaaagtgaaaagactgttgtttacgataagaggattcaaacaaaagctaaacgagttactgaaatgcaaagacgatgtacaattgcagaaaattttggagtcgttaaaacctatagatgacacaatgactctactgactgattcattacgtaaactatatgttgatagtgaaagtaccagttcaacagaggaggtagaggcactactgcagagattgaagaccaacgggaagcaaaataataaggatttcagaacacgatatatcgatataaggacgaataatgtcctacgaaaattggggctactaggtgataaagaggacgaaaaacagtctgccaagccggatgcgaggacgcaagcaggggatatagttagtatagatattgaagagcctcaattggatttacttgatgatgtgttataa

SEQ ID NO: 1796 - DNA, 871 bp, Saccharomyces cerevisiae
atgggtaaatcgtatgtcatttaatcctatgaatctacagcacgaacgaatcatggtatctcaaaccgaacatatcgtcacagaaataaaaagatttaaagacgtgtctagtgtgaataaagcaaacatatcattagagcaaaatattgggcagataagatgatgctacactgattctgagaaaattacgtgacatgataggcttttaacgggctgtaagtcattagtttacagtcgttgctttgaaaattagttcaacattagaagtgtagtaattacaagccctttttccaaacattcggttatgtgctgggacgcatctcagaaactcgcaaaacaatagaatactaacatgatttcttataaatcttaattttgatttatttccttataatacagacacggttacagatctcgtactcgttacatgttccaacgtgacttcagaaagcatggtgccgtccatctttctacttacttgaaggtctacaaggttggtgacattgtcgacatcaaagccaatggttctatccaaaagggtatgccacacaagttttaccaaggtaagaccggtgttgtctacaacgttactaagtcttctgttggtgttatcatcaacaagatggtcggtaacagatatctagaaaaaagattaaacttaagagttgaacacatcaagcactccaagtgtagacaagaatttttggaaagagttaaggccaatgctgctaagcgtgctgaagctaaggctcaaggtgttgctgttcaattgaagagacaaccagctcaaccaagagaatcccgtatcgtttctactgaaggtaacgttcctcaaactttggccccagttccatacgaaactttcatctaa

SEQ ID NO: 1797 - DNA, 872 bp, Saccharomyces cerevisiae
atggcaagatacggtgctacttcaaccaacccagctaaatctgcgtcagctcgtggttcttatttgcgtgtttctttcaagaacaccagggaaactgctcaagccattaatggttgggaattgactaaggctcaaaaatacttggaccaagttttggaccaccaaagagccatcccattcagaagatttaactcctctattggtagaactgcccaaggtaaggaatttggtgtcaccaaggctagatggccagctaaatctgttaagttcgttcaaggtttgttgcaaaacgccgctgccaatgctgaagtatgtttaaaatgaaaatatgaaaaataagattgaaaaataataatgatgtgttgacgggagatgataaagtattagaatatgttcatatgtgttgcatcctattttctgcatgaatgcacgattcgaaagagctaaaattaacagttttccaaatgaaagagaaaagaaataaagaagaaatgggacatgcaaaaaggaactatggatacctattaagcgtatagcatagtgttttctaatcttattttttcttacactacgactttaaaatttttactaacaatgaattactattaattttctttttaaaacaggctaagggtctagatgctaccaagttgtacgtttctcacatccaagttaaccaagcaccaaagcaaagaagaagaacttacagagcccacggtagaatcaacaagtacgaatcttctccatctcacattgaattggttgttaccgaaaaggaagaagctgtcgccaaggctgctgaaaagaaggttgtcagattgacttctagacaaagaggtagaattgctgcccaaaaacgtatctctgcttaa

SEQ ID NO: 1798 - DNA, 873 bp, Saccharomyces cerevisiae
atgagttataataatccgtaccagttggaaaccccttttgaagagtcatacgagttggacgaaggttcgagcgctatcggtgctgaaggccacgatttcgtgggcttcatgaataagatcagtcaaatcaatcgcgatctcgataagtacgaccataccatcaaccaggtcgattctttgcataagaggctactgaccgaagttaatgaggagcaagcaagtcacttaaggcactccctggacaacttcgtcgcacaagccacggacttgcagttcaaactgaaaaatgagattaaaagtgcccaaagggatgggatacatgacaccaacaagcaagctcaggcggaaaactccagacaaagatttttgaagcttatccaggactacagaattgtggattccaactacaaggaggagaataaagagcaagccaagaggcagtatatgatcattcaaccagaggccaccgaagatgaagttgaagcagccataagcgatgtagggggccagcagatcttctcacaagcattgttgaatgctaacagacgtggggaagccaagactgctcttgcggaagtccaggcaaggcaccaagagttattgaaactagaaaaatccatggcagaacttactcaattgtttaatgacatggaagaactggtaatagaacaacaagaaaacgtagacgtcatcgacaagaacgttgaagacgctcaactcgacgtagaacagggtgtcggtcataccgataaagccgtcaagagtgccagaaaagcaagaaagaacaagattagatgttggttgattgtattcgccatcattgtagtcgttgttgttgtcgttgttgtcccagccgttgtcaaaacgcgttaa

SEQ ID NO: 1799 - DNA, 873 bp, Saccharomyces cerevisiae
atgcgtggtttcagtggtcaaccattgagtgatgatgataattatagaattgaaaagactcaaaggaacacaattcctgaacgtctccattttagcagagagagaaatatgcccattgcaagtatattcgggactagaggatattttgtattctcaagtgagcaatcctatgacaaattcaaacagacaaactttaatatcagtactctagatgcggatggtgtaggtgttcctctttttcatattgtccaaagttataacgttattggcaaaattactcggagctcgccggatttctatatctacaagtacgttttacaaggggtgcaagatccgcctttatactctgattgtaaagttatttgtcaagataaagtttttcgtttatgcaaaattttatattgtgaaatttatgctcatcaaggattttttgaaactaaatacgatttcttctatccttctaaaacgcagccggtcaaaaaataccaaataatcaaacaaagtaatatgcgagatctatattccactttggacggtatgcgttttcgttggcatgtgaaattctacagcgatcattttcgattgatgttcctagatgaggacaggctcaattactcaaatagtaaccaaaaggaaaggcaaaaaccagatcaaggaaaaagtaaggctccagatttcgtaattggccattatacaagaactttttccgatatactccctagatccacgtcaaaatgctccaatcttattattggagaacactcaaagccagactctcttggtatcacgaccgttcctgatttgactcaggaatttgcctgtcagggagctttaatccattatctgctgcatatagaacgagaaagaaaataa

SEQ ID NO: 1800 - DNA, 873 bp, Saccharomyces cerevisiae
atgctaagaagacaagcccgtgaaaggagagaatatctatacagaaaagcgcaagaattacaagattctcaactgcaacaaaaacgtcaaataattaaacaagcgctagctcaggggaagccattgccaaaggaactagcagaagatgagagtttacaaaaggatttcagatatgaccaaagtttaaaggagagcgaagaagcagatgatctacaggttgatgatgaatatgctgccacaagtggtataatggatccaagaatcatcgtcacaacatctcgtgacccaagcactcgtctctcgcaatttgccaaagaaattaaactgctatttccaaatgctgtcaggctgaacagaggtaattatgtgatgccaaatctagtggatgcttgtaaaaaatccggtactacagatttggtggtattacatgaacatagaggtgttccaacttctttgaccatatcacattttccacatggacccactgcacagtttagtttacacaatgttgttatgagacatgatattataaatgctggtaaccaaagcgaagtgaatccacatctaatatttgataactttactaccgctttagggaaaagagtagtctgtattttaaagcacttgttcaatgcggggcccaaaaaagattccgaaagagtaatcacttttgcgaataggggtgatttcattagcgttagacagcatgtatatgtgagaacaagagagggagtagagattgccgaagttggtcctagatttgagatgaggttgtttgaactgaggttgggaactttagaaaataaggacgctgatgttgagtggcagttgagaagattcataaggactgccaataaaaaagactatttgtga

SEQ ID NO: 1801 - DNA, 873 bp, Saccharomyces cerevisiae
atggaaaagctattacagtggtctattgcgaattctcaaggggacaaagaagctatggctagggccggccaacctgatcctaaattgctacagcagttattcggtggtggtggtcctgacgatccaaccttaatgaaagaatccatggctgttattatgaatccggaggttgacttagaaacaaaactcgttgcatttgacaactttgaaatgttgattgagaacttagataatgctaataatatcgaaaatttaaaactgtgggagccattgttggatgttcttgttcagacgaaggatgaagaactacgtgctgctgctttatccattattggaacggctgtgcaaaacaacttggattcgcaaaataatttcatgaaatacgacaatggtctgcgaagccttatcgaaatagctagtgacaagacaaagccactcgacgtgagaacaaaagctttttacgcactatctaatctaataagaaaccacaaagatatctcagaaaagtttttcaaattaaatgggctcgactgcatagcacctgtattaagtgataacaccgccaaaccaaaactgaaaatgagagccattgccttattgaccgcatatttgtcatctgttaagattgatgaaaatataatcagtgtgctgagaaaggatggagtaattgaaagtacgattgagtgcttgtctgacgagagtaacttgaacatcatagatagagttctgtcttttctctctcacctgatatcttccggaataaaatttaatgaacaggaattgcacaaattgaacgaaggttacaaacatatcgagcctctaaaggacagacttaatgaagacgattatttagccgtaaagtatgtattatga

SEQ ID NO: 1802 - DNA, 873 bp, Saccharomyces cerevisiae
atggaattcatatctgcagactattctagcagtgacggtagtgataccgagagcgaaagtagtaacaaaagtgaggtccaaatcgaatacacggagaaaacttgcatacagaaagccgattccactgatttacctgcaataccggattcaattatattgaagtaccacatccctccgaatttacaaaagtacgagcaccaggatatgaatatgagtcgattttggcgttcgttcacatattttgagtggcgtccgactccagcgattcaccgacaacttcagaaaatcatatgtaaatataaagaaacatttatgaaacaggaatacactaatccgtatcaactggtggattttgacccgttgttcatctcacacttgggagcccccaaacctttacacgtttccttaactcgatcgttgttgtttgaaactgaagaacaaagacatgttttcattcaagaaatgcgtaatggtttacgaaataatgaaataaccccttttaaacttcaaatctgctcatatccgaagttatatatatcagaacgagccaacaccttgtacctcggtctccctgtctcagaatgtcccaataaggcacaaatttctcctttcaaaacgataatagctgaggcacttcagaaatcaggcatttcaaactatcaggatttaattgtaagtaggcaaaatttacatgtttcaattgccatcgctagcaacccttcaaaagccacattaaaacgttatcaacaattaaacgagacgatgggggcgcttttactactcaataatgactttgcatacaaactagagttcttagttaactctatctattgtgatgaaaaccgtcactccattagaatcccttttaactaa

SEQ ID NO: 1803 - DNA, 873 bp, Saccharomyces cerevisiae
atggggaccgaagatgccattgcccttccaaatagcacgctagagccgcgtaccgaagctaagcaaagactatcatctaagagtcatcaagtctcggcgaaagtaacgattccagcaaaagaagaaattagtagtagcgatgacgatgcacacgttccagtgacagaaatacatttgaaatctcatgaatggttcggcgattttataactaaacatgaaattccccgtaaggtgttccattcttccattggctttattactttgtacctgtatacgcagggtattaattataaaaatgttttatggcctttgatatacgccttcatcatattgtttattttggatctgataagactaaactggccctttttcaatatgctttactgtagaactgtgggtgcgctaatgagaaaaaaggagattcatacatacaatggggtattgtggtacattcttgggttaatcttttcttttaactttttctctaaagatgttaccttaatatcgttatttttgctaagttggtccgatacagccgccgcaactattggaagaaagtatggtcatttaacacccaaagtggcaagaaataaatcccttgcaggttcgatagctgcgtttacagttggtgttatcacctgctgggtattttatggctattttgttcctgcctacagctacgtcaacaaacctggcgagatccaatggagcccagaaacaagcagattaagtttgaatatgctatccttgttaggtggtgtggtagctgctttgagtgaaggtatagatttgttcaactgggatgataatttcactattcctgtcctgtcatcactttttatgaacgcagtaatcaaaacattcaagaaataa

SEQ ID NO: 1804 - DNA, 873 bp, Saccharomyces cerevisiae
atgtcaaatatcattgcaagatttcacaagattcaagttcaagacggtgtaaaggtttggtaccgtgaggccggtgcagcaggtaaccccacaattttattgctacatgggttccctacatcttccaacatgttcaggaacctcattcccttactagctggacagtttcacatcattgctccggatcttcctgggttcggatttacggaaacgccagaaaactacaagttcagctttgattccctttgtgaaagtataggatatttgttagatactttgagtattgaaaaatttgccatgtatatatttgattatggatctccggtaggttttcggttagccttgaagtttccctccagaattactggcattgttactcaaaacggtaatgcttacgaagagggtctcgatgaccgcttttggggtccgttgaaggaatattggaagtcatatcaaagtgatccggtatttgttaaatcccttatcccgtaccttgaagatccagctaatgtcatatgccagtaccatgatggagtaccagctatcgaatctgttgatcccgccgcttatacgcttgatattgcgctaattcagcgtaccggccagaccgatattcaattgagattatttttcgattatcagaataatataaagttgtacccagcctttcaaaagttcttgagagattcaaagattcctgtgctagttgcatggggtgcgaatgatactatttttagcgttgccggggctgaagcttatcggaaagacgttgataatttaaaggttgtttactatgatactggccattttgcgcttgaaactcacgtagttgctattgccgaagaaatcatcagtatgtttgcagaaaattaa

SEQ ID NO: 1805 - DNA, 873 bp, Saccharomyces cerevisiae
atgtcagtttaccatttaccaacgctgttgaacccgctggttaatgctatatttaactgtcccgaaccagaaagatccccattgaaaaagcttttcgctaatttaaaaacccgtaggtttatcctcctagcacctccttcagaataccttttgaattaccacgatgtcaagagcaaactgccgttacatgacctctgttataatgcagagtttattaactcttacatattgttaatgactgaaaactcttacataaatacgaattcaagggacagtcattatgaaacgttagatggtaagaccgttgttattcaatggaagaataatgtgatccatgccttaaatggatttcatataaggcgaagactaaagattctagagacaaaaatattacccaattttaatgactactttgaaggggcggctgattttatcatactattcatagatcaacctttaaattgcgaatttgtacctaacgactacttacagtgttttcacaattatgagaaaataccaaaaaatgcacatgctatgccaaatctgtcgatagattcttttcagcaagaaagatcgtcattcgagaatatattgcacattcatcctgctcgattaacacagcttggccaattgttttcgagttacagaacgctcgctcctggtgatgatccatctagaagtatttttgaaagcatcgtgcaacaagcatttgatggaatgaaatcggattcacttttcaagaacttttctaatctttacgatcttatacacgactattttgaactaaatctttacgatgatatatggtctaggcttactacacatttcaaaggccacgaagtagacactgaaaaaataaatatttttcagtga

SEQ ID NO: 1806 - DNA, 873 bp, Saccharomyces cerevisiae
atgtccgaaaatcacgttcctgcctggaaaagaattgctttgaagagacagactataagcagtggtgacgaaagtaaagaaaaaggccaatccaatctaatagatgatgatccactaaatatcactacgcatttatccactggtaatttgacaaagaaagagaaaaaaagaatcattaatggtgagagcaaatcctctaccaaaaaagggaagcgtgtgtcgaaaccagggacgaagaagaaggaaaaattgtcaaaggatgaaaagaattcgaaaaaaaataaaattcttaaagatcaattacgttacctgatagaatttttcaggacaaagtctgagagcaagtttcccaccggaatcctagaattggaaagtgtaaaagaaaattacggcgactccctgatcaaagacgagccatcagagtctggtgttgttgaagtttggaaattttccaagcaaaagcaaaattggcttattaagcattttttcaacttggacgaaatcccctcagtatataatgatcttttgcttttatatttcagggacttacaaggtaaatcaaaagaagaactaatatcaaaatgcaaaggaaaactgaagcaatggaacgactatgtggaagatcaagaaacaaaaataaaagcgttaattgcagaggataaggctagcgaaccaattaatggtgaagaaaaagaagaaggtgaaaaagacggtaatgccgaacaagggaagcaaaaagaggtacaagacgagcaagaggaagtacaaatgccgaataaagagcttgttcaaagaagtctgaaattactagaaatttggaagaatgatgactcggagcagatagaacttaagaatttcttcgttgatgtttaa

SEQ ID NO: 1807 - DNA, 873 bp, Saccharomyces cerevisiae
atgtgtgataagtcaaaaacggtattggactacacgatagaattcttggataaatatatacctgaatggtttgagacgggaaataaatgccccttgttcattttcttctcgggcccacaaggctcaggcaaaagttttacaagtatccaaatctataaccatttgatggaaaaatatgggggtgaaaaatctatcggttacgcctcaattgatgatttttatttaactcacgaggaccaattgaaactcaatgagcaattcaagaacaataagctgttacaaggacgtggtttaccaggtactcatgatatgaaattgttgcaagaggtattgaacaccatcttcaataataatgaacatccggatcaagatactgtcgtactacccaagtacgataaatcccaatttaaaggagaaggggaccgttgccccactggtcaaaaaatcaagctaccagtcgatatttttatcttagaaggttggttcctcgggttcaaccccattttgcaaggaattgagaataatgatcttcttactggggacatggttgatgtcaatgccaagctcttcttctatagcgacttgttgtggcgcaacccagaaatcaaatctttagggatagtattcaccaccgataacattaacaatgtttatggctggagactacaacaggagcatgaactaatatcaaaggtcggaaaggggatgaccgacgaacaagtgcatgcttttgtggatagatacatgccctcctataaactttatttgaacgactttgtccggagtgaaagtttaggttccattgctacattgacgttaggaatcgactccaacaggaatgtatattctacgaaaacgagatgtattgaatag

SEQ ID NO: 1808 - DNA, 873 bp, Saccharomyces cerevisiae
atgttggtaagaaataggtatctgggtgaactgctcaaaaactctcgatcgtttagtgtgctgaattcctcggtacgttcaggtcacaacaaatggtcaaccatcaagcacggtaaagccaagaatgatgcggaacgaaacaaaattaataacaagtttgcaaaccagatagcaatgtcagtcaagttaggcaacggtattacggatccgagcatgaatataagattagccaccagcatcgagctagcaaataaaaacaatgtcagcaaaaaagttattgagaacgccatccggaaagcttctggaagcagcgcatcgggcaaggactcaaacgcttctgagctatgtgtatacgagggaatggggcccggcggggtcgctatagtggtggaagcgctgacagacaacaagaacaggaccataggtctgataaggagtgcatttaataaagctaatggatcgatgactccaacgttgtttttcttcgacaaaaaaggatacgttacaatggtacctccgaagatgttagacactgaggacaaggtgctagaaagcgtactggagattcaaggcatcgaagacattgcgcctgtgcaggaagacgcagaagatttagagtgtgataccgaaactgaaactacaggccaaacttacgaggcggtgatggaacctgccgataccaataaggtggccgccctactgaaggagcgtggtttccacatcagagacttgggcatcggctacaatgccaagccggatatggaagttttcgtgcaaggcgatgaaacgctcgagaaactacagaaactgaccacagcgctcgaggacatcgacgaagtgacgtcgttgtacactaacgctagcaacgcttaa

SEQ ID NO: 1809 - DNA, 874 bp, Saccharomyces cerevisiae
atggtatgttaaaaagtgctcagatgaaagatgacgtcccatattccatgttaaagttgccatgagttagtataaaaggcaataaaggtaccataacgagaaaagaaagtaaaagaagaaatgttttgcaaatttaaggtggcgtaacagcaactattggctaatatattaatggcaatcattgtgaaaagaaatgtgaaatccgtatcgtaattggttaaatttataactcaaatttaaacactcgaatagctgacccgtaatattttatcccgctttaagagttcaacgctaaaaaatgatatctagctaaccattatgctacaggaaccttttttggactattatccctatcatgaaaactggaaggatctttcaaggacgccatttccaaagatttcccccacactggaacctattttactaacaatttttaaaatggttttttacctaaattgttttttctcagtctgacgctgttactatccgtactagaaaggttatctccaacccattgttggccagaaagcaattcgtcgtcgacgtcttgcacccaaacagagctaatgtctccaaggatgaattgcgtgaaaaattagctgaagtctacaaggctgaaaaggacgctgtctccgttttcggtttcagaacccaatttggtggtggtaagtctgttggtttcggtttggtctacaactctgttgccgaagctaagaagttcgaaccaacttacagattagtcagatacggtttggctgaaaaggttgaaaaggcttccagacaacaaagaaagcaaaagaagaacagagacaagaagatcttcggtactggtaagagattggctaagaaggttgctcgtcgtaacgccgattaa

SEQ ID NO: 1810 - DNA, 876 bp, Saccharomyces cerevisiae
atgaactctattttagacagaaatgttagatctagcgaaactactttaattaaacctgaatctgaatttgataattggttgtcggatgaaaatgacggagctagtcatatcaacgtcaacaaggactcctcgtcagttctttctgcatcttcttccacatggttcgaaccattggaaaacattatctcctctgcatccagctcctcgataggctctccaatcgaagaccagtttatatcttccaacaacgaggaatctgctctttttccaacagatcagtttttcagtaatccttcctcatactcgcattctcccgaggttagcagctcgataaaaagagaagaggatgacaatgccctttcgttggcagattttgaaccggcttctttgcaattaatgcctaacatgataaatactgataataatgacgatagtaccccacttaagaatgaaatcgagctaaacgactcgtttataaaaacaaatctagatgctaaggaaacgaaaaagagggctccaagaaaaagactgacccccttccaaaagcaagctcacaacaagattgaaaaacgctacagaataaacatcaacacaaagattgcaagactgcagcagattatcccatgggtagcaagtgaacaaacagctttcgaagtaggtgattctgtaaaaaaacaggacgaagacggcgcagaaactgccgctactactcctcttccatctgccgctgctacaagcacgaagctaaataaaagcatgatcctagaaaaagctgttgactatattctatatctacaaaataacgaacgactatacgaaatggaagttcaaaggttgaaaagtgaaatcgacactttgaaacaagaccaaaaataa

SEQ ID NO: 1811 - DNA, 876 bp, Saccharomyces cerevisiae
atgaatacactattatttaagcgaaaaggtggcaattgtgggaacgaaagtaacatagtttcgcagggatcgccctcaagtagcaatcttcctgaatcacctggcactttagatgaaaagaatcttcccagattgcctactccattcgctagaagcctttctaccattcctagttatgagcagatgaaacgtacaaacaaactgccagattatcacctaaagattgttgttgtgggagatggcgctgtagggaagacgtgcctgctgatatcttatgtccaaggaacatttccgactgattatattcctactattttcgaaaattatgtcacaaacatagaaggacccaacggtcaaattatagaattggcattatgggacactgccggccaagaagagtatagtagacttagaccgctttcatatacgaatgcagatgtgctgatggtgtgctattctgttggtagtaagacatcgcttaaaaatgtggaagatctctggttcccagaggttaagcatttttgtccttccactccaatcatgctagtcggccttaaatcagatctatatgaagctgataacctttcagatctggtggaaccaagttcagcagaatccttggccaagcgtctgggggcatttgcacatattcaatgctcagcacgattgaaagaaaatatcgatgaagtatttgaaactgccatacacacgttactttccgattcattatatgctcccagagagcctacacatacaatcaaaaatccctttaaaagaaataccaccagatcagatatcgattcttctactggagataccagcgtctctatttccggaacgaaaagattaagaaaaaacaagtgtattataatgtaa

SEQ ID NO: 1812 - DNA, 876 bp, Saccharomyces cerevisiae
atgactcgctcttccgttttagctgatgctttgaatgccattaataacgccgaaaagaccggtaaacgtcaggttctattgagaccttcttccaaggttatcatcaagtttttacaagttatgcaaaagcatggtatgttccaactatttttcaatattttcacatgtgtttcaatttctgcttatttttaaatgttaccacgaggtttgtccaagttcaatgttgcgcaactctaacgaagaaataattattgccattgttttttactccgggctgataactagatggtgtgatcgggcagtatactaatttatactggacaaagactcgtaaaagatgttctttgtgcttagtcccatactgttttttaagtgtccgggatatttaatcccatgtggaaatgcttcttacacggttatggattacacctcatgtgtagctactatatccattaccgtttacttttcctcaaaatctcactcttaaaattttcaatggcaaaattcttccgcacaacttagacaacattttcttgttttttatgaagtaagcaaaaatttcgaatcaacaacgctccatgagattcttcaatactaacatttactccttatttaggttacattggcgaattcgaatacattgacgaccacagatctggtaagattgtcgtccaactgaacggtagattgaacaaatgtggtgttatttccccaagatttaacgttaagattggtgacattgaaaaatggaccgccaacttattgccagccagacaattcggttacgttattttgactacttctgcgggtattatggaccatgaggaagctagaagaaagcacgtttccggtaaaatcttgggttttgtctattaa

SEQ ID NO: 1813 - DNA, 876 bp, Saccharomyces cerevisiae
atgagcaataaaagcaaccgcaggagtttacgtgacatagggaatacgattggtcgaaataatataccaagtgacaaggacaatgtctttgtgagattgagtatgtcccctttgaggacgacaagccaaaaagagtttttgaaaccacctatgaggatatcacctaacaagacagatggaatgaagcatagtatacaagtaacaccaagaaggattatgtcgccggaatgtctgaagggctatgtctctaaggaaactcaaagcctggataggcctcagttcaaaaattcgaataaaaatgtgaagatccaaaactcagatcatataactaatataatattccctacatcaccaaccaaactgacattcagtaatgaaaataaaatcgggggtgatggttcgttaacgagaatacgggcccggtttaagaatggactcatgtcacctgaaaggatacagcagcaacagcagcaacatattctcccatcggatgccaaaagcaacactgacctctgttctaatactgagctcaaggacgccccatttgagaatgaccttcctcgagctaaattgaaagggaagaatttattagttgaactcaagaaagaagaggaagacgtgggaaatggcatagaatcccttactaaatcgaacactaaactgaattccatgctggcgaacgaaggtaagatacacaaagctagtttccagaaaagtgtaaaatttaaactacctgataatatagtgactgaagaaaccgtggaacttaaagaaataaaggacttgctactacaaatgttgagaagacagcgagagattgaatcaagattatccaatatcgaacttcaactcacggaaataccgaaacataagtaa

SEQ ID NO: 1814 - DNA, 876 bp, Saccharomyces cerevisiae
atgagtgcttcgaagattctttcacaaaaaattaaagttgcgttggtccaactgtcaggctcgagtcctgacaaaatggccaatcttcaaagggctgcaacgttcattgaaagggctatgaaggaacagccggataccaagttggtcgtattgccagaatgcttcaattctccgtactccactgatcagtttagaaagtattcagaagttatcaatccgaaagagccttcgacgtcagttcaatttctgtctaatttagccaataagtttaaaatcatcttggtaggaggaacaattccggaattggatccaaagacagacaaaatctacaacacctctataattttcaacgaggatggcaagttgattgacaagcatcggaaggtccatcttttcgatgtagacattcctaacggtatatcgttccatgaaagtgaaaccttgagccctggagagaagtctactaccattgacacgaaatatggtaagtttggcgtaggtatatgctatgacatgaggtttccggaactcgcaatgctaagtgcacgcaagggtgcgtttgccatgatctaccctagtgcattcaacactgtcacagggcccttgcattggcatttactggcaagaagcagggcagttgacaaccaagtgtacgtgatgttatgttctcccgcaaggaatctacagagttcttaccatgcatatggccactctatagtggtggaccctagaggcaagattgtagctgaagctggcgagggagaagagattatttatgctgaattagatcccgaagtcattgagtcatttagacaagcggtacccttaaccaaacaaagaagatttgacgtgtactccgatgtaaatgcgcattag

SEQ ID NO: 1815 - DNA, 876 bp, Saccharomyces cerevisiae
atgagttttagacatttcaagaggagacttgacacaagctcagcagatgaaagctcttcggcggatgaagagcatccagaccaaaacgtatctctaacagaaaaatcagcctcattaagccatagtgatttgggcggcgaaattttaaatggtacaggaaagaaccgcacccccaatgatggccaagaatcaaatgaaagtgatgggagtcccgaaagtgatgagagtcccgaaagtgaagaaagtagcgacaacagtgattcgagcgatagtgacgatatgagacctttaccgaggccattatttatgaagaaaaaggccaataatttgcagaaagctaccaagatagatcaaccctggaatgcccaagatgacgcacgagttctgcaaacaaagaaggaaaatatgataaaaaacatcgacaaagctaatcaagtggcaaagaactacgaaacgatgaagctgagacttaacaccaattacagcaccaacgaagaattgatcaagcagtgcttgctcttagatgataacgatgaagtcgattcagaaaaggagagacagaaatggtttgaaaggcagaacgaacgaaagcaaaagcatagaagaatacaacttgcgaaacaaagagaatcagaagaatatgaggcaaaacgatttgaagcgatgcaaaaaggcaaagatgggaataccaaatacgacgttatcttggacaaggagaaagagaaacttgatcacaaaaaacaaagatcggctgaaaaagtagaaaaatctcacaataacaaccgttacaagattacaagaactaaaaatgttgaatttggtgacctaggcaagaatagtagagattacgaagaaactgaatattcggttatataa

SEQ ID NO: 1816 - DNA, 876 bp, Saccharomyces cerevisiae
atgcctaaaactagttatttaaacaaaaattttgaatctgctcactataataacgtacgtccctcttaccctttatctttagtcaatgagataatgaaatttcacaaaggcacacgcaaaagtttggttgatattggatgtggcacaggaaaagcaacttttgtcgttgaaccctattttaaggaagtgattgggattgatccttcttctgctatgctttcgattgctgagaaagaaacaaatgaacgtagattagataaaaagattagatttattaatgcgcctggtgaagatttatccagcattcgaccagaaagtgtagatatggttatttcagcagaagccatccattggtgcaatttagaaaggctgtttcagcaggtttcctctatattacgaagtgatggaacttttgcattctggttttatattcagccggaatttgtggactttcccgaagccttgaatgtatattacaaatatggatggagcaaggattatatgggtaaatatctgaacgacaaccaacgggaaattttgttgaattacggtggtgaaaagctacgttctttattgtcagatcgatttggagatattgaagtcacaatttacagtccttcggacccaaatgcatcaacagtaacggctgaaaacagtcagtttctctggagagcagctattactctcaatcaatttaaagagtttgtgaaaagctggagcatatacacttcttgggctagagataatccctcgaaaccggatattgccgatatattcattaacgagctcaaagaaatctgtcattgtgaagatttgaatgtacctttaaaaatagagtggtcaacgttttattacttatgtaggaaaagagaatga

SEQ ID NO: 1817 - DNA, 876 bp, Saccharomyces cerevisiae
atggagctaagaagtagacggagcgcagaggcctatcttgtcacgcctgaggaacctgccaagaataagagtgaacggagcatagaatccaatgagagggtcggcacgagggaagcaaagagcgagaacacaagtgtatttagtcccgcttactctgataccgctactacagattcatcgaagaaagttgatgacaatgaatactacaattttactagtcacttcatgccatctttgaaaaacaccagagaactagaaaacacaattctcaatctcatacagaggataaaggaaggggatgatgaaacgttagttagtgagaaagatctcatattaagtgtgcttaacaggtctttagcatccacatctcactggaagttacaggcccagctatcggagttaagggccacctcagagggaaggtatgcagttgagacaaacttgttgaaaaaagaggtagaatttttaaaaaacaagaccccaaaaaccaacgaaagtgcaagttccgcagagttgagaccacttcttgaacgacctttaaagcgtaaactgtcattgccaggactagcgcaaagaccattatccactggcgctaggctagaaggaggatatggaggtgtatcgccgaactcatggaaaaccaaagttccaaaacttcctcttcctgcttcccggccgtctttgaatctttctccccaaaaagtcccaacgggtactgataaagttgaggaagataccaaaattgacacattggaattagtagagaacaataaaccgcatccaaggatgagaagaaggagtgacaatccagcaacaaacgaatatgtgagagtttttcatttggagaaaaaagaacctaaatcacgaaaaaaatag

SEQ ID NO: 1818 - DNA, 876 bp, Saccharomyces cerevisiae
atggcacccagaaaacgctttaggctactcgaattagggtcaccaacacattctaaaaggaaagttcaaaaacctcttcaagagaagaccccaaacttgcgagtttctccacttgcttttaaaattggtaaagaaatcaagaataaggaaatcagaaaaacaaaaaaaacagaatcagaaaatatattcaattcgaaacatgtcgatttaagactagaaagcccacatccaggattaaattttgtaagtgatgctcaacagtactcaaaggctggagatgttcgatatttgaaaaataaatcaagcaataccttgaaaaacgaaagacaaacaatagagcgcccctcatttgataattccttaaggttcgaggacattgagcagcctccaaaatctacttcaacgccggttctttctcaatcttctcaaataaatgtagaaagagaagcacccatgtttccagttccttactatattgctccttctcctatgtataattttagcccgtatcaaaatttcgttggaaacccaacgttcctgacgccaagtcataacccaaacctaaactatgccattcccatccaacggccggagttgctttatccgaatgttaacgtatacgattcgccattgtttaagaaaacaagactgccccatcagaccaaaagtctagataaagaaaaaaattaccaatatcttccaatatatccggtctcgatttctaataacggagattttgttggccaagagacaccaagggcagcaccaaagttaagtaaaaagagactttcaaatacattggatgttaattgttccgattatgagtctagtggacaaaatgcaacttataatgatagtgagtcttcccttaattaa

SEQ ID NO: 1819 - DNA, 876 bp, Saccharomyces cerevisiae
atgggcaagaagaagagtaagaaccaattaaacactggaggtgttcctaatggtgtccataataccaagaaagaggcagctttgccacctttgggaaataagctgggaagcgcaagttttacagctataaatacgctgactaagcccgctttgttttcattttatgatgacgatattaccaagaatgaaggtaatgtttatgacaaggctttattgtctaacgcctctcaattggaaatggttccgccatccgcgactgcgagacacgaaaggtcattgtatgcgaaaataatcaatactattgctgcattttttattctattcatagcaggaatactcttccccatgatatcagaatgtttgtttgataatgaccaattggcaaagggagatatcgtatcctttttaaagcatggtatagaaattaagaacaagatcgtcgcggaacctgacatggtgcctgattgggctgtatttggtactgaaggtgttatctttggttccatagtaccattcattgactctttcgttcgttatcaacaccagccaaaaaccaggtcatcagtttacaaaaacaccctaggatcatttataagatgtgccaatactcttttgggcttaatatttggtattaggaaacttgaatggtcctcctctttgcaggcagctggtgcatggagcttattaaacattgttctgtggttgttctttgatggcactttaaccgtttttttcccaggtctagtaattggtgcccttagtgcgttcacttgctcacaatgtttctcgcagttgtcactggcgttgtattttatagatttctatttttttgggtttttgatgttcagcaagttgggcagatatttattcaattaa

SEQ ID NO: 1820 - DNA, 876 bp, Saccharomyces cerevisiae
atgtctaatccagatgatttagatgatggactcgcctatgattttgatgccgaacatgaagtaatttttgacgccaaggatggtagtcccccaaccaaaaaggtacaaaagaggtctatagaacaagatgacgatgacgttgatgatatagatgggaaaaaagaggagagaaattcagaagatgattcgaatagacctatttcgaaaagacagaaaaagctacagaaaaaatcaaagctaattgagaaaaagaaagaggaaagccagtatatcgtctcacaacgaaaagcacttccagcaagttcaccagaaaaaattattgagtacctaacaactttgatacgagaaaaaaatcctgacttgagtgttttagaattagaggaactttacttcaaaagaaatgattttctttcgacagaaaaatttgacgctgaacgcagattaagcaatttcccagcctttattcaaaaattttccgtagctccaaaaaaaattgttttttctatgtctaatattagagtagcagacgtttatcgtagtctaaacggtggcaaaaattgcgtcaaattattctctaaaagtaaactaaaggatgacatagccaccgtggaacgtttacttactgacagctctaaaaaatcaaacaaaaataaagattcactatattttattgccactccaacaagaatgcagaaaattatagaagctactgacttacttttccaaggtaaggaaaagttagatatcattcttgatgcaagttatttagatcctaaggataatactatattatcattcgagaatgcagccgtcctctgccaagtcttgaaaacctttttgaataaaaaaagctccgtgaaaatactgttatattaa

SEQ ID NO: 1821 - DNA, 876 bp, Saccharomyces cerevisiae
atgtcttctatctacaaagccctcgcaggaaagagcaaagataataaatctgaaaagaagcaaggcaatgtcaagcaatttatgaacaagcaaagaactcttctgatttcgagtagaggtgttaactatagacatcgtcatttaattcaagacttaagcggattattgcctcattccagaaaggagccaaaattggatactaaaaaggatcttcaacagttgaacgaaatcgctgagttgtacaattgtaataatgttctattctttgaggccagaaaacaccaagatttgtatctatggttatccaagccgccaaatgggccaactataaaattttacattcaaaacttgcatactatggatgagttgaattttacaggtaactgtttaaagggttctcgtccggtattgtcgtttgatcaacgtttcgaatcctccccacactaccaattaattaaggagttgctagtgcataattttggtgtaccaccaaatgctagaaaatctaagccatttattgatcacgtcatgtccttcagtattgtagatgataaaatatgggtgaggacatatgagatctcacacagtactaagaacaaagaagaatatgaagatggcgaagaagacatatcattagtggaaattggccctaggtttgttatgactgtcattttgatcctagaaggttcatttggtggtccaaagatctatgaaaataaacaatatgtttcgccaaacgtcgtaagagctcaaattaaacaacaagctgctgaggaggcaaagtctagagctgaagctgctgtggaaagaaaaattaagagaagagagaatgttcttgccgccgatcctttatcaaacgatgccttgtttaaataa

SEQ ID NO: 1822 - DNA, 876 bp, Saccharomyces cerevisiae
atgtctttagttgtccaagaacaaggttccttccaacacattttacggtatgtttattattactagtgagctatgacaaaatcggctaaaaacttaaaaatatgacagacaagaaaggaaattcattcacctctttaatcgtggcgattattcgctaacgacgtgattaaatataataatgatgttcccgggctggactaagaacgtaataataaggctgatgaacaaatttatggtttatgcatcaaaaaggaacatgaatttggcataagcgcacataattacggaacattgcaatagcggtcggaggtaaagtaccgggaatgctttacaatgaatcagctattggcggatattgaccaaccaacactaaaattttatatcctgctccgatttttgtcttggccgtgaaatccattatgcacattttttactaacgtttatcaataagttcggtttcccgtctaaatttttttacgcagtttgttgaacactaacgttgacggtaacattaagatcgtttacgctttgaccactatcaagggtgttggtcgtcgttactccaacttggtctgtaagaaggctgatgttgatttacacaagagagctggtgaattgacccaagaagaattggaaagaattgttcaaattatgcaaaacccaactcactacaaaatcccagcttggttcttgaaccgtcaaaatgacatcactgatggtaaggactaccacactttggctaacaacgtcgaatccaaattgagagatgacttggaaagattaaagaaaatcagagctcatcgtggtatcagacacttctggggtttgcgtgttagaggtcaacacaccaagaccactggtagaagaagagcttaa

SEQ ID NO: 1823 - DNA, 879 bp, Saccharomyces cerevisiae
atgaatacagcaaacactttggacggcaaattcgttactgagggttcttggagacctgatttatttaagggtaaagtggcatttgtcactggtggagctggcacgatatgtcgggtacagacagaagccttggttcttcttggctgtaaggcagctattgtcggcagggaccaagaaagaacagaacaggcagcaaaaggtatttcgcagttagcaaaggacaaagatgcagtcttggctattgcaaacgtcgatgttcgcaattttgaacaagtggagaatgcggttaaaaagaccgtagagaagttcggtaagatcgatttcgtcattgccggtgctgctggaaattttgtgtgcgattttgcgaacctctctccaaacgccttcaaatctgttgttgacatagatttactaggaagttttaataccgccaaggcatgcttgaaggagttaaaaaagtcaaaaggttccatccttttcgtctctgccactttccattattatggtgtgccgtttcaaggacatgtgggcgctgctaaagcgggaatagacgcattggcaaagaatttagcggttgagttggggcctctgggtatacgttcgaattgcattgctccaggtgctatcgataatacggaaggcttgaagagattagccggcaaaaaatataaggaaaaggccttggcaaagataccattacaaaggcttggatctacacgggatatagccgaatctactgtttatattttttcacccgccgcatcgtatgtcaccggtaccgtcttagttgttgacggtggtatgtggcatttagggacctattttggacatgagttgtatccagaagccttaataaagagtatgacatctaaattataa

SEQ ID NO: 1824 - DNA, 879 bp, Saccharomyces cerevisiae
atgacatcactgaatatcatgggaagaaagtttattctagaaagggccaaaagaaatgacaacattgaagaaatatatacttcggcctatgtctctctaccctcctcaactgatacacgtttgcctcacttcaaagcaaaagaagaggactgtgatgtttacgaggaagggaccaatttagtgggtaagaatgctaaatatacctacagatcccttggtagacatttagattttttgaggccaggattgagatttggcggttcgcaatcgtcaaagtacacgtattatacggtggaagtgaagattgataccgtaaacttgccactttacaaggattcgcgttctttggacccgcatgtcacaggtactttcactattaaaaatttaacaccagtcctagataaagttgttaccctttttgaagggtatgtcatcaattataaccaattcccgttatgttcactgcattggcccgctgaggagacgctcgacccttatatggctcagagagaaagtgattgctctcattggaagaggtttggtcattttggttctgataactggtcgttaacggaaagaaattttggtcagtataatcatgaaagtgcagaatttatgaatcaacgatatatttatcttaaatggaaggaaaggttcctacttgatgatgaggaacaagaaaatctgatgttggacgataatcatcatctggaaggcgcgtcatttgagggattttactatgtgtgtttagaccagctaacaggttcagtggaaggctactactatcatcccgcttgtgaattgtttcaaaaactcgaactcgttccaaccaactgcgacgcattgaacacctactcaagtggatttgaaattgcctaa

SEQ ID NO: 1825 - DNA, 879 bp, Saccharomyces cerevisiae
atgcaaaggttttcactagtcactcacagatcattctctcactcctgtgtgaagcccaaatctgcatgctctttggtcaaaccagttcatcacttggtgaaaattgataagtcaaagttatcccctagatttccagaattgaaatatgacaaaagtgatattaggtcacctggatttaaaccaaaagacactcatgcagatagactcaatgaccattaccttaacactttacaatctgatttgttattgattaattattcacataacgctgcggtggtaaagggtctaaaacaaagagcgtggagtggtgattcgccataccacttgaacagaccaccgaaaaatcctcgaggttcgaaagctcaactacctgacattcatcctatcaaatggagtaacattcctgggctagaaagtgttgtaataaactgttttgttagggaagcgagagaaaatcagctattggctatcaccgctgcgttacaattacaacaaattactggatgtaaacctcatccaattttttccaaaaatgatgttccaacctggaaactgagaaaaggtcatcagatgggagctaaagtcgaactaaagggaaaagaaatgtctcagttcttaagcacattgaccgaaatcgtcctaccaagaatcagagaatataaaggtataagcaaccagtctgggaacagatttggtgggattagtttcggcctgacggctgaagatatcaaattcttccctgaaatcgatgcaaaccaggactcatggcctaaaacttttggtatgcacataaatataaacacctcagctcaattagattaccaggcgagaactttgttgagtgggttccagttcccatttttcggagaggagaaataa

SEQ ID NO: 1826 - DNA, 879 bp, Saccharomyces cerevisiae
atggaggacagtaaaaagaaaggattaatagaaggcgctatactcgatataataaacggttccattgcaggcgcctgtggtaaggtgatcgagtttcctttcgatactgtgaaagtcaggttgcaaacacaagcatccaacgtgttcccaacaacatggtcttgtataaaatttacttaccaaaatgaaggaatagcacgagggttttttcaaggcattgcttcacctttagttggagcatgtctggagaacgcgacattatttgtgtcttataaccaatgttctaaatttttagaaaaacatacaaacgtttccccgttggggcaaatcctgatctctggtggagtagcgggttcatgtgctagtttagttttgacacccgtggagctggtgaagtgtaagttgcaggttgcgaacttacaagttgcatcagctaaaacgaaacatacaaaggtgttgcctacaataaaagcaattataactgagagaggattggcaggattgtggcaagggcaatcgggcacttttattcgagaaagcttcggtggtgttgcctggtttgcaacctacgaaatagttaagaagtcgttgaaagataggcactcccttgatgacccaaaaagagatgaaagtaagatatgggaactacttattagtggagggagcgctggattggcattcaacgccagtatttttcctgcggatactgtgaaatcagtaatgcaaactgaacatataagcctcaccaatgcggtgaagaagatatttggcaaatttggactaaagggtttttatcgaggactgggtataaccctttttagggcagtaccagcaaacgctgcagttttttacatctttgagactctttctgcactttaa

SEQ ID NO: 1827 - DNA, 879 bp, Saccharomyces cerevisiae
atggattctgcaagcaaagaggaaacattggaaaaacttgatcaagaaattacagtgaacctgcagaagatagactctaacttgagtttctgctttcataagatcacccaggacatcatcccacacgtggctacatattcagaaatatgtgagcggatcatggatagcaccgaatggctggggactatgtttcaagagactgggctggtgaatttgcaggcaaatgcagctgcaccagtgggaaacgctccagtcaaaagccttgtgagcaataatgttggtatatttcctacatccgctgaagaggcgagtaggcagtcccagacagacaatgggcctaacgaggcagattcagctgtacatgtcaaccgggatgtccattctatgtttaataacgacagtatagatgatttccacacagcgaatataacatccacgggacagatattgaaacttccggactctagcgacgaagatactggttcagaggcggtgccttcaagggagcaaacagaccttacaggcgagggtcatggtggagctgatgatgagcaagatgaaagtacaatacagagacaaagccgcaaaagaaagatttcgctacttttgcagcagcagtacgggtctagttccagcatggtaccgtctccgattgtgcccaataaaatgcggaagcaactggctcatgaagaacatattaataacgacggcgataacgacgatgagaacagcaataatatagagagctcgcctctgaagcaggggcaccaccacccgaagggacaagcggatgataacaacgaagggcccgatgaagaagagagtacgaaagaagtaccaaagcctgggaccatcattcatttttctacgaatagatag

SEQ ID NO: 1828 - DNA, 879 bp, Saccharomyces cerevisiae
atggcatgcaattttcagtttccagaaatagcttatccaggtaaactaatatgcccacagtacggtacggaaaataaagatggcgaagatataattttcaattatgtgcccggtcccggaactaaactaattcaatatgaacacaacggacgaactttagaagctataactgctacactagttgggacagtgaggtgtgaggaagaaaaaaaaactgatcaggaagaagagcgtgaaggcactgatcaatctacagaggaagaaaaatcagtagatgcatcacctaatgatgtcacaagaagaactgtaaaaaatattctggtttcagtgcttcctgggacagaaaagggtcgtaaaaccaacaaatatgctaataatgattttgccaataacctaccgaaggaaggtgatattgtgctgaccagggtgacaaggctttcgttgcaacgagccaatgtcgaaattttagctgtggaagataaaccatctccaattgatagtggcatcggcagtaatggatcgggaatagtcgctgctggtggcggttctggagcagctacgttctctgtttctcaagcatcatcagatttaggtgagacattcagaggtataatcaggtctcaggatgtacggtctacagacagagatcgtgtgaaagtgatagaatgtttcaagccgggagatattgttagggcgcaagttttatcattaggtgacggaaccaactactatttgaccactgcaaggaatgaccttggggtcgtgttcgccagagctgctaatggtgctggtggattgatgtatgctacagactggcaaatgatgacttcaccggttacaggcgctacagaaaagcgcaaatgtgccaaacctttttga

SEQ ID NO: 1829 - DNA, 879 bp, Saccharomyces cerevisiae
atggtattaacgaggcaagtactagaggaagtggagaacacatttattgaattacttaggagtaaaataggacctctcgtaaaatcgcacgcaggaacaaacttttgttcatatgatgataaagcaaatggcgtagatttggtaactgctttagacaaacaaattgaatctataatcaaggaaaatttaacggccaagtatcccagtttcaaatttatcggagaagaaacttatgtaaaaggtgtcacgaaaataactaacggccctacatttattgttgatcccatcgatggtactactaattttattcacggttacccctatagttgtacatctctaggtttagctgaaatggggaagccggttgttggtgtggttttcaatcctcacttaaaccaactattccatgcttccaaaggcaatggagctttcttaaatgatcaggagataaaggtttcaaaaaggccattgattttgcaaaaatccttaattgctttagaaggaggttcggaaagaactgaaggttcccaaggaaactttgataagaaaatgaatacttataaaaacttactaagtgagtccggcgcctttgttcacgggttcagaagtgcaggaagtgctgccatgaacatatgctacgtagcgagcggcatgcttgatgcttattgggaaggtggctgctgggcttgggatgtttgtgccggttggtgtattcttgaggaagcaggaggaataatggttggcggaaattgtggagaatggaacattccattagacagaagatgttacttggctattagaggtggatgtgagtcgatggagcagaagcgatttgcagaatcgttttggcctcacgttgcgggtgagttagaatactaa

SEQ ID NO: 1830 - DNA, 879 bp, Saccharomyces cerevisiae
atgtcatattacaacaggtataggaacaaaagaagaagcgataatggtggaggaaacttaagtaacagtaacaataacaatggtggtatgccatctggactatccgcatcagatgcaatttttgatctgggtaaaaataagagggtcacggtaagacaatttagaaacataaatttaattgatatccgtgagtactatctggactcatctacaggcgaaatgaaacctgggaagaaaggtatttcgttgacagaagatctatacgacgaattgcttaagcacagattgaatattgatgaagccttgagaaggctaggatccaagagaccaaaaaccaaaatggttagactattgtccgacgacgaatatgaagatgataacaataatgacagtactaataacgacaaggataaaaacgggaaggacaagaacagcccaaagaagaggagagaagataagtccaaagcatctaatgagagtcatgacttggagccacgttcaaagaagaagaaacctgctccacctactctacttccacacgaggaaaacattcaaaacgctgaaagagaagccaatgctactttgatcatcccaggccaggcaggtaggaaacaacaagaggaacgcaagcaaaaggaaaaagaagaggcagaggaggcaaaggcaaaagcagttgcagaacaagagaaagaggcaaaggcaaaagaaaagatagctgaacctgaacctgaacctgtacccacacttcaagctaaaaaagaagatattgtctccaacataaacgagtcaaaagatgcaaattctagtgacgaagaatttgctcaaagcttggaagctgaaatgaacaaggctgaagacgacataagtgaagaagaataa

SEQ ID NO: 1831 - DNA, 879 bp, Saccharomyces cerevisiae
atgtccgcagaaccattattacccacacataacggatcgcagggaggggaagtgaggtccccagatcagaagttcattgtgatacggttttccgacgtatcagtaagggatctgcagttgaacatatcaaatgtaccattttcgaatataaatacccactggctacgtcggatgtgtagagaattgaggccccaacaaacacaaaaaagaagactgaagtttataaggaacgggagtattctgaatacgcattccaagattgctgaggaactgacgcattacttcgatactgctaataactctaacgtcgcaacaggcaccagcgtggcaccagagcagaacaactactatattcattgtataattggtacagaggagctgacacaagcagagttagccaacgaagatctaaaggacgatgcaactccgtccaatgactccatgaccacgcaggccatcgggtttgataggctacgatccgtgggatttactgagcaagaaatcgaactgctgaggcaacagtttcgggccacgtatggagatttggaggaggaggaggagagacttgctcaaaatggcaacagagatgatgagggccatgacattagacagttggaggaacagtggatggaaagcgggagtgggaccgctcaggggaatggggccggaggcggcaatgaagacaggtttaactctgtgccgatcgctaacataaagcacaacaaagacttgcttttaggtatatgtgtcggattcttcttcggcgtctttggtatactattaatgaagtttgatggattgttcaacagacggcaaaaaatggcgatttttgccggtgtgattgttaatgttatgttttgtcttgtgagaggtttttag

SEQ ID NO: 1832 - DNA, 879 bp, Saccharomyces cerevisiae
atgttgaaggatttggttagagaaaagcttttgacaattatgaataccaaagcgtatactcaatttaatccagaacaattactgcaactagaaaatgaaatgaaaatttacatgaaaagcggagactctgcactaacagaaggaaactatttcttcttgatggaaatgcttttctatgttttggtgtaccgaaaccaagacgttgatgcgcaagttgtttataatacattaagagatcgtcttggtgaaaattcgtataaaatggtaatcatgaaagccactttattgcagataaacggaaatgataaaggcgctattgaatatctggaaaatttgttgaatgatgatctggagtatgaaacggacttcgttacttatgtctctattgcaaagaaattgatagctatcaagacaacttccaagaacttgagccaagaaagtgttcttaaagaagtggtagctcttacagataaattcccgcttgatgcagaattgtggtggtatgccagcgagatttatttcgaaatgggccaatttgaaaaagcctgttattgtttggaacaggtcctatgtattacaccattcaattacgcttgttttggtaggctaagtgagactctgtattatgaggctctacgtagcaagaaacaaaccaagaccgagctcttggaaaaggcattaaagaatgctttgaggagcgttgaacttagcgaactatacctaaaagggtgggcattggttaacatcatttctcgcgaactgggacgtaataaacaaaatgacttgatcaaactatctgcatcgaagctaaaggaaatttctgcgaagtctaacaataaagataagattaccgctgaattaattttgaataagatatga

SEQ ID NO: 1833 - DNA, 880 bp, Saccharomyces cerevisiae
atgtatgaagtaatacagaaaaggaaaacaaaaataataaacgttttacagagtcctgaactcatgaggctcatagaggacccatcaaatctgggtatttctttacattttccagtaagttcactgctaaaaagtaataagtgcacaccaatgcctaaactttctacgtatagtttggctagtgggggatttaaggattggtgcgcgtgacatccctctagacgttccaccagagattgatatcatcgatttttactgggatgttattttatgcatggaatctcaattcatattagattacaatgttccgtcaaaaaataaggggaacaatcagaagtctgttgctaagctgttgaaaaataagcttgtaaacgatatgaaaactacgttaaaaagactaatttataatgaaaataccaagcaatataaaaataataatagccacgatggttacaattggagaaaactaggctcgcagtatttcatactgtatcttcccctatttacgcaggaactgatttggtgtaaacttaatgaaaactatttccatgttgtattaccatctttactgaatagtaggaacgttcatgataaccacagtacctatataaataaagattggttacttgcccttttagagctaacttccaacctgaaccaaaacttcaaattcgaatacatgaaattgagattgtatattttaagagatgatttaattaataatggtttggatcttttgaaaaatcttaactgggtcggtgggaaactgattaaaaatgaagatagagaagtcttgttgaactcgaccgatttagctacggattctatttctcatttattaggtgatgaaaactttgttattttagagtttgaatgctaa

SEQ ID NO: 1834 - DNA, 882 bp, Saccharomyces cerevisiae
atgaaggcttctagtaaagctattaaattagtactggaccatctgaagtccacgggaagagttcttggctccgtagagtcaggaaattcagcaacaataagtgagaaaacggcatctgttaataagcagcagcagttgcaggaaaagaaaccttctgtcctacaatatagaagctacaatccatatttagttaaggaggatttcctgtcaattctgccagaaaatttgtataaaaagaggggacaatttacaaatgagcttgactttcagttgatgaaagtcagggaccctaaatacttccagttcaaggatcagtattacttgttttttaatgattataactcgcttactgagtatatcaaattaacaaaacactcgcgaataaacaagatcagggtgaaaatgacgccattggcgcaacccttgccaaccctgttaacaaaattacaaagatattcaaaaaatctatataacgcattccgatcatctgagcaatattttgagggactaaacgaaaaagtcgatgttagtggagagttcactaccaatcagttacggagtatccttgattcggtggaagaaatagaaaataagtccgtattagtctggaatatacccactaaattacggtcgcacgatatattgaattatttttggttttacaacataaggtctagcttcaagatatactgggatgatgaaatgaaaagaaatctacgatttatatctttcgaaaactcgcatgacgcctaccgctttaaaagaaactatcatggattattggctaaagagctattgaccctgtcagaaaagggagatgcagctgactattcgctcgaaatggacgattccaaaatattaattgaacatcttagtgaatga

SEQ ID NO: 1835 - DNA, 882 bp, Saccharomyces cerevisiae
atgcatatgcaactcaggaaaagaaaaagggttgactattcagggagaaatcagacgtccgatcctccttcaaccacaacggcagcggtaccatccattattgtccctaagaagcgtaaagtagtcgcacaaaacatggttagtccagctattcgagccacaaccacaacactgggcacctcaaatataataatacctaagcctctgcagcgccctaaattccacaatagcgccagcctatcttcacctgatgatgatcccgaaaagatctctgtattggaagttcagaaaaatttgtccaatctcatcaaaagacaacaaagattattttataaagatatacataagccgactctcgccggcttgaaaaatttcgaaatgttaaggctgcccaatgatctaaaactcctacaaaacatcgtaaacctattatattcattcgagcaattaaacagtgactcgaagacaagaccagtcactacttccaaattaaaggcctcctctcaagcgcactcagacaaattgaaaaaaatgctagctgagaggaaacctccatttagccaccccagtcacagcggcactgcctaccacaatgacatcatccatgagatagcgaatttgcattctattaacctggtagatttgattaatttggaagtatataataacaattgccatacaaacaacacagcgttgcaaactacggcgaattcgctgacacttaatagcattatcaaaaagcttgacaagccaatactgaaagaaagaaataattctctggtatggccccataaaagcagatttaaagcaaaaaggaaccaaccttcgcctggccaatctttaattaacaatacagatataactctctacaacgatgtatag

SEQ ID NO: 1836 - DNA, 882 bp, Saccharomyces cerevisiae
atgctggtagatttgaatgtaccgtggccacagaacagctatgcagacaaagttacttctcaggcggtcaacaatttaataaaaacgttatccacattgcatatgttgggatatacacacatcgccataaattttacagtaaaccacagcgagaaattccccaacgatgttaagctgttaaatcctatcgatatcaagagaaggtttggagaattgatggatcgaacagggctaaaattatacagcaggatcacgctaattatcgacgatccatcgaagggacagtctctttccaagataagccaggcctttgatattgtagcagcattgccaatcagtgaaaagggccttactttatcaactaccaatctggatattgacttgttgacctttcagtacgggtcgcgcctgcctactttccttaagcataaaagcatatgcagctgtgtgaacagaggagtaaaacttgaaattgtttatggctatgctttgcgtgacgtacaagctcggaggcagttcgtatccaatgtaagaagcgtcatcaggagttcgaggtccagaggcattgttatcggcagtggtgccatgtcaccacttgagtgccgcaacatattaggagtaacaagtctaatcaagaatttaggtcttccgagcgataggtgttcgaaggccatgggagacctagcttcactcgtcctcctaaatggccgcttaaggaataagagccacaaacagaccattgttaccggtggtggtagcggaaacggcgatgacgtggtcaacgatgttcaaggcatcgacgacgtccagaccatcaaggtagtgaaaaggagtatggatgctgaacaattaggccatgcttccaaaagacacaagccttaa

SEQ ID NO: 1837 - DNA, 882 bp, Saccharomyces cerevisiae
atggaaagcacatcaggagaacgttccgaaaatatacatgaggatcaagggataccaaaagtaattctgcccgctgattttaataaatgctctagaactgacctagtggtgctcatatcacgaatgttagtatcgctgatagcaatcaatgaaaattcagcaacaaagaaatctgatgaccaaattactttaacacgataccattctaagattcctccaaacatatcaatcttcaactatttcatacgactgacaaagttttcctctttagaacattgtgtgcttatgacatcactctattatatcgatttattgcaaactgtgtatcctgattttacgcttaattcgttgactgcccataggtttttattaacagccaccacagtcgcaacaaaaggcttatgtgattcgttctcaacaaacgcccattatgcaaaagttggaggagtacgatgtcacgaattgaatatactggagaacgattttttaaagagagtaaactacagaatcattccgcgggatcataacattacgttatgtagtatagagcaaaaacagaaaaagtttgtcatagataaaaacgcattagggtctctcgatttggattcttattcttacgttaatcgtccaaaaagtggatataatgttctagataaatactatcgaagaatagttcagctggtgggttcctttaacgcttcacctgataagagtagaaaggttgattatgttctcccgccaaatattgatatagtgagtgaaagtggctcccaaactactcaactaaaggggtcgtcatcacccaattctcactcttcacaaaagcgatattctgaggcaaaggacgcacatatctataacaagcgatcaaagccagattaa

SEQ ID NO: 1838 - DNA, 882 bp, Saccharomyces cerevisiae
atggaggaacaggagataggcgttcctgcggcctctttggcaggaataaaacatatcatattgatcctttccggaaaaggtggtgtcggtaaaagttcggtaacgacacagactgcgctgactctttgcagtatgggcttcaaagttggagttttagatattgatttaacagggccatccttaccgaggatgtttggcctagagaacgaatctatatatcaaggtcctgaaggttggcaacctgtgaaagtggagacaaactctactggctctcttagtgtaatatcattggggtttctactaggtgatagagggaacagcgtgatatggaggggtcctaagaagacttctatgataaaacaattcatctctgacgtcgcctggggtgaactggattacttactgatcgatacccctccgggaacgtcggatgaacatatatcgattgcagaggagctgagatattccaaaccagatggtggtattgtagtaactaccccacagagtgttgcaacagctgatgtcaaaaaagaaatcaatttctgcaagaaggtcgatttaaagatcctcggtataattgaaaacatgtcagggtttgtatgcccgcattgtgctgagtgtacaaatatcttttccagtgggggtggtaaaagattatcggagcaattttctgtcccataccttggtaacgttcctatagatccaaaatttgtagaaatgattgagaatcaagtttcaagtaaaaaaacgcttgtagaaatgtacagagaatcatctctttgtcccatttttgaagaaataatgaagaaactgaggaaacaagacactacaacccctgttgtggataaacacgagcaaccccagatagaatctccaaaataa

SEQ ID NO: 1839 - DNA, 882 bp, Saccharomyces cerevisiae
atggcacaagaaatcactcacccaactattgtagacggctggttcagagaaatttctgataccatgtggccaggccaggccatgactttaaaagtggagaaagttttacaccatgagaagtcaaaatatcaagacgttttgatcttcaaatccactacatatggtaatgttctagttttagataatgtaattcaagccaccgaaagggatgaatttgcctaccaagaaatgattgcccatcttgccttgaattcccatccaaatcctaagaaggttcttgttattggtgggggtgatggtggtgttttgagagaggttgtcaagcatgattccgttgaggaagcctggttatgtgacattgatgaagctgttattagactatcaaaggagtacctaccagaaatggctgcctcttattctcacccaaaggttaagacccacattggtgatggtttccaatttttaagagattaccaaaacacatttgacgtaatcattactgactcttctgacccagaaggtccagctgaaacccttttccaaaaggaatatttccaattgttgaacagtgcgttgacagaaaagggtgtaatcactacacaagcagaaagtatgtggattcacttgccaatcattaaggacttaaagaaagcctgttctgaagttttcccagttgcagaatactctttcgttactattccaacttacccaactggtacgattggttttatggtttgctccaaagataaaacttgcaatgtcaagaagccactacgtgaaatctctgatgagaaggaggctgaattatacagatactataacaagaaaattcacgaagcttcctttgttctaccaacctgggcagccaaggaattaaattag

SEQ ID NO: 1840 - DNA, 882 bp, Saccharomyces cerevisiae
atggcatctgtgaacaattaccaggttgattgcgggtcaaggtctgctcgcattcaacccagaattaataacggcattcacgatgaagaatcgctatttgaagtcctggaactctcagaagaggaatttgagctagacttccatagattaaagtcattcaatgatgtaagggttatcaataacccagatttatctccagaatgtacaaatactgccattagtcgcgatgagacactggaatctgcaagtagtgccttcgaagttccttctgacgaaattgctatactgtcgatatccagtgacagcaataaaaattctccgccctcagagcagccggcgcccgctcttcgtaacattcgatcgtctagtaactctgaccggatcgatgagtggtgtttgggcagccatttatttaatgagctgcatcaaaatgtccctcaatcaagcgacggtgtcaatcatggatttcccgtttattcctttaaggaaagagaactttatacctctgcgaaattaaagaaacttacaaatgcccaaagaattgctgtgcagaaactatcaagagacttgtatccaattctaagaacatgctaccgcgagaaaactcgccggcaattattgacataccatcatgaaagaatatttgacgatataccatcttttttcccccagcgtgactttattttcaattactactcgatgcctcttgaattcgacaggttgtcagacgtagatatagattcgtcatcgcggtcacgatttacagatgagagcactggagaaacattaaaccgttcaccaagcgcagcgtcttcgtcgttggaaaacacatcttggtttggctggactttactttctaggtttttggacagagaatggtag

SEQ ID NO: 1841 - DNA, 882 bp, Saccharomyces cerevisiae
atggcgtcccaggttaacgccttattactgccggtcatagagtctacgccgcttcatcaaataaccaaggtagcattgacgaccacactcacaagtaaacaaagcgattacaagttcaaagaaatagccgtgccgttaacaaaatcactacaactgtacgagaaggcgcaaagaagacaagatttaagggcaagcttaaaagcactggagagtatcatttaccaaacgcacttccaatggaataacccgctcccacgacatgcgcatctcttccaaaaacactaccactttctactgactcactggccatttgagaaccacagagacttggtagattccatcgctgtaaacaatgggaaactaaattcaacgtcttcaaggagcgtctggctgaaggcggattggataacactgtttaacgttaaaaacccttgggtccaaacgccgccatcgttaatgcgtctgagtgggacagatcttgataccttcacaccagagaggatattcctgataaattctcttggaaaccactacaaatttttaatagcgaacagtcatctaagctacaatcacaaaaaatacccctcccctggcgtgcaaattcctgtcaggaacgctcttggcgaagtttctccggccaaacaaattgcccaacttttcgcaagacagctgtctcatatttacaagagcctcttcatagaaaaccccccgctctctcctgagaacgagctggcattgactgccgtcttctatgacgagactgtagagcgacgccttagaaggctctatatgcgagcttgtgcaagggcatatacgactactaatgccgactccaccacggagcctttgatgtttcattgcacccggtgggaagttgattag

SEQ ID NO: 1842 - DNA, 882 bp, Saccharomyces cerevisiae
atgtccaatgatgagataaaccagaacgaggaaaaggtgaaaagaacaccacctttaccgcctgtgccagaaggcatgtctaaaaagcaatggaaaaaaatgtgtaaaagacagagatgggaggagaataaagccaaatacaatgcggaacgccgtgtaaagaagaagagacttcgccatgaaagaagtgcgaagattcaagaatacattgacaggggagaagaggtcccgcaggaattgattagagagcctcgtatcaatgtgaatcagactgattctgggatagagatcatacttgactgttcttttgatgagttaatgaacgacaaggaaatagtaagcttgtctaaccaggtcaccagggcatactccgcgaatagaagggcgaaccattttgcagaaataaaggtggccccattcgacaaaagactaaagcaaaggtttgaaactactctgaaaaataccaattatgaaaactggaaccattttaaattcctaccagacgacaaaatcatgtttggagatgagcatataagtaaggacaaaatagtgtatttaacggccgatacagaggaaaagctggagaagctggaacccgggatgcgatacattgttggcggcattgtagacaagaatcgttataaagaattgtgtctgaagaaggcccaaaagatgggcattcctacgcgaagattgcccattgacgagtacatcaatctcgaaggcagaagagtgttgacgacaacgcacgtcgtgcaactcatgctgaaatactttgatgaccataactggaaaaatgcctttgaaagcgttttaccacccagaaagctggatgcggaagcaaaatccgcaagctcttcgccagctccaaaggacacatag

SEQ ID NO: 1843 - DNA, 885 bp, Saccharomyces cerevisiae
atgaaattcgacaatgacagtgagaagcaggttttcgataagcttaaaaaagcgattcctggtattatcaaggaaaaatgtgcaggatacgatgaattgtatggttacaagttgaatcctgaaggtcttacacaagaggaggttgataaatactatgacgaaaaaatcgccgatcgtctaacctacaaactttgcaaagcctatcaatttgaatatagcaccattgtacagaacctgatcgatattttgaattggaggagggaattcaacccattgagttgtgcctacaaggaagtccataatacagaattgcaaaacgttggtattttgacattcgatgcaaacggcgacgcaaataaaaaggctgtcacttggaacttatacggccaactggtcaaaaaaaaagaattgtttcaaaatgtggataagtttgtacgctacagaatcgggctcatggaaaagggtttgagcttattagatttcaccagctccgacaacaactatatgacccaagtccacgattataaaggcgtctccgtgtggcgaatggattctgacattaaaaactgtagcaagacggtcattggaatctttcaaaaatactatccagaactgttatatgcaaagtattttgttaatgtccccaccgttttcggctgggtttacgatttaatcaaaaagttcgttgacgaaaccaccagaaagaagttcgtggtattaaccgacggcagcaagttgggtcaatacttgaaggattgcccatatgaagggtatggcgggaaagataagaagaacaatctgaccaagcaaaatgtcacaaatgtccatccaacagaatacggcctttacattttacaaaaacaaatcatcgaggacgttgagtga

SEQ ID NO: 1844 - DNA, 885 bp, Saccharomyces cerevisiae
atgaacacgaatcagtccaatccgaatacagatttaacagatgatgccaatatagaacatacgttgcatcggctgctcactcaggcaaataatcattttgatgatacagtaaagattgatgggcagagtttagatttgggaaaggatctcgaacaagttatgatggataatttagactgcactgatatttttgattccgacatcgcttctcagaaacacctaacattggaatctttatttaacgatgaacacaacaccgattcgagcacacttttggaaatgcagagaagtgctaatgatagcctagttggtattgatctcgataggcataaaaagggttatactggcaaggcatcattagataaaagtacaaaccaaaataacgtacataaacctgataaagaacaaaagaactataagatagataaacccaccatcaagaagaaaaaatcccttttgaaaaccacaaatgaacccatgttatcccctgcatccctatcaccttcatcttcgttagcttcatccgacgctaatgaatcccacctaaaaatagaatccatgattactgatataacatctaaaatagattctgcaagacaagacattgtatctgcaacgaagcctgctaagttcacaaatgagtttacaataagtcaaatttcggaaatgaaggcaagaataattaatactcataaattgctgctcaatttcaattttattaaagaaggttacgcgagatcttgtattcaattgaaaaaatctatggactctttaaaggatagtgaaattcacagagcacatttattggttgagaatgatgacttgaagcaacaaatcctagaacttactcaaaaactcaatgaaaaatcatccaaggaaagttaa

SEQ ID NO: 1845 - DNA, 885 bp, Saccharomyces cerevisiae
atgaaggctactttactgttgaaggcccagctctcacctgttagctatacgacgaagaaatctttccaaaggcaactcaatcgcactccatacactgcttttcaatacttcttccaacttgaagtccaaaagttacataacgtctcgaagtatgaggatattataaatcacgtaagagggaatagcaattttaaaagatttgcaaggaatgaatgggatagcatgtcattgactaagaaaagactttactatgcatccttttgccagtcaatggatattgacattttgaatgtcagtaaaattgaacttgccaaaagattagaaattcccataccagcaatgagtgaatatttgttatttagaaataagttcaaggtaaaatttgactctcattgcagctccttggagcgtaaagatcgtaaaagtgttccacgaccctctattactaggaaggttgcaactacagaaatatgttcaaaaagccgtagcaacacacccgtcggtaaaatcaacccccggaaacgattagtggcattgaaaaggatttcccgttcagagaacactgcaaaaaatcattcccatgaggctcaaaattacctttatgattatatgaaaaggtttcaacaaatgtgcaaagaatgccggtatgcttggaacgaagaggttgactatgaccagaaactagaaattagaaaaaaattacaggtatggagggcaaaatttgaggaaatgatggataacgagatacaaatattacaaaaaaacatggatatcatgtcaaagtttggtctcagaagtgagtcctatcttacagcagcgaatcacgatacaaatacacaaccaaataatattcttcccatgacgtacctactaaaaaagaaatga

SEQ ID NO: 1846 - DNA, 885 bp, Saccharomyces cerevisiae
atgaatgacattaaacaattactttggaatggtgagcttaatgtgctggtatcgatcgatccttcatttttgatgaaaggaagtccaagagaaattgcggtgctacgaataagggtaccaagggaaacatatttagtcaattatatgcccctcatttggaacaagattaaaagctttctttcttttgacccattgaccgacagtgagaagtatttctggtttgagcataataagacgcctattccgtggaattacccagtaggtgttttgtttgactgcctagccggaaaaagcgctacttttaccacctcttttgagaaccaggtaaaggatgttctcacttttttgagaattcacttggttatgggcgattcgttgccaccaactatcattcccatcgcatctagcaaaacgcaagcggaaaagttttggtttcaccaatggaaacaagtttgcttcatactgaatggttcctcaaaagctattatgtctttatcggtcaacgaagctcgaaaattttggggcagtgttattacgagaaatttccaagatttcattgaaatatctaacaagataagttcatcaagaccgcgacatataccgctcatcattcaaacctcaaggacatcaggaacttttcgaatatcacaaccaactatcagtatgactggagtcaatcctacgttgaaggatattgaaggcgatattctggacgtaaaggaaggaatcaatggtaatgatgtcatggttatttgtcaaggaattgaaattccttggcatatgctcctgtatgatttgtattctaaattgcgaagttttgatggctttttgtacataactcttgttcctataaaaggcggcgataaagcttcctctgagctctaa

SEQ ID NO: 1847 - DNA, 885 bp, Saccharomyces cerevisiae
atgactttaatggtacctttcaaacaagttgatgtattcactgagaagccctttatgggaaatccagtagcagtaataaacttcttggaaattgatgaaaatgaagtcagtcaagaagaattgcaggcaattgccaactggacaaacttatcagaaacaacgtttttatttaaaccatctgataaaaagtatgattacaagttgaggatctttactccaagaagtgaattgccatttgctggtcacccaaccattggttcatgtaaggctttccttgagttcaccaaaaacaccactgcgacttctctcgtccaggaatgtaaaataggcgctgttccaataacaattaatgagggactaattagcttcaaagctccgatggctgattacgaaagtatatcgagtgagatgattgctgattatgaaaaagcgattggtttgaaattcataaagcctcctgctcttttacatactgggccagagtggatcgtggcgctagtagaagatgcagaaacttgcttcaatgcaaacccaaattttgctatgcttgcacaccagacaaaacagaatgaccatgtgggaattatcctagcgggccctaaaaaggaagccgccatcaaaaactcctacgaaatgagggcgtttgctccggtgataaacgtttatgaagatcctgtttgtggtagtggttctgtagcccttgcaagatatttgcaagaagtttataagtttgagaaaaccacggatattaccatttctgagggtggaaggttaaaaagaaatggcctaatgttagcttcaattaagaaagaagctgataatagcacttcctactatatagcaggtcatgccactaccgttattgatggtaagatcaaagtttag

SEQ ID NO: 1848 - DNA, 885 bp, Saccharomyces cerevisiae
atgcatttcaaagatttaggattgcatgactacactctcaaaaacttgatgtatgagaataattgctgtaaattttatgatgccgtggatgaaaacaacatctcatatgttttaaaatttgttccctcagatgtgacttcggaaggggatactttcccattcgtggatcgctttcaagtaaaggaaggtgtttttttggtatattcctcaaatgactttggaaaagaaggtacggactactttacttatactggtagtggtggaaatgaggttcacatctcgggcacctcttcagaagcaggaataaaaccgcagtttattgaaacttgccatccaaaacatcttaagcggggaacaaaagagcaggaagatataaatagtagtacctcaaagaaaagtgcagttatcaacaatttttcgggtgaaaaaacaccaaatccaaggccacagagttccaacatttcagaaagagagacgtatgtcggaatattgaacgtcaaatgtaaaaataagaactcatcgaaaatacgaagtgaaaaattggtaagctccgtcatcgaaacaaagcatacgccaggattggcatctattttatcgaaagaaggcactacatatccgaataatgcggacgggaaacatatcagtatcgtgaatccatcctcaaaaatatatcattcatcccataaacagattgttaaaacgcctatccctaagagtggcctttctccaattgagagatgccctttcaatggtcaaaatattaaatgctactcaccaagaccactagatcatgaaagtccccaacgtgatttcaataataactttcagctgagaatactgaagagctcggtgttgcaaaggagacaatcaacacagaatagttga

SEQ ID NO: 1849 - DNA, 885 bp, Saccharomyces cerevisiae
atggacattaacatagacgatattcttgcagaactggataaggaaactactgctgtcgactctaccaagatcacgcaaggttcttcttccactacccacagagatgcaaatacaatagtgggttcgtccttagacttgaatgacaagactcagatatatgtctctccccagcaggatttttctgacttgatgaagtcttggaaaaatgaacggtgttcgccagaactcttaccatatcctcatcagttgatgaaaagattattgaatcgaatatccatgcaatctcaattaattgaaaacatttcaatgggattcctcgatatgcaaaatgcttctaatgcgaacccgcctatgcctaacgaatctaaattgcctttactctgcatggaaactgagttagaaagattgaaatttgttattagaagctacatacgatgtaggctaagcaaaattgacaaattctcactttatttgcgccaattaaatgaagatgaaaattcgctgatctctcttacagatttactatccaaagatgaaatcaaataccatgacacgcattccctgatctggttgaaactagtcaatgattctatcctgaaatacatgcccgaagaacttcaggctattaatgatacagaaggtagcgtaaacatgatagatgagcccgactggaacaaatttgtctttatacacgttaacggcccaccagatggtaaatggaacgaagatccgctattgcaggaaaacgagttcggtaaaccttgctacacggtcacaatacccgatttaaaggaagaggttgaactcactattggaagtatttacgttatgagatatgaagtcattagggatctgctgagagacgacaaagttgctcttatttga

SEQ ID NO: 1850 - DNA, 885 bp, Saccharomyces cerevisiae
atggataattttgaaagtactgctgaaggaaatttaagtataggaaacaaacgagtatacgaactacgaaaaagaaacttccaaagaaatttggtgaataatttgagctttctcgggtatgttttaatatcattggaatatatcaagtatgatcgtaccgtctggacacttataacaagagcaatagtgcaatctctcataagttctccttttccaagtgatgccaagttacgtaggctagcgaccctcggtgcagataataacacgacgggggttgcaacacttccaggcggaagatctatcaggtttcccggaatgtttggaacagaaatgctttataattcttctagtgaagctgagcaacaagaccatgatgataccgctattgtgtccatgaaaaagcaaatccggaagtttttatttcatggttgcttatcgttgaatatgcttttcattatcttaacaatcctattcccaattgatttttttgaacccctgagtggtagcgagccagtagacgatggccctaagaatactccctcacccttttccaattcagatggtctacttttgggtgagagaagaggtgggctttttctacagatgatcggagaacggctaccaaagagcaacttttccggcaatcttggattagtaatgttcgaatttagcatacttattgtacagtttactttattttcactaacatgtgttgtattggcagatttagattttgaagagccagaaagactagaacctgtaaatagtgatggctacgatggctctgtaatagttgcacgaataccattaaataaaaccatgaatgccattttaaatgacggcaatattaatgacaacaatgagaatgctagcaattctgtctaa

SEQ ID NO: 1851 - DNA, 885 bp, Saccharomyces cerevisiae
atggcaaaaccgcgtggaagaaaaggcggcaggaagccttcacttactccacctaaaaataagagagctgcgcaacttagagcatcccaaaacgcatttagaaaacgaaagttggaaagattagaagaactagagaagaaagaagctcagctaacggtaacaaatgatcaaattcacatattaaagaaggaaaatgaacttctccattttatgttgaggagtcttttgactgagaggaacatgccttctgatgaacggaacattagtaaggcctgttgtgaagaaaaaccgcccacatgtaacactctcgatggtagtgtggttctttcctccacatataattcccttgaaatacaacaatgctacgtatttttcaagcaactgctctcagtgtgtgttggaaagaattgtacagtgccgtcaccgttgaattcctttgatcggtccttctatcccataggctgtacgaatctctcaaatgacataccaggctattcttttctaaatgatgcaatgagtgagattcatacgtttggtgactttaatggggaacttgatagtacctttttggagtttagtgggactgaaataaaggagccaaataatttcattactgaaaacactaatgcaatagaaacagcggcagcgagcatggtgattaggcagggtttccatccaagacagtattatacagtggatgcttttggaggggacgtcctattaagtgcgatggatatttggagttttatgaaagtgcatccaaaggttaacacatttgaccttgaaattttgggaacagaacttaagaaaagtgctacgtgttctaattttgatattttaattagcctcaagcatttcattaaggtcttttcgtcaaaattataa

SEQ ID NO: 1852 - DNA, 885 bp, Saccharomyces cerevisiae
atgtcaggtaacggtgctcaaggtacaaaattcagaatttctgtatgttaaaaccgaaacaagtggaaatacccatttaaatcacacaagatgtcgtcaatcaacaaataaaaaagtatattcccgagactgaatgttacaattgagacaagcaatgttcaagaaatgtgggagtctatcaatgaatatagtggatagccaaaatggaagatgccaaatttatccttaatggcttctccatgcctacatccagatagcgaaatctacttctgggccttaaagcgttaaatggatgcctttccaactgattactgagaaggttacttttgttaagactattggaagttctatgcggaatatacaaactccaaaaatgtccaattgttgtaagatcatttatgtccaagaaatatatttgtgttgatggttccattcttgccaagataggattgatttactaacagattaattgtgtgctcatttttatgtgtcacttacattttttttaaatagttaggtttaccagttggtgctatcatgaactgtgctgacaacagtggtgccagaaacttgtacatcattgccgtcaaaggttctggttctagattgaacagattaccagccgcctctttaggtgacatggttatggccactgttaaaaagggtaagccagaattgagaaagaaggttatgccagctattgttgtccgtcaagctaagtcttggagaagaagagacggtgtctttttgtacttcgaggacaatgctggtgtcatcgctaatcctaagggtgaaatgaagggttctgccattactggtccagtcggtaaggaatgtgccgacttatggccaagagttgcttccaactctggtgttgttgtttaa

SEQ ID NO: 1853 - DNA, 885 bp, Saccharomyces cerevisiae
atgtcggtaagcgaacaagatcctaatagggcgtacagagagactcaatcccagatatataaactacaggaaacactactaaattcggcgagaacaaaaaataagcaagaggagggacaagaaagcaacacccattcttttccagagcagtatatgcattaccaaaacggcagaaattcggcctacgacctgcctaatgtaagttcacagtcggttcttgctttcactgagaaacactatccaaacaagttaaaaaacttgggtacactttattacaatcgtttcaaagaagggtcttttgatgaagactccacaagttactcagacaggcacagttttccatacaacctttatgacaacactcttccaccaccgttccttccagctatcggtattcaaaatatcaataatattgcaacgctaaaaataacatatgaagatattcaggcaagtttcaataatatagaatctcctagaaagagaaataatgagatatggggatgtgatatctattctgatgactcagacccaatactagttttaagacattgcgggttcaaaattggagcgccttctggtggctcatttcacaaattgagaagaacccctgtaaatgtaactaatcaagataatgttacaggtaaccttcccctactggaaggcacaccttttgatctagaggtggagttgttgtttttgcctactctacaaaagtatcctagcgtaaaaagatttgatataacatcgcgggaatggggatcggaagccaccgttatacacgatggactgagttacggtatctatagtattgtcattaagcaaagactagatagagataaacctcatgaaccaaacgggtatattaaaaatttaaaatggacctaa

SEQ ID NO: 1854 - DNA, 885 bp, Saccharomyces cerevisiae
atgtctgctgaaattgaagaagctactaatgccgtaaacaacttgagcatcaacgactccgaacagcaaccaagggctcctactcataagacagtaattgaccccgaggacacaatctttattggtaatgttgctcacgaatgtaccgaagacgacttgaagcaattgtttgtggaggaattcggggatgaagtcagcgtagagatcccaattaaggaacacaccgacggtcacattccagctagtaaacacgctctagtcaagttcccaaccaagattgattttgataatatcaaggagaattatgacacgaaagtcgttaaggacagagaaattcatattaagagagctagaactccaggccaaatgcaaagaggaggtttcagaggcagaggcggtttcagaggcagaggaggttttagaggaggtttcagaggcggctacagaggaggtttcagaggcagagggaacttcagaggtagaggcggcgccagaggtggtttcaatggacaaaaaagggaaaagattccattagaccaaatggaaagatcaaaggataccttatatattaataacgtcccattcaaagctaccaaagaggaggtcgctgaatttttcggtactgacgccgactccatctctttgccaatgagaaaaatgagagaccaacacactggtaggatcttcacatccgattctgctaatagaggtatggcatttgtcactttcagtggtgaaaacgttgatattgaagctaaagctgaagaatttaaaggcaaggttttcggtgacagggagttaactgtagatgttgctgttattagaccagaaaatgatgaagaagaaattgagcaagaaactggttctgaagaaaagcaagaataa

SEQ ID NO: 1855 - DNA, 887 bp, Saccharomyces cerevisiae
atggactttactgcgaagataaagggtatgttgaaactcatctgctttcattatgcgtccaactaattaacattgcatattttcgtatactatttttttgtgtagagctcgaacgagaactctcagagacgagtgactataagaccttgcagaagaagaccataagtcttcgaagtgagctgaatactctgtcacattctttgacatcttatgaaaaagaacacttctccaatgatatagaaaatgtattaaaatctattaatgcaaaattatctgagtcaaagggcaaaaaacgactattctccttcaaacagaaaaattcatcatcagccgttcataagaatgttgaacgtacggagcttgcgaatgcgccggcgtataccactactttgaaaaagcattatgtcttggagaagggtgattcagcttttgaaaatttagagttttgtactgttacatcaacaacagattatagtggcaatagtgccctttctggttctttgtgctttcgcaatattactaaatgtgtcataaacttacaaaggattttctttcaaacagggagtattttcataactgattgtacggattctataatttttctacggtctccttccgacaaggatttccaaatccgtttacgtgacttgaaaaattgcaaaattttgatagagaaactctcgccaagtatcgattgcaaacaagtggtaatcatagaaaattgtcacaaatgcattttcaacgcaagcactcgggaccacctaattatacaagatttctctaaccccttccaaagcgaagaaactgaggacaattctgcctttgcatttgaagattttgatatttgtaacaaggatacaatgcagttgtttcgcgcttacttatag

SEQ ID NO: 1856 - DNA, 888 bp, Saccharomyces cerevisiae
atgaacggttactggaaacctgcgttggttgtcctgggattggtatctctatcatatgcttttaccaccattgaaacagaaattttccaattacaaaatgaaataagtacgaaatatggcccagatatgaacttctacaagttcttgaagttacctaaactgcagaattctagtacaaaggagattacaaaaaacttaagaaagctatccaagaagtaccatccggataagaaccctaaataccgtaaattgtatgaaaggttaaacctcgctactcaaattctttcaaacagctctaatcgtaagatttatgattattatctacagaatggctttccaaactatgatttccataagggtggtttttatttttccagaatgaagcctaagacttggttcctgctggcctttatttggatagtcgttaatattgggcagtatatcatttctattattcaatatcgttctcaaagatcaagaattgaaaacttcatcagtcagtgtaaacaacaggatgataccaatggactaggcgtaaaacaactaacgtttaaacaacatgaaaaggatgagggtaaaagtttggttgtaaggtttagcgatgtctatgttgtagagcctgatggaagtgaaacactaatttcgccagataccttggataaaccttcagtaaagaactgtttgttttggagaatacctgcttcggtttggaacatgacgtttggcaaatctgttggtagcgcaggaaaagaagaaataataacggatagtaaaaagtatgatggtaaccaaacaaaaaaggggaacaaagtaaaaaagggttctgcaaagaaaggccaaaagaaaatggaattgcctaacggtaaagtgatctattcacgtaaatga

SEQ ID NO: 1857 - DNA, 888 bp, Saccharomyces cerevisiae
atgaacgtgacaccgttggatgaattgcaatggaaatctccagaatggattcaagtttttggtttgagaactgagaatgttcttgattactttgcagaatcaccatttttcgataagacgtcgaataatcaggtaattaaaatgcaaaggcagttttcccagttaaatgatcctaatgctgccgtgaatatgacacaaaacataatgaccttaccagatgggaagaatggaaacttggaagaggagtttgcctatgtggatccggcaagaagacaaatccttttcaagtatcctatgtatatgcaactggaggaggaattaatgaagttagatggtactgaatacgtattgagcagcgtaagagagcctgacttctgggttatcaggaagcaaagacgaacaaacaattctggtgtgggaagcgctaagggaccagagattattccattgcaagactactacataattggtgcaaacatttaccaatcgccaacaatttttaaaattgtgcaaagtaggctgatgtccacgagctaccatctaaatagcacattggagagcttgtatgacttgattgagtttcaaccttcccaaggagtacactataaagtacctacggacactagcacgactgcaacggctgccaccaacgggaacaacgctggagggggcagtaacaagagcagtgtacgacctaccggcggtgccaatatggcgactgttccctcaaccacaaatgtcaacatgacagtcaacactatgggtacaggaggacaaactatagacaacggtaccggtcgtactggcaacggtaacatgggtataactacagagatgttggacaaattaatggtcacaagcattcgatccaccccaaactacatatga

SEQ ID NO: 1858 - DNA, 888 bp, Saccharomyces cerevisiae
atgaccattgatctagcttctatcgagaaattcctctgtgaactggctactgaaaaagtaggaccaatcatcaaatccaagtccggcactcaaaaggattatgacttgaagactggctccaggagcgttgatattgtaactgctatcgataaacaggtcgaaaagttaatttgggaatcggtaaaaacccaatatccaactttcaagtttattggagaggaaagttatgtgaaaggggagaccgtgattactgatgatcctacctttattattgatccaattgatgggactacaaactttgttcatgatttcccatttagctgtacctctcttgggctcacagtaaacaaagagcccgtagtaggcgttatatataatcctcacattaatcttctggtatccgcttctaaaggaaatgggatgagagttaacaacaaggactatgactataaatcaaaattggaatctatgggttctctaatactaaataaatccgtagtggcattacagccaggttccgctagagagggaaagaattttcagacaaaaatggccacatatgaaaaattactatcatgtgattacggttttgttcatggattcagaaatttaggatcatctgcaatgacaatggcatatattgctatggggtaccttgatagttattgggatggtggttgctattcgtgggacgtgtgtgctggatggtgtattttgaaagaagtgggcggtcgtgtagtaggtgccaatccaggtgaatggagtattgatgtcgacaataggacatatttggctgtgaggggaacaattaataacgaaagtgacgaacaaacaaaatatatcacagacttttggaactgtgttgatggccatttgaaatatgactga

SEQ ID NO: 1859 - DNA, 888 bp, Saccharomyces cerevisiae
atgagcaacgctaatccttatgagaataacaatccgtacgctgaaaactatgaaatgcaagaggacttgaacaatgctcctactggtcactcagatggtagcgacgatttcgtagcttttatgaacaagatcaactcaataaatgctaacttgtccaggtacgaaaacattatcaaccaaattgatgcgcaacacaaagacctacttactcaagtgagtgaggaacaggagatggaattgagacgttctttggacgattacatctctcaggccacagatttgcagtatcaattgaaagcggatatcaaagatgcccagagagacggattgcacgactctaataaacaggcacaagctgaaaattgcagacagaaattcttaaaattaattcaagactacagaattatcgattctaactacaaagaagaaagcaaagagcaggcgaagagacagtacacaattatccaaccggaagccactgacgaagaagtggaagccgccatcaacgatgtcaatggccagcagatcttttcccaagcgttgctaaacgccaatagacgtggtgaggccaagacagcattggccgaagtacaggctagacatcaagagttgttgaagttggaaaaaacaatggctgaacttacccaattgttcaatgacatggaagagttggtcatcgaacaacaagaaaatgtggatgtcattgacaaaaacgtcgaagacgctcagcaagatgtagagcaaggtgtgggtcacaccaacaaggccgttaagagtgccagaaaagcaagaaaaaacaaaataagatgtttgatcatctgctttattatctttgctattgttgttgtcgttgtggttgttccatccgttgtggaaacaagaaagtaa

SEQ ID NO: 1860 - DNA, 888 bp, Saccharomyces cerevisiae
atgagtagtcgcaaaagcaccgcttctagcttactgttacggcaatatagagaacttactgatcctaagaaagctattccctcatttcatatagaactagaggatgattcaaatattttcacttggaacataggtgttatggtgctaaatgaggattccatttatcatggagggtttttcaaagctcaaatgagatttccggaagactttcccttttctccaccacagtttcgatttacgccggctatctaccatccaaacgtttacagggatggcaggctttgtatttctattttacatcaaagtggggatcctatgaccgacgaacctgatgctgaaacgtggtcccccgtgcagaccgtggaaagtgtgttgatctctatagtatctctattagaggaccccaatatcaactcgccagcaaatgtcgatgccgctgttgattacagaaagaaccctgaacaatacaagcaaagagtcaaaatggaagtggaaagatcgaaacaagatatccctaaaggtttcataatgcccacttctgaatcggcgtacatatctcaaagtaaactagatgaaccagaatcgaataaggatatggcggataatttttggtatgatagtgatttggacgacgatgagaacgggtccgtcattttacaagacgacgactacgacgatggaaacaaccatatcccctttgaagatgatgacgtttacaactataacgacaacgacgacgatgacgaaagaatcgaattcgaagatgatgacgatgatgacgacgatagtatagataacgacagcgtcatggataggaaacaaccccacaaggctgaagatgaaagtgaagatgtggaggatgtagaaagagtttcaaagaaaatataa

SEQ ID NO: 1861 - DNA, 888 bp, Saccharomyces cerevisiae
atgagtttgagaacgccgaagagaagcaggactagcgatgaacaagaacaagaacaagaacaagagcaggtacagaacccagatacacatgtaaacaacgagcatcagcagcgacctgggccaaccactctattgagcacgccagtacgtctcaaaaatggctttggaacaccatcgccgccgtcaccaccaggcataacgaaaagcatcactaaatcgagaagaaggccgtcgacaacgagtcttcagggtatattcatgtcgcccgtcaataagcgtcgtgtcggcataaccgcacatggacgtgtatatgaccataacgacgacggacacgaaagtgagagtgaggacgacgaaaatgaagaagaaaatgaaaatcaaaagaagtacgacggacacgttagtatgcctttgttgccaccgacaacgcccaagtcaagacggtcggaggtgtttctgtcgccgtcgccgcgtttgaggtcacctccgacggctgcgcgtcggtctacgggcgagcggcccatccgcgaaatatcacatactttgcgcaccaggctcaattacgcgttagtcaagctgcaaaatggatggacggacaagacacttcccgagctggagacggagcttgctccagcagtgcagacgccgccacgtcgctatcacaacagatttccagatagtgcagacgcgggtacttccgcgcatacagcgtttcttcaggcgctcggaggccacccaccacgggaggaggccacggctgtcgaaacactgatgctattgtcgtcgcctaccaagaagcaacaacaccgacccgtgccggcgacatctgctggagaacccacggacgaaacggagcccgagtcggataccgaagtggagacgtcttaa

SEQ ID NO: 1862 - DNA, 888 bp, Saccharomyces cerevisiae
atgcctgtttatgaacacttattgcccgttaatggagcatggagacaagacgtcaccaattggctgagcgaggacgttccttcttttgattttggtggatatgttgttggttccgacctaaaggaggccaatttgtactgtaagcaggatggtatgctgtgtggtgtcccctttgcgcaagaagtctttaatcagtgcgaattgcaagttgagtggttgtttaaggaaggctccttcttggagccttcgaagaatgactctggtaagattgttgtagctaaaattactgggcccgctaaaaacattctattagctgaaagaaccgccttgaacatccttagtagaagtagtggaattgccaccgcctcacataagataatcagtttggcgcgttcgactggttacaaggggaccattgcggggacaagaaagactacaccaggtttacgtagattagaaaagtattccatgcttgtaggtggctgcgacacgcacagatacgacctttcctctatggtcatgctcaaagataatcatatttgggctactggttctataacaaacgcagttaagaacgccagggccgtgtgcgggtttgctgtgaagatcgaagtggagtgtttgagtgaagatgaagccacagaggccattgaagctggtgcagacgttatcatgttggataatttcaaaggtgacggtttgaaaatgtgcgcccaaagtcttaagaacaaatggaatggtaaaaagcatttcctcttggaatgtagtggaggcttgaatttggacaacctcgaggagtatttgtgcgatgacattgacatttacagcactagtagcattcatcaaggcacaccagtgattgatttctcattgaaactggctcattga

SEQ ID NO: 1863 - DNA, 888 bp, Saccharomyces cerevisiae
atgctgaagttgtcaagaagtgccaatctaagattggtccaattgccagccgcaagattaagtggcaatggcgctaaattgctcactcaaaggggattctttactgtaacgcgcttatggcagtcaaatggcaagaaaccattaagcagagtacctgtgggcggtactcccattaaggataacggcaaagtgcgagaaggctcgatcgagttttccacgggaaaggccattgctctattcctagcagtcggtggggcactttcttatttcttcaacagggagaaacgcagattggaaacacagaaggaggctgaagcaaacagaggatacggtaaaccttcacttgggggacccttccatctggaggatatgtatggcaatgagtttacggagaaaaaccttctcggtaagttttctataatatactttgggtttagtaactgtcctgacatctgtcctgatgaactggataagctaggtctatggcttaatacactctcttcaaagtatggtattactctgcagccattatttataacttgtgatccagcaagagactcccctgctgtattgaaagagtatttgagcgactttcatccctccatcctgggtttgacggggacgttcgatgaggtgaagaacgcatgcaagaagtacagagtatacttttctacgcctccaaacgtcaaaccgggccaagattatttggtagaccattccatcttcttttatctcatggaccctgaaggacagtttgttgatgctttgggtagaaattatgatgaaaaaacgggcgtggacaagatcgtggaacacgttaagagttatgtgcctgcagagcagcgcgccaagcagaaggaggcatggtactccttcttattcaaataa

SEQ ID NO: 1864 - DNA, 888 bp, Saccharomyces cerevisiae
atggacctcctaaaattcagttctctagctatatcagaaattaacttcctgcacgagtcatcgtttgactcgatagaccactcttggtttttattgataggttgcaaattggatcaagatgatgaaatttacatcccaataaatggtaatgaagcagagtctcaatggtatattgaaaaagttatacgaatcccgatgcaggaaaatgataaaataaatcaagaacgcctagaaaggagaattaacctaacaaaagtgactcaaaaggacatttgtatactgggtattcttgatttatgtcagttagaagaggacgaaaatatcactaataaagtgacggagaaagtgctcacccaattgaccgccttggcattgaaatatctgataaaatataacgtgtttcgccaacatacctccttccaagaagctgtcaatagtttaaagggttataaaattgaaaatagtgtacagataggcgcggaaattatccttgattttctacaagataaagtgcaaattaaggatgtaaatgacagataccaaattcccacacctaataataccgtagacccaggttttgatgagtttcaattaattgacatgaaggataaagaaatcaatattcaaaaatataataataataccataagaaaattactcgagaagattaatcgaatgataatattcttgaaaaattatgatgccactgacaagcctttctcttccacgcaagatgtaatacttcgaaaaatatcaatgcttgtaacacaactgcaaagaggtggaacaagtgacatgaattacctgctggataacaaaattaatgaaataaaattattagaaatttcgtgtaaacaatgggaaatttcaaatatgttaaaaaaataa

SEQ ID NO: 1865 - DNA, 888 bp, Saccharomyces cerevisiae
atggctacgttcaacccacaaaacgagatggagaaccaggcacgtgtacaagagtacaaggtctccactggcagaggcggagctggcaacatccataaatctatgtccaagccgtctcccgtacttcttccattgaaatccaattcaaagacagtagcaaacaacaataataacggtagcaaccaggaaaaggttcctcgttttgcaattggtagaggtggtgccggtaatatctttcatgatccgcacctgacgagatccgcccaacaactggactctaacgacaatatcaactataacgacgtgatcaatgacatcgacgattatatttcccctataacttcggatatggtggatgaaggtgggtcaaacccggtgaccaacaccaggtctcgtatcagcgctacaaggagccatcagtctttgcatgccaccacttcgtctccgaacaacaacgccccaattgtcgttggtagaggtggggcaggaaacattttcttcaacaaaaaaaaggtggccagcaatggtggaaatgaagaggatgagatacgaggcggcaatatcgaggatgaggatactatcaatgcaaacgaggacaacctgtttgtggtgacttccaatggcaatgctttggcggcaatcaagtccacgtccaagaagcctaaaaataagctcaagggcaaaagcgcaccggaaaaatttgctattggaagaggtggcgctggaaacataatttctccaaagtcaagcaggaacactatcaaccataacttaaacgatgatgatgaagataagtttaatttgaaagatgacaatggtaaagagaagaagaagaagaagaagaagaaatcagggtttttcagttctttgaaaactatgtttaattga

SEQ ID NO: 1866 - DNA, 888 bp, Saccharomyces cerevisiae
atggctctcggtaatgagataaacatcacaaacaagctaaagaggcaagaaatttttgctgatataaaacatgaaaaaaataaagagcgccataccatgagaagaaagagagctaaggaagagagagagaatccggagctgcgggagcagagattaaaagagaacgtaacacagacgatagagaacactagagtgtacgatgagaccattaacaaggaagtggagggagatgaagacgatttgatgagatacttcaacagcaattctaatgagccaccaaagatctttctgaccacaaatgtaaacgctaagaagagcgcttatgaatttgctaacattttaatcgaaattttaccaaacgtcacatttgtgaaaagaaaatttggctacaaattgaaggaaatatctgatatttgtataaaaaggaatttcactgacatcgtgataatcaacgaggacaagaaaaaggttactggcctaacattcatacatctgccagagggcccaactttttattttaaattatcatcatttgttgaagtgaagaaaattgtcggtcatggtagaccaactagccatattccagaattgattctaaataatttccagaccagattgggtcaaacagtaggtaggttgtttcagtccattttacctcagaatcctgatattgaaggtcgacaagttatcaccctacataatcaaagagattacattttcttcagaaggcatcggtatgtcttcaaagataatgaaagggttggtttgcaagaactgggtccacaatttaccctcaagttgaaaagattgcaaaggggtattaaggaagaaactgaatgggagcataaacctgagatggacaaagaaaagaaaaagttttatttatag

SEQ ID NO: 1867 - DNA, 888 bp, Saccharomyces cerevisiae
atgggggaaagcttggatagatgtatagatgatattaatagggcggtggactctatgtccacactctatttcaagccaccaggaatttttcataatgccatcctacagggagcaagcaacaaggcaagcattagaaaagacattactagactaataaaggactgtaaccacgacgaggcgtatcttctgttcaaagtcaaccctgagaaacaatccgtttcacgtagagacggcaaggagggagtattcgactatgttattaaacgagatacggacatgaaaagaaatagaaggctgggcagaccaggggaaaaaccgatcatccatgtgcccaaggaagtatatttgaacaaagatcgtcttgatttgaacaataaaaggagaagaaccgccactacaagtggcggtggcttgaacggttttatttttgataccgatcttataggatcctctgtcatttcaaattcaagttcaggtacattcaaagcattatcagccgtgttcaaggatgatccgcaaattcaaaggctcctatatgccttggaaaatggaagcgtgctcatggaagaagaatccaataaccaaagaagaaaaaccatctttgtcgaggatttccctactgatttaattcttaaagttatggccgaagtaacagatttatggccactaacagagttcaagcaggattacgaccaattgtaccataattatgaacaactttcttccaaattgcgcttcatcaagaaagaagttttgcttcaagatgatcgcttaaagactatgtcacagtaccatccttcttcttctcacgacgttgctaagattattcgaaaagaaaaagatgaaattaggcggctagaaatggagatagccaacttgcaagagtag

SEQ ID NO: 1868 - DNA, 888 bp, Saccharomyces cerevisiae
atgtcactcagagcagtcccaggatattttgctgcatatccaagtgagggttttcaaggattagactccacgaaatatgatcacttagaattgattaaccataagaattggaaggaactgtatcatgctatccctagaaataccaaaaatcgccactataagctgttgattttagctaggcatggtcaaggttaccacaatgctgccatactgaggtacggtatggagaaatgggacgcctattggtcgttgctttcgggcgatgaacatggagagtggcttgactctaaactgacacctctgggtaaagatcaagttagaagaacaggatcgaatgtcttgctaccaatggcaaagcaattaggtatgctacctcatgtgtttttcagttctccaatgagaagatgtctcgaaacattcattgagtcgtggacaccagtgttagcggagacgcaagaattaccggccggaactaaaatttctacacgcattatagaaggtctaagggagacgttgggctctcacacttgtgacaaaagagtggctcactcaatggcagttgacgaataccaggatttcagcacggaatcgggccacactgtacattggcaatatgtaccagattacccagaagatgatgaattgtggcttcctgatcatagagaaacgtgtgctgaaatggacaaacgtacactgaatggattatttgaactatttaatcaattgtcaagcgaagaaaaattcatctcgcttacttgtcactcaggtgtcattcaaagtgtcttgagaaacttacagcatcctccaatttataacctggacacaggtaaagtcgtcgctgtcgtcgtggaagtaccagtcaacacggccgatcgcggcaggctctga

SEQ ID NO: 1869 - DNA, 888 bp, Saccharomyces cerevisiae
atgtccgcctcagctcaacatagccaagcccaacaacaacaacaacaaaaaagctgtaattgcgatttgctattatggaggaaccctgttcaaaccggtaaatatttcggtgggtctctgttagccttgttaattttgaaaaaagttaacttgatcactttctttttgaaggttgcctacactatcttattcacaacaggatctattgaattcgtatccaagctctttttgggacaaggtttaatcaccaagtatggtcctaaagaatgtccaaatatcgccggctttattaagcctcatatcgatgaagctttgaaacagctaccagtcttccaagcccacataagaaagactgtattcgctcaagtccctaagcacactttcaagaccgctgttgccttatttctactacacaaattcttctcctggttctctatctggaccatcgtctttgttgctgacatttttaccttcactttgccagttatctaccattcctacaagcatgaaattgatgctactgtcgctcaaggtgtagaaatttctaagcaaaagacccaagagttttctcaaatggcttgcgaaaagacaaaaccatacttggacaaggttgaatctaaattgggcccaatttccaacttggtcaaatctaagactgctcctgtgtcttctactgccggtcctcaaaccgccagcacttctaagttggccgctgatgttccattggaaccagagtctaaggcttacacatcttcagctcaagttatgccagaagttccacaacacgaaccttccactacccaagaatttaacgtcgatgaattgtctaatgaattgaagaaaagtacaaaaaacttgcaaaatgaattggaaaaaaacaacgcttga

SEQ ID NO: 1870 - DNA, 888 bp, Saccharomyces cerevisiae
atgttaatgcaaataaaaatggacaatcatccttttaattttcaacctattttagcttcccattcaatgacaagagacagtacaaagccaaaaaaaatgacggataccgctttcgtgccaagccctcctgtagggtttattaaagaggagaacaaggctgatttgcatacaatttcggtagttgcttcgaatgtgactctaccgcaaattcagctcccaaagattgcaacacttgaagagcctggttatgagagcagaactggctcacttacagatctttctggaagaagaaattctgttaatataggagcattgtgtgaggatgttccaaatactgcgggcccacatattgcaaggccggtgacaataaacaatttgattcctccgtctttaccaagactgaacacataccagcttagaccgcaactatcagatactcatttaaactgtcacttcaattctaatccatacaccactgcatcacacgcaccatttgaatcttcctacactactgcatctacatttactagccaaccggcagcttcatattttccctcaaatagtaccccagctacgagaaaaaatagtgccacgactaaccttccttcagaggaaagacgtcgagtttccgtttctctttcagagcaggtttttaacgaaggcgaaagatataacaatgatggccagttgatcggtaaaacaggcaaacctttaagaaatactaagagagctgcccaaaatcgaagcgcacaaaaggcgtttaggcagcgtcgtgagaaatacatcaaaaatctcgaagaaaaatcaaaactattcgatggcttgatgaaagaaaacagtgaattgaaaaaaatgattgaatcattaaagtcgaaattaaaagaataa

SEQ ID NO: 1871 - DNA, 890 bp, Saccharomyces cerevisiae
atgatgagtgaccaagaaaacgagaacgagcagtatgtaggattgagctctgcagggcatgaaatggaaaaataaagcaacccattatactaacaatatgcacttagcaagtgcggtagatggtcagtgcaaaagcattcttaggattggctaaatgcgaagaagaagtggacgctattgaacgtgaggtagaattatacagattgaacaaaatgaagcctgtttatgaaaagagggacgcgtatattgacgaaattgcagagttctggaaaattgtgctttcacaacacgttagttttgcgaattacataagggcttcagattttaaatacattgacactatagataagatcaaagtagaatggctggcattggagtctgaaatgtacgacactagagattttagtataacattccatttccatggaattgagggagacttcaaagagcagcaagtcaccaaggtgttccaaatcaaaaaaggcaaagatgaccaagaagacgggatactgactagtgagcccgttccaattgagtggccccagagttacgactcgataaacccggacttgatcaaagacaaacgcagtccagagggtaaaaaaaagtacagacagggaatgaaaaccatatttggctggttcagatggaccggcctaaaacccgggaaggagttcccgcacggcgactcattggcgtcattgttcagtgaagagatctaccctttttgtgtgaagtactatgctgaggcccagagggacttggaagacgaagaaggagaatccgggttaagcgcagatggcgacagcgaggatgacgatggcagtctcggtgaggtggacttgccactatccgacgaggaaccaagctctaagaaaaggaaagtttag

SEQ ID NO: 1872 - DNA, 890 bp, Saccharomyces cerevisiae
atgtctgttgaaccagttgttgtcattgatggtacgtaagattttgcactaataattgaatgtgttttcctttcccagccgcaggatttgctcatagtgcacagcgtttacgagtccccaaggaatatgataaaaatattacagccgcagaagggtggaatacagaagggtcttcgtagattgtgtatacgctaaaacatggagatagagagagatgggaattatgaacgggaaaaacaggttttatttaaaggataatactaacaaatccatttttttgaatgagcatccattcattcatcaataataatcttcaaccaggtaagggtcatttagtaggtcgtttagcttccgttgttgctaagcaattattaaacggtcaaaaaatcgttgttgttagagctgaagaattaaacatttctggtgaatttttcagaaacaaattaaagtaccatgatttcttgagaaaggctaccgctttcaataagacccgtggtccattccatttcagagccccatctagaatcttctacaaagctcttcgtggtatggtttctcacaagactgctcgtggtaaggccgctttggaacgtttaaaggtctttgaaggtatcccacctccatacgataagaagaagagagttgttgtcccacaagcattgagagttttgagattgaagccaggtagaaagtacaccaccttgggtaagttgtctacttccgttggttggaaatacgaagatgttgttgccaaattggaagcaaagagaaaggtttcatccgctgaatactatgccaagaagagagctttcaccaagaaagttgcctctgctaatgctactgctgctgaatctgatgttgctaaacaattagccgctttgggttactaa

SEQ ID NO: 1873 - DNA, 891 bp, Saccharomyces cerevisiae
atgaaactaaaaagggagtatgatgagttaataaaagcagacgctgttaaggaaatagcaaaagaattagggtctcgacctctagaggttgctcttcctgagaaatatattgctagacatgaagaaaagttcaatatggcttgcgaacacattttagagaaagatccatcactttttcccatacttaagaataatgaatttacgttgtacttgaaggagactcaagtccctaatacactcgaagattattttattaggcttgcaagcacaattttgtctcaacagatcagtggccaagcagctgaaagcatcaaggcaagggttgtcagtctttatggcggtgcatttcctgattacaaaatccttttcgaagacttcaaagacccagcaaaatgtgcagaaatcgcaaaatgtggattgagtaaaaggaaaatgatatatctagagtctcttgctgtctattttactgaaaaatataaggatatcgaaaagctcttcggtcaaaaagataatgatgaggaagtgattgaaagtttagttacgaatgtaaaaggtataggcccatggagtgccaaaatgttcttgatctccggattgaaaagaatggatgtatttgctcctgaagatctaggtattgctaggggtttttcaaaatacctttcagataagccagaattggaaaaagaattaatgcgtgaaagaaaagtagttaaaaagagtaagattaagcataagaaatacaactggaaaatatatgacgacgacataatggaaaaatgctctgaaacattttctccgtataggtctgtgtttatgttcatactttggaggctcgcgagcacaaatacagatgccatgatgaaggcagaagaaaatttcgtgaaatcctaa

SEQ ID NO: 1874 - DNA, 891 bp, Saccharomyces cerevisiae
atgaagctgatcccaattattttgaatgctaagaatctcagtgggatggctggatccatatcaatatgctgttggattgttgtgtttgtaccacagatttatgaaaacttccgaagacagtctgcggagggattatcactgcttttcattgtgttgtggctattaggtgatatatttaacgtcatgggagctatgatgcaaaatttactcccaaccatgataattttagctgcttactatacattggcagatttaattttgttaatacagtgcatgtggtatgacaaggagaagaagagcattttacaagaagtcaagaaaaatgttgatcctgtgcatttgcctccagcaaaccccataaatgagactgtcttacaagacgtttttaatgaatatgagccacttttgccaaggatagaagaagaagatagccaatcgtatagctcgcttgagcttggcagaacaatagtcgtaaaggaaagagagaattttttcaatgacttcttaattgtttcaggtgtacttattgccggaattttgtcatggtatatatcttactgttccggcctagataacggtattcctaaaaaaaaacctgcgttcgaacagattaatttacctgcacaaattttagggtatttaagtgcgatactgtacttgggctctaggatccctcagattgttcttaacttcaaaagaaaatcatgcgaaggagtctcattcctattctttttatttgcatgcttagggaacacttctttcataatctcagtgctctcagcatcttggcttatcggtagcgctggtacgctgttgatggacttcacagtttttattcaatttttcctttacgccaaacctaaatacgagaaaatactaatagataattaa

SEQ ID NO: 1875 - DNA, 891 bp, Saccharomyces cerevisiae
atgaataggcagagcggtgtgaatgcgggggtacagaacaacccaccatcccgagtggtgtatctgggttctataccatacgatcaaacagaggagcagatacttgatttatgtagtaatgttgggcccgtgatcaatttgaaaatgatgttcgacccccaaactggtaggtcgaaagggtacgcgtttattgaatttagagatttagagtccagtgccagcgcagtacgtaatttgaatggataccaattaggctctaggtttttgaaatgcggttactccagcaatagtgatatatcgggagtttcacaacagcaacaacaacagtacaacaacattaatgggaacaataacaacaatggaaataataataataatagtaatgggccggactttcaaaacagcggaaatgccaattttctaagtcaaaagtttccagaattgccctctggtatcgacgttaacataaacatgaccacccctgctatgatgatatcgagcgaactagctaaaaaaccgaaagaggtgcagttgaaatttttacaaaaattccaagaatggacaagagcgcatcctgaagatgctgtttcgctattagagctgtgtccacagttgagttttgttacggctgaattattgctaacgaatgggatatgtaaagtggatgatttgatcccgttagcttccaggccgcaagaagaggcatcggctacgaataacaatagcgtgaacgaggtggtggatccagctgtgcttaacaaacagaaagaactactgaaacaggtgttacaactgaatgacagtcaaatttctatcttgcccgatgatgaaaggatggctatttgggacttaaaacaaaaagcattaaggggagaatttggtgcattttga

SEQ ID NO: 1876 - DNA, 891 bp, Saccharomyces cerevisiae
atggacgacattgaaacagccaagaatctgacggtaaaagcacgtacagcttatagcgtctgggatgtatgtcggctgtttattgaaatgattgctcctgatgtagatattgatatagagagtaaacgtaagtctgatgagctactctttccaggatatgtcataaggcccatggaatctctcacaaccggtaggccgtatggtcttgattctagcgcagaagattccagcgtatcttctgactccagtgctgaggtaattttgcctgctgcgaagatggttaaggaaaggtttgattcgattggaaatggtatgctctcttcacaagaagcaagtcaggctgccatagatttgatgctacagaataacaagctgttagacaatagaaagcaactatacaaatctattgctataataataggaagattgcccgagaaagacaagaagagagctaccgaaatgctcatgagaaaaatggattgtacacagttattagtcccaccagctccaacggaagaagatgttatgaagctcgtaagcgtcgttacccaattgcttactttagttccaccagatcgtcaagctgctttaataggtgatttattcatcccggaatctctaaaggatatattcaatagtttcaatgaactggcggcagagaatcgtttacagcaaaaaaagagtgagttggaaggaaggactgaagtgaaccatgctaatacaaatgaagaagttccctccaggcgaacaagaagtagagacacaaatgcaagaggagcatataaattacaaaacaccatcactgagggccctaaagcggttcccacgaaaaaaaggagagtagcaacgagggtaaggggcagaaaatcacgtaatacttctagggtatga

SEQ ID NO: 1877 - DNA, 891 bp, Saccharomyces cerevisiae
atggactctcttgaagctagattacaattcattcaggtcctgaagaacctgcaaaagacgctgcacaagaccagagactctatcacatcatcgtcgaccaccacaccaccgtcatcgcaacaaaagctgaacaatgaccctatacagttctacttgagaaactacagacatcactacgaggacttccaccaatgtttgttcgatacaaccatgaagatggacccactagatagactggacgtagtgatatactatgttagaataataagaaacttatatccgcatagccattccaataccaatgttacaaaagtgttaaacgaagtgctactcatggacatagacttggtttttgagctttgtctgccctgccaggactggaaatccctcacgaatcaagccacctgtaaagagctattccttgacttatccaaactaatccattacgacgccaccagcgtcacgcacacaccatcagacaccacactcatagacgctactacctggtacagtgtcaagacagagaggactacaaaggactataaagaatcattgcaacgaacggagtctctgcttaaggacagagacttgaagaaattggctttctttcagcagttcaattccgatacaactgcgatcaacccggacttacagacgcagccaaccaatgcaaacattttgttgcacaggatggaagcagacagggaactgcacaagaggtcgaaagagacaagttggtacatcgaaaggccctccaacgatatactggatgaatccgaatttaaaagcttgtggacgcattttgaaactactgattccggatttgataaggacgattacaaaaatatcaaggctttaaatgacattgcgaaggcatcttacatatattag

SEQ ID NO: 1878 - DNA, 891 bp, Saccharomyces cerevisiae
atggattactttaatatcaagcagaattactacacggggaacttcgtgcaatgtttgcaggaaatagagaagtttagcaaggtcacagataacaccttattattctacaaggcgaaaacccttttagctctaggccaatatcaatcacaagatcctacctctaagcttggcaaggtactagacttgtacgtccagttcttagatacaaaaaacattgaagaattagaaaatttgttaaaggataaacagaattcaccatatgaattatatctgttagccacggctcaagctatcttgggtgacttagataaaagtttggagacatgtgtagaagggattgacaatgacgaagcagaagggactacagaattattgctgcttgccatcgaagtcgctttgttaaacaacaacgtttcgaccgcgtccaccatctttgataactacactaatgctattgaggatactgtttccggtgacaacgaaatgattttaaacctggctgaatcgtacattaaatttgccacaaacaaagaaacggcaacatccaacttttactactatgaagagctatctcaaacctttcctacttggaaaactcaattgggattgctcaatttgcatttacagcaaagaaacatagctgaagctcagggtattgtcgagctattactatctgactactatagcgtcgaacaaaaagaaaacgccgtattgtacaaacctactttcttagcaaaccaaattacgcttgctcttatgcaaggtcttgatactgaagatttaacaaatcaattggttaaattggatcacgaacatgcattcatcaagcatcaccaagaaattgacgcaaaattcgatgaattagtgaggaaatatgatacgtccaactga

SEQ ID NO: 1879 - DNA, 892 bp, Saccharomyces cerevisiae
atggcaagagatatcacatttttgaccgtatttttagaaagttgtggcgctgtaaataatgatgaggcaggaaaattgttatctgcttggacttcaaccgtacgcattgagggaccggaatcaaccgactctaattcattatatattccactgctaccacctggaatgttgaaagtatgtttctcctagcaaaattaaaacccatccgtgaatgaagcgttactaactataataactggtagctttgtcactcgtaccaggaaaagtgaagattaaactgaattttaaaatgaacgatcgattagttacggaagagcaagagttgtttacaaaattgcgcgagattgtaggttcaagtattcgcttttgggaggaacaactgttttatcaagttcaagatgtaagcaccatagaaaaccacgtcattctcagtttaaaatgtacaattttaacggatgctcagataagtacgttcataagcaaacccagagagcttcatacgcatgccaaaggatatcctgaaatctattacctttccgagttatcaacaactgtcaattttttttctaaagagggaaactatgtcgaaataagccaggttattcctcattttaatgaatatttttcctctttaatagtgtctcaattggaatttgaatacccgatggtcttctccatgatttcaaggctccgattgaagtggcaacaaagttcgctcgctccgatatcctacgccctaacgagcaattcagtacttcttccaataatgcttaacatgattgcccaagacaaatcttcaacaaccgcgtatcaaattctgtgtcgaagaagaggtcctccaattcagaattttcaaattttttccttaccggctgtaacgtacaataagtag

SEQ ID NO: 1880 - DNA, 894 bp, Saccharomyces cerevisiae
atgactggagaagactttaagatcaagagtggtctcgcccaaatgttaaaaggtggcgttattatggatgttgttactccagagcaggcaaaaatagctgaaaaatctggtgcatgtgcggtaatggcattagaatccatcccagcagatatgcgtaagtcaggaaaggtttgccgcatgtcagatccgaagatgattaaggacatcatgaactccgtttccattcccgtcatggctaaggtaaggattggccattttgttgaagctcaaattattgaggcattggaagttgactatattgacgaaagtgaagtcttgactcctgctgattggactcaccacattgaaaaggacaaattcaaagttccatttgtttgtggcgctaaagacttaggtgaagctttgagaagaattaatgaaggcgccgctatgattcgtaccaagggtgaagctggaacgggcgatgtctctgaagccgtcaagcatataaggagaattacagaggagataaaggcgtgccaacaattgaagagcgaagatgacattgcaaaagttgctgaggaaatgagggtaccagtttctttgctgaaagatgttttagaaaaaggtaagttgccagtagtaaattttgctgcaggtggtgtagcaacgccagccgatgccgcattgttaatgcagttgggttgtgatggtgtgtttgttggctcaggaatttttaaatcatctaatcctgtaaggttggccactgcagtagtagaggctaccactcactttgacaatcccagcaaattgttggaagtatctagtgacttaggagagttaatgggtggtgtatcaatcgaatctattagtcatgcttccaatggagtaagactttccgaaattgggtggtga

SEQ ID NO: 1881 - DNA, 894 bp, Saccharomyces cerevisiae
atgcctatcaaagaaactgataaagaagttgttttgactcatccagctgatgagaccaccagcgttcatattctaaagtacggtgctacagtttattcttggaaattgaaatctgaagaacagttgtggttgtctactgctgctaaattggatggtagcaaacctgtgagaggtggtatacctttggtctttcctgtattcgggaaaaatagcaccgatgaacatttgagtaaattacctcaacatggtcttgcaagaaattctacttgggagtttttgggtcaaactaaggaaaacccaccgaccgtacaatttggcttgaaaccagaaattgctaacccagaattgaccaaattgtggccaatggattatcttttgattttgactgttgaattaggctccgattatttgaaaactgccatagaagtagaaaacacatctagttccaaggaattaaagttcaactggttgttccatacatacttccgtatcgaagatattgaaggaacaatggtctctaatttagctggcatgaaactttatgaccaactgttgaaggaatcctacgtcgacaagcacccagtcgttaccttcaatcaagaaaccgatgtaatttatcagaatgtcagcgccgaacgggccattcaaatagttgacaagggcgttcaaattcacactctaaaaagatacaacttgcccgacactgttgtttggaatccatggattgagaagtctcaagggatggccgatttcgaaccaaaaactggttaccaacaaatgatatgtattgaacctggtcatgttcatgattttatttccttggctcctggtaaaaaatggaatgcttatcaattactttgcaaagaagaattgaaatatcaagctattcaataa

SEQ ID NO: 1882 - DNA, 894 bp, Saccharomyces cerevisiae
atggatttggtgaaccatctaaccgatagactactgtttgcaatcccaaagaaaggtcgtttatattctaaaagtgtttctattttgaatggtgctgatattacctttcaccgctctcaaagattagacattgcactaagcacaagcttacctgtagcgttggtctttctgcccgctgcagatattccaacttttgttggtgaaggtaaatgtgatcttggtataactggtgttgaccaagttcgtgaatctaacgtcgacgtagacttagcaatcgatttgcaatttggtaactgtaaattgcaggtacaagtccccgtaaatggcgagtataaaaagccagaacagttaattggcaaaaccattgttaccagtttcgtgaaacttgctgaaaaatactttgccgatttggaaggtactactgttgaaaaaatgaccacaaggataaagtttgtcagtggttccgtggaggcatcatgtgctctgggaattggtgatgctattgtagatcttgtagagagtggtgagacaatgagggcagcaggtttagttgatattgccaccgtcctaagcacaagtgcctacctaatagaatcaaagaacccaaagagcgataagagtttgattgctactatcaaatcaagaattgaaggtgtcatgaccgctcaaaggttcgtttcatgtatttataacgcacctgaagacaagctgcctgaactgttgaaggtgacgcctggccgtagagcaccaaccatttccaaaattgacgatgaaggatgggttgctgttagttccatgattgagagaaaaacgaagggtgttgttttagatgaattgaaaagactcggcgcatctgatatcatggttttcgaaatttctaattgtcgtgtataa

SEQ ID NO: 1883 - DNA, 894 bp, Saccharomyces cerevisiae
atggctttccaaaaagacgctaagtcctctgcttactcctctcgtttccaaactcctttcagaagaagaagagaaggtaagactgattactaccaaagaaagagattggtcacccaacacaaggccaagtacaacactccaaagtacagattggttgttagattcactaacaaggatatcatctgtcaaatcatctcttctaccatcactggtgatgtcgtcttagctgctgcctactcccacgaattgccaagatacggtattacccacggtttgaccaactgggctgctgcttacgctactggtttgttgatcgccagaagaaccttgcaaaagttgggtttggacgaaacttacaagggtgttgaagaagttgaaggtgaatacgaattgaccgaagctgttgaagatggtccacgtccattcaaggtcttcttggatattggtttgcaaagaaccaccactggtgccagagttttcggtgctctaaagggtgcttctgacggtggtttgtacgttcctcactccgaaaacagattcccaggttgggacttcgaaaccgaagaaattgacccagaattattgagatcttacatctttggtggccacgtttcccaatacatggaagaattagctgacgatgatgaagaaagattctctgaattattcaagggttacctagctgacgacattgatgctgactctttggaagacatctacacttctgctcacgaagctatcagagctgacccagctttcaagccaactgaaaagaaattcaccaaggaacaatacgctgctgaatccaagaagtacagacaaaccaaattgtccaaggaagaaagagctgctcgtgttgctgccaagatcgctgctttggctggtcaacaataa

SEQ ID NO: 1884 - DNA, 894 bp, Saccharomyces cerevisiae
atgggtattgaagacattagcgccatgaagaacgggtttatagtggtgccgttcaaattaccggatcacaaggcactacccaaaagccaggaagcttcgttgcatttcatgtttgctaaaagacaccagagttcaaattccaacgagtctgactgtttgtttttggtcaaccttccattattatctaacatagagcacatgaagaaatttgtcgggcagctctgtgggaaatacgatacagtatcgcatgtagaggaactactatataacgatgaatttggattacatgaagtagatttatcggcattgacctccgatctgatgtcctccactgacgtcaacgagaagagatacacaccaagaaacacggcgctattaaaatttgttgatgctgcaagtataaataactgctggaatgctttgaaaaaatactcgaatttgcatgccaaacatccaaatgaactatttgaatggacatatacgactccatcattcacaacttttgttaacttctacaaaccactggatattgattatttgaaagaagatattcatacacatatggcaatttttgaacagcgtgaagctcaagcacaagaggatgttcaaagttctatagtggatgaggatggattcacattagttgtaggaaagaacaccaagtcattgaattccataagaaagaaaatattaaacaaaaatccattatccaaacatgaaaataaggccaagccaatttcaaatatagataaaaaggcaaagaaagatttctatagatttcaggtcagagaacgtaaaaaacaggagatcaatcaactgttaagtaaatttaaggaagatcaagaaagaatcaaggtaatgaaagctaagagaaaattcaatccatacacttaa

SEQ ID NO: 1885 - DNA, 894 bp, Saccharomyces cerevisiae
atggtcgtcatagctaatgcgcacaacgaattaatccatgacgctgttctagactattatgggaagcgccttgcaacctgctcttctgacaagacaatcaagatctttgaagtcgaaggagaaacacacaagttaatagacacgttgactggccacgaaggcccagtttggcgtgttgattgggcacatcctaaattcggaaccattttggcatcgtgttcttatgatggtaaagtgttgatttggaaggaagaaaacggtagatggtctcaaattgccgttcatgctgtccactctgcttctgtcaactctgttcaatgggctcctcatgaatatggccccctactgctggttgcttcctctgatggtaaggtctccgtagtagagttcaaagaaaacggtactacttccccaataatcatcgatgctcatgccattggcgttaactctgcttcttgggctccagctaccatcgaagaagatggtgaacacaacggtactaaagaatctcgcaagtttgttactgggggtgctgacaatttggtaaagatttggaagtacaattcagatgcccaaacttatgttctggaaagcaccttagaaggtcacagcgattgggttagagacgtagcatggtcacctactgttcttctacgttcttatttggccagtgtttctcaagatcgcacctgtattatttggactcaagacaatgaacaaggcccatggaaaaaaactttattaaaagaagaaaaattcccagatgttttatggagagccagttggtctttgtcaggtaatgtactagctctttccggtggcgataataaagttactttatggaaggaaaatcttgagggtaaatgggaacccgctggtgaagttcatcagtga

SEQ ID NO: 1886 - DNA, 894 bp, Saccharomyces cerevisiae
atgtcaggtcctccacctccttacgaagagcaaagctcacatctttacggccagcctgcgagcagccaggatggaaacgctttcatcccggaagactttaaatattccacggtggttatctcgtgcgaacccatcattcgccagcggtttatgcacaaggtttactctctgctgtcatgccagttactggccagtttgtcgttctgctactgggctagcgtttccacttctttgcagaactttatcatgtcgcatatcgccctcttctacatctgcatggtggtatcgctagtatcgtgcatttggctggcagtaagtcctcgtcccgaagactacgaggccagtgttcccgaaccgttgctcacgggcagcagcgaagagccggcacaagagcaaaggcgtctgccttggtacgtcttgtcctcgtacaagcaaaagctcacgctgctctccattttcactctttccgaggcttactgtctgtcgctggtaaccttagcgtacgataaggatacagtactttcggctctgctgatcaccaccatcgtcgtagtcggcgtttccttgaccgcactatcagagagattcgagaacgtgctgaattccgcaacgtcaatatactattggttaaactggggtctatggattatgatcggaatgggtctcacggccttgcttttcggctggaatacccactcttccaagtttaatctgctttacggctggcttggtgccattttatttaccgcgtatcttttcatcgatacgcaactgatttttaggaaagtgtatcctgatgaagaagttagatgcgccatgatgctttacctggacatcgtcaatttgtttttgtctattttaaggattttggccaactctaacgacgacaattaa

SEQ ID NO: 1887 - DNA, 894 bp, Saccharomyces cerevisiae
atgtcgcatcaaatggcgccatggatacccatgtttattcaatcgtgcaaaaataacactgaaccgtttgtatcatttcaatttgctactgttgacgaactaacgaacaaaccacgttgtagaacggtagtgttcagagattttttatttcatgacaaaagaactaatgtgttgacttttaacactgatatgaggagctcaaagataactgaatcatttataactccaaattcaaataactctagcgacagcaaaagatgtgagactccatttttcgaagcatgtttctatttcccggaaacttgggagcagtatcgcttcagtggccaatgctttacaatatctaaacaatttaagaaaataccggctgagattgtaaccaagtatgacatattttcaccgcggttttcagagacaaatgatgacagcactgacgaagaaatagatactccaattaacgacgacgacgacgacgataaaaataatgacgccgacaataatgacattaacgaagataacaaacttatagaatccatagagaacgatgaacaccatgaggatgaagacgactactaccctcaaccacaagaatgggaggctgaattactaagacaatggtcctctctatcaaggcataccaagtcattgtataggaagccagccccgggccagaaacttacctctgaaactagcaaacaactggacaaactccatagaggagttgacggtgctaaagaggacgctggactggaaaactttggtattgtctgtctttgtgttgattctgttgattttttgaacttgaaagagggaagaggtggtgaaagatggattttccagaaaaccgacggcaaagacgaagatctgtgggaggaacaagaagtgtgtccgtga

SEQ ID NO: 1888 - DNA, 894 bp, Saccharomyces cerevisiae
atgtcggagttacagtcacaacctaaaaagattgccgttgttacaggcgcctcaggtggtattggatatgaggtaacgaaggaattagccagaaatggctatttggtttatgcatgtgcaagaagactagaaccaatggcacaattggccatccaatttggtaacgatagtatcaaaccatataagttggatatttccaagccagaagaaattgtaacattttctggttttttgcgagctaatttacctgatggtaaattagatttattgtacaacaatgccggtcagagttgtacattccctgcattggatgcaacagatgctgcagtagaacaatgctttaaggtcaatgtgtttggtcatatcaacatgtgccgtgaattgtcggagttccttattaaagcgaaaggaaccattgtcttcactggttccttggcaggagttgtgtcattcccctttggtagcatttattccgcttctaaagctgctatccaccaatatgctcgtgggttacatctagagatgaagcccttcaacgtgagagtgattaacgctattactggcggtgtggctactgatatcgctgataaaaggcccttgcctgaaacctcaatatacaacttccctgaaggtagggaagcttttaattcaagaaaaaccatggctaaggacaataagcccatgccagctgatgcgtacgcaaagcaactggttaaagatatcttgagcactagtgaccctgtagatgtttatagaggaacgttcgccaacatcatgcgttttgtcatgatatttgttccttactggctattggaaaaaggactttccaaaaaatttaaattggacaaagttaataatgctttgaagtcgaaacagaagaataaggacgattag

SEQ ID NO: 1889 - DNA, 894 bp, Saccharomyces cerevisiae
atgtctggaagctatcaacatttatcaaacgttggatcgcgtgttatgaaaagattggggaatcgacccaaaaactttcttcctcatagtgaaaagttcattaaaaaatctacgcctgagttcatgaagtcagatttaaaggaagtagatgagaaaactagtttcaagagtgaaaaagaatggaagtttatacctggcgacagagtagtagtaatgagcggggcttccaaaggaaatatagctgtaattaaatctttcgataaaagaacaaattcattcatattagatgagaatgggcccacaaagactgttccagttcctaaacaattctggcttgaaggccaaacatctcacatgataacaattccagtttcaattttgggaaaggatttaaggctagttgctgatattgacgatgaaaagaccccaggaaagacaagaacggtggcagtaagggatgtttccttcaatggttcctactatgatgcagactacaaaaaggtaatgccatatagatgcgtaaagggtcaaccagacttgatcattccatggcctaaaccagacccaattgatgtgcaaacgaacttggctaccgatcctgtaattgctagagaacaaacattttgggtcgattccgtagtgagaaaccctattccaaaaaaggcaataccaagtattcgcaatcctcattctaagtacaaaaggggtaccttgacagcgaaagatatagctaagctagtagcacctgagatgcccctaacagaggtaagaaaaagccatttggcagaaaaaaaggagttggctgagagagaagtaccaaaactaactgaagaggacatggaagctattggggcgagggtttttgaatttttggaaaaacaaaaaagagaataa

SEQ ID NO: 1890 - DNA, 897 bp, Saccharomyces cerevisiae
atgtcagaattcaaggttaaaactgggcttgcccaaatgttaaagggcggtgtgattatggacgtcgtcacacctgaacaggctattatcgcagaaagagcgggcgcttgtgctgtaatggcattggaacgcattccagctgacatgcgcaagtctggccaagtatgccgtatgtcagatcctcgcatgatcaaagaaattatggaagctgtttcaattccggtgatggcaaaggtccgtattggacacttcgtggaggcacagatcctggaagagctgcaagtagactacattgacgaaagcgaggttttgactccagctgattggacacatcacattgagaagcataacttcaaggtgccatttgtttgcggtgccaaggatctaggtgaggctttgagaagaataaacgaaggtgctgcaatgatccgtaccaaaggtgaagcaggtaccggtgacgtttccgaggccgtcaagcacatcaccaagattaaggcggagatccagcagtataaagagaatttgaagaccgaatccgattttgcagctaaggccacagaattacgcgtccctgtcgacttgctgaagacaacactatcagagggaaagctacctgtagtcaattttgctgctggtggagttgctactccagcagacgctgctctattgatgcaattgggttgtgaaggtgttttcgtcggttcaggtatattcaaatcgtcagatcctgagaagttagcatgtgctattgttgaagccacgactcactacgataatccagcaaaactgttgcaaatttccagcgatttgggtgacttgatgggtggtatttccatccaatcaattaatgaagcaggaggcaaaaacggtgcaagactttctgaaatcggatggtag

SEQ ID NO: 1891 - DNA, 897 bp, Saccharomyces cerevisiae
atgaaagtatttataactggtgcttctggcttcattggttctgccgtattatctgaactaatatcctcgggtcatgaagttgttggcttggcaaggtcagacgaggctgctgcaaagattaagtcgattgatcctgctgcaaaaatccttcgcggtgatctcaaggatctggaaattttgaaaaaaggtgccactgaatctgatggcgttattcatttaggatttgtgcatgattttaaaaattttgaacagtgctgcgaaattgaccgtcaggccactgtagctatgctagagtcacttaaaggttctaacaagcctttcttatatacgaatggtacactttctttgcgaccaaacaaagttgctaacgaacaggatggtattgatgaagattccaaaattttgcgtgctgtcactgaacaggttgccttgagttacaaagacaaaggtgtttcagcaagaattgtcagactcccattctcggttcatggcaagggggacaaggcttttgtaccaatattaatgaatattgccaaagctgccggaaaatctggctatgtcggacaaggcacaaacgcttgggcggctgtacatcgtttggatacggctcctctgttcagacttgttttagagaaaggaaaaacaggacaagtgtatcattgcgttggtgaacaaggtataccattcaaagatattgcgcgtgtgattggagaaattttgaatgttcccgtggcctctatccctgttgatgacgcggaaagtcattttggcttcctcacttgttttgtcactagagatggcccagtttcaagcgaaggtaccagaaaagagctgggatggcagccacaacaaatcggtcttcttgaagatatccgtgcgaactatagcttaaactga

SEQ ID NO: 1892 - DNA, 897 bp, Saccharomyces cerevisiae
atgagcggtgaattagcaaattacaaaagacttgagaaagtcggtgaaggtacatacggtgttgtttataaagcgttagacttaagacctggccaaggtcaaagagtagtcgcattgaagaaaataagactagagagtgaagacgagggtgttcccagtacagccatcagagaaatctcattattgaaggaattaaaagacgataatattgtcagattatacgatattgttcactctgatgcacacaagctatatcttgtttttgagttcctcgatttggacctgaaaagatatatggagggtattccaaaggaccaaccgttaggagctgatattgttaagaagtttatgatgcaactttgtaagggtattgcatactgccactcacaccgtattctgcatcgtgatttaaaaccgcagaacttattgattaacaaagatgggaatctaaaactaggtgattttggcttagcgcgtgcttttggtgttccgttgagagcttacacacatgaaattgttactctatggtatagagctccggaggtattactgggtggaaaacaatatagtacaggtgtcgatacatggtccatcggctgtatatttgccgaaatgtgtaacaggaaaccaatcttcagtggcgatagtgagatcgatcagattttcaagatattcagagtattgggaacgccgaatgaagctatatggccagatattgtctacttgcctgatttcaagccaagctttcctcaatggcgcagaaaagacctatcacaagtggtaccaagtctagatccacgcggtattgatttgttggacaaactcctcgcgtatgaccctattaaccggattagcgccagaagagcagccatccacccctacttccaagaatcataa

SEQ ID NO: 1893 - DNA, 897 bp, Saccharomyces cerevisiae
atgatgaataaagtagatcaaatcatcggttacaaaaagtacgaagtgaaactaccaaaagatcgacaagtaaagaaaaataaatcaaaaggtggaaatgttgatcaaatagatactaagagggaaaaggataaaatgagagcttttggtgaagaaaggaaaaagttcttagataaaatggctaaaaacaaaaaaaaaaatacaagtagaaaagatagagagaagccaaaagaagtagaaaaagaaaactacaaaagagaagacaaaaggctaaaagaacagaaaaaattatcactggcaaaagaatttcgtttcaaagaaccgaattcagaagccattaatcagaacacagcagctgaaaatggtaaacctaaaccacagactggactagattttgacatagaccatcaaaccgtgtccaagatcatgatagatcaggctattcaaacatctagtcctcttaatgtccaactcacggaacttttcaatgataacgtcctcgacgtctcgaaagatagtcagtttgtccttcaagacatggagttcacctcctgggaacgacgctggtcaaactgcagcacgaccagtaatgcgactacggtctcatcagttcctgatcccaaatataatatcaactacaacgacataacctccttcaattcagtagcgctaattaccgaagatcttaacatatctgcatcatctaatggtctgcatgagagaggtaaaaagctactgcagcaagagatggaatactcaaacaaggtcaaaaatgtcaccatcgggcttgaaagattgtgtatggatgaaaaaccagtcccagatgcaggaataaccatgcaacaagcgtcgcgctggtcagaattccccacttgttgcgatcaagctgctatttag

SEQ ID NO: 1894 - DNA, 897 bp, Saccharomyces cerevisiae
atggtcgcaatctcaatgatttggttttttaccaagcgtatgcccagaatatttgcattagcttttaatttaatttcaatatttcttttgatttttcttctcatcggctgttacaacccgtcaaatcagtcaacatttctagtgaagtataaatttgatgacaactcacctttttatacgatcatagagaaatcatatgaaaaatcaaatacaactctgggcttggaggaagtcattataagatccggttacatgggtgtttgtattgataacattccctcccaatatagctcttacaataatatgactacattctccaattcaatttgctatgcaagaaagaatttaagctcggttcccttatacagagacttggaaattcaactctcaaatattgcatcttccagctccaaaacccaatcaagcgttgtcttgaacattttgaagttagcccaattaacttcggttaatgttatacatccatatgtcttgatggcaactgtaatcctaacaatcctaatgtttctatttattctgtatgtaactgtccctaagttaccattcaaactagcggttaataaatttctactgttgctaagttcaactatagttttgacatggggtattggtgcgatgtggactcatgtagggataaatgcaagttacagattggttccatcatcaagtatgaatataatcactgtcaagaagggcaagaaggcagcagtaatggcttggtttagctttgcattcctccttttagacagtgtggttttatggttaatatttttaagggataggaaaagcttgaaagatgaaattgataatgttccatgtgcccaaaataggtacaataactactcttcggattcatctacattgcattccaaagtttag

SEQ ID NO: 1895 - DNA, 897 bp, Saccharomyces cerevisiae
atgtcaaccaacgcaaaagagtctgccggtaagaatatcaagtatccatggtggtacggaggtgcagcgggtatctttgctaccatggtgacacatcctcttgacttggccaaagtcagactgcaggcggctcctatgcccaagcccacactcttcaggatgttggagagtatcttggcgaatgaaggtgtggtggggttatattccggcctgagcgctgctgtgttgaggcaatgtacatacacgacggtgagattcggtgcatacgacttgttgaaagagaatgtgatcccacgcgagcaattgactaacatggcgtatcttttaccttgctccatgttcagtggtgccattggggggcttgcagggaattttgcagatgttgtaaatatcagaatgcaaaacgactctgctttggaggcagcgaagaggagaaactacaaaaacgctatcgatggtgtgtacaagatatatcgctacgagggtggactgaaaaccttgtttaccggttggaagcctaacatggttaggggcatactgatgacggcaagtcaggtcgttacgtatgacgtgtttaagaactacttggtcacaaaattagatttcgacgcatccaagaactatacacacttgacagcgtccctgttggctggcctggtggccaccactgtgtgctctccagcagacgtcatgaagacacgtatcatgaacggcagcggagaccatcaaccggctttgaagatccttgccgacgctgtccgcaaagagggcccatctttcatgttccgggggtggttgccaagtttcactagactgggtccattcacaatgttaattttctttgcaattgagcaattgaaaaaacatagggttggcatgccaaaggaagacaagtag

SEQ ID NO: 1896 - DNA, 897 bp, Saccharomyces cerevisiae
atgtcgacgtcagtcccagtcaagaaggcattaagtgctcttttacgcgatccaggaaacagtcattgtgccgactgtaaggcgcaactacatccacgctgggcttcctggtcacttggtgttttcatttgcattaaatgtgctggtatacatagatcattgggaacgcacatttcgaaagtgaaatctgttgatctggatacatggaaggaagaacatttggtgaaactgatacagttcaaaaacaatttaagagctaactcatactacgaagctactttggctgatgaattgaaacagaggaaaatcactgatacgagcagtttacaaaatttcatcaagaataaatatgaatataagaagtggattggtgacctctccagtattgaagggttaaatgattctactgaaccagttctgcataagccgtctgcgaatcattcgttgcctgcttcgaatgcaagattggaccagagctcaaattcattacaaaagacgcaaacacaaccaccttcccacttattaagcacctcaaggagtaatacgagcttattaaacctacaggtttcatcgctttctaagactacatctaatacaagtgtaactagttctgcaacaagcataggtgctgctaataccaagactggcaacagagtcggtgaatttgggcaaaggaacgatttgaaaaaatccattttatctttatactcaaaaccttctgcccagactcaaagccagaactcatttttcacttccacgacacctcagccttgtaatactccgtcaccattcgtgaacactggaattaccgctacaaataataatagtatgaattcaaattccagttctaacatttcattggatgataacgagttatttaagaacgtctggagttga

SEQ ID NO: 1897 - DNA, 897 bp, Saccharomyces cerevisiae
atgtcgcctcaataccatttttattttgtatcattccggaacttagtattgaatgaaaaatgcctccgaagtaaaaagcaggtgatgaaaagtttcaattggtataagacagatcgctattttgatccgcataacatccttcaacaccatagcagagctatagagaagacaagatataaactgggcatgcaaacatcttcagaaagtaccgacgccaagtcggattttctcgacgaacccagtgcatatttaattgagaaaaatgtggctcttcccaaggacatattcggttcgtacttaagttattggatatatgaagttactcgtcataaagcggcagtaattttgctcgtacttattgtgacttcaattttattattagtgtttttttataatacggaattttgcgttgcctttgagatactattgttttccttttgctttccaggaacatgcatggttgtaattgcatttagtgaaccgatcggtgatcgggaatttaaagttaagcttctgatggaaattatcacacgtaaaccggcggtaaaggggaaagaatggaggacaattacatacaagatgaaccagtatttatttgatcatgggctatgggatactccctactacttttaccgtgatgaagattgccaccgttattttctaagtcttattaagggaagaactttcaagaagcaaaaggaatcgtcagccagcaatgttaaagacgcacaatcaaatgacgaaaccgctggcacaccaaacgaagccgctgagtcttctagttttagtgccggaccgaactttataaagctcctcaccaaggcagccgaaatcgaacaacaatttcaaaaggaatattggcgacaagagtatcctggtgtcgatgagtttttttag

SEQ ID NO: 1898 - DNA, 897 bp, Saccharomyces cerevisiae
atgtctagaattagtatattagctgtcgccgcagcattagtggcaagtgcaaccgccgcatccgtgaccaccactctatccccttatgatgaaagggtcaatttgattgaattggctgtttacgtttctgatattggcgcccatttatctgaatattacgctttccaggctttgcataagactgaaacatacccacctgaaattgccaaggctgtttttgccggtggcgatttcaccaccatgttgactggtatttcaggtgatgaagtgaccagaatgatcaccggtgtgccatggtactctactagattgatgggtgctatttccgaagcacttgcgaatgaaggtattgctactgcagtaccagcttctaccacagaggcttcttccacctccacttcagaagcttctagtgccgccactgagtcttctagctcctctgaaagttcagcagagaccagctcaaacgctgcttccacccaagctactgtttcatctgaatctagctctgctgcaagcaccattgcaagttctgctgaaagttctgttgcaagctctgttgcaagctctgttgcaagctctgctagttttgccaataccacagctccagtttcttctacatcttctatctcagtcactccagtggtccaaaatggtactgacagcaccgtcacaaagactcaagcttccactgttgaaactaccataactagttgttcaaataacgtctgttcaactgtgactaagccagtctcctccaaagctcaatctacagctacttctgtcacatcgtcagcatctcgtgttattgacgttaccactaacggtgctaacaagttcaataacggtgttttcggtgccgctgctattgctggtgccgccgctctattgttatag

SEQ ID NO: 1899 - DNA, 900 bp, Saccharomyces cerevisiae
atgaaactttctaaattatcgatcttaacctccgccttagccacgtctgcattggccgctcctgccgttgttactgtcactgaacacgcccatgaggctgcagtcgttactgtgcaaggcgtagtttatgtcgaaaacggccaaacacgtacaacttacgaaacactagctcctgcttccactgccactccaacttctacagctacagctttggttgctccccctgtcgctccttcctctgcttccagcaattccgatgtggtcttgtctgctttgaagaacttagcctctgtttggggtaaaactaccgattcaacgaccacgttgacatcttctgaatctacatcgcaatcgttggctcaagctactacgacttctacacccgctgctgcttccaccacttccacacccgctgctaccaccaccacttctcaagccgctgctactagctcagcatcgtcttcggatagtgacctgtcagattttgcctcttctgtgttggctgaacacaacaagaagagagctttgcacaaggacacaccagctttgtcctggtccgatactttggcctcctacgctcaagactatgctgacaactatgattgctccggcactttgacccattctggcggtccatacggtgaaaacttggctttgggttatgacggcccagctgccgtcgacgcttggtacaatgaaatttccaactacgacttctcgaatccaggcttttcaagtaacactggccactttactcaagtcgtttggaagtccaccacccaagttggttgtggcatcaaaacctgtggcggtgcatggggtgactatgtcatctgtagttacgaccccgcaggaaactacgaaggcgaatacgccgataatgtcgagcccctagcttaa

SEQ ID NO: 1900 - DNA, 900 bp, Saccharomyces cerevisiae
atgaagattcaggcgggccaattgggcctggacgataatgacgtgccgggaccattgccggacacagacagcaaaccctcatcacaatcacaaaatgacacaccaatgtttaaattgggcaactttgaaagtcctgtgctcaaggagctatcacggcgaacggtaaacaaggaaatggagacgcagagaattatgacaaacgtaattgcgtttgcgttctggaacctgctggtgaagttcatcaagttcttttggaacaacactcatgttgggagacagttttgcaaccggctatccagaatccatctgtacatgttgacatttcacacgttaaagaaggctaacatcatatatcacaccacgttcagttggttgaatgcagaacttcttgactacttgttccacctattaatctcgctcaatatactgttttctctttggaagctcttatccaccgtcaaagtaagtgatttgaatctcactgacaggcaaaagaagctcctgggggtagacatgcaatcatctgtcgatactgggttgcagccacaacacccccactacgtatccacttctaagatcagccaaatggcacagaacaaaacacatattcctcaaacaaatctcaaaaatcatccagcatatctcttcaaaggcttagagacgcctttgaaagcaagacaaagggaaatggcggaggaacagacgaaactacaatctcaatccttacacacaaagaatgtatttggcacactgcagaggcatagcggtatcagtagcacattagtgagcgctaacaatgacaataactcgccgcatacccctgtaactaggaagggctacattccaagtagcaaatatgcatatatgatgaactcacagtccccaagggggaaaatataa

SEQ ID NO: 1901 - DNA, 900 bp, Saccharomyces cerevisiae
atgaaggttgttaaggaatttagtgtctgtggtggcagattgatcaagttgtcacataactcgaactctaccaagaccagcatgaacgtcaatatctatttgcctaagcactattacgcccaagattttccaagaaataagcgtatcccaactgtgttttacctttctggcttgacgtgcacgccagacaacgcctctgagaaggctttttggcagtttcaagctgacaagtacggatttgcaatagtctttccggatacgtccccacgtggtgacgaagtagccaatgatcctgagggctcctgggattttggacagggcgccggattctatctaaatgccacccaagaaccatacgcccaacattaccagatgtacgactacattcacaaagaactcccacaaacattagattctcattttaacaagaacggtgacgtaaagctggacttcttggacaatgttgccatcacaggccattcgatggggggatatggtgcaatttgtgggtatttgaagggctattccggaaagagatacaaatcttgttctgccttcgcccctatcgtgaacccttccaacgttccctggggtcaaaaagcgtttaaaggttatctgggcgaagaaaaagcccagtgggaagcgtacgacccatgtttattaatcaagaatattagacatgtgggcgacgacagaattttgatccatgtaggagactccgatccctttttggaagaacacttgaaaccggaattactacttgaggcggtgaaagccacttcatggcaggactacgtggaaataaaaaaagttcacggctttgatcactcctattactttgtcagcactttcgttccagaacatgctgaatttcatgcgcgaaacttgggtttgatttga

SEQ ID NO: 1902 - DNA, 900 bp, Saccharomyces cerevisiae
atgacggatatagggagaaccaagtctagaaattacaaatgttcttttgacggttgtgagaaagtctacaacagacctagtttgcttcagcaacaccaaaattcgcataccaatcaaaagccgtatcattgtgatgagccgggatgtggcaaaaaatttataagaccgtgccatctacgagttcacaaatggactcattcacaaatcaagcccaaagcgtgcacattatgtcaaaaaagatttgtcacaaatcagcaattaagaaggcatttaaatagtcatgaaagaaaaagcaagcttgcatcaagaattgaccgtaaacacgaaggagtgaatgcgaatgtgaaagcagaactcaatggcaaggagggaggttttgacccaaaattaccttccggctctccaatgtgtggtgaagaattctcgcaaggtcatttgcctggatatgatgacatgcaagtgctacaatgcccatacaaatcatgtcaaaaagttaccagcttcaatgacgatctaataaatcatatgttgcaacatcatatagcaagtaagcttgttgtaccatctggagatccatctctgaaggaatcgcttccaacctctgagaaatccagcagcaccgacactacatccattccacaactttcatttagcactactgggacaagcagtagtgaaagcgttgatagcactacggcacaaaccccaactgatccagagagttactggtcggataaccggtgcaaacatagtgattgtcaagagcttagtccattcgcatctgtatttgatctcattgaccactatgaccacacgcacgccttcattcctgagacgctggtaaagtacagctacattcatttatataagcctagcgtctgggatttattcgaatactga

SEQ ID NO: 1903 - DNA, 900 bp, Saccharomyces cerevisiae
atggactgcaagatattggtgttaggcgcaggtggtctaggatgcgaaatcctgaagaatttgacaatgttaagctttgttaaacaggttcatattgtagatatagacacaatcgagctaaccaaccttaatagacaatttcttttttgtgataaggacataggcaaaccgaaagctcaagtggcagcccagtatgtaaacacgcggttccctcaattggaagttgtggcgcacgtacaggacctgaccactttgcccccgagcttttacaaagacttccagttcataatctcggggctggacgccattgaacctcgtcgcttcatcaatgagactctcgtgaagcttaccttggagtccaattatgaaatttgcatcccgttcatagatggtggaacagaggggctcaagggacatgtaaaaacaatcattccaggcatcactgcatgctgggagtgctccattgataccttgccctcgcagcaggatactgtgccaatgtgtacaatcgccaacaatcctcgctgcattgagcatgttgtggagtatgtctcaactatacaataccctgatttaaatattgagtctacggcggatatggaatttctgctggagaagtgctgcgaaagggctgcccaatttagcatctcaacagaaaaattatcaacaagttttatcctgggtataataaagagtatcatacctagtgtaagcactacgaatgcgatggttgcagcgacatgctgtacgcagatggttaagatttataatgatttaatcgacctggaaaacggcaataatttcactttgattaactgctcagaagggtgttttatgtacagtttcaagttcgagcggttacccgactgtactgtttgttcaaattccaattccaactag

SEQ ID NO: 1904 - DNA, 900 bp, Saccharomyces cerevisiae
atggccaatagaggagaaccggatccaaagaagagcaccgaatcaatctgctctctgactaaaccgcagctttattcattatatgatgatgacgtcgtgagatcggaagataacgaaatttacgaagaattgaaacgctctgtctctatagattctaccaaatatagtagagatcaaactattgattcgactttttacttggcccataaggttggcggctcgctgccaaggaacacagtatcttctaataatttggaaaggattttatcagcatcatccattcacgaaaactttccgtcaagaaccagacaaactcgtcaaaatattcttcattacctgcaagctgtattaattttgtcattgagcggtttcgcatatcatgaactgtccagaaacttgcacgataatcatctcttacatccagattttgcatcgagaccccttctactgggtgtcaaactttgtaactggctatccaatggggttctgccaaactggttaggctacggtgttgaaggactgttatttggttctgttgtaccaattctggataatatttttcaaacagaggttgttaagagctctgtccaccatgacagtttgacctctgttattagaagtatcaatgccatgttgggagtcacatttgggatcaggaaaatacagtggaactcctctttgcaggcggcaggggcatgggggcttctgaatattatactgtggttgttttttgacggctcaatatccatgttaatgagctgcatctgcattggggtgggttgttgtatctcttgctacaaagatattatcgacggttcccaatttttatatttcatggatttttatttccttggttctctaatgtttggaaaactaggaagatatctatattctcattaa

SEQ ID NO: 1905 - DNA, 900 bp, Saccharomyces cerevisiae
atgtccacaagcattacagtaagaaatagagatcgatcgctaccaccgctattgctccccaatgtttccctgctagaaaaagatatacggcgtaaaggcacccaaaatgtgggcatcaccgatccagaactcttgtcgaccacttggacgaggaagcgggcttttccgactgacgagcttttaggaggctataagagattaaagcctgctgccgctgacagtaatgagtgcgctattggtattgccacggtgacgccgccgccaacgctccccgtaagtgcgattgttccccctccacaaaattacactccaccattgtttgagtatcatcctcatgctcttgcttccatggtcaatgaagacgctaatgcgtcatgcactcaaatgtctataatttcgcgctcaacgagcaactcgacaacctcctctgccacatctactagttcaatttccaagagacaaagaagtggcccaagttgtgacaaatgtcgtttgaaaaaaataaaatgtaatgcgaaaattgagattttgcttcaagacgatactataatgccaatgatctcgaacaagttgcggtacgtcttgactcctgacgatattcggctatatcgaggcacgctgttgcggaatattgccataccggatgatgtcattgagggtacaggctcacgcaagttgattaagcatattgataagttggttttgctcacaccttgtttaccatgcattaagaaaaagcattcttcttcttccactaatttcccaaaaaatgataaatgtactttttcaaaaggctttaccagagctgacataaacatttcatccaaaatctccttaaaatttaaggataaaaccatttacgacataacctatgatgactataaaagcattgatttttag

SEQ ID NO: 1906 - DNA, 900 bp, Saccharomyces cerevisiae
atgtccagtaaagctaccaaaagtgacgtagatccattgcactcgtttctggcagggtccctagccggtgctgctgaagcatgtataacatatccttttgagtttgccaaaacaaggctgcagctgattgataaggcctccaaggcatcaagaaatcctctggtattgatatataaaactgcaaaaactcagggcattggttccatttatgtcggatgtcccgcatttattattggaaacaccgctaaggcgggtattagatttcttggctttgataccattaaagacatgctaagagatagtgaaactggagaactaagtggtacaagaggggtgatagctgggttaggtgcgggactattagaaagtgttgccgcagtgactccttttgaagcaatcaaaactgctttgatcgatgataaacaatctgctacaccaaaataccataataatgggcgcggtgtagtacgaaactattcatcattagtccgtgataaaggattttctggtctttatcgtggtgttttgccagtttccatgagacaggccgcaaaccaagccgttagattgggttgttacaataagattaagaccttgatccaagattatacggattcgccaaaagacaaacctttatcatccgggttaaccttcttagtgggtgcatttagtggtattgtgacggtctattccaccatgccccttgatactgtgaaaacaagaatgcaaagtttggattccaccaaatactcctctacaatgaattgttttgcaaccattttcaaagaagaagggttaaagacgttttggaaaggtgctacgcctagacttgggagattggtcttgagtggtggtattgttttcactatctatgaaaaggtcttagttatgctagcctga

SEQ ID NO: 1907 - DNA, 900 bp, Saccharomyces cerevisiae
atgtctaccttttctgcttctgatttcaactcagaaagatattcatcttcaagaccttcttatccctccgatttttacaagatgattgatgaataccacgacggagaaaggaaattactcgtagatgttggctgtggaccaggtactgccactttacaaatggctcaggagttaaaaccattcgaacaaattatcggaagcgatctctccgctaccatgattaagactgcagaagtaataaaggaaggaagtcctgatacatacaaaaacgtttcatttaagatttcttcaagtgatgattttaaattcctaggcgcggattcagtagacaaacagaaaattgatatgattaccgcagtagaatgtgctcattggttcgatttcgaaaaatttcagcgatctgcttatgccaatttgagaaaagatggtactatcgctatttggggttatgcggacccaattttcccggactaccctgaatttgatgatctgatgattgaagttccttacgggaagcaaggactgggaccctattgggaacaaccggggagatctcgccttcgtaatatgctgaaagactctcacttagacccagaacttttccatgatatacaagtttcatatttttgtgcagaagatgtgagagacaaagtaaaactccaccagcatacaaagaagccattgctaatcagaaagcaggtcaccctagtggagtttgcagattatgtcagaacctggagcgcttaccatcagtggaagcaggatccaaagaacaaagataaagaagatgtagcagattggtttattaaagagtcactaaggaggaggccggaactttccaccaacaccaaaattgaagttgtttggaatactttttacaaacttggcaaaagggtctga

SEQ ID NO: 1908 - DNA, 902 bp, Saccharomyces cerevisiae
atgtccgactccgactccgactccgattatgaattgtaagtacaggatattttcaacacagtaacgtagaattactaactaacacgaaacttaataggacactttctgctaatgccctcgctgcccttgaagaattcaaaagagaggaacaacaacatcaagaagcctttcaaaagctttacgacgaaacggatgaagacttccaaaagaaaaaaaaagaagaagggatgaagcttttcaaggaagattggcagctttcccagttttggtacagcgatgacacagccgcaattttagcagatgccatattggaaggtgcggacgaaaacactgtaattgcaatagttagtgcgccatccgtctatgctgccattcaaaagaaacctactaatgaaattccaaccgaacatatctacttgttcgaatttgataagagattcgagttgttagctggaagagatcatttctttttttatgattacaataaaccactggacttcagtgatgaaattaaaggaaaagttgatagattgttaattgacccaccttttttaaatgaagattgtcaaacaaagtgtatgtatatcataaacatatccctactcattttttaatcttttttccagtatcttttcatcttactaactgttattcattgatataaaatagcctctatcactgcaaagtgtttattagcgccaaatgacaactctaaaactaagaaaggagtttttaagcaccgcctcataagttgtactggtgaaagaatgtctgaagtcatatccaaagtttattctgacacaagaataacaacttttcttcctgaacattctaatggtttgagtaacgaatttaggtgctacgcaaattttgaatgtagttcatggaaatttgcttcttga

SEQ ID NO: 1909 - DNA, 903 bp, Saccharomyces cerevisiae
atgaaacgctttaatggtatgtataaatatttctacacaattaacaaatgtttaaaaaagggattatgcgaatgctcatccccccatgccataattttactatgttacattcagtagactaacgttccattttgcttgattttgcatatggtcttagtaagttatgtggaagttataaaaaatggtgaaacaatatctagttgtttccagccgttccagaaaaacgaaaactatggtacaataacttcagcaaacgagcagataacgccggtcattttccataatttgatcatggatatggtattacccaaagtagttccgatcaaggggaacaaagttaccaagatgtcaatgaatctcatcgacggattcgattgtttctactccacggatgaccatgaccccaaaactgtgtacgtttgcttcacattagtagatatgcccaagattttgcccatcaggatactaagtgggctgcaggaatacgagtccaacgctacaaacgaacttttaagttcgcatgtaggtcaaatactagactctttccatgaagagctggtcgaataccgtaaccaaactttaaatagttctggaaatggccaatctagtaatgggaatggtcagaacactataagtgacatcggggatgccaccgaagaccaaataaaggacgtcatccagataatgaacgataacatcgacaagttcttggagagacaagaaagagtttctttattggtggataaaacttcccaactaaatagcagcagtaataaatttaggcgcaaagcggtcaatataaaagaaataatgtggtggcagaaggtcaaaaatattacgttattaactttcactattatactatttgtaagtgctgctttcatgtttttctatctgtggtaa

SEQ ID NO: 1910 - DNA, 903 bp, Saccharomyces cerevisiae
atgaattataatctatccaagtatccagacgacgtgtcgagacttttcaagccaaggccacctttatcttacaaaagaccaaccgattacccatatgcgaagagacaaacaaatccaaatatcactggcgttgcaaacttactatcaacctctttgaagcactatatggaggagtttcctgaaggatctccaaacaaccatctccaaagatacgaagacatcaaactttccaagatcaaaaatgctcaattgttagaccggagactacaaaattggaatcctaacgttgaccctcatatcaaggacacagatccctacagaacgatatttattgggaggctaccatacgatcttgacgaaattgaactgcaaaagtattttgttaagtttggcgagatcgaaaaaattaggatagtcaaggacaagataacccagaagagtaaaggctacgccttcatagttttcaaagacccaataagtagtaaaatggcattcaaggagattggagtacacagaggtatccaaatcaaagacagaatctgcatagtcgacatagaaagaggcagaaccgttaaatatttcaagccaagaagattgggcggcggcctaggaggcagaggctattccaacagagacagcaggcttccaggaaggtttgcaagcgcaagtacatcaaatcccgccgaaagaaattatgctcccaggctgccacgcagggaaacttcttcctccgcatatagcgctgatagatacggcagttccacattggacgcgaggtaccgtggaaacaggccattgctctccgccgccactcctactgctgctgttacttctgtatataaatctagaaactcacggactcgagagtctcaaccagctcccaaagaagcgcccgactattga

SEQ ID NO: 1911 - DNA, 903 bp, Saccharomyces cerevisiae
atgataagaatatgtcccattgttagatctaaggttccactgttaggaacttttcttagatccgactcatggttggcacctcatgcgctagctctaaggcgggccatatgcaaaaacgttgcattgagaagttattcagtgaacagcgaacaaccaaaacatacatttgatatttcaaaacttactagaaatgaaatccagcaattgcgagagttgaaaagagcaagggagagaaaatttaaagatcgtacggttgcattttatttcagcagcgtcgcggtacttttcttgggtttggcatatgcagcggtaccactctatagagccatttgtgctcgtactggttttggtgggattcccataacagatagaagaaaatttaccgacgataaactcattcctgtagatactgagaagagaattcgtatctcattcaccagtgaagtatcacaaattttaccgtggaaattcgttcctcaacaacgtgaggtttacgttctgcctggtgaaacagccctcgctttttataaagccaagaattacagcgataaagatattattggtatggctacttatagcatagcgcctggtgaagcagctcaatactttaataaaatccaatgtttttgctttgaagaacaaaagctagctgccggtgaagaaatagatatgcctgtcttcttttttatcgatccagattttgctagcgatccagcgatgcgaaatatcgatgatattattttacattacacattcttcagagctcattatggtgatggtacagctgtaagtgactctaaaaaggagcctgagatgaatgcagatgaaaaagcagcgtcattggctaatgctgctattttatccccagaagttatagacacaaggaaagacaactcaaattaa

SEQ ID NO: 1912 - DNA, 903 bp, Saccharomyces cerevisiae
atgcctcataccgataagaaacaatcaggattagctcgtcttttggggtccgcctctgcaggcataatggaaattgccgtcttccatcctgtggacaccatttccaaaagactgatgtccaaccacaccaaaataacctctggccaggaattgaatcgtgttatttttcgtgatcatttcagcgaacctttgggcaaacgtttgtttaccttgttcccgggtctcggttacgctgcatcatacaaagttcttcaaagagtgtataaatatggtggtcagccttttgctaacgagtttttgaataagcactacaaaaaggattttgataatcttttcggtgaaaagactggtaaggcaatgagatccgccgctgctggatctttgattggtattggtgaaattgttcttttgccgctggacgtgttgaagattaagagacagaccaatcccgaatcgtttaaaggtagaggtttcatcaagattttgagagacgaaggcctgttcaacttatataggggttgggggtggacggctgccagaaatgctcccggttcattcgccctttttggtggtaatgcattcgccaaggagtatatcttgggtttgaaagattattctcaagctacttggtcccaaaacttcatctcctccatcgtcggtgcttgctcctctctgatcgtttctgctccattagatgtcatcaagacaagaattcaaaataggaattttgataatcctgaaagcgggttgagaatcgtcaaaaacactctgaaaaatgaaggtgtaactgcgtttttcaagggcttaacacctaaattactaacaacgggtccaaaactggttttctcatttgcgttagctcaatctttgatacctagattcgataacctgttgagcaaatga

SEQ ID NO: 1913 - DNA, 903 bp, Saccharomyces cerevisiae
atgcgtttgtttgaaaatagtaaagatatggaaaaccggaagagattgttacgtgccaagaaggctgccggcaataacaattgttttgaatgcaagagtgtcaatccacaatttgtttcttgcagcttcggcatatttatatgtgttaattgcgcaaaccttttgagggggatgggtacgaacatattttgtgtaaagtcaataacaatggataattttgaagaaaaggatgtcagaagagtagagaaaagcggaaataacagattcggttccttcttgtccaaaaatggtattttgcagaacgggattccattgcgtgaaaaatatgataatttgtttgctaaaagttacaagaggaggctggccaatgaagtgcgcagtaatgatattaatcggaacatgtatttgggattcaataatttccagcagtatacaaacggtgcgacgagccaaataagagataggacgttgagggaaatatctaataacagcaatgcttcggaaggggcggaatttgtactacctgagaaggtgttaggctctgacaattttcaagactgcgaaagatttcccgcttgtttgagttccgaaagaaacctggacgagaataacgttacaagtgctacgagtacgttaacaattgaaaaatttcaaaatgaccccataggaaccatttctagaagttggcagttgctttcagatgcattatacaaatcatacgaagactttaaaggctcggttgttcagccaacgattgaaaacattcaacaaaggaatttgccgaatgatatcaagagatcattcgtgcactttaacgagaagttgcatgaaacgccccatttaccctcgccagttttttcttgttttactgggggagacattctccctccagaattcaattag

SEQ ID NO: 1914 - DNA, 903 bp, Saccharomyces cerevisiae
atgctttatttgatcggacttggtctctcgtacaaatcagacattaccgttcgtggtttggaagctattaagaaatgttctagagtttatctagaacactataccagtatcctaatggctgcaagccaagaagagttagaatcttactatggtaaagagatcatcttggctgatagggaattagttgagactggttctaagcagatcctaaataacgccgataaggaagacgttgctttcttggtcgtgggcgatccatttggtgccaccacacacacagatttagttctcagagctaaacgtgaggcaattcccgtcgaaattattcataatgcgtccgttatgaatgcagttggggcatgtggcctacaactatacaatttcggtcaaaccgtttccatggttttctttaccgataattggagaccagactcatggtacgacaagatctgggaaaatagaaaaattggccttcatactttagtgttattggacatcaaagttaaggaacaaagcattgaaaatatggcccgtggcagactaatctacgaaccaccaagatacatgtctatcgctcaatgttgtgaacaattattagaaattgaagagaaaagaggtacaaaggcatacactcctgatactccagcagtcgcaattagtagattaggctcgagctcccaaagctttaagtctggtaccataagtgagttagccaattacgattcaggagagccacttcattcgcttgtcatcctcggcagacaatgtcatgaattggagctggaatacctgctagagtttgccgacgacaaagaaaagtttgggaaagatgtggcaaatgaccaagagtacttcaaacctgcggcatgggtcccacccacagaagacgacagcgacgagtaa

SEQ ID NO: 1915 - DNA, 903 bp, Saccharomyces cerevisiae
atggaaaagtacaccaattggagagacaatggtacgggaatagctccatttctaccaaacacaatcaggaaacctagtaaggtgatgacagcgtgtttgttgggtatcctaggggtgaaaaccattataatgctaccattgattatgctgtaccttctaactggccagaacaacttactgggtttgatattgaagtttacattcagttggaaagaggaaattaccgtgcaaggaatcaagaaacgtgacgtaaggaaatccaagcattatccacagaagggcaagctttatatttgcaattgtacctcacctttagatgctttttcagtggtgttattagctcaagggcctgttacgttgttggtcccatccaatgacattgtatacaaagtttccataagagaattcatcaacttcatcctcgccggtgggttagatataaaactctatggccacgaggtagcagagctatctcaattgggcaataccgtgaattttatgtttgctgagggtacctcatgtaatggtaaaagcgtcttaccgtttagtataaccgggaaaaaacttaaagaattcatagacccttcaataaccacaatgaaccccgcaatggccaaaactaaaaaatttgaattgcagaccatccaaatcaaaactaataaaactgccatcaccacattgcccatctccaatatggagtatttatctagatttctgaacaagggcattaatgttaaatgcaagatcaacgagccacaagtactctcggataatttagaggaattacgcgttgcattaaacggtggcgacaaatataaactagtctcacggaagttagatgttgaatctaagaggaattttgtgaaggaatatatcagcgatcaacgtaaaaagaggaagtag

SEQ ID NO: 1916 - DNA, 903 bp, Saccharomyces cerevisiae
atggagtccaataaacaaccacgtaaaatccaattatatacgaaagagttttatgccacatgtaccttaggtggtataattgcgtgcggtccaacacattcttcgatcactccactagatcttgtcaaatgtaggctacaggtcaatcccaagttgtatacttcaaacttacaagggttccgtaagattatagctaatgaaggctggaagaaagtatacactgggtttggtgctacattcgtcggatattcgctacaaggtgcaggtaagtatggtggttatgagtatttcaagcatttgtattctagttggttaagtcctggtgtcactgtgtacttgatggcctcagcgaccgctgaattcctcgctgatatcatgttgtgcccatttgaagctattaaagtgaaacagcagactactatgccgcccttttgcaataacgttgttgatggatggaaaaaaatgtatgcagaaagtggaggtatgaaagcattttataaaggtattgttcccctatggtgcagacagattccttacacaatgtgtaagtttacctcattcgaaaaaattgttcaaaaaatatacagtgttttacctaaaaagaaagaagaaatgaacgcattacagcaaatatcagtcagttttgtaggtggttatctggcaggtatattatgtgctgcagtctcacatcctgcagacgttatggtttccaagatcaatagcgaaagaaaggccaacgagtccatgtctgtagcctctaaaagaatatatcaaaaaattggctttactgggttgtggaatgggttaatggtgagaattgtcatgatcggtactttgacaagtttccaatggctaatttacgattcgttcaaggcttatgtaggcttaccaaccaccggttag

SEQ ID NO: 1917 - DNA, 903 bp, Saccharomyces cerevisiae
atggttaataattcacagcatccttacatcaaagatggatggtttagagagattaatgataaaagttttccgggccaggcctttactatgaccgtggactcaatactttatgaagcccgcagtgaatttcaggacatcttaatcttccgtaacaaggtatacggtactgttttggtcctcgatggtattgtccaatgtacggaatttgatgagtttgcctatcaagagatgatcacccacattgccatgtttgcgcattctaatcccaagcgtgtacttatcattggcggtggggacggaggtgtcttaagggaagtagccaagcacagctgtgtagaagatatcactatggtagaaattgactcatcagtgatcgaattatcccgtaagttcttgcccacattgagtaatggtgctttcgatgacgaaaggttggacttgaaactttgcgatggcttcaagttcttacaagatataggtgcttccgacgtccataagaaatttgacgtcattattacagatagttctgatcctgaaggtccagctgaagcgttttttcaagagaggtatttcgaactattgaaagatgctttaaatcctaatggcgttgttattatgcaaagctctgaaaatttttggttaaatttaaaatacttacatgatttgaaaaatacagccaaaaaggtatttcctaatacagaatattgctataccatggttccaacctatacatctggccaattaggtttaattgtttgcagtaataacgccaatataccgttgaacattccgcaaagaaagatatctgagcaagaacaagggaagctgaagtactataatcctcaaatacattctagtgcgtttgttttgcctacttgggcagacaaggtcattaatgaatga

SEQ ID NO: 1918 - DNA, 903 bp, Saccharomyces cerevisiae
atgtcaccgtgttatggacaaaacagtgccatcgccaaggggtcttggaacagagaggttttacaagaggtgcaaccgatttatcattggcacgatttcgggcaaaacatgaaagaatattcggcatcacccttagagggggattccagcctgccttccagcctgccttccagcactgaggactgtttactactatcattagaaaacacaatcacagttatagccggaaatcagagacaggcttatgactctacgtcgtctactgaggaaggtacagcacctcaattacggccggatgaaatagcggacagtacacactgtatcacgtcattagttgatccggagttcagagatcttattaattatggacgtcaaaaaggagcaaatcctgtatttattgagagcaatacaacagaacaatcccattcacagtgtattctaggctatccccaaaaatcgcacgtggcacagctatatcacgaccccaaagtactcagcacaatttccgaagggcaaacaaaaagaggaagttaccactgttctcattgttctgaaaagttcgcaacgttagttgagtttgccgcgcacttagacgaattcaaccttgaaagaccgtgtaagtgtcccatagagcaatgtccctggaaaatattgggtttccaacaagcaactggtctgagaagacattgtgcttcccaacatataggagagcttgatatagagatggagaaatcattaaatctaaaagtagaaaaatatccaggactgaattgcccatttcctatctgtcagaaaacgtttaggcgcaaagacgcctataagagacatgtggccatggtgcataacaacgctgattcaagatttaacaagcgtttgaagaaaattttgaacaataccaaatag

SEQ ID NO: 1919 - DNA, 903 bp, Saccharomyces cerevisiae
atgtcgtattactttaaaaatctgaagccagacttgaactccgacgtagaagaagatgacggaaacttattggagagcataatggcgaacaaaagtaagcgagaaattgacgaacaagaatcaagtgacgatgagttgaaaaccttgtcttttggttctttgaagaaggctgaaacggtaatagatgaagaagatttcaaagatacgaaacccgttcacaaaaaaccgatcacaactacatacagagaagaaagttttgatgaagatgaggacagtgaggaccaatcagacgaggatgctggattctttgaagaagatagtgaggatgaaactcatcatggtcagaaagtaccaaaaaagaagagcaaacacgctccagtagaacaatcatccaagaaaagggtaccacgagtccgaaatatccctgggctggaaataccgaggaataaaaggtctaacctctatcaggacatcagatttgataagtccaccggtaaagcccttgatagttctatcataagaaaacgttaccagttcttggacgaatatagagaaaaagaaattgatgaactgcagaagctgttacaagaaagaaaatttctatcaaaaatagaccagggagaacgtgaagaaatggaacaaagactgaaaagtatgaaatcgagattgcaatcaatgaaaaacaaagatctcgagcgtgaaattctcaaggaatacgaaaatgatatgaataaaaacaataatacgagataccatttgaaaaagtctgagaaacgtaaagtggtgcaaaagtggaaatttgatcacatgaaggccaagcaacgtgaaaaggtcatggaaaggaaaaggaagaagagattgggtaaagagtttaaacaatttgaatttcataatcgtaggtag

SEQ ID NO: 1920 - DNA, 904 bp, Saccharomyces cerevisiae
atgggtaaatcgtatgtccatataacttcaaaatgaaaatatagcagttgaaacatatcaattaaatcattatacatctccaataaacatgtatgcaagaggaaagcgtaaatatcttcgatttcgacaatactttgctactgaactaaaaatgaaaatgaagttgaattctcaaaggaatgtgatgcaagttcgttaattaatatggtttttagtggaattatcatagtttgtgatagatacacacgaggagtagtgagcaaagcaagtgcaacagcaatgatatgttagcaggaaataatattataaattggatattgtgtgtttttttgatatatgtttgtcgaagctaatacagaatgattactaactggaatttaaaagcacaatcatgctcttggatgattgatctattaaaaaattataaaacagacatggttacagatctcgtacacgttacatgttccaacgtgacttcagaaagcatggtgccgttcacatgtccacctacttgaagatctacaaggttggtgacattgtcgacatcaaagccaatggttctatccaaaagggtatgccacacaagttctaccaaggtaagaccggtgtcgtctacaacgttaccaagtcttctgttggtgttatcatcaacaagatggtcggtaacagatacttggaaaagagattgaacttgagagttgaacacatcaagcactctaaatgtagacaagaatttttggaaagagttaaggccaatgctgctaagcgtgctgaagccaaggcccaaggtgttgctgtccaattgaagagacaaccagctcaaccaagagaatcccgtattgtctctactgaaggtaacgttcctcaaactttagctccagttccatacgaaaccttcatttaa

SEQ ID NO: 1921 - DNA, 904 bp, Saccharomyces cerevisiae
atggtatgtttttaatttcgtttctttagttctcaggctcttcaaagtactaacactttattggcaaggggcgctcaaatgtgatgcatcattatagagtaataataaaataaaaagaaaggatgcaagcccggaacaagaggcaattgaatcattcacctcattaaccaaatgtgaccccaaggtatccaggaagtacctgcagcgtaatcactggaacatcaattacgctctcaatgattattatgacaaggaaatagggacgtttactgacgaggtttcaactgtggctcatccacccgtatacccgaaggagctaacacaggtatttgaacactatatcaataacaacttgtttgatatagactcactggtcaagttcattgaggagctaggctacaatcttgaagatttagcgacattatgcttagcccatttactggggtacaagaaactagaagaacccttaaaacgagaggacttcctgtcaacatggtttatgcaaggctgttccaccatttcagacatgcaagagtgcatcaagacgttagatgttaaattacatgaagacttacaatatttcacacagatttataactatgctttcaatttgattctggacccaaatcgaaaggatatagatacagacgaaggcatccagtattggaagctatttttccaaccagagtacccagtgcgtatggaaccagatttgcttgaggcatggttccgtttccttcgcgatgaggggaaaaccactataagtaaagacacctggcgtatgctgctcctctttttcaaacgataccccactattcagaaaataataagcgattacgacgaaactgcagcctggccatttattatcgatgagttctatgagtgcttacaggatcagcaataa

SEQ ID NO: 1922 - DNA, 904 bp, Saccharomyces cerevisiae
atgtctgaatttaagatgtatgctttgacataagatacaagtttgcctctaatttcatttttttactaacttttcaacgaatcgtttaatattctaattattttgcagagtatcaagaaaagatctttataatgaaggagagggattaggagaagattatgattccaatagtagtagtaaaaataatagtgagcatgtagaggtattagtaccgccaacagaatttgaattcgttgaagttgaaagaaccgactcatcattagatctcaaagaaagtaataacagcgcacatgaacaaaaggaagaaaaacaagaagaattcgagttcccgttattttcgtttggtgtggttgaagcatcgactagcccagctcaagaagaacaaggttcatcaactcaagagaaggatacgccacagactgaagtaagtttgatgaaaatttcattgaaggaacctgaagaagaaataatcaaccaagaaaggcccaaagactactactttgcaagctattctgcagaccaaaagctgcaattccaacagagctctatcgactatgatgtgataatacaagaaagtacaaaaattctggaggatgatctacgtattcgtgataaatggccatattgccagggtcgaataatagatctgtataagcacaatgcgagaatagagttagagcagcagaaggaattgaagattaaaaagaggagacctggtcaaaagcaacgtgcagccaaaaaactggcacttgaaagaaccaaggagcgtgataccaaagctcgtgagataaagaaacagttgaagaaaaagtttcataagcgtggtggaaagaaaaacaaaaaaaaggtacctttgaacccactggcaaaagctggcagtacccctaagtttaggacagaatga

SEQ ID NO: 1923 - DNA, 906 bp, Saccharomyces cerevisiae
atgaaaattttcaatacaatacaatctgtgctgttcgcagcattttttctaaaacagggaaattgccttgcgtcaaatgggagtaccgcattgatgggggaagtagatatgcaaacgccctttccagagtggttaacagaatttactaatcttacacaatggcctggaattgacccaccttatattccgctagattacataaatcttactgaagtgccagaattagataggtactatcctggccagtgtcccaaaatttctagagagcagtgctcatttgactgctataactgcatcgatgttgatgatgtaacttcgtgtttcaaactttcccaaacatttgacgacggtccggccccggcgacagaggcattgctcaagaaattgagacaaagaaccactttttttgttctggggataaacactgttaattatcctgatatatatgagcatattttagagaggggtcatttgattggtacacacacgtggtcacatgaattcttgccaagtttatcaaacgaagaaattgtagcccaaattgaatggtcaatttgggctatgaatgccacaggcaaacatttccccaagtattttaggcctccatacggtgcaattgataatagggttagagctatagtaaaacagtttggcctaacggttgtcttgtgggatctcgatacttttgattggaaattaatcactaatgatgatttcagaacagaggaagaaatacttatggacataaatacttggaagggaaaacggaaaggtttgatcttagagcacgatggtgcacgaagaacagttgaggttgctattaaaatcaacgaacttattggtagtgaccaattgacaattgcagaatgtattggtgatacagactacatcgaacgctacgactag

SEQ ID NO: 1924 - DNA, 906 bp, Saccharomyces cerevisiae
atgaaactgaaagttactggagcaggaatcaaccaagtcgttactttgaagcaagatgcaacactaaatgatcttattgagcatatcaatgtagatgttaagacgatgaggtttggatatccgcctcaaaggatcaatttgcaaggggaagacgcttctttgggacaaacccagctggacgagctgggtattaactctggtgaaaagattacaatagagtcctctgatagtaacgaaagcttcagtttgccaccaccacaacccaaaccaaagagggtgctgaagagcactgagatgtcaattggtggcagtggagaaaacgtcctatcagtacatcctgttctcgacgacaactcgtgtctgttccatgctattgcctatggcatcttcaaacaagatagcgttcgtgacctcagggagatggtctctaaggaggtcctcaacaaccccgtcaagttcaatgacgccatattggacaaacctaacaaagattacgcgcaatggattttgaaaatggaatcttggggtggagccatcgagattggtatcatatccgatgcactcgcagtagctatttatgtagtcgacattgacgctgttaaaatcgaaaagttcaacgaggacaagttcgacaactacattttgatactgttcaacggaatccactatgattccttgaccatgaacgagtttaaaactgttttcaacaagaaccagccggaatcagatgatgttctaacagcagctttgcaactggcctcaaatttgaagcaaactggctattccttcaacactcataaggcccagatcaaatgcaacacttgccaaatgacctttgtgggtgaaagagaagttgctaggcacgctgaatccacgggacacgttgattttggccaaaatagataa

SEQ ID NO: 1925 - DNA, 906 bp, Saccharomyces cerevisiae
atgctacaccataagttcgtatacccatttttattcaagtggcacttatcatgtgtagaaaagtgtcccccacaaatcacttttatagctaagtatgctacagcgaacgataaaaatggcaatagaaaacttacgataagggatgaacaatggcctgagttggcagatccaactccctatgatatttttggcattccaaaggccggatctggaaatcctaaactggacaagaagtcgttaaaaaaaaaatatcatcgttatgtaaaattgtaccaccctgaccattccgataacattcaaatatttagctcagaaaaggttaccaacagtgatagtaaatcaccgctgctgctaacatcaagcgaaaaactacatagatttaaagtcatctctcaagcatatgatattctttgtgacccaaagaaaaagatcgtatatgacacaacgaggcaaggctggaccacatcgtattcaccacgttctaacgttaatactgaaaattaccaatatgccggctcttatggctaccactctaacgcgcagtatgaatactggaacgctgggacttgggaagacgcaaatagcatgaaaaacgaaagaattcaagaaaacatcaacccatggaccgttattggcataatttgtggcctagctatatgcatcgaagggactgcgttgttagccaaaatccaggagtctctgagcaaggccgaatttactcatgacgaaagtggattacatttgattcagtcatacacgaattatggtcttgatactgacaaattttccagattgaggcggttcttatggtttagaacttggggactttacaagtcgaaagaggatttagatagagaagccaagatcaatgaagaaatgatacgcaaactgaaagcagctaaatga

SEQ ID NO: 1926 - DNA, 906 bp, Saccharomyces cerevisiae
atggatgcttttgagaatatgtctgtatcaaatcatccgggcggtaacgcaagaagaaactcccaatcagcaaacgaaatgcttgcatcgcaaattcaggatttccagaatattccaaggtctttcaatgacagcaatgcaaatgtaaatttgtcaaaaaattgtactgtcggcaatcaactgcctttctcatcacgtcaacaaaaaattatcatggaacatttactgataacgaagaacaattctcaacagcagaaggactattcacacgtgccatgcaaattttttaagatgggcaattgccaagctggctcgtcttgtcccttttcccattccccagatattatcagttctgcgaataatttaccttgcaagtatttcgcaaagggtaactgtaaattcggtaacaagtgtgttaatgctcatgtgctgccaaatgggttcaagatgaacagtaaagaacctattgacatcactcccccttcacaaaacaactacttatcccatgctagatcagcttctttctctacctacacgtctcctcctctgtctgcacaaacggaattctctcactctgcttcgaatgcaaactacttttcctcgcaatacctaatgtattcgcctcagaaaagtccagaggccctatatactgaattcttttctcccccttcgtcttcttcttcgtacatcaactatagctataataactccaacattaatgcctattctccagtctcttcgtcttcatctaacatttggcaagagcaaggccaaactacgttatcgaatccgagtgtgaatcagaatttaaggtatcgtacaggccctgcaattcaagaagaatcagataatgaaattgaagatttacttattcacaatttcaattccagatactgtcatgaatga

SEQ ID NO: 1927 - DNA, 906 bp, Saccharomyces cerevisiae
atgtccagtaatatagaacctcagacaacagctaaatgtatactgtatacaacaaaggggaacattgccattgaattatgggctaaagaatgccctgagacatgtaagaggttcttatctatgctctcagatggcacattcaccaatggagaatttaaagagttaaagccaacacagtggctaatgtttaatgcaaatagtactggtgagtaccgtacagttgctgaggaaaaaaatcctcgtatacgcttcaatagagatggactcttgggatgggatagacgaaggaacacatggtttataactgtgctggcggattctaagcacgtactgaacgattgtaatgtatttggcaaaattgttgggaaatctatttacatctttagagagatcttgggcggcgaaattgaagcttcctcccgtgacaatgatgtcaaacgattcatgtatcctgcagttttgaaggatgttgagattaccataccattctttgaggacatctttggatcaaaaagaagactggaagataatgaaaaaaaagaacaagagccggcaaagaaacttgtgaaatcagcaaaagtaaagatggtttatgaagatgagcaagaggatgatgatggtgatgttcaaaagcttaagccaagaaagagaatgattctcccagcatggatcaaagatgatagtcgcagtgaaggaattaaactagacgcatccttagatcagccacaagaggcactaattagggaaaagacggagttgcatgataatgttgatgaggcaaccactaaagaaacggaaagtcaagaaaacatcaaggaagaaccaatggataaaagagagcgggaaactttggcaatgttgtcaaaatttcaagaacgaataaaaaacaagaatattctaaagtga

SEQ ID NO: 1928 - DNA, 906 bp, Saccharomyces cerevisiae
atgtcctacaaaaagtttgtgtactttattaaccttttctttctactaggggctacattgttgactttttttctgatactagcaggtggcaggaccacaggagtgttgaagaatttttattggtttcaggcatccacttcgggctttaactcggcgccctccgtaaccagatggtacaattataactggtgcggctgggaaagccgcggaatagcagtcaactgctcttctaagatggcagctcagccgttttcaccaagggacaactttggcagttcccccctcatgccctcaacttttttaaacaacagaaatgcctactattatctttcaagagtgggctgggcaatgcttctaatcgggcttttctttttgttaatcacgttagtttcggttattgccagtttaatcagatacaatagacgtaccgccgctctggcaactgcaatgagctggatcacgcttttcttcataaccctatccgcttgtctgtacacaggatgttacgctaaggcagtaaaggcgtttcaccatgagaatcgtgatgctagactaggtcccaagaattttgggcttatttggaccacagtatttttgttaattgtaaacgccatttgctgtactatcatggtggctactcataaaagaaacgagtacatctatgaccgcagtttcgcttctaccaagacagtggactcacaaactccaactccagttccaacaaatggaggaataccttcctcggtgcctgtaactgaggtccaacaatctcaatcccaccagaatcataggttctttaagaaattgagaacgaaaaagagaactgtgactagcgcaggcgatgaaccagaccgggttcaagaggaacgcgtctatactgaacagaatgttcctgttgtatcatag

SEQ ID NO: 1929 - DNA, 906 bp, Saccharomyces cerevisiae
atgttgaatagttcaagaaaatatgcttgtcgttccctattcagacaagcgaacgtctcaataaaaggactcttttataatggaggcgcatatcgaagagggttttcaacgggatgttgtttgaggagtgataacaaggaaagcccaagtgcaagacaaccactagataggctacaactaggtgatgaaatcaatgaaccagagcctattagaaccaggttttttcaattttccagatggaaggccaccattgctctattgttgctaagtggtgggacgtatgcctatttatcaagaaaaagacgcttgctagaaactgaaaaggaagcagatgctaacagagcttacggttcagtagcacttggcggtcctttcaatttaacagattttaatggtaagcctttcactgaggagaatttgaagggtaagttttccattttatactttggattcagtcattgccccgacatttgtccagaagagcttgacagattaacgtattggatttctgaattagatgataaagaccatataaagatacagccattgtttatctcatgtgatcctgcaagagatacaccggatgtcttgaaagagtacttaagcgattttcacccagctatcattggtttaaccggtacgtacgaccaagtgaaaagcgtatgcaaaaaatacaaggtatatttttcaactccacgtgatgtcaagcccaaccaggattacttagtggaccattcgatatttttctatttgatcgaccctgaaggacagtttatcgatgcgttgggaagaaactacgatgagcaatctggtctcgaaaagattcgtgaacaaattcaggcgtatgtgccaaaggaagaacgggagcgtaggtcaaaaaaatggtactcttttatcttcaattga

SEQ ID NO: 1930 - DNA, 909 bp, Saccharomyces cerevisiae
atgacctatccgaaaagaatacctataaatgcgtggtctgaagttcatagggtggcaaggccactaattattactttcgacgcatataatacactatacgccacaaaacttcccgtcatggaacaatactgcattgttgggcgtaaatatggtatcaaggcgaatccttcgactttaacaaacaattttccacacgtttttaaaaaactgaaggaagactatccccaatacggaaaatattctggtatcaagcccgaacaatggtggtccatcttgattaggaacgtcttcgcaccaaacgaaattcccgatgagatgataaatgaaatattaatgcggtttgagggcttcgattcgtattttgtttatccagatttgatcaaatttttaaaggatttgaagtcaagacatcctgatgttatcttaggaatagtaagcaatactgatccaattttttacaaattattaaagaatatcggattatttgagacattttccggtcacatttatttatcatatgagcttaatctcgccaaacctgatagagcaatatttcaatatgcgcttgacgatattatatctaaacaacctcatttactcgaaaagtacaccagggaggaaattctacagcattgctttcacatcggagatgaattaaagaacgatctcgaaggggcagaagctgccggttggactggtatactgttagatagaaatgataaatacgggtttctttcaaactcgattagtaaaccaatgcgggacgaatacaagctgtcaattgataaaatagataataattcaataaacacttgggaagccaatactaagcaaactgacacgttacagttgagtgaaagaaagtacgttgtttcgaatcttgaggttttagaggaactctttccctga

SEQ ID NO: 1931 - DNA, 909 bp, Saccharomyces cerevisiae
atgacctcaggatactataccgtctcatttttttatgcgatcttattgttatgcgcatgcacacgtgctgagatctacctgacgggcggtgaaagccagggcttgccatcaggattctggcaaatggacgatgatttggcaatcgctccagtttctatggttgaattttaccagacgataggattaactgcaaatggtactgtacctgagtccttcaacaagcgtgatgctactgaataccctaacattatcagtaatataactacccaagcagccaacttcactcagcatagtctcgtcgagcaacttcaaaatgacgtcacggcaataagtatcagtaatgccattaatgtagccgtcgatggttctgtggaaacaccagcagacctgcaatacaaccgcaaccaggaaacaggtgaatctaccctctgtagagccaagttttacggagtggaggtaagaacttggtctaggttgtacaatagggccgtctcttccacaactcttacgactaatttgaacagctacatagcgcaatgggtagcatgggccgttcacgggagcggtgacaagaagttttgcggcagccaggagttcacgaatatcttttttgatgggcaagagggttggagtttgtttgtcaagacgtggtcaacaaacagtagctgtgatattacagcctctgaaggaaatttaacatgtgcagttcgtgtttcagtatccagtatgcacaatcacggcaagacagcgttttgtgttacctatagccacggtgattcttggcgtgccgagctgagagtagttgccaatgatgcttggtcccattattatccctggagtattgactgtccagaagttgataaaaataatatggctattaatgattgttttgatcaggcgcaaggttaa

SEQ ID NO: 1932 - DNA, 909 bp, Saccharomyces cerevisiae
atgactgttataaagacagaaccaacaacagaagtgacattatattctccaccatcaaaagaatctttaagtaaagatgacgcccacagaaaaaaacaaaataataaaccaccttcgagtataaatagccgctcaggaccaaataagcataaacttgccgccaaagcaccggaaaagaaaatcaataacacagataaacaagacctctctgcctttttattaaatccttcccttattgttaaaccttctgagagcaaaaaaaaagaaaatattgtggcctataatgatacaccaggtataaaaacagaacatacagcgtttcagccgctgacaccaatttcgaaaaaaagggccctgaaagagaaagcagcatcagaaaaatgtgatagctttgatctttccagagacgagaagccttatattcagaaaaagtcaaagacgctttcttccgtcacagagattaattcctcagaatataaactctcactaaatggcgaaaatacatcatccccagctaaggaaaaatcgcaagaacccatagaaaatcctggaagttaccaaaaaacaagaaattacctttttgaaaagcccgatcctttagacacgtgccttcaggactactcgagtatgctaccgtcaaatgtagcagaagaagatcaagaatattttatcagcgtagctgattcgacattggaggagtggactaacaagggccaggaaattattgaccaacagttccagctctaccaagaaataatcaagaaacgaatagaactaagctacaaatttaagggtattatttctgtaatcaatgatagggcagatgccctagaagaacagggtcaacaactagaaggaaaaattaagaaagttaaaactttggctaatgaaattctcaatattatataa

SEQ ID NO: 1933 - DNA, 909 bp, Saccharomyces cerevisiae
atgagggaaaaaagaacaatttcaaataaagacacaaactatctcaaattcccaaataaactccaaagatattcccgattcttgagcaggaagatatccaataccagcccagaaaagcaaccgaagaagaacataaaagaacactgtttatcgagttatcataaagaacactcggtaaaaccaaagcaaaactccggtaatgttgcagcaaaagaagacaaagatacgcagcatttacaaaataatgtcgctaatgaagaagcaacggaatgtctaacaagaagtaatttgaaaaagttacaagagaaaattttcgatagagaacttaatgatattgcctgtgatcattgtctttgtagcacagaaaatagaagagatatcaagtattcacgactttggttcctttttgagttggaaatgagtgaaaactggaatgaaaatctccgccttagttgctataataaatatgtgtattccgcaattgatgagtcgtggaaaatggagaatattctacttaaagaacaagagaagcattatgaatattttccaataggacaattactgatacccaataatattgactacactaataaacagaaaaggaaggaaaacattgaagacttaacaattgaaattgatagtattatagagacaaaccatcaaaagaaaagatttttgccgcaaagtgtcctgataaaaagggaggatgaaattgcatttgacgactttcatttggatgcacgaaaggttctaaacgatttgagcgccacttctgaaaatccattcagctcttcaccaaatacaaaaaaaattaaatcaaagggaaaaaccttggaagtggttcccaaaaagaaaaacaaaaagatcataggtgctttggaaagaaagctacatatagatgaaaattaa

SEQ ID NO: 1934 - DNA, 909 bp, Saccharomyces cerevisiae
atgataaagttgcatgaagtgcctccagaaccagtagaccctgctagtctccctcatgatgttaatgcacatagccccgaaggagatggtaatcctgataagaggaaaaaaatatttggcattccgtatcctttttccaggagttcatgtcggagattcctttggaactgtcaaaagatttcggtactgcccatggcattgtatttcccactacatgcagcaaatacattaatcacgccggcagtatcacctgattctgctcctgacgacgttttaatgatggtgagagagattttaccgtccataactaccaagctgttagttgcgggtattactcttcatgtttctgctggtgtcttgctccgaatcgtgaacaactggaacaagccaagaagaaatagacatcgacatttaaagatatcggccgaacaagatctatcccaagattcgattggtttaactggtggaatttctggctatttatttggattgtataagaccttccgcattcctccacaagtgattagtggatacatccttgttcccgtcctgatataccacttattaattatgaaatgggtgccgaattccatctctactgaggtggatttcgcctctataaagcaattactatctagcaagaacaggtggtggaaatggcttggaggcctggtgccgttagctattctcctcgagtcaggtgtatatcatataggttcggggctctgccgttatttcggtgttagaaaaatgactagcaggaaaaaatggtccacagctatcaatctattaacactcgttgggttcgtttctctgattagattgatgaaagaggattctacgaaactgggtcccaaccaattcgaaagcattttcaaaaagatccggttgctgttgcacgtgaattag

SEQ ID NO: 1935 - DNA, 909 bp, Saccharomyces cerevisiae
atggttaaggtctggaatatagtactacgtctggtagtgttgctgtttttagcaggtaataccttgctgttaattttgatgattatatctggtgccacggaccattaccccgtgaacagattctattgggtgcagggcaatacaacaggcatacctaatgctggggatgaaacacgttggacgttttggggcgcctgtctacaggataaagacgggtcggatacctgcacaagcaatttggcacctgcataccccatttccccagtagataacttcaacacacacatcaatgtccctcaccagtttatttccaaaagagacgctttttactacctgactagattttcattttgtttcttttggattgcgcttgcctttgtaggtgtgtcgtttatcctttacgttttgacttggtgctcgaagatgctttcagagatggtgcttatcctcatgtcttttgggtttgtcttcaatacggcagccgttgtcttgcaaacggccgcctctgccatggcaaagaatgctttccatgacgatcatcgtagtgcccaattgggtgcctctatgatgggtatggcttgggcaagtgtctttttatgtatcgtggaatttatcctgctggtcttctggtctgttagggcaaggttggcctctacttactccatcgacaattcaagatacagaacctcctccagatggaatcccttccatagagagaaggagcaagcaactgacccaatattgactgccactggacctgaagacatgcaacaaagtgcaagcatagtggggccttcttccaatgctaatccggtcactgccactgctgctacggaaaaccaacctaaaggtattaacttcttcactataagaaaatcacacgagcgcccggacgatgtctctgtttaa

SEQ ID NO: 1936 - DNA, 909 bp, Saccharomyces cerevisiae
atgttttccagattatccagatctcactcaaaagcattaccgattgctctaggtacagttgctatagcagctgctaccgcattctattttgcaaaccgtaaccaacattcctttgtcttcaatgaatctaataaagtgttcaaaggtgatgacaaatggatcgacttgccaatatctaaaatagaggaggaatcccacgacaccagaaggtttacttttaagctgcctaccgaagactcagaaatggggttggtcctagcatctgctctgtttgctaaatttgtcacaccaaagggatccaatgtggtgagaccatacactcctgtgagtgatctttcccagaagggtcacttccagctggtcgtcaagcattatgaaggtggtaaaatgacctcacatttatttggtcttaaaccaaatgacaccgtttctttcaagggtcctattatgaaatggaagtggcaacctaatcagttcaagtcaatcaccttgttaggtgccggtaccggtatcaaccctctgtaccaattagctcatcatatagttgaaaacccaaacgacaagaccaaagttaacttgctatatgggaacaagactcctcaggacattttactaaggaaggaactggatgcgttgaaggaaaagtatcctgacaagttcaatgttacttactttgttgacgacaagcaagatgaccaagactttgatggtgaaattagtttcatctccaaagattttattcaggagcatgttccaggtccaaaggaaagcacacatttgtttgtctgcggtcccccaccatttatgaacgcttactcaggtgagaagaagtcacctaaggaccaaggtgaattgatcggtatcttgaacaatttgggctactccaaggaccaagttttcaaattttaa

SEQ ID NO: 1937 - DNA, 912 bp, Saccharomyces cerevisiae
atgactgttactgacacttttaaactgtttattttaaggcatggtcaaagtgaattaaactcagaaaacatattctgcggatggattgatgctcaattaacggaaaaagggaagtctcaggcccgccactctgcaaaattgatcaagcagttttgcgattctaacaatatctctttgcctcagattggctatacttcaaggttgattcgaactcagcagaccatggacgttattctcgaagagttgggactaaaacacaccaattatgtaattactacgaatacaaacattaaggaggagctgcaggacacaagatttgaaggaagtatgcctgtgttgcaaacctggaggttaaatgagcgtcattacggcgcatggcaaggacaaagaaagccagatatcttgaaagaatacggtaaggaaaaatacatgtatatcagaagagattacaacggaaaaccccctaaagtcaacctaaacctggaaatggtccaagaggaaaatgatcaggggtcctccacaggctatgattttaaggagcccaatagacacttaaaatacggccccgaagagaaggctaatgagcgtctgccagaaagtgagtctctttgtgaagtggtcgtcagattgaaaccatttttaaataatgttgttctgtctaccgccaacaaaatcagtcaagaatcgtgtgttatagttgggcatggcagctctgtaagatctctgctgaaagtattggaaggtatctcagatgaagacatcaaagatgtcgatattcccaacggcattccgctagttatagagttggatagagacaattactcttttgtgaggaaattttacttggatccagaatcagctaaagttaatgctcaaatggttcgtgatgagggtttcgaaaagaatccatga

SEQ ID NO: 1938 - DNA, 912 bp, Saccharomyces cerevisiae
atgagtgtgataggtaggttcttgtattacttgaggtccgtgttggtcgtactggcgcttgcaggctgtggcttttacggtgtaatcgcctctatcctttgcacgttaatcggtaagcaacatttggctcagtggattactgcgcgttgtttttaccatgtcatgaaattgatgcttggccttgacgtcaaggtcgttggcgaggagaatttggccaagaagccatatattatgattgccaatcaccaatccaccttggatatcttcatgttaggtaggattttcccccctggttgcacagttactgccaagaagtctttgaaatacgtcccctttctgggttggttcatggctttgagtggtacatatttcttagacagatctaaaaggcaagaagccattgacaccttgaataaaggtttagaaaatgttaagaaaaacaagcgtgctctatgggtttttcctgagggtaccaggtcttacacgagtgagctgacaatgttgcctttcaagaagggtgctttccatttggcacaacagggtaagatccccattgttccagtggttgtttccaataccagtactttagtaagtcctaaatatggggtcttcaacagaggctgtatgattgttagaattttaaaacctatttcaaccgagaacttaacaaaggacaaaattggtgaatttgctgaaaaagttagagatcaaatggttgacactttgaaggagattggctactctcccgccatcaacgatacaaccctcccaccacaagctattgagtatgccgctcttcaacatgacaagaaagtgaacaagaaaatcaagaatgagcctgtgccttctgtcagcattagcaacgatgtcaatacccataacgaaggttcatctgtaaaaaagatgcattaa

SEQ ID NO: 1939 - DNA, 912 bp, Saccharomyces cerevisiae
atgagttctatagataatgacagcgatgtggatttaacagaagatttagccgtggccaagatcgttaaagagaatcctgtagctagaaaaatggttaggtatattttatcgagaggagaatctcaaaattcgatcataacaagaaacaagttacaatctgttatacatgaagctgctcgcgaggaaaacatagcaaaaccgtcttttagtaaaatgtttatggacataaatgctatactgtataacgtatatgggtttgaattacaaggattgccgtcaaaaaataatatgaacgctggcggtaatggaagcaatagcaatacaaataaatcaatgcctgagccactgggacatagagcccagaaatttatcttgctaaacaatgtcccgcactcaaaaaattttgacgatttcaagattttacaaagcgctcacacttatgaagagctaatagttaccggagagtatattggtgacgatatagcttcaggaacttccaataccttagaaagcaagttgagtacagatcgagatcttgtttacaagggtgttttgagcgtcattttatgcattgttttcttctctaagaataacatattacatcaggaattgatcaaatttctagagacatttggcattccaagcgatggttcaaagattgctatactgaacattactattgaagatttgataaaaagtttagaaaagcgcgaatatatagtcagattggaggagaaatccgataccgacggggaagtgatatcatacaggataggtagaagaactcaggctgagcttggactagagtctcttgaaaaattggtgcaagaaatcatgggccttgaaaaggagcagactaaaagtttgcacgatgatataataaaaagcattggcgattcatattctatatag

SEQ ID NO: 1940 - DNA, 912 bp, Saccharomyces cerevisiae
atgccagaagtagagacaaagattataccaaacgaaaaggaggacgaggacgaggacggctacatagaagaggaggacgaggacttccagcctgaaaaagataaattaggtggtggtagcgacgatagtgatgccagcgatggcggtgacgactatgatgacggtgtgaacagagataagggtagaaataaagtggactattcgcgtatagagagcgagagcggcggactgatcaagactagaagagctcggcaagctgaggaagaatatgcgaaaacacataagtatgaatcgttaactgttgaatcgatccctgcaaaagtaaacagcatctgggaggagctacaggaagctagtaagaaccgtcttttgagcagttcagggaaagtcggctctgttctcgacggttccaaggaggctaggtcgacaacggccgcgcaacaggaggacaaaatcctcatcgaaagaaactacaagtttgctggtgaaactgtccatgagaaaaaatgggtttcacgcagcagtgcggagggtcaagaatatctaaacagtttgaaatttaagcagcaggcgcctgctgctcctgttcaactggaaaaagcagttaggaccaagtccaatgaaagccggcaacacttgcgacggccactgaaaaggcctccattgttggagcagatcatttctggcgggctacgacccaagctaacgacattagaaaaatctcagctggactgggctagttatgtagaccgtgctggacttaacgacgaattggtgctgcacaacaaggatgggttcttggcccggcaagaatttctgcagcgggtcgggtctgcagaggacgagagatacaaagaattgcgccggcaacaacttgctcagcagttgcagcaggatagcgaagcttcatag

SEQ ID NO: 1941 - DNA, 912 bp, Saccharomyces cerevisiae
atggacgaaaaagtcgaacttattttagtgccatgccactcaatatggaagtcctcatcgcatcctagtgataattcagttaatttgggtcaattacctgaatactggcatttagctccgtttcagtatgagggtaatgatcatttagcattcatcaaacatggcctaactgctattaaactactcctacaaagattcgacaccgctaccgttatcttcagtggatcccaaacgaaaaaagaggcaggcgctatatctgaggcacaaagctactattttttatttgaaaagttgattagatatgtgatgagcaatgataacatcgatgttccaaactttgataacgagctgcgtcttttattaaaagaggtcaaaaacttgctatcaagtcaaaatgtaaatgttgatgaattgttctatggtggttcaatcactactgaagagttctcgctggactcatttgataatttaatttattctatatatagatttgaggaagtgaataaaaaattcccacagaaaataactataatagggtttgcgtttaagatgccaagattcatcagctgtcatgccaaggccattgattacccacaatcaaacataacctacataggaattgaccctaaaccagcaaactacaaccaaacacaactttcaaaatactatgatgatctagtacaaatggaagataaaaatgcactaagcttattttcttcagattggtacgctacaaaggatagattactcaccaagaaaagatctcgcaacccatttaacagaactgcaccgtacgctcagaatattttctgcaaagaaaacggcaagaggatcgagggaatcgaggatgacgaggaatattttgaaacaaaaattaagtgtaaaatgccatggtcgtcgccaagacaataa

SEQ ID NO: 1942 - DNA, 912 bp, Saccharomyces cerevisiae
atgggtatgtcagcaccgtgatttaacaaccatgtgattgtcgtaatggcgcaatgtcatcacacccttttacagtctttttattccttttgttgaaaatgtatcgtgtatactaacagaactgtgttttttctcattattttttattcaggtagagttattcgtaaccaaagaaagggtgctggttctatctttacctcccacaccagattgagacaaggtgctgccaagttgagaactttggattatgctgaacgtcacggttacattcgtggtatcgttaagcaaattgtccacgactccggtagaggtgccccattggccaaggttgtcttccgtgacccatacaagtacagattgcgtgaagaaatctttattgctaacgaaggtgtccacactggtcaattcatttacgccggtaagaaggcttctttgaacgtcggtaacgtcttgccattgggttctgtcccagaaggtaccattgtctccaacgttgaagaaaagccaggtgacagaggtgccctagccagagcttccggtaactacgttattatcatcggtcacaacccagacgaaaacaagactagagtcagattaccatccggtgccaagaaggttatctcttctgatgccagaggtgtcatcggtgtcattgccggtggtggtagagttgacaaaccattgttgaaggctggtcgtgctttccacaagtacagattgaagagaaactcttggccaaagacccgtggtgttgccatgaatccagttgatcaccctcacggtggtggtaaccatcaacatattggtaaggcttctaccatctctagaggtgctgtttctggtcaaaaggccggtttgattgccgccagaagaactggtttgttacgtggttctcaaaagacccaagattag

SEQ ID NO: 1943 - DNA, 912 bp, Saccharomyces cerevisiae
atgtccacaactgattcggggttcgtactttaccactatacgccaagtaaagcggctgcaatcgtatttgtcgtactcttcattataatgacagtcatttttgccgttcaaactttatatgctgcgagaaaatcttctaaggcattgaaaaataatccatttgagtcatctgatgataaggtcgatagtcttgaggatgctgaatacaagcaactaaaaatcacacccacagtttttgcgtttatacctttcttcactggctgcatcatggaagctgtcgggtatatcgggagggctctatccagttccaatcctgaaagaacgaccccatatattatccaatctgttcttttattagtcgctccagcactaatagctgcgacgatttatatgatttttggaaggttattacatgttatgaggtgccaatctttaattttgatttctgcacgctttggtacgactttctttgttgtgggagatgtgtttagtttctttttacaagctgcaggtggcggactaatgtctaaggcaggatcaacgaagactggttcaggactcataactgcgggtctttttgtacaggtaattttttttggatttttcattatcaatgagataagattcacagtaaatgttaaaaggagatgcttattttacgaagatatttccagaaagtggatctttgtgaatgctaccctattattaagcagtatgttgatcctactacgttcaattgtccgaatagttgaatttattcagggattcaatggctatataatctctcatgagtatttcatatatgtcttcgatgctgtacctatgttattggtaataatagcatttagtgtgggatcctttttcggcaacgtattcgatgttataaaggagtgtcaaacgttaagtaattag

SEQ ID NO: 1944 - DNA, 912 bp, Saccharomyces cerevisiae
atgtctgttatcttagtatctgctggctatgaccacacaataagattttgggaggctcttactggggtttgttcaagaacaattcagcattccgactcacaggttaatcgcttagaaatcaccaacgataaaaagttgttggcaacagcaggccatcaaaacgtacggctttatgacattcggacgacaaatcccaatccagtagcatcctttgagggtcatcggggaaacgttacctccgtttcttttcaacaggacaacagatggatggtgacctctagcgaagatgggaccattaaagtttgggatgtgcgttctccgtccattcctagaaattacaaacataacgcaccagtaaatgaagtcgtaattcatcctaaccaaggcgagttgatatcttgtgatagagatggtaatataagaatttgggacttaggagaaaatcagtgtacccatcaattgacacctgaggacgatacctctctccagtctttatctatggcaagtgatggttcgatgttagcggcagcaaatactaaaggtaattgttacgtatgggaaatgccaaatcatactgacgcatcccatctaaaaccggtaacaaaattcagagcgcactccacatatataactagaattctactatcatctgatgtaaaacatttggcaacatgttcagcggatcacactgctcgtgtgtggtcgattgatgatgattttaagctagaaacgacattggatggccaccaaaggtgggtttgggattgcgcatttagtgctgacagtgcgtatctagtaacggcatcgtccgatcattacgtgagattatgggatttatcaactagagaaattgtcagacagtacggtggacaccacaagggagctgtatgtgtcgcattaaacgatgtatag

SEQ ID NO: 1945 - DNA, 915 bp, Saccharomyces cerevisiae
atgaagatgttgaggcgtacaaaggtaaatttttcaaaattgctttacaagattactaaactagcaatagtactgacgatcctatatatttattttacgcccaaaatcgtctcccgaaacaatgcatcattgcagcatatttttcctcataaatatggcgattatgaaatcaatttggtcatagcgcaccctgacgacgaagttatgtttttttcccccataatttctcaactgaattcgtactttccgagaaccgtcccatttaacataatctgcttatcaaagggcaacgccgaaggtcttggcgaaaccagggtaagagaattaaatgagtcggccgctttattgctacacaatgaaagagcagtctccgtacaggtgatggatttccaggatggtatggacgaaatatgggatattgattctataacttcttctctttcacaaaagatagatataaagaatcataacttgaaccagattatcgttacctttgattcatatggtgtatcaaatcatatcaaccacaaaagctgttatgctgccgttaaaaagttggtggatgattatgctcaacctaagaccaaaagaaatgaacaaccacctcatgtcactgcgctttatttgagaagctacaagaacaacatcgttttaaagtacaactcctttatttgggaaatcctaaaaatactttacgacctgatttctccattccgtagaataattcaggcgcttccgcctaacacagccgccgaaaaagacaagctttcacttatgaatacacatgcacaatacgtactagcgtttgccactatgctaaatgctcacgaatcccaagttgtgtggtttagatacggatggtggatattttccagatttgtcttcgttaatgaatttgatgtttatacatattag

SEQ ID NO: 1946 - DNA, 915 bp, Saccharomyces cerevisiae
atgaatacttcagaactgtcaatagctgaggaaatcgactacgaagctcttccatcacatgctccgctacattcccagttactggcaggagcatttgcaggtataatggagcattctttgatgtttccaatagatgctctgaaaacccgagtgcaggctgcaggattgaataaagctgcctctacagggatgatatctcagatatccaaaatatctacaatggaaggttcgatggctttatggaagggtgttcaatcggtaatactgggggcagggcctgcgcatgcagtatattttggtacatacgagttttgcaaagctcgcctgataagccctgaagatatgcaaactcatcaaccaatgaagaccgcactgagtggtaccattgctaccattgctgcggatgcattgatgaacccctttgacaccgttaaacaaagactacaattggatactaatctaagagtttggaatgttactaagcaaatatatcaaaatgaaggctttgcagcattttactactcctatcccacaacattggccatgaatatcccatttgcagcgttcaatttcatgatatatgaatctgccagcaaattcttcaacccacaaaattcctacaatccattgattcattgtctttgcggtgggataagtggtgcaacatgtgctgcgttaactacaccgttggattgcataaagactgtattacaggttagaggcagcgaaactgtctccatcgaaataatgaaggatgcgaacacttttggtagagcctcaagagccatactggaggttcatggttggaaggggttttggcgaggtttgaaaccaaggatagtggctaatataccagccactgccatttcttggactgcatatgaatgtgctaagcattttttaatgaaaaattga

SEQ ID NO: 1947 - DNA, 915 bp, Saccharomyces cerevisiae
atgacaaaagatattagaacaggcgatttagtgttatgcaaagttggctcgtttccaccttggccagctgtagtatttccacagcgtttgctgcgaaacgatgtatatagaaagagaaaatccaattgtgttgctgtttgttttttcaacgatccaacttattattgggaacaacccagtagattaaaggagctagatcaagacagcattcacaatttcatattagaacatagtaaaaatgcaaaccaaagggaattggtcaatgcttataaggaagcaaaaaattttgatgatttcaacgtatttttacaagaaaagtttgaagaagaaaacaggttaagtgatctaaaagcgtttgagaaaagtgaaggttctaaaatcgttgccggagaagatccctttgtaggtcgaacaaaagtagtgaataaaagaaaaaaaaattcaatatccatcaaagaagatccggaagataaccagaaatcaaatgaagaagaaagcaaaccgaacatcaaaccgtccaaaaaaaagagacccacagctaattcgggaggaaaatcaaacagtggcaataaaaagaaagttaaattagactattccagaagagtagaaatttcacagttatttcgccgcaggattcaaagaaatctaatccagagagaaacacctcctactgagcatgagatcaaggaaactcatgaactattaaatagaatatatgagaattctgacaccaaacggcccttttttgatttgaaggccctacgcgaaagcaaattacacaagctactgaaagcaattgttaatgatcctgacttaggcgaatttcacccactttgtaaagaaattttactgtcctgggcagacctaatcacagaactgaagaaagaaaagttgcaagcgctacctacgccttga

SEQ ID NO: 1948 - DNA, 915 bp, Saccharomyces cerevisiae
atgactatggacggaaaaaacaaagaagaagagcaatatcttgatctatgcaaaagaatcattgatgaaggtgaatttaggccagatagaacaggcactggtacgttgagtctttttgcaccaccccagctgcgttttagtttacgtgatgataccttcccactactaacgaccaagaaggtttttactagaggtatcatacttgaactattgtggtttttggccggtgatacagacgctaacctattgtctgagcaaggtgttaagatttgggacggtaatggatctcgtgaatatttagataagatggggttcaaagataggaaagtaggagatctggggcccgtttacggatttcaatggaggcattttggtgctaaatacaagacgtgcgatgacgactatactggacaaggtattgatcaattgaaacaggttatacataaactaaagacaaatccctacgatagaagaatcattatgagtgcctggaacccagctgattttgacaaaatggctttgccgccatgccatattttttcacagttctatgtcagtttccccaaagaaggagaaggatccggtaagccccgcctttcatgcttattgtaccaacgttcttgtgatatggggttgggagtaccatttaacattgcatcatatgctttgttgactagaatgattgctaaagttgtcgacatggagccaggtgagttcattcatactttgggggatgcacatgtttataaagaccacattgatgccttgaaagaacaaatcaccagaaatccaagaccattcccgaaactaaagattaaaagggacgttaaagacattgatgatttcaagttgacagactttgaaattgaagattataatcctcatccaagaattcaaatgaaaatgagtgtataa

SEQ ID NO: 1949 - DNA, 915 bp, Saccharomyces cerevisiae
atgactgcccaacaagtatgtgtaaagatgagtaaattgaaggatgtgatggttatggagatggcacacgtgcctagaggaaaatagttacccaagaacaaaagcaggaagggagctaaccttttaaatatgaactggacaaaactggacaaaatgaaaataacgattttagtaaaaatgaaaatatagcatcaaatgactgagaaacatagtaacaataactcatattatagctaatctgagtaaacttcttcctacgctaagaatttttttgaggatagtaccaaaccttgtgctgaatcagcacacgccatgcccaccatcaattgtgcaagaaaaaagtaaacgagtagtatactaactatatatgtgatttacatcacgatatgtcaattataggccccaaagtggtatccttccgaagacgttgctgccccaaagaaaaccagaaaggctgttcgcccacaaaagttgcgtgcctctctagttccaggcactgttttgatcttgctagctggccgtttcagaggtaagagagttgtctacttgaaacatctagaagacaacactctattggtcactggtccattcaaggtcaatggtgttccattgagaagagtcaacgctcgttatgtcattgctacctctaccaaagtctccgtggaaggtgtcaacgttgaaaaattcaacgttgaatactttgccaaggaaaaattgaccaagaaggaaaagaaggaagctaacttgttcccagaacaacaaactaaggaaatcaagactgaacgtgttgaagatcaaaaggttgttgacaaggctttgttggctgaaatcaagaagaccccattgttgaagcaatatttgtccgcttctttctctttgaagaacggtgacaagccacacctattgaaattctaa

SEQ ID NO: 1950 - DNA, 915 bp, Saccharomyces cerevisiae
atgactgtaaaagagtatactaaatcgaagttgccatgctcgatattgaatatcaaacctacagtcactaaaagtggcgaggatgcgcctcttctagtatggatccctggtaatcctgggcttttatactattatcaagaaatgctacatcatctacacttgaagcacccagattgggaaattcttggcatatcccatgccggaatgacattgaacgctcattctaatacaccgatattttctttacaagatcaagtagatcatcaggtagaggtaattaacaatttctcatgcaagaacaggaaaattattattatgggacattcggttggggcatacatcgtacaaaaagtatgcctttctaacaaactggttggctccgtacaaaaagttggtctcgttacaccaactgtgatggacattcacacctctgagatgggtatcaaaatgacagcggcacttcgttatattccaccattggctcatgtggtatcattgttcagttatattttcttttattggatcttatcagaagggttttcaagatttattattgataaatttatgggctgtggaagtactggttatcaggcagtactatctacaagaatttttttgactcataggcagtttgttcgtcaatctctaggattagctgcccaggagatggaagaaataactacgaactgggagtttcaagatagatttatcaattattgcgaagagaacggaatttctatttggtttctcttcagtagcaacgaccattgggtttctggtaagaccagatcacatttgtcggattattataaggataaagtcaagcaggaacgcttaaaaattgatgtcactgacaaaatacctcattcatttgtagtaaaacatgcagaatatgctatcaatgcatttttttag

SEQ ID NO: 1951 - DNA, 915 bp, Saccharomyces cerevisiae
atgatttctgactacgatgctcttttgcaattcaacaaaaaacctgtttcgcaagaaatgattcagttcttagccacttctactgcttccataattaaaatcagggaaaataataatccaatccaaggatgtcgcccaccagacttatctatcttcattaaaaacgtggtaattcagtcaaatgttcaaacaccaactttaatggccacatcagtttatttaaacaaactgaaaagcgtaataccaaaaaatgtgtacggtattaacaccacaagacatcggatatttctcggatgcttgatattagctgccaaaactctgaacgattcttctccctggaacaaacactggaccacgtacacagaaggtttactcagaatacgtgaggtgaataccatcgaacgagaactattagaatatttaaattgggatgtgaggataactacaccggatttgattgattctctttcttacttcctcgggcctatcaaggaacaactatttttacaaaggagacaagaaatgctgttgttcaatgcaccaagtcccggccaactgaaagaatatataaatcatagaagaccggtttcgcattctagaacttcttctgctatatcggttccttcactgacatccatggcaacagtttcgacaacagactcaaggtcttctctactggcaaaataccaaccgtccctaccgttggtggaatctgacaacttcaacaaaaaaaatcatgtgccgttaaggaataataacgatatctgtaataatttcagggcagaggaaaacatacactcagtaaaccatattgatgtaacaatgggaagttcaccagtaatgtcgcataagcccacaattcaccaacggttaaattttacaaggaggggctggtcatcgtttttcaagcaataa

SEQ ID NO: 1952 - DNA, 915 bp, Saccharomyces cerevisiae
atgcaacaagcaactgggaacgaattactgggtatcctagatctggataacgatatagactttgaaactgcttaccaaatgctcagcagtaacttcgacgaccaaatgtctgcgcacatacatgaaaacacgtttagtgcaacttcccctcctctgttaacacacgagctcggcataattcctaacgtagcaaccgtgcaaccctctcacgtagaaactatacctgccgataaccaaactcatcatgctcctttgcatactcatgcacactatctaaatcacaaccctcatcaaccaagcatgggttttgatcaagcgcttggtctcaagttgtctccttccagttcggggttgttgagcacgaatgaatcgaatgccattgaacagtttttagacaatctaatatcacaggatatgatgtcttccaacgcttccatgaactccgaatcacatctacatataagatcaccaaaaaagcagcataggtataccgaattaaatcaaagatatcctgaaacacatccacacagtaacacaggggagttacccacaaacacagcagatgtgccaactgagttcaccacgagggaaggacctcatcagcctatcggcaatgaccactacaacccgccaccgttttcagtacctgagatacgaatcccagactctgatattccagccaatatcgaggacgaccctgtgaaggtacggaaatggaaacacgttcaaatggagaagatacgaagaataaacaccaaagaagcctttgaaaggctcattaaatcagtaaggaccccaccgaaggaaaacgggaaaagaattcccaagcatattcttttaacttgtgtaatgaacgatatcaagtccattagaagcgcaaatgaagcactacagcacatactggatgattcctga

SEQ ID NO: 1953 - DNA, 915 bp, Saccharomyces cerevisiae
atgccattatttgatcttatttctccaaaagcgtttgttaagttagtggccagtgagaaggttcatagaatcgttccagttgatgcaacatggtacctacccagttggaagcttgataataaagtggatttcttgaccaaaccacgtataccaaactccattttctttgatattgatgcaatcagtgacaaaaaatcgccctatccacatatgttccctacaaagaaggtttttgacgacgctatgagtaatttaggagttcaaaaagatgatatattagtggtttacgatcgtgttggtaactttagctcccctagatgtgcttggacattaggagtgatgggacatcctaaggtgtacttactaaataatttcaaccagtacagagagtttaagtaccctctagattcctctaaggtggcagcgttttcaccctatccaaagagtcattatgagtcctcagaaagtttccaagacaaggagattgtagactatgaggaaatgttccaattggtaaagagtggggaactggctaagaaattcaatgctttcgatgcaaggtcgctcggtagattcgaaggtacagaaccagagcctcgttccgacattccatcggggcatattccaggtacccaaccattaccatatggaagtttacttgatccggagaccaaaacgtacccagaagctggggaggcgatacacgctactttggaaaaggcattgaaagactttcattgcactttggacccaagtaaaccaactatttgctcttgtggaactggcgtttcaggagtcattatcaagacagcattggagctagcaggagttcccaatgttagattatatgatggatcctggaccgagtgggtcttgaaatccgggcccgagtggattgctgaaaacagagattaa

SEQ ID NO: 1954 - DNA, 915 bp, Saccharomyces cerevisiae
atggtcaccattgtatttgatcatccggcggaagactttccagagttgaagatcgctggggagtttaccaattgggaaggtgtacccatgaaaataaataccagtagcgggaaatgggaatacaaatttgatgaatcttcggtaaccaaacataatgataaagataaggtacatttcaaatttatagatcagaacggtaactggtttgccgatgatgagtatccaaaggaggtggacgagcacagcaatgaaaacaatgttgctactttaaataacgaagaggacggcggaagcgctggtgaagaaaaggacgagggcgacaaaactgcacacaatacaaatgaaaatgggtcagagttgtactatgagggccctgagacgccaactccttctttaaaaggtaatgtaacgtttccttcccctaaaacagctatttcgcaagatggttctgcttttgcaaaagagactaccaggaaagaaagaaagtatgaacatgctccattgaacgaagttccagtagaaagagatccaaaagaagagaataaggagctctctccaaacttttctcaggaacagacagagaataaacaggacaaaggtttagacaatctatctgaaggtaatgataatgataacacaagagttaatgaagatacagacgtcaccgacacgcaagaatcagaacatgagatcaacggttctgatactgaaaatacggatatgtccgaacaagaagaaatacagaaaatagataaacccgccgatcaaaacgctaagtcaattgtaaaagaaggcgatgccaatactgaagattatgaaagtgttttgaaaaagctactgggagcgttaggacgcttttttggctcatggttttcttggttgacaacgaaaatgtcaagctcagaggcatcataa

SEQ ID NO: 1955 - DNA, 915 bp, Saccharomyces cerevisiae
atgtccacttctcattgcagattttatgaaaacaaatacccagaaattgacgatatcgtcatggttaacgtccagcagattgctgaaatgggtgcttatgttaaattgttagaatatgacaacattgaaggtatgattctactaagtgaattgtcccgtagacgtattaggtcaatccaaaaattaattcgtgttggtaaaaatgatgtcgccgttgttcttcgtgtcgacaaagaaaaaggttatattgatttgtccaaacgtcgtgtttcttctgaagatatcattaaatgtgaagaaaaataccaaaaatctaagactgttcattccattttaagatactgtgccgaaaaattccaaatccctttggaagaactatataagaccattgcttggccattaagtcgaaaatttggtcacgcttacgaagctttcaaactatccatcattgacgaaactgtttgggaaggtattgaaccgccatcaaaagatgttttagatgaattaaagaactatatctccaagagattaacaccacaagctgtaaagattagagccgatgttgaagtgtcttgttttagttacgaaggtatcgatgccattaaagacgcattaaaatcagctgaagacatgtccacagaacaaatgcaagttaaagttaaattagtcgccgccccattatatgttttgaccacccaagccttggataagcaaaaaggtattgaacaactggaaagcgctattgaaaaaattacagaggttattacaaaatacggcggtgtttgcaacattaccatgccaccaaaggctgtcactgctactgaagacgctgagttacaagctctattagaaagcaaagaattagataatagatctgactctgaagacgatgaggatgagtcagacgacgagtaa

SEQ ID NO: 1956 - DNA, 915 bp, Saccharomyces cerevisiae
atgtcgcagaaaatacagcagcatcagtttcctgatttttattgttgttatctactacaatcgattaacaagaggcaatcattttacgttggatcaactcctaacccagtacgacgtttgaggcagcataatgggaaattggctgttggaggggcatatcgaaccaaacgtgacggttcaaggccctgggaaatgataatgattgtgcggggcttcccaagtaagatagcagctttacagtttgaacatgcatggcaacatgggtaccaaacgcattatattgccgaaaaagatcgtgttgtaaagcataaagcaggtggaagaactttacatcacaaagttgcattaatgaagttacttttaaagcatgaattttttcaaaggatgaacttgatagtcgaggtttttaatataaaggcttgggaggtttggaaacaggacaaattttttattgaaagagacagatttccgattaatatacaaataaatgaaaatgcgcttgaagaaccaaaggagaaaactgtggatgttctcatggatcatagtgatgagaatttaaaagtggtggaagctgtatacactaaagtcattgaaaatgaaagaaacatattcgaaactttcgaaaagaaactaactacaggggtagtgcgatgtgaaatttgtgagaaagaaattgactacacgtctgaagagcaaaatctgaagccgtttgtagcgctttgcaataataaagactgtgggtgtgttaaccacttgaaatgtcttcacaggtactttctagatgatgaacagttgatggtagggagaagaaatttgatacctcgaggtgggaaatgtccgaaatgtgatatgttttgcgactggacgaccctagtcaagttttcgacaagaatgaagttagctcacgggaagtag

SEQ ID NO: 1957 - DNA, 917 bp, Saccharomyces cerevisiae
atgcttgtatgttacaataatcttttttccccatcatattttgctagagtagagtggtttgactaacttatgttacttgattctttttgaagtttaaacaatggaatgacttaccagaaccaaaacatctgctagatctcccagagatttcaaaaaacctgcaatctttagaagtctgcccggttccaaaagttgagtttcctcaggacttggatgttcctcaatattcgacagccgtcattactactaagataatgaacccattattccccaaaaatctgcttcaattaacctctattggtgaaattaaaactacattgacggtgaaaagtccaagtcttccccaatcttcaggtaaacactcgtggaattacgacgaaaactttccaaacgaggttgatcctgatcaaaaaaatgacaccgccgatgaaacagtatatggtttttctttcccgatttattcatttggaaagacgttattattttctatggaggagaatttcattagtatatcgccgatttttggtaacatgataagtagatctatcatatcacagttagcccagttctcccctgatataatagtaattggcacctctgataaaatcgccagcatgaaggtaatgacggaaaatgaatgtacactacaaccaccagaatttataacgggattcataggaagtgtgctaacacaattgattgtcggtcccagtaagggactgaaatttaaatgtcttgtagcgcctagtgaggggcctaatggatttgagaaactttcgttgtctgacatgggttctttagttgatttgtgcggtcaatggcttggttttgagccttcaagatattctgaagaatgctatcgcttatggaggtgtgatagcgcggcaattggtgcacaatcaggcctatatatatga

SEQ ID NO: 1958 - DNA, 918 bp, Saccharomyces cerevisiae
atggccaaagacattgagatatccgcatccgagtcaaaatttatcttagaagcactgagacagaattataggttggacggccgctcctttgatcaatttcgtgacgtggaaataacgtttggtaaagaatttggtgatgttagcgtaaaaatgggcaacaccaaagttcactgcaggattagttgtcaaatagcacaaccatacgaagacaggccatttgaaggattatttgtaatatctacagaaatatctcctatggctggttctcaatttgaaaatggaaatatcacgggggaagatgaagttttatgttcaagaataattgaaaaatctgttaggcggtcgggcgcattggacgtggaaggactatgtatcgttgctggcagtaaatgctgggctgtgagagctgatgtacatttcctggattgtgatggtggatttattgacgcttcgtgtattgccgtcatggcaggattgatgcattttaagaaaccagatataactgtccatggcgagcagatcattgttcatcctgttaatgaaagagagccagttccactaggtatactgcatattccaatatgtgtaactttttctttcttcaatcctcaagacaccgaggaaaacataaaaggtgagactaactcagaaatttccatcattgatgcaacattgaaagaggaactactgcgagatggtgtattgacggttacgctaaacaaaaaccgtgaagtggtacaagtttccaaagcgggtggtttaccaatggatgcgttgacgctaatgaaatgttgtcacgaggcttacagcattattgagaaaataactgatcaaatactgcagcttttaaaggaggattcagaaaagagaaacaagtatgcagccatgcttacatctgaaaatgcccgcgagatctaa

SEQ ID NO: 1959 - DNA, 918 bp, Saccharomyces cerevisiae
atggttgaggaaaattccagagttttgattgttcttccttatacaccgcctagtgctactttgcagaggattatagggcaaactattccgttcttaagagaatgtcaaagtcaactagacatcgtgattgtacctgaattcaaaacctcattccagttggattctgcgctagggaagatgtacagtattaccagggatgtccttttgggctatggaatgatcaacagcggaatcaacatcatattcaacaatattcatttcgtcgagagtaatttgcaatggaaagtggttttattgccacaggaatccacttttgaaacttggaagctagagttgggacaaggacaataccatagtatagaacattatgcattacacgataatataatggaagagatagaaggtcccaaagatgctaacaaatttcatgtcaccgcattgggcggaacgttcgaccacattcacgatggacataaaatattgttgagcgtctctacattcatcacgtcacaaaggttaatttgtggaattacgtgcgatgagctcttgcaaaacaagaaatacaaagagttgattgaaccttatgatacacgatgcaggcacgtacatcaattcatcaagttgttaaaaccggatctctccgtagaactagttcccttaagggacgtgtgcggccccacagggaaagtacccgagatagaatgtttagttgtgagtagagaaaccgtcagtggggcagagactgtgaataagactaggattgaaaaaggcatgagcccattggcagtacatgtggttaatgtacttggaggaagggaggaagacggctggagcgagaagttaagcagcacggaaatcagacgcctacttaagtcctctgcttcgccaacgtgcactccacaaaacccttgcgtataa

SEQ ID NO: 1960 - DNA, 918 bp, Saccharomyces cerevisiae
atgtccggtaacggtgctcaaggtactaagtttagaatctcagtatgttaaaatttttattttccacaatgcaatttggttaaattgatcataaagtaaagttccaagatttcattttgctgggtacaacagaattaaacagaggtttaaaagacgctaaacactaagtgtgaagcctgatcatatacctatcggtgttattttccataagaatggtagatgtgccatcactggtaccgccccgccaaagatgcaattacacacataaattcagtttttaaatggttaagcgggctgtatttgcagatgaagtgatacctgtcaatattcatggactcaaaaatttctggtttcaaaatcatacacggcaagcatatcctaactccctcttttgcccatactaatggataaccatcgaaatgttatttctacaaaaatcacgcttaactctatttttcaagattaaccacatctgctaactttctccctatgcttttactaacaaaattattctcactccccgatattgagatcttttttaactagttaggtctaccagtcggtgccatcatgaactgtgctgacaacagtggtgccagaaacttgtacattatcgccgtcaaaggctctggttccagattgaacagattgccagccgcctctctaggtgatatggttatggccaccgttaagaagggtaagccagaattgagaaagaaggttatgccagctattgttgtccgtcaagctaagtcttggagaagaagagacggtgtctttttgtacttcgaagacaatgctggtgtcatcgctaatcctaagggtgaaatgaagggttccgccatcactggtccagtcggtaaggaatgtgccgatttatggccaagagttgcatctaactccggtgttgttgtgtaa

SEQ ID NO: 1961 - DNA, 918 bp, Saccharomyces cerevisiae
atgtcctctgtccaatccaagatcttatcccaagctccaagtgagttggaattacaagtcgccaagaccttcatcgatctagaaagctcctctccagaactaaaggctgacttgagaccattgcaaatcaaatctatcagagaagtatgttaaaagttatataatttggaagcagcaacattgtgatttcttctaaaggggttctttgcagtaattttttcaaaaaagagtgattttgagcagtatctgtatgaaattttcatgtgttcgagaaaaatagtaattccgagagctgtcaataccatgaacgttgcgatgagcctttgaactataaaggcctccttggtcagtaccaatatcgatgaataaaatagaagcacgcgaaaaagaccttaccccaaggagaagaatcacaaacccttttttgttatgaatgaaccaattcagttactaactttatttcaacgctgcttgattcttattgtttagattgatgtcaccggtggtaagaaagcactagtcctttttgtcccagttccagctttgtctgcataccataaggtccaaaccaaattgacccgtgaattggaaaagaaattccctgaccgtcatgttattttcttggctgaaagaagaatcttgccaaaaccatctagaacatctagacaagtccaaaagagaccaagatccagaactttgactgctgttcacgacaaggttttggaagacatggttttcccaactgaaattgtcggtaaaagagttagatatttggttggtggtaacaagatccaaaaggttttgttagactccaaggatgttcaacaaatcgactacaagttggaatctttccaagctgtctacaacaagttgactggcaaacaaattgtttttgaaattccaagccagaccaactaa

SEQ ID NO: 1962 - DNA, 918 bp, Saccharomyces cerevisiae
atgtcggagtttaatattacagaaacttatctaaggtttttagaagaagatactgagatgacaatgccgattgctgccattgaagcattggtcacgctattaagaataaaaacaccagaaacagcggcagaaatgattaatacaataaaaagctccacggaagaacttattaaatccattccgaactcagtttccctgagagccggttgtgatattttcatgagatttgtcttaagaaatcttcatttatacggtgattgggaaaactgtaaacaacatttgattgaaaatggccagctttttgtatcgagagccaaaaaatcgcgtaacaagattgcagaaataggggtggatttcatagctgatgatgatatcatcttggtacatggttattcgagagcagtattttctttattaaatcatgcagcaaataagtttattaggttcagatgtgtggtgacagaatcaagacctagcaaacaagggaaccagctatatactttacttgaacaaaagggcatacccgtgactcttattgtcgatagcgcggttggagcggtaatcgataaggttgacaaagtgttcgttggtgctgagggtgttgctgaatcaggtggtattataaatctcgtgggtacctattcagtgggtgttttagcacataatgcaagaaaaccattctatgtggtcactgaaagtcacaaatttgttcgtatgtttccattgtcttcagatgatctacctatggccggccctcctttggatttcacacgtcgtacggacgatctagaagatgcattgcgtgggcccacgatcgactataccgcccaagaatacattactgcattgattacagatttaggggtcctcactccaagtgccgtttcagaagagttaatcaagatgtggtatgattaa

SEQ ID NO: 1963 - DNA, 918 bp, Saccharomyces cerevisiae
atgtcttcgaacgattcgaacgataccgacaagcaacatacacgtctggatcctaccggtgtggacgacgcctacatccctccggagcagccggaaacaaagcaccatcgctttaaaatctctagggacaccctgagagaccactttatcgctgcggtcggtgagttctgcggcacattcatgtttttatggtgcgcttacgttatctgcaatgtcgctaaccatgatgtcgcactcgttgcagcgcctgacggttcccatccgggtcaattgattatgattgccatcggtttcggattttccgtcatgttttctatctggtgttttgccggtgtctctggtggggctttgaatcctgctatgtcgctttcgctgtgcttggcgagagccgtctctcctacaagatgtgtcgttatgtgggtttcgcagattgttgctggaatggccgctggaggcgctgcaagcgccatgacacctggtgaagtcctctttgccaattctttgggcctgggctgctctaggacgaggggtctgttcctggagatgttcggcaccgctatcctatgtttaacagtcttaatgacggctgtggagaagcgtgaaaccaactttatggctgcgctgcccatcggcatctccctgtttatcgcacacgtcgctttgactgcatacacaggcacaggtgtcaaccctgcgaggtccttgggtgctgctgtcgcagccagatacttccctcattaccactggatttattggattggcacgctgttaggatccattttagcatggtctgtatggcaattattgcaaatcttagactacacaacctacgttaccgctgaaaaggctgccagcaccaaggaaaaagctcaaaaaaaaggtgaaaccagcagttcctctgctgtggctgaagtctaa

SEQ ID NO: 1964 - DNA, 921 bp, Saccharomyces cerevisiae
atgaatcaaatctggtctacaggtcccccaaatttttacttcaactctgaatggaaagaaaataagagaaatgacaggacaattgaagactctttaagagaactagatgggttgatccattccttggagagaactcatattgaagtacaaacaaacccaaagctaaagaacgatgtcacagctttaaatgatattaacaagaaagaaaataaagaagagatcactcatgaaaactatacacaccagattaatagtattccattgacaagctcaaatttaaatcggcatttctccttttctagagactacaaccaatctgataatagcaataataattattacagggaatatttatccaaaccaaggtatttgcagcagtcaactaaagaacaaactttcaatgaaattaataaaagaaaaagtgctgcaattattcccccttggttaaatattccagaaaactcaagattttttgtaataaagtcctcgtctttgaagcatgtcaaaaggtcgttttacaacggaatttggtcgtctactcatttcggcaacaaaaggctatctgaggcatataaaaagcttaattcgggagccaaagtgtttttatttttttcaatcaacacatcaggaagattctgtggcgttgcagaaatggtatcggatttgaaaatggatttggacaccagtatatgggaagatgaacaaaaatatggcaaagcctttaaagtaagatgggtgatcgtgcgtgatataaataacagatcgttaaaaaggtttttgataccatccaatgaaatgaaaccgataacacattccagagatactcaagaaattccatattcgattggaatttcaataattaatctatttaaaactcaagattctgatattttctccttcttggatgagacgtatgaatag

SEQ ID NO: 1965 - DNA, 921 bp, Saccharomyces cerevisiae
atgaattataactgcgaaatacaaaacaggaacagtaagaatgttgacaatcaagtcagtctaccccctatccaagttctatttaactccatagaaaaacggagtatgcccgagttggcattttcgaacatagaatactcgcatgggaaccttcggtctagtaccgaggaacaaaactatcctgcgcctgtgttacttccacagcatcattcgattgcgtatcccgcaattaattctggcggtactagtactactgctactcctactgcttctacagttgaaacgtccaagacgagtagcagtgctatggatacacaatctcaatatggcagttcaaagaagtcaaaatcggcgtccgatgatgcaaagccctgctacaaatccgccccaatatatgaaataatcaataaggaaaaggatgcgggggcacaatacaacaggccattttcggattttgtagaatctaaatcaaggaggaagcaaaattcgggcaggaggtctaacctgccaaaggaaacagtgcagatactgaatacttggttgctgaaccacctgaataacccctacccaactcaacaagaaaagagggagttgttaatcaaaactgggctaaccaagattcaactttctaattggttcataaatgtgagaagacgcaaaatatttagtgattactataccctggtaaactcaattcctaatgacaacgcgaataataccccagtggaacgagttcaaaacgtctcagcatatcataacacattatctgccacaaataatactatgtacgatgctacgtcaacctgctccacggattatgaattatccaagagatttgctcatgcccccgttacacgccgtaaaaaactaattgataggctggaagaattgaaaaagctatccaaccctgatatgaattga

SEQ ID NO: 1966 - DNA, 921 bp, Saccharomyces cerevisiae
atgacctcaattgaagatctgatatcaaatcctcccctgctactgcattcctcactctctcaacttcgctacctcatactcagtgaagggcttcccatatctgaagataaacagcagcagcgcacgcgatgttacgtgtggacggtgctctctcaaacttctatggaggcgtctacacaacggtaccttgcgctcttgaaactgggcccaccttccacaaccatttaccaaaaaatcaagaacgacacatccagaacttttcagacggatccaaactttagaaatagagtctcagaggatgccctcatccggtgtctgtcgtgctttgcttggcaaacacaacaaagaagacaaaagactcgttttggtcgcattcctgtgagcacatatgtgcagggcatgaacgtgttattagctcctctgctttactcatgtccttctgaacctatggcgtatcaacttttcactaagctttgttatgaaatgataccgacgtatctaactaagaacctaaacggcgcccagaacggcgccaaactactagatatttctctcagaatcattgatccaaagctgagtaaatttctatcggacaatttacttacagcagagatttatggtatgccttccatactcacgttatccagctgcaataaaccgcttgatcaggtcattaaactgtgggatttcatgtttgcatatggattccatatgaatattctctttgtggtggcattcctagttaaaatgagatccaaggttttcaaatcggattcccctgttaatttactacgacagtttccggattttgatgctgacgagatcattcggctgggcgtcgggttcatcgctaagatccctgctcaaatttatgacctattggtagaccacttgaccgacccagacatatatataccgtaa

SEQ ID NO: 1967 - DNA, 921 bp, Saccharomyces cerevisiae
atgagttcagtagagagaataaaagaatatacagatataccttccgaatcaaacggctacatatcacctccagctaattggcctcaaacaggagatgttgaactaaaaaacttatcattgcgctattctcctcattcctctaaggcactagataatgtatcattcaaggtaaaagcaggaacaaaagttggtattgttggtagaacaggggctgggaaatcttctattatagcggctatttaccggctttcagactgggaaaacggtacgattactattgataacaaagacataaaacatatccctttagagcgtttaagaaattctataagctgcatcccacaggatcctactttatttgatggaactgttcgatctaatttagatcctttcgatcggtattctgatgtacaaatttatggcgtactatccaaagtgggattaattgaagaatgcgatgaattgtgcttgatttttgagcaagagcagcctaatttttctagtcataaactaagaaatagattcattgatttgaatactgttgtgaaatcaggtggttcaaacttatctcaagggcaaagacaacttttgtgcttggcacgatccatgcttggtgcacgtaatataatgctaattgacgaagcaaccgcctcaatagattatatttctgatgctaaaattcagaaaactataagagaaacaatgaaaaatacaacaattttgactattgctcatcgattaaggtcagtaatagattatgacaaaattctggtgatggaaatgggcagagtcaaggagtatgatcatccatacactctaatatctgatcgaaataccattttttaccgcctctgtaggcagagtggcgagttcgaaaaccttttcgagttggctaaagtctcattcgataataaaagataa

SEQ ID NO: 1968 - DNA, 921 bp, Saccharomyces cerevisiae
atgatgaaaaaaaaaccaaagtgccaaattgcaaggaccaaaccatcggtcgaaaacgtcataccatataaccaattcaagaagacgcagccgcgattcaacggcaacttttctgcactgaataatgaagaatacataatactctttggcggaggtcgggacctgatactaggctccctgacaccttgttcgagctctcatttgtccaatcaagccaacccacaagacaccagtgagtatggcacagacctgtttatactcaacagctgcattatcatttggttcaatggcttgggatatgggctggaaattccctacagcagcgttttgtaccatgcatcaagacggctaccagatggtagggaagggcttcaattagaaattttgctgactttggaaagagacgaagtgttggacatgctctaccaaagcctcgcgccacaggcctgcgaattcgacggcgaagaagcacatgccttcaccgtgcgcagcgtggaattgactatcaggcccaaatattcaatatacgatcgccattataacaacgaaatcgaaacccttttcaccttcgaaaacttcggcgtgaacaggggcgatgacctggtaaacaattgtaacgaagcactagccgtatgcatggacctgcacggtgaggacgtacaagatcaagaccaggaacaataccaagatccaagcatggcgtttgagggtgcgcaagatctcaacgccacgtattctgggcttggagacacccttcacgggccgcccgtgtatcagaacgacgggctggcagacgatctggatggcgacctcgttatggacaacgtggtctctaggggtggtccagaagcaagtatgtctatggagttctacgcaaatcaaaatcttgctggcagaaagaactccagagacaatgaatga

SEQ ID NO: 1969 - DNA, 921 bp, Saccharomyces cerevisiae
atgcagttgagcaaggctgctgagatgtgttatgagataacaaactcttacttacacatagaccagaaatctcagataatagcaagtacacaagaagcgatacggttgacaagaaaatacttactaagtgaaatttttgtacgttggagtccactgaatggggaaatatcattctcgtacaacggaggaaaagattgccaggtattactactgttatatctgagttgcttatgggaatatttcttcattaaggctcaaaattcccaattcgatttcgagtttcaaagcttccccatgcaaagacttccaactgttttcattgatcaagaagaaactttccctacattagagaattttgtactggaaacctcagagcgatattgcctttccttatacgaatcacaaaggcaatctggtgcatcggtcaatatggcagacgcatttagagattttataaagatataccctgagaccgaagctatagtgataggtattagacacacagacccatttggtgaagcattaaagcctattcaaagaacagattctaactggcctgattttatgaggttgcaacctctcttacactgggacttaaccaatatatggagtttcttactgtattctaatgagccaatttgtggactatatggtaaaggtttcacatcaatcggcggaattaacaactcattgcctaacccacacttgagaaaggactccaataatccagccttgcattttgaatgggaaatcattcatgcatttggcaaggacgcagaaggcgaacgtagttccgctataaacacgtcacctatttccgtggtggataaggaaagattcagcaaataccatgacaattactatcctggctggtatttggttgatgacactttagagagagcaggcaggatcaagaattaa

SEQ ID NO: 1970 - DNA, 921 bp, Saccharomyces cerevisiae
atgctgtggcatcctgatggttacgagcctcgagtaaaggctatagaagaagaaatctacgctaacgaagacaggaaggatgttccggataagtttaaatttgatactgtaacgaaaactggaatggtcaagcttcgtgttttcaaagacgatctaatattcaaatcacaacgatctataaatctgtttgcaagtaggaagcatcccttcaagtcatttacggcggatggagagggcttgccgttatttgccttccgcactaagaagcctttttttgttaggcgagattatgtgggttttcttttttatcaatacgagatattgaaaaatggggacttccctgaagagtcggattatgaggtaaaaggagagtgcgacggtttcactctgtttaaagttcttttttgcactgttaaggtgaagaaaacaagctattatcgcaataaggagagaatatcccacatactagagctcaacttcggaaaaaaggaagattttaggatattgacactggttagatgctctgaaattagatcagtatatgttgtagaggataaaaaggttattatgaaatgggttttcacctcagagagtaaatttaatttgaattcctcactgttcatcataaaggccgcaattggctgtttaccagaggtgggtgatagcatagaggacatacctaaatttgattgggactcctgccctactattggatgtatgtgcagaactaaggaggctctttttcaacctgagtctcgaaaagatatgcatatatgccctcaattatttttaggggaaaccggaccgccacattataatgagagttcagttccgtggctaacaaaaatgaatatatgcatttcagtgctaataaatttccttgaatataccgatttcatgtcttggatgcaggataattag

SEQ ID NO: 1971 - DNA, 921 bp, Saccharomyces cerevisiae
atggaacgactacagagattgatgatgaatagtaaggtggggtccgcggacaccggccgtgacgatacgaaagaaactgtttatatttcttcgattgcgcttttaaagatgctaaagcatggtagagctggtgttcccatggaagtcatggggttgatgttaggtgagtttgtcgatgattatacggttaacgttgtggacgtgtttgcgatgcctcaatcgggtaccggagtttctgttgaggctgtcgatgatgttttccaagcgaagatgatggacatgttaaaacaaacgggcagagaccaaatggtcgttggctggtaccactctcatccagggtttggctgttggctatcttctgttgatgttaatactcaaaaatcttttgaacaactaaacagcagagctgttgctgtcgttgttgaccctattcaatccgttaagggaaaagttgtcatcgatgcttttagattgattgacacgggcgcattgataaataacttagagcctagacaaacaacctccaacacaggcttattgaacaaggccaacattcaagccttaattcacggtctgaataggcattactattctttaaatattgattatcataaaaccgcgaaggaaaccaagatgttaatgaacttacataaagaacagtggcaatcaggtcttaagatgtacgattatgaagaaaaagaagaatcaaatttggctgctacaaagagtatggttaagatagccgaacagtactctaagagaatagaagaggaaaaggaattaaccgaagaagaacttaagacaagatacgttggtaggcaagatccaaagaagcacctttccgaaacagcagatgagacactagagaacaatattgtttctgtgctgacggcgggtgttaattcagtggcaattaaataa

SEQ ID NO: 1972 - DNA, 921 bp, Saccharomyces cerevisiae
atgtcaattacgaagactgaactggacggtatattgccattggtggccagaggtaaagttagagacatatatgaggtagacgctggtacgttgctgtttgttgctacggatcgtatctctgcatatgacgttattatggaaaacagcattcctgaaaaggggatcctattgaccaaactgtcagagttctggttcaagttcctgtccaacgatgttcgtaatcatttggtcgacatcgccccaggtaagactattttcgattatctacctgcaaaattgagcgaaccaaagtacaaaacgcaactagaagaccgctctctattggttcacaaacataaactaattccattggaagtaattgtcagaggctacatcaccggatctgcttggaaagagtacgtaaaaacaggtactgtgcatggtttgaaacaacctcaaggacttaaagaatctcaagagttcccagaaccaatcttcaccccatcgaccaaggctgaacaaggtgaacatgacgaaaacatctctcctgcccaggccgctgagctggtgggtgaagatttgtcacgtagagtggcagaactggctgtaaaactgtactccaagtgcaaagattatgctaaggagaagggcatcatcatcgcagacactaaattcgaattcggtattgacgaaaagaccaatgaaattattctagtggacgaggtgctaacgccagactcctctagattctggaacggtgcctcttataaggtaggagaatcccaagattcttacgataagcaatttttaagagactggcttactgctaataagttgaacggtgttaacggcgtcaaaatgccccaagacattgtcgacaggacaagggccaaatatatagaggcttatgaaacattgacagggtctaaatggtctcactaa

SEQ ID NO: 1973 - DNA, 921 bp, Saccharomyces cerevisiae
atgtccgacgaaattgtttggcaagtgattaatcaaagtttctgctctcatagaattaaggcacctaatggtcaaaatttttgcagaaatgagtataacgtcactgggttgtgtacaaggcaatcatgcccacttgccaactccaagtatgcaacagtgaagtgtgacaatgggaaactgtacttgtatatgaagacgcctgaaagagcgcacactcctgccaagttatgggaaagaatcaaactatccaaaaattacacgaaggctttacaacagatcgacgaacacctactacattggagcaagtttttccgtcataagtgtaaacagagatttacaaaattgacgcaggtcatgataacagagagacgtttagcattaagggaggaggagagacactacgttggtgtagcaccaaaggtcaaaagaagagaacaaaacagggagagaaaggcattggtagctgccaagattgaaaaagccatcgaaaaagaattgatggacagattaaagagtggtgcttacggtgataaaccattaaatgttgacgaaaaggtctggaagaagataatgggtcaaatggaagaggagaattctcaggacgaggaagaagactgggatgaagaagaggaaagtgatgatggggaagttgaatacgttgcagatgatggcgaaggtgaatacgttgacgtggatgacttagaaaagtggttagctgactctgacagagaagcttccagcgccagtgaaagcgaaagcgacagtgaaagcgagagcgacagcgatagtgatgaagaaaataagaattcagccaagagacgtaagaagggaactagtgccaaaactaaacgtcctaaagtcgaaatcgaatacgaggaggaacacgaagttcaaaatgctgagcaagaagtggcacaataa

SEQ ID NO: 1974 - DNA, 924 bp, Saccharomyces cerevisiae
atgaccggcatggaatcaggagagaatttggaaaacatggaagatattttggcgagacatcgcaaggaaaataaagatttacagaataagataacgggtatgaaaaagcaggctactaaatccaaaaggaaagaagttaattcgaaatgcctagatcttcaagataaactaaagactaagcaagaaaatgaaataagggattggaaaattgcaaataatgaagtgtttgacgcagaacaagaagatgaagtgactcctgaaaaacttttagaacaactatccatatctcgagatgagaaagaacaacagaatgttcccgttcaacaacagcaacaaggccagacaaagaagcgtcgcaatagacaaaaggaaagattggccaaaagagatgcagcaattgctaaaatgaaagaagaggctgctttagaagcatccaaacaaccggacttgaaaaaaatggagcaggagtctatagatcagttatgcgagttgaagaaactgaaacaattcgatatacaacccgatggccactgtctctttgcatctatattagatcagttaaaattacgccatgatccaaaaaaactggatcaagacatggatgtcatgaagctgagatggttgagttgtaattacgtacaggagcacagggatgatttcattccatatttgtttgatgaagaaactatgaagatgaaagacattgatgagtatacgaaagagatggagcatacagctcaatggggtggtgaaattgagattttggctctctctcacgttttcgactgccccattagcattctgatgagtggaagacctattcaagtgtacaatgaatgtgggaaaaatcctgaattgaagctagtttactataaacacagctatgcattaggtgagcattataattcattgcatgattcttga

SEQ ID NO: 1975 - DNA, 924 bp, Saccharomyces cerevisiae
atgactagtaaattaaaacgggttgctgtcgcacaattatgttcatccgctgacctgaccaaaaacttaaaagtggtaaaagaattgatatctgaagccattcaaaaaaaggcggatgtcgtttttctccctgaggcaagtgactatctttctcaaaaccctcttcattccaggtatttggcacagaaaagccccaaatttattcggcaattacagtcaagcattaccgaccttgtcagagataattcacggaatatagatgtttccattggggtacacttgccgccctcagaacaagatttacttgaaggcaatgatcgagtcagaaacgttctattatatatcgatcatgaagggaaaatattgcaagaataccaaaaactgcatttgtttgacgtagacgtgccaaatggaccgatattgaaagaatcaaaatctgtccagcctggcaaagccattcctgacattatagagtctccattgggaaaattgggcagtgccatttgttatgatattcgctttcccgaattttctttgaaattacgatcaatgggggctgaaatcttatgttttcccagtgcgttcactattaaaacaggggaagcacattgggagttactaggcagagcaagagcggttgacactcaatgctatgtgctcatgccagggcaggttggaatgcacgatctcagtgatccagagtgggagaaacaatcacatatgagcgctctcgaaaaaagctccaggagagaatcttggggacactcaatggtcattgatccttggggtaaaataatagcgcatgccgatccctctactgttggaccacaactaattctcgctgatttggatcgtgagcttttgcaagaaataaggaacaaaatgcccttatggaaccagagaagagacgatttatttcattga

SEQ ID NO: 1976 - DNA, 924 bp, Saccharomyces cerevisiae
atgactagtttggacgatacaataatttcgtaccagaatataatgttactggataacatgaccaactacaacaagcctgcgattgactatttccatcatgaatttaatgatgcaagcttggaaatatcggcttcatggacactactattgaagatgcgcaaacataaactacttcgattaccaagttgctcttcagaggacgtgctagattacaacatgtacctcgttaggctacatcattgcctctggaggcgttggtccataaatcactatggtttacagaactccaaatccaatccactgtccatcaactggaacaaagaaaccgatgtaacggtgttgtacggtccagatttgactaacatagatagtaatgaaaacgaaatatcgccggtccagaaccaaattgaccagaaacaaacaaaaaatctaaaatctgctttaaagaaaaatacggaatgctgggtaaccgaggaggtggatgagattaacgcttctatagagagcaatgacaacgctttggtgaaattagaagacatttcatgcccatcgtctgttgattctcacacgtcttccattttcgaccagcattctacatgcactaaaatttcctccatagatgaagattctgaagaccttatgaacgaaaagaaggaacaattccccaggaagttgaagtttaaccaagccgtgatgaagagggagatcgactcaaaggggactatccgcgaatccctcatcaacataaacgatatccaacattcccgccaccatcgccgtcaccatcgtcgccatcatcaccatcaccatcaaaatagttctcattctgatgaaacaataaaagaagctcattatgagttcagcaactatacatttggcactatggaagaagacattttttataggaaccaggttgttttttaa

SEQ ID NO: 1977 - DNA, 924 bp, Saccharomyces cerevisiae
atgactgagcaagcaactaagccaagaaattcatcgcatttgatcgggggctttttcggtgggctaacatctgctgttgcgttgcaacctttagaccttttgaagacgagaatccagcaagacaagaaagctacattatggaaaaatttgaaagagatagacagccctctacagctatggagaggtacattaccttcagcattacgaacatcaataggcagcgccttatatttatcatgtttgaaccttatgcgctcatctttggcaaagaggaggaatgctgtgccttcattaacaaacgattcaaacattgtatataacaagagcagtagcttaccacgattaacgatgtatgaaaatttactaacaggtgcatttgcaagaggtttggtaggttatataaccatgcctatcaccgtcattaaagtccgttatgagtctactctgtacaattactccagtttaaaggaggcaattacccatatatatactaaggaaggactttttggatttttcagagggtttggagctacttgtttaagagacgctccctatgcaggtttgtatgtgctgctatatgaaaaatcgaaacaattactgcccatggtattaccttctaggtttatacattacaatcctgagggaggatttactacttatacctctacaacagtaaatacaacaagcgccgtactatccgccagtttagccaccacagtaacggcaccgttcgacaccataaaaacgagaatgcaattggaaccatcaaaatttaccaactccttcaatacatttacatctatagttaaaaatgaaaatgtgctgaagttatttagcgggttaagcatgaggctggcaagaaaggccttcagtgcaggtattgcgtggggtatatatgaggagttggtcaaaagattcatgtaa

SEQ ID NO: 1978 - DNA, 924 bp, Saccharomyces cerevisiae
atgagtagcgacgctaagcaacaagaaacaaactttgccattaatttcttaatgggtggtgtgagtgcggccatcgctaaaactgctgcctcaccaatcgaaagagtcaagatcttgatccaaaatcaagatgaaatgatcaagcaaggaactttagataaaaagtattccggtatcgtggattgtttcaagagaactgcaaagcaagagggactaatatccttttggcgaggaaatactgccaatgttattcgttattttcccactcaagctttgaacttcgccttcaaagataagattaagttgatgtttggtttcaagaaagaggaaggctatggtaaatggtttgcaggtaatctggcttctggtggtgcagctggtgctctttcgttattatttgtttattctttagattttgccagaaccagacttgctgctgatgcaaaatcgtcgaaaaagggtggcgctcgccaattcaatgggttgactgatgtttataaaaagaccttgaaatcggatggtatcgcaggattatacagaggattcatgccatcagtagtgggtatcgtggtttatagaggactatatttcggtatgtttgattctctcaagccactggtgctaactggttcattagatggttcattcttggcttcatttttattgggatgggtggtcactacaggtgcctcaacatgttcttatccattagacacagtgagaagaagaatgatgatgacttcaggtcaagcagtaaagtacaacggtgctatagattgtctcaaaaaaatcgtagcttctgaaggtgtagggtcattgttcaaaggctgcggggcaaatatcttgagaagtgttgctggagctggtgttatttccatgtatgaccagttgcaaatgatattgttcggtaaaaaattcaaatga

SEQ ID NO: 1979 - DNA, 924 bp, Saccharomyces cerevisiae
atggtaccccccacggtagaagcatccttggagtctccttacactaagtcgtacttttcacctgtcccaagcgcgctcttggaacagaatgactctccaataataatgggtatcgatgaagctggcagagggcccgtattagggccaatggtctacgcagtagcctattctacacagaaatatcaggacgaaactataatccctaactacgagtttgacgactctaaaaaacttacagatcccatcagaagaatgctgttttccaagatataccaggacaacgaagaactaacccagatcggctacgcaactacgtgcatcactccgttggatatctctagaggaatgagcaagttcccaccgacgagaaactataacttgaatgagcaggcgcacgatgtcacaatggcactcattgatggcgtgataaagcagaacgtgaagctcagtcacgtgtatgtggatactgttggaccaccagcgtcctatcagaagaaactggagcaacgatttcctggtgtcaagtttacggtcgccaagaaggcagactcgctctactgcatggtcagtgtggcgagtgtcgttgcaaaagtgaccagagatatactagtcgaatccttgaagagggatcccgatgagatcctgggttctggatacccctccgacccgaagacagtcgcatggctgaagcgcaaccagacaagtcttatgggctggcccgccaacatggtaagattctcatggcagacatgccagactctgttagatgacgccagtaagaatagtatccctatcaagtgggaagaacaatatatggacagcaggaagaacgccgcacaaaaaaccaagcaattgcagctccagatggtcgctaagcctgttagaaggaagaggctgagaaccctagataattggtaccggtga

SEQ ID NO: 1980 - DNA, 924 bp, Saccharomyces cerevisiae
atggttcagcaactaagcctttttggatctattggtgatgacggctacgatttactaatttcaactttgaccacaatatcaggtaatcctccgctactgtataacagtttatgcactgtctggaaaccaaatccatcttacgacgtcgagaacgtgaactctagaaaccaattggttgaaccaaatagaataaaactttccaaagaggtgccattttcttacctgatcgatgaaacaatgatggataagccattaaactttagaatcttgaaatcttttacaaacgataaaatcccgcttaactatgctatgacacggaatatcttgcacaacacagttccgcaagtcaccaacttcaacagcacaaacgaagatcaaaacaacagtaagcatacagaagatactgtaaatgaaagtcgaaacagcgatgacatcatagatgtcgacatggatgcaagtcccgccccttcaaacgagtcatgttccccttggtcattgcaaatttcagatattcctgctgcaggaaacaatagaagtgtttcaatgcaaacgatagctgagactatcatattatcttcagctggcaaaaactcttcagtatcctcgctcatgaacggattgggttatgtattcgaatttcagtatcttacaattggtgtgaaattttttatgaagcatggtttaatacttgagttacaaaaaatttggcaaatagaagaagcaggcaattcacaaataacaagcggagggttccttttaaaagcatacatcaatgttagtagggggaccgatatcgatcgtataaactatacagagactgccttgatgaacttaaaaaaggaactacaaggctatatagagttaagtgtacccgatagacagtcaatggactcgagggtagcacatggaaatattctaatataa

SEQ ID NO: 1981 - DNA, 924 bp, Saccharomyces cerevisiae
atgtcatcagactcaaacgcaaagccattgccttttatatatcagttcatatcaggtgccgtcgccggtatttctgagttaactgttatgtatccgcttgatgttgttaagacaagatttcaactggaggtgacgacgcctactgccgctgcagtaggaaagcaagtagagagatataatggtgtcatcgattgtttgaaaaaaattgtaaagaaggaagggtttagcagactttacagaggtattagttcaccaatgttgatggaagcaccaaagagagccaccaaatttgcatgtaacgatcaatatcaaaaaatcttcaaaaacctattcaacacgaatgaaactacgcagaagatctccattgcggctggtgcatctgctggtatgacagaagctgcagttattgttccatttgaattgatcaaaatcaggatgcaagacgtcaagtccagctatcttggaccaatggactgtttgaaaaaaacaatcaaaaacgaaggtattatggggctatacaagggtatcgaatctaccatgtggagaaacgctctttggaatggtggctacttcggtgttatctaccaagtgagaaattccatgcccgtagcaaagacaaagggacaaaagaccagaaatgaccttattgcaggtgcgatcggtggtacggtcgggaccatgcttaacactccctttgacgtggtgaaatccagaatccaaagtgtggacgcggtcagcagtgctgttaaaaaatacaactggtgcctaccttcgctattggtcatataccgtgaagaaggcttcagagcattgtacaaaggtttcgtccccaaagtatgtagactagcacccggtggttcattaatgttggtggtttttaccggtatgatgaactttttcagggatctgaagtacggacactga

SEQ ID NO: 1982 - DNA, 924 bp, Saccharomyces cerevisiae
atgtctgaagaatttccatctcctcaactaatcgatgatttggaagaacatccacagcatgataatgctcgagtcgtgaaagatttgcttgcaggtacagcgggtggtattgcgcaagtgctagtgggccagccctttgatacgacaaaagttaggttacaaacatcgagcaccccaacaacagccatggaagtcgtcagaaagctgcttgccaatgaagggcctcgcgggttttacaaaggaactctgacgccattaattggtgttggtgcatgtgtttcattacaatttggtgttaatgaagctatgaagagattttttcatcatcgcaatgctgatatgtcatcgactttgtcattgccacagtattacgcatgtggtgtcacaggcggtatagtaaactcattcttggcgtccccaattgagcatgtcaggattcgcttgcaaacacagactggctcaggcaccaacgcagaattcaagggtcctttggaatgcatcaaaaaattaagacataacaaggccttgctacgtggtttaacacctacaatattgagagaaggtcatggatgtggcacatatttcttagtgtatgaagcgttgattgctaaccaaatgaacaaaagacgtggactagagagaaaggacattcctgcatggaaactttgtatttttggagcattgtctggcactgccttatggttgatggtatatccattagatgtcatcaagtctgtcatgcaaacggataatttacaaaagcctaaatttggtaattctatttccagtgtagccaagactttatatgccaatggagggataggcgcttttttcaaagggtttggtcctaccatgctaagagctgctcccgccaatggtgccacttttgctacttttgaattagcgatgaggttattgggttga

SEQ ID NO: 1983 - DNA, 924 bp, Saccharomyces cerevisiae
atgttcaagaggcaattatcgactagtgttcgttatctacagcattatgatgagtcgctattatcaaggtactatcctgaaagtcttttaaaatccataaaacttgctcaacaaacgataccagaagatactaaattcagagtatctcgtaacgtggaattcgcaccaccatatttggatgattttaccaaaatacatcctttttgggattacaaaccaggcatgccccatctccacgctcaagaggagaataataacttcagcatctttagatgggaccaggtacaacaaccattaccaggcgaaggtaacattctgcctccaggagtcagcttaccaaacgatggtggtcggaaatcgaaaagcgccgatgtagctgcagggctacacaagcaaaccggtgtagatccggattatatcactagaaagttgactatgaagccgctggtgatgaaaagagtgtcaaatcagactgggaagggtaaaattgcgtctttctatgccttggttgtcgttggtgacaaaaacggtatggtaggtttgggagaaggtaaatctcgtgaagaaatgtccaaagcgatctttaaagctcattgggatgcggtaaggaacctgaaggaaatacctaggtatgaaaacagaactatttatggtgatatagattttaggtatcatggtgtgaaactacatttaagaagtgcaaaaccagggtttggattacgtgtaaaccatgtaatctttgagatttgtgaatgtgcaggtatcaaagatctgagtgggaaagtatataaatccagaaacgatatgaatatagctaaaggtaccatcgaggctttcacgaaagctcaaaagacattggatgaggttgccctgggtagaggcaaaaagcttgttgatgtcaggaaagtttactattcaagctga

SEQ ID NO: 1984 - DNA, 924 bp, Saccharomyces cerevisiae
atgttgatttcttcacggatcgttcgaagctcgctggtaaatgtcccgctaagattatctaggtgttttacgcaagctcacagagcatgcaaagaagaagaagttaatagtcctttatcatccgcagctgaacagccagagcagaagtatacgcattttggttcgaagactgtattgaagtctaccaagcagaagttagttggtgatgtcttttcttccgtggccaatcggtatgacttgatgaatgatgttatgtcattaggaattcatagattgtggaaggaccattttatcaataaactagatgcgggaaaaaggccaaactctacgactcctttgaacttcatagatgtggctgggggatccggtgatattgctttcggattactagaccatgctgagtcgaaatttggtgacactgagtctacaatggatattgtagatatcaaccctgacatgcttaaagaaggtgagaagagagccatggaacaaggaaaatatttcaaggatcctcgtgtgagatttttggtttctaatggtgagaaactagaggagattgattctgattccaaggacatctacacagtctccttcggtatcagaaatttcaccgatattcaaaagggtttaaacactgcttatagagttttgaaaccgggcggtattttttattgtctagaattttccaaaattgagaatcccctaatggactttgcttaccaacagtgggctaaggtcctacctgtaatgggctcgatgattgctaatgactacgactcttaccagtatttggtggagtctatcgaaagatttcctgaccaagaaacgttcaaatccatgattgagaaggcaggattcaaatctgctggctacgaaagtttaacttttggtatatgtgccatccattggggcattaaagtttaa

SEQ ID NO: 1985 - DNA, 927 bp, Saccharomyces cerevisiae
atgaagagcttttttctttatctttatgtggcattcatgtttagttgcataacggctctgccattacctgtggataacaaaagggcttcttcagactccttagacctaaagaaaaaatacgcaccagaccctcctattacacataatgtaaacatcggaattgttttcacagatcctgaaagttcggaagaagccggccgtctcataacaatagacttatacgggactatggtgcccaagacagtaatgactttttgccagtatgttgatagtgtaaaagatcgccttgcttcccgtcacagttactcgccagaacgcgattttgataaaattctaccgaatggagctatagaaggtagctccgtttcttcctcctctattgaagaaacggaaatgttggctccaaaactcccggaagaaaatcatagtttaattcatgataggccaggcagagtttccatgattaaggacgataagggtcttaagtttataattgagaccagtgagacgccacttgaaggtgaaagtgttgtgtttggccaagttaccgccgggttaaaagatctgatggataaactagctaatgtgaaaactgacgaaaatggcaaaccagagcaaccaataacaataggttacatttcatcccaggaacacaggattcagcatgcaaaggaagctcacgaaaagtatttacaaaggcttcaagattaccaaaacggcgatttggagaaaggtattacattgaagaattatttataccagggtagtcaaagaaagttagaagacgcaaaatataatcagcttcaccatcctttaccaaagattatgcttggtatttcggtattgttacttttctacgttttggccaagtacaggaaaagaatattcaacagatcgtctaaaatagtttctattagagaggattaa

SEQ ID NO: 1986 - DNA, 927 bp, Saccharomyces cerevisiae
atgatggacttagataagattatagcatcactgagagacggaaaacatattcctgaagaaaccgtttttaggctatgtttaaattcacaggaactattaatgaatgaaggcaatgtaacacaagtcgatacaccggttacaatatgcggtgatatacatggccaattacacgatctactaacgctcttcgaaaagagtggtggtgtagagaaaacaaggtatattttcttgggcgattttgtggataggggattttactcattggagagttttttacttttactatgttacaaattaagatatcctgataggattactttaattagaggcaatcacgaaacccggcaaattactaaagtatacggattttacgatgaagtagtaagaaaatatggtaatagtaacgtatggaggtactgctgtgaagtttttgattatttatcattgggggcaataataaacaatagcatattctgtgttcatggtggattatctccggatatgaccacggttgatgaaatacgaacaatagacaggaaacaagaagttccacatgaaggtgctatgtgtgacttattatggagcgaccccgaagacgttgacacatggtcattatcaccaagaggtgctggatttcttttcggtaaaagagaagttgatcaattcttagagaaaaacaacgttgagttaattgctagagctcatcagttagtgatggaaggttacaaagaaatgttcgacggtggattagtgacagtctggtcggcaccgaattactgttatcgttgtggtaatgtagcagctgtattgaagatagacgacgatttgaatcgtgaatatacaatttttgaagctgttcaggcacaaaatgaagtcggaaatgctataattccaaccaaaaaatctcaaatggactatttcttataa

SEQ ID NO: 1987 - DNA, 927 bp, Saccharomyces cerevisiae
atgcaacttgtgccgctagaattgaatagatccactctaagtgggatatctgggtccatctccatctcctgctggatcattgtgtttgtccctcaaatttacgagaacttttaccggaagtcgtctgatgggctgtctttattgttcgtggtactttggttggccggcgatgtctttaaccttatgggtgccgttatgcaacatcttttgtctaccatgatcattcttgctgcttactatacggtggcagatatcattttactaggtcaatgtctatggtacgataatgaggaaaaaccagcagtagaccctattcatctctcccctgccaatccaataaacgaaaacgttctgcacgatgtgttcaatgaacaacaaccgcttttgaattcccaaggtcagccaaatcgtattgatgaagaaatggctgctccttcatccgacggaaacgctggtgatgataatctccgtgaagtcaattcaagaaatttgataaaagacatatttattgttagtggtgtagtttttgtaggtttcatctcgtggtatgtaacctactgcgtaaactacacgcaacctcctcccgtggaggatccatcactgcctgttcccgaactgcagatcaattggatggctcagatattcggttacttaagtgcccttttgtatctgggttcaagaattcctcagatattactgaattttaagagaaagtcttgtgaaggtatcagtttcctattctttttgttcgcctgtttgggtaataccacatttattttctctgtgattgtcatttctttagactggaagtatctaattatgaatgcttcctggttggttggaagcataggtactttattcatggatttcgtcatattttcccagtttttcatttacaaaagaaataaaaaatttatactgaattaa

SEQ ID NO: 1988 - DNA, 927 bp, Saccharomyces cerevisiae
atggtacgcaagaataaaataaatagagcgagtggaactacaaaacacctcaaggattttccatcagtcatcctaagtctgcccagctacaacccttccatcctttctaaaaatgcaactgcactaataaccggtggttctagtggactcggatttgaacttgcaaaggaactttccagaagaattaataaagttattgtggcagatattcaatcatttcctacttttgctcaggtagaatataataacattttctactatcaatgcgacataacaagtctagatgaaattaaaaatttgaaaaaagctattgaaagagatcatggcaacattaatataattataaataatgctggtgttgctcacatcaaaaagttagaacatatgacaaacaaggaggtagaacaattgatcgacataaacttaataggtgcttaccgaatcatcagtacatttgcagaagatatgatagacaatagggaaggctttataattaacattgcttcagtcctcggagaactgactcctgcaaggctgacatcgtatggtgcatcaaaaggagcaatgattggttttcacaagtgtatgagcaggcatttcagaagtttgtccacggaatgtaataaaactggaataaaaacactactggtgtgcccgggaaaaatcaaaactaatatgtttattgatgtccctacaccatctaagttattggctcctgacatcataccttcccaactggcactagcgataatctctgcgatggagcataatcatctgcaaacactaaatgccccatattatgtgaacctagttccctttttcaaaactttgagttggccatataggcatctcttaaaacatttcagtggaatggaccatgtaacgtcaaccagcccgcgagcaataaatccgaagagaagtgcataa

SEQ ID NO: 1989 - DNA, 927 bp, Saccharomyces cerevisiae
atgtcaaactacgaagccttgctgaaattcaataggaaggctgtatctaaggaaatggtgcaatatctagcatcgaccacagcttccattatcaaaattaagaagacgaatagtatgatagatattgcattgccagcaccaccgttgactaaattcatcaacagactgatcaagcattctaacgttcaaactccgactctgatggctacctctgtatatttggccaaattaagatcaataataccgagtaacgtttatggtatagagaccaccaggcatagaatattcttaggttgcctaatattagctgcaaaaacgttaaatgattcctcccctcttaacaaacactgggccgaatatacggacggccttctcatcctaagggaggttaatactattgaaagggaactattagaatattttgattgggacgtcaccatttccacagatgatttaattacatgtctctcgccattcttgaagcctatcaaagaggagcagttgtacaaatcgcaaagagactgtcgcacgttgaaaaatttttctgctcaagaaaaagacatagtaaacaaaacatccatttcccattcgcgctcatcgtccaatatgtctatcccatctttagcttccacttcgaccctctccacgttggaatctagaagatcgaatttatccaattatagtaacagaatacgaactttgcccgaactacacgaatccaataacattagcgacaagttttctccgcgaacatacaacatagactccaaacacgataacaaggaaaataggccaataccgacaattaagccttttaattttagtaaagcgcgccctgtgatcttgaaaactgggttaaacaaacagataataaaagaagatacaaaagtaaagaaatcgaattggtcaaattacttcaaatcgtga

SEQ ID NO: 1990 - DNA, 928 bp, Saccharomyces cerevisiae
atgggtgaaaaacgtaaccgtaatggtaaggatgcaaattcccaaaacaggaagaaagtatgtctgtctgcacacgaattagagttctttaagtactaacgatcaaaagtaatagtttaaagtatcttccggattcttagaccctggtacgtctggaatatatgccacatgttctagaagacatgaacgtcaagcagcccaagagttgcagcttttattcgaagaaaaatttcaagaactctatggggatatcaaagaaggagaagatgaaagtgaaaatgacgaaaagaaagatctatcaattgaagaccagataaaaaaggaattacaagaattgaaaggtgaagaaacaggcaaagatttatcttcaggggagacaaagaagaaagaccccttagccttcatcgacttgaactgtgagtgcgtgacattttgtaaaacaagaaagccaattgttcccgaagaatttgtgctaagtatcatgaaagacttagcggatcccaaaaatatggttaaacgtactagatatgttcagaaattaacacctattacgtactcttgtaatgcaaaaatggagcaattaatcaagttggccaatttggttattgggccacactttcatgacccttcgaatgttaaaaaaaattataaatttgctgtagaagtgacaagaagaaatttcaatacgattgaaagaatggacatcattaatcaagttgtgaagctggtcaataaagagggttctgagtttaatcatactgtggacttgaagaactatgataaattgattctagtggaatgttttaagagcaatatcggaatgtgtgtagtcgatggggattataaaaccaaatatcgtaaatacaacgttcaacagctttatgaatcgaaattccgaaaggatgaagataagagtgtaaaacaataa

SEQ ID NO: 1991 - DNA, 930 bp, Saccharomyces cerevisiae
atgcaagcaagtttacctggcgaaaagaaagtcgacacagagcggctgaagcgtgatctatgcccacgtaaacccattgagataaagtacttttcacagatatgtaacgatatgatgaacaaaaaggaccgattgggtgatattttgcatattatcttgcgagcatgtgcactcaatttcggggcgggtccccgtggtggcgctggtgacgaagaggatcgatctattacgaatgaagaacccattattccctctgtggacgagcatggcctgaaagtatgtaagttgcgcagtcctaacactccacgaagactcagaaaaacactagatgccgtgaaagctttattggtgtcgtcttgtgcttgtaccgcaagggatttagatatatttgatgacaacaacggcgttgcaatgtggaaatggatcaaaattctgtaccacgaagtagcgcaggaaaccacgctgaaggactcttatagaataactttggtaccttcttctgatggtatatcagtatgtggaaaactttggggagagttgaacaactgcttccatatgccagcctcattttgcgtaatcgagaagttttgttcagagaaccgaagcgaggaattgacgagtatctggaaaacgattctttttttcaaatgatacctgttaaatatcgtgaaattgtgctgcccaagttgagaagagatactaacaaaatgaccgcggctcttaaaaataaagtcgctgttgcaattgacgagcttacggtgccacttatgtggatgatccattttgccgtaggatacccttaccgttatccagagcttcagctactcgcttttgccggtcctcagcgcaacgtatacgtcgatgatacaacaagacgcatccaactgtacactgattacaacaagaacggttcatcggagcctcgactaa

SEQ ID NO: 1992 - DNA, 930 bp, Saccharomyces cerevisiae
atgaaaatcttccatactgtcgaagaagttgttcaatggagaacacaggagctgagggaaactagatttagagaaactattgggttcgttcccacaatgggttgcctgcattcgggtcacgctagtttgatctcgcagtctgtgaaggaaaacacctatactgtggtcagtatatttgtaaatccctcccagtttgcgccaacggaagatctagataactatcctcgaactttgccagacgacatcaaattgcttgagtcgttgaaggtggatgttctatttgctcctaatgcacacgtgatgtatccacagggaattccgctcgacatagaagagcagaaaggcccttttgttagtgttcttggattgagtgaaaaattagaggggaagacgagacctaacttctttaggggcgtggcaactgtcgtgactaaactattcaatatcgttatggcggatgtggcttattttgggcagaaggacattcaacagttcattgttttacagtgtatggtggacgaactgtttgttaatacaaggctacaaatgatgcctattgtaagaaacaataatggactggctctgagtagtagaaacaaatatctttgtccagagtctttaaagatctctgaaaacctttaccgcgggctgaaagctgcggaaaatgctattaggagactagcaccagggggacgtctctccagatcagaaatcatcgatactgtgactcaaatatgggcaccctacgttgattcccacgatttcaaaatcgactatgtttccttagcagattttaagactcttgatgaactctccgatgttgaaaacaccagcgaacagcagccaatagtcattagttgtgctgtatacgtgactgaccgcgaaaaacccgatacggtcgtcagactaatagataacatcgttatttaa

SEQ ID NO: 1993 - DNA, 930 bp, Saccharomyces cerevisiae
atgaacttccacacggcaagaatatctcaggtcggtgtcatttctagggctctactttcttctgtaagtagacgttggattcatgtaacgccaataagtcttaataattcaggaggatcactattcggaagcattacagaaaataaaccaaaggaaggaaaaaacaggggggatgaagatgcaggcagcttctctaataggttagcgattgcttctgattcttctggagaggctcctgaagttaatagggattcaataaccatagaaaacgataaactactacagcaacatatcatatcgttgcagcaaccggaacaattagcatcacagagcttattatctcctttgaaaagggaaatatatgaagctaattgtaaaattaatggtgggttttacaagaaagatactattgtaaagttaccaaattctagcgaacgttacaagctaaagttaacaaaaagagaaattgaagtactagaaccttccgtatatgctcagtcatatagaattaaatcgtcgatgaaaaaggctacacttttgttgaggttattgggaggcctcgacgttatgaaagctatatctcagtgtcacttttctaataagaaaattgctcgcgaagtagcagaactacttcaaaaaggtgtaaaagatggccaaaaattaggtttgaaaccagaggacttatatatctctcagatttggacagggagtgacgggttttggagaaaacgtgttgaattcaaggcaaggacaagaatcggaatcataagtcatccttacatacatgtcagatgtattctgagaacaaagagtgttacgaaacgaagacttgcttatgaagcacatttaaaagagcaaaaaagagcgccatgggtacagttgggagataagcccattaggggtgttacaggcggcgtatacaagtggtga

SEQ ID NO: 1994 - DNA, 930 bp, Saccharomyces cerevisiae
atgattttcaaaaggttcgttaatttgcttgtgtttttattcctactcggtgctggcttattgacgttttttcttattctgtcaggaggcagagaatctggaacgctgaaaaatttttattggttacaggctgatacaaacggctttaacagcgctccatcgaccacgagatggtacaattacaattggtgcggctacgaagacggccagctagctaattgctctagcagggcgcccgccaagcctttctctcccagagacaattttggtaactctgtcaatttaccatcgtcgttcagaaacaaccgggatacctactattatctatccagggttggatgggccatgctgctgatttccctatttttcatcgtactggcgctggtacccggctttctggctaccttccttcctttcaaggcagtgccagtcctgtactgtgtgttgtcctggttggcctttttcttcattatattggctgcatgcttgtacacaggttgctatgtgaaggccagaaagaccttccgcaacagcgggaggtctgcaaggctgggacccaaaaactttgcgttcatctggacttcggtcttcttgatgctcgtgaacgccatttggtccactatattcagtgctacccacaaggcccactctacctactcggaccacgacatgtatgcccaatatgaaagcccttctgttgacaccggtgctcaaatggagaaatccacttacaatagtggggcgacggacggcgcgggccctatcacagccgcacctgtggttggacagcctcaacctacaaccaccactactccggctggcaatggcaagttctttcaaaaactgaaaacaagaaagcaggtgccatcagctgagttagaaccagctggggatggtggtcttgccgggccagtgacggtacgcgactag

SEQ ID NO: 1995 - DNA, 930 bp, Saccharomyces cerevisiae
atgcagggaaataaatcaactataagagagtataagatagtagttgtcggtggaggtggcgttggtaaatctgctttaacaattcaattcattcaatcatactttgtggacgaatatgaccctactatcgaagattcttacagaaaacaagttgtcatcgatgacaaagtatccattttggacattctagatactgctggacaagaagagtattctgcgatgagagaacagtacatgaggactggggaaggtttcctactggtctattccgtcacctctagaaattcctttgatgagttactgtcttattatcagcaaattcaaagagtaaaagattctgactacattcctgtagtcgtggtaggtaacaaattggaccttgaaaatgaaagacaagtctcttatgaagacgggttacgcctggccaagcagttgaatgcaccctttctagaaacgtctgcgaaacaagccatcaacgtagacgaggccttttatagccttattcgtttggtaagggacgacggtgggaaatacaatagcatgaatcgtcaactggataatacgaatgaaataagagattcggagctaacctcatctgcaacagcggatagagaaaaaaagaacaacgggtcttatgtactcgataattctttgaccaatgctggcactggctccagttcaaagtcagccgttaaccataacggtgaaactactaaacgaactgatgaaaagaattacgttaatcaaaacaataacaatgaaggaaataccaagtactccagtaacggcaacggaaatcgaagtgatattagtcgtggtaatcaaaataatgccttaaattcgagaagtaaacagtctgctgagccacaaaaaaattcaagcgccaacgctagaaaagaatctagtggtggttgttgtataatttgttga

SEQ ID NO: 1996 - DNA, 930 bp, Saccharomyces cerevisiae
atgcctcttcaactttttggcagggatcagatcgttgtacattatgataacggcaacatgagtaacgatgaccagaatcaccaaagtgttctcggatcttggacaagaagggcagcagcagcattaagaacgttaatgaacaagcgaatacaacgtataacacttacgcactggttgctgttagtcatatgggttactagcctatggaaatttaccagtcattatagacagctgtatgctaattctgctgtttttgcaactttatgcacgaacattcttttatttgggatatctgacatactagcacaaagtatagcctgcttttattcatatcacgtggaccctataccgcaaatacttaacgatacctttcatcatgttcagaacaaccgtgatgtagaaaatggaggaggttatgaaagtgatgagctatctatcttcaatgattttacctcggaacatagctcctacacggataacgacgactatcctgaacttgataggccattagctactttcaaaacggacacatttgacttcttcaggtgggggtgttttatgttctggggattttttatatcatttttccaggctccttggtacaagttcttgaatttcttttacactgaagatccgacagtggtacaggtttttgaaagggttctttcggatcagctcctttattcgccaatctctctctattgtttctttatgttctcaaactatgtgatggaaggtggagataaggacacccttggcaagaaaatccaaaggctatatatatctacgcttggttgtaactatctggtgtggccaatggtacaattcattaatttccttataatgcctagagatttccaagcaccttttagctcttcagttggagtggtatggaattgcttcctttcgatgagaaatgcgtctaaatag

SEQ ID NO: 1997 - DNA, 930 bp, Saccharomyces cerevisiae
atgctgagatcgttattgcaaagcggccaccgcagggtggttgcttcttcatgtgctaccatggtgcgttgcagttcctcgtcgacctccgcgttggcgtacaagcagatgcacagacacgcaacaagacctcccttgcccacactagacactccttcctggaatgccaacagtgccgtttcatccatcatttacgaaacaccagcgccttctcgtcaaccaagaaaacagcatgtcttgaactgtttggtgcaaaacgaacccggtgtcttgtccagagtctcgggtacgttagctgccagaggctttaacatcgattcgttggtcgtgtgcaacaccgaggtcaaagacctaagtagaatgaccattgttttgcaagggcaagatggcgtagtcgaacaagcacgcagacaaatcgaagacttggtccccgtctacgccgtcctagactataccaattctgagatcatcaaaagagagctagtgatggccagaatctctctattgggtactgaatacttcgaagacctactattgcaccaccacacttccaccaatgctggcgccgctgactcccaagaattggtcgccgaaatcagagaaaagcaattccaccctgccaacttgcccgccagtgaggtattaaggttgaagcacgagcatttgaacgatatcaccaacttgaccaacaactttggaggtcgtgtcgtcgacatcagcgaaacaagctgtattgtggagttgtctgcaaaacccacacgtatctctgccttcttgaagttggtcgagccattcggtgtcctagagtgtgcaagaagcggtatgatggcattgccaagaactcctttgaagacaagcaccgaggaagctgccgacgaagacgaaaagatcagcgaaatcgtcgacatttcccaactaccacctggttag

SEQ ID NO: 1998 - DNA, 930 bp, Saccharomyces cerevisiae
atggatagtaaggaagtactggtacatgttaagaatctagaaaagaacaaaagtaatgatgctgcagttctagaaatcttacatgtcttggataaagaattcgtccccactgaaaagttactgagagaaacaaaagttggtgtggaagtcaacaagtttaaaaaatccactaatgtagagatcagcaaactcgtgaagaaaatgattagctcttggaaagacgcaattaataaaaataagcgttccaggcaagcacagcagcatcatcaagatcatgcgccaggcaatgcagaggacaagacaactgtaggtgagtccgtgaatggtgttcaacagccggcctcctcccagtcagatgccatgaaacaagacaagtacgtcagcactaaaccaagaaatagtaagaacgatggtgtggatacagctatataccaccacaaattacgtgatcaggtactaaaagcactctacgacgttttggccaaggaaagtgagcatccacctcaatctattttgcatactgcaaaggccatagaaagtgaaatgaataaagttaacaactgtgacaccaacgaagccgcttacaaagccaggtatcgtataatttattcaaacgtcatatcaaagaataacccagatctcaaacataaaattgccaacggtgatataacacctgaattcttagctacatgcgatgccaaggatctggcaccagcgcccttaaagcaaaagatagaagaaattgccaagcaaaacttatacaacgcacagggtgccaccatagaaaggtcagtcaccgatagatttacatgtggtaaatgtaaagagaagaaggtatcttactatcaattgcaaacaagatctgcggatgaaccattgaccactttctgtacatgtgaagcatgtggtaacagatggaaattctcttag

SEQ ID NO: 1999 - DNA, 930 bp, Saccharomyces cerevisiae
atggcaagtatgtattagtgctaggaattggaggatttgctcttttctgcatcattttttttatttttattggcgaatgttaaaattactaacaatggatgggattccaatacagcctatcaaccatataacgaatattcatcagtaacgggcggtggctttgagaactctgagtcccgcccaggtagtggggagtcggaaactaacactagagttaacaccttgacacctgtgacgatcaaacaaattctagagtccaaacaggatattcaggacggccccttcgtttcgcataaccaagaacttcatcacgtttgttttgtaggtgtggtgagaaacattacagaccatactgcaaatatttttttaactattgaggatggaactggtcaaatagaagtgagaaaatggagcgaagatgcaaatgacttggctgccggtaacgatgactcttctggtaaaggttatggttcgcaagtcgcccaacaatttgaaattggcggttacgtaaaagtttttggtgctttgaaagagtttggtggtaagaaaaatatacagtatgcggtgattaagcccatagattcattcaatgaagtgttgacgcatcacttggaagtcatcaaatgtcattccatagccagtggaatgatgaaacaacctttggagagtgcatccaacaacaatgggcaatcattatttgtcaaggatgataacgatacatcttccggctccagtccgttacaaagaattctagaattttgtaagaagcaatgtgagggcaaagacgctaattcattcgctgttcccattccattgatctcgcaatccttgaatttggatgaaactaccgtcagaaactgctgtacgaccttgactgaccagggttttatctacccaacttttgatgacaataacttctttgccctatga

SEQ ID NO: 2000 - DNA, 930 bp, Saccharomyces cerevisiae
atggccagttcgtcacataaccctgtcattcttttgaaaagaatcttatcgctcacagaaagctcccctttcattttgtgcttagattctattgcccagacctcatacaagctcatccaagaattcgtccaccagagcaagagtaaaggaaatgagtatccaattgtgtacatttcgttcgaaacagtgaataaaccatcgtactgtactcaatttattgacgctacgcagatggattttgtacatttagtgaaacaaattatatcatatctaccggctgctactgccacacaggcaaaaaagcacatggtcattatcgattcattgaactatatttctacagaatacataacaaggtttttgtctgagatcgcctctcctcactgcacgatggttgcgacttatcataaagacatcaaagatgagaaccgtacggtaatacctgattggaataacaattatcctgataagttgactttactgcagtttatggccactacaatagtagatattgatgtggtattaacaggcactctcgatactgaggaggtgagtgaattgttaaacgaatttagaattcctcgcgggttaaataacgatatatttcaattacgacttgttaataaaagaaagtccggcaggtcattggaatacgacttcatagtaaattcaaacacccacgaatatgaattattatcaaccactaagcaagaagaggagagcagtagtaacggactggagacacccgaaatgttgcaaggattaacaacattcaacctaggaacatccaacaaacagaagctggccaaagatcaagtcgcattgccttttctggaggcacaaagctttggacaagggggtgctattgtttatgagtacgaaaaggatgacgattatgatgaagaggatccatatgaggatcccttttaa

SEQ ID NO: 2001 - DNA, 930 bp, Saccharomyces cerevisiae
atggcgagtgtaccaagtctatgcgacatactgataccgctagaaaagaatagtcgcagcgacggcgatgctgaaagtagcaatacagtgctgattcaactgcgaaaagggcatcacgaacggatgcgttctccttacacaatacaaaagttttacaaatttctaaaaagagctcattgtgaggaaaatttagaatttttcgaaaaagctcatcagttcctccagcttaagcaaaacaggagtattagcgaggagaagctcttggaagtttggaacaagtcgttgtacataaaatacattgccgtggactcccccaaagaatgcaacttttcacaggatactagggagatatttgagaagtgctttgctaacaatgaagtacctgccgacgtagacgtcctgtgtgccattagccatgtgatgggcctattaatggacgggtatcaccgatttgtgagttctgttaatgagaaaaagtactccgccacatatgcccacaatgactctgctacggaacaagatctcaaaaacgagtctacaacttctttttcgtcattaggcgtggaggatatttctgaagatagaaattcgtatcttaagaagcctgatatcaatggtttgtcaactatcattcaagaaacgtctgcaaacacgaccaatgagtcgcaatgcagcgatcgcacttctcggccaagcgagtcctcttcctcactcaacactaccagctcgacctacaagaataccagcactagaaatctgcaaaaaccgcaaaatacaggaattctcaactcggggaaaggtttattgcaaaaacttaactttgttaaaaaacggaaatctttcaaacagccttcaggcgtcatttgtagccattataacagcaatgttcaaaaccgtttgaaaggacaaaacagtcatcaacaaagatag

SEQ ID NO: 2002 - DNA, 930 bp, Saccharomyces cerevisiae
atgtcaaagtttgttatcacctgcatagctcatggagaaaatctcccaaaagaaaccatcgaccagattgcgaaagaaattactgaaagctcggcgaaagatgtatcaatcaatggtaccaagaaactatcggccagagctaccgatatattcattgaagtcgcaggatcgattgttcaaaaagacctcaagaataagctgacgaacgtcattgacagtcataatgatgttgatgttattgtttctgtcgacaatgaatatcgtcaagccaaaaagctctttgtctttgacatggattcaacattaatctaccaagaggtcatcgaattgattgccgcttatgctggtgttgaagaacaagtgcacgagatcacagaaagagccatgaacaatgaacttgatttcaaagagtctttaagagaacgcgttaaattattgcaaggcctccaagtcgatacactatatgatgaaataaaacaaaagctagaggtcaccaagggtgtgccagaactatgcaagttccttcacaaaaaaaattgcaagctcgctgttttaagcggtggttttattcagtttgccggttttatcaaggatcagttaggtttagatttttgtaaggcaaacttgttggaagttgacactgatggaaaattaaccggtaaaacactgggtcctatcgtagacggacagtgcaagagtgaaacccttctgcaactatgtaatgactacaatgttccagttgaagcaagttgtatggtgggtgacggtggtaacgacctgccagccatggctaccgccgggtttgggatcgcatggaacgccaagccaaaggtgcagaaagctgcaccttgtaagttgaataccaagagcatgactgacattttatacattcttggttacaccgatgatgaaatatacaatagacaatga

SEQ ID NO: 2003 - DNA, 930 bp, Saccharomyces cerevisiae
atgtcagaagaccagcgtgtaattagtcaaccaattgaattacataagctgtcgattgtcgataaacactcccaaggacagcagcaacagccgcatcaaaaacaacatgaagtgcagcctgaatcaaaatcaccaagggttacgacacctttaaagcccaaaagacttgctatacctatatcaagtccgcaaagatctacgacaaatcagtcacccgtgagcgaccacgcaagtccgatttcaacagaccaagatttaatatataaattagctgcaaaacacagagaaatcaatgaacttagtttcaaattagaggtcgcccaaaaagaattaaaacaattagagttacagttcaaagatacactgccccgaaatggacaacagaaattaggtaaccagaacccaagtgaatacctctctacttttaccaaaagaattcaacagacatttgtggacgtaaataattcaccaaatatgctcaagggaaaaaagagtataaacgatttttttagtaagcccaataataatgttaatagcaacataaataacactctacccaatcgtaaaccgaaccctccgcctaatcggtcacaacgtatgcaaaatattgctccaagccgtagttcagaatcaactccaacatcgggtcctcccttgctacccccaaggaatactatgaagaatgctaataccacggcaactgctggggagaacacaccattcttacaaagaatacttaacaaattcaatcaaatgaatatggaagaggacgaattcgatgaccttttggaaaagaggaaaagtaagaaagatcactattacataaaagaaaatttgggttacgaatacgatgaagtacgcagtgaagacgaggatgatgaagagtttgaacccatgggtgacatacccgttcatttatttaaaaggtag

SEQ ID NO: 2004 - DNA, 930 bp, Saccharomyces cerevisiae
atgtctcacacagaaacacagactcagcagtcacacttcggtgtggacttccttatgggcggcgtttctgctgccattgcgaagacgggtgccgctcccattgaacgggtgaaactgttgatgcagaatcaagaagagatgcttaaacagggctcgttggatacacggtacaagggaattttagattgcttcaagaggactgcgactcatgaaggtattgtgtcgttctggaggggtaacaccgccaatgttctccggtatttccccacgcaggcgctgaattttgccttcaaagacaaaattaagtcgttgttgagttacgacagagagcgcgatgggtatgccaagtggtttgctggaaatcttttctctggtggagcggctggtggtttgtcgcttctatttgtatattccttggactacgcaaggacgcggcttgcagcggatgctaggggttctaagtcaacctcgcaaagacagtttaatggattgctagacgtgtataagaagacactgaaaacggacgggttgttgggtctgtaccgtgggtttgtgccctcagttctgggtatcattgtctacagaggtctgtactttggcttgtacgattctttcaagcctgtgctgttgacgggggctctagaggggtcctttgttgcctctttcctattaggttgggtcattaccatgggtgcttccactgcgtcgtatcccttggatacggtaagaagaaggatgatgatgacttcgggccagaccatcaagtacgacggtgctctggactgtttgagaaagattgttcagaaagagggcgcgtattccttgttcaagggctgtggtgccaacatatttagaggagtcgctgcagctggtgtcatctcattgtacgatcagttgcaactcataatgtttggcaaaaaattcaagtga

SEQ ID NO: 2005 - DNA, 930 bp, Saccharomyces cerevisiae
atgtctgccgttttcaacaacgctaccctttcaggtctagtccaagcaagcacctactcacaaactttgcaaaatgtcgcccattaccaacctcaattgaatttcatggagaaatactgggccgcatggtacagttacatgaacaatgatgttttggccaccggtctaatgttctttttattgcatgaatttatgtatttctttagatgtttgccatggttcatcatcgaccaaattccatactttagaagatggaagttacaaccaactaagattccaagtgctaaggaacaactatactgtttgaaatccgttcttctatctcatttcttggtcgaggccatccctatctggaccttccacccaatgtgtgaaaaattaggtattactgtcgaagttccattcccatctttgaaaacaatggctctagaaattggtctattcttcgtcttggaagatacatggcattactgggctcaccgtctattccactacggtgtcttctacaagtacattcacaagcaacatcacagatacgctgctccattcggtctttctgctgaatatgctcatcctgctgaaactttgtctttgggttttggtaccgttggtatgccaattctttacgtcatgtacactggtaaattacacttgttcactctatgtgtatggatcaccctaagattattccaagctgttgactctcattctggttatgacttcccatggtctttgaacaagatcatgccattctgggctggcgctgaacaccacgatttgcatcatcactactttattggtaactacgcttcctctttcagatggtgggattactgtctagacactgaatctggtccagaagctaaggcctccagagaagaaagaatgaagaagagagctgaaaacaatgctcaaaagaagactaactaa

SEQ ID NO: 2006 - DNA, 930 bp, Saccharomyces cerevisiae
atgttctggaaaaaggatcccaccgtcagttgggaaagaaaaaatatcaatgacattgattttagtcgttttaatgtggccataattggtggcacaggtggacttggacgtgcaataagtagagagctggcccaaagaaatgccagggttactgttgtcgggcaaacttttagggacgaggacctaaaagataaaattaactttgtcaaggctgatttaagtttagtgtcagaatgcaagcgtatatctcatagtgatgaaattccctacgaggagttaacacatctgattttcactacgggtatttttgcatcacgccagagacaagctacaagtgagggtttggaaaaagacatggcagtgagctatttgagtagatacattatcttccatgatgtggcgaagcgattaggaattagtaggacaaaaaaagacgatttgccaaaagttttcatagcagggtttccaggaaatggtcaggtgggagacccagatgacttgaattctgatgaaaagaagtatagtgcctacgctacacatatgaacactgtggcagccaatgaaagtctggtcatagacgctaaagacagatacacgaatatagatactttcggtttgaaccctgggctgatcaaaacgaacattcgtaataatcttcttggcagtgacacctacctcagccgcattacagaatggataatcagctggacctgtcaaagcgcagagacgtatgcgaaaacaatatgcaccctgattgcgagccccgctatcgaatcacgcagtggtacaatgttcagcaacaaaggcgatgctattttaccttcgcctggtttgaccaaagatgttgttgagaagtttatggaaaattcggaacttctagttgaaaaggccttgcgtaatcaaagtcctttcacttccagtaacgaatga

SEQ ID NO: 2007 - DNA, 930 bp, Saccharomyces cerevisiae
atgttttcaaatctatctaaacgttgggctcaaaggaccctctcgaaaagtttctactctaccgcaacaggtgctgctagtaaatctggcaagcttactcaaaagctcgttacagcgggtgttgctgccgccggtatcaccgcatcgactttactctatgcagactccttaactgccgaagctatgaccgcagctgaacacggattgcacgccccagcatatgcttggtcccacaatgggccttttgaaacatttgatcatgcatccattagaagaggttaccaggtttaccgtgaagtttgtgccgcctgccattctcttgacagagttgcttggagaactttggttggtgtttctcataccaacgaagaggttcgtaatatggccgaagaatttgaatacgatgacgaacctgatgaacaaggtaaccctaaaaagagaccaggtaagttgtccgattacatccctggcccatacccaaacgaacaggctgcaagagctgccaatcaaggtgccttgccacctgatctatctttgatcgtgaaagctagacacggtggttgtgactacattttctctttgttgaccggttatcctgatgaacctcctgctggtgtggctttaccaccaggttctaattataacccttacttcccaggtggttccattgcaatggcaagagtcttgtttgatgacatggttgagtacgaagatggtacccccgcaacgacatctcaaatggcaaaggacgttaccacctttttaaactggtgtgccgaacctgaacatgacgaaagaaagagattgggtttgaaaacggtgataatcttatcatctttgtatttgctatctatctgggtgaagaagttcaaatgggccggtatcaaaaccagaaaattcgttttcaatccaccaaaaccaagaaagtag

SEQ ID NO: 2008 - DNA, 933 bp, Saccharomyces cerevisiae
atgaatagatcacctggtgagttccaaaggtacgcaaaggcgttccaaaaacaattgtccaaggtacagcaaaccggaggcagaggtcaagtgccttcaccaaggggggcatttgcaggcttgggaggtttgcttttactcggaggtggtgcactgttcattaataatgcactgttcaatgtagatggtggtcatagagccattgtttattccagaatacatggtgtttcctctaggatatttaatgaaggtactcacttcattttcccttggcttgacacaccaattatttatgatgtgagagcaaaacctcgtaatgttgcttctttaacaggtaccaaagacttacaaatggtgaatatcacctgtagagtactttcaagaccggatgtggtgcaattgcccaccatatacagaaccttaggtcaggattacgatgaaagagtgttgccttccattgttaatgaagttttaaaggctgtagtggcccaatttaatgcgtcacaattaatcactcaaagagaaaaagtttccaggttgattcgcgagaatttggttcgtcgtgcaagcaaattcaatatcctactggatgatgtttctattacgtacatgactttttcgccagagtttacgaacgctgtagaagcaaagcaaattgcccaacaagatgctcaaagggctgcatttgtagttgataaagccagacaagaaaaacaaggtatggtagtgagggcacaaggtgaagccaaatccgccgaactgattggtgaagccatcaagaaatcaagagactacgtggaattgaaaagattagatacagccagggacattgcaaagatcttggctagctctccaaatagagtcatcttggataatgaagcattgttgctaaataccgtagtggatgcaagaatcgatggaaggggcaaataa

SEQ ID NO: 2009 - DNA, 933 bp, Saccharomyces cerevisiae
atgaatttattacgaatgaatgctttaacaagcaaggctaggtcaatagaacggttaaaacaaacattgaatattttatccattcgtaatcatagacaattcagcaccattcaacaaggcagcaaatataccctcgggtttaagaaatacttgacattattaaatggagaggttggttcttttttccatgatgtccctttagatttgaatgaacatgaaaagaccgtaaatatgattgttgaagtaccaagatggacaactggaaaatttgaaatatccaaagaacttaggttcaatccgatcgttcaagatacgaagaatggcaagcttaggttcgtgaacaatatctttccctatcacggctatatacacaactatggtgctattccccaaacatgggaagatcccacaattgaacataaactggggaagtgtgacgtggctttgaaaggtgacaatgatcctcttgattgttgcgaaatcggttcggatgttttggaaatgggttccattaaaaaggtcaaggtattaggatcactcgctttaattgatgatggagaattggattggaaggtcatagtgatcgacgtaaatgatcctttatcctctaaaatagatgacttggaaaaaattgaggagtactttcctgggattctagatacgactagggagtggtttagaaagtataaagttccagcagggaagccattaaatagtttcgcctttcatgaacagtatcaaaattccaataaaaccatccaaactataaagaaatgtcacaattcgtggaaaaacctcatttcaggatcactccaggagaagtatgacaacctgcctaatacagaaagggctggtaatggtgtcacacttgaagatagtgttaaacccccttctcaaataccgcctgaggtgcaaaaatggtattacgtttaa

SEQ ID NO: 2010 - DNA, 933 bp, Saccharomyces cerevisiae
atgacaaccagcatactcgatacttatcctcaaatatgctcccccaatgctttgccaggtactcccggcaatttgactaaggagcaagaggaagcgcttttgcaatttaggtcaatcttgttagaaaagaattacaaagaaaggctggatgattctacgctattgcgatttctacgggcaaggaaatttgatatcaatgctagcgttgagatgtttgtagaaactgaacgatggagggaagaatacggtgccaacactattatcgaggattatgaaaacaacaaggaagccgaagacaaagaaagaatcaaattggccaaaatgtaccctcagtattaccatcacgttgataaggatgggagaccattgtacttcgaagaactaggaggaattaacttaaagaaaatgtacaagatcactaccgaaaaacagatgctaagaaacttagtcaaggagtacgaattatttgccacgtaccgggtcccagcgtgttcgagaagagctggctaccttattgaaacttcgtgcactgtgctggacttgaagggtatctcactttctaatgcttatcatgtgctttcctatattaaagatgttgcagatatcagtcaaaattattatcctgaaagaatgggtaagttttatattatacacagtccatttggtttctcgacgatgttcaagatggttaaacccttcttggatccagtaaccgtgtcaaaaatctttattcttggctcttcttataaaaaggaattattaaaacaaattccaatcgagaacttgcctgttaaatatggtggtacatctgtcttgcacaaccctaatgataagttctactattccgatattggtccctggagagaccctagatacatcggaccagaaggtgaaattcccaacatttttggtaaatttactgttaccagctaa

SEQ ID NO: 2011 - DNA, 933 bp, Saccharomyces cerevisiae
atgacatctatagataatagacctttgccgttcatataccagttcacagccggtgccattgccggcgtctcggagctattggtgatgtatccattggacgtggtgaagacaagaatgcaattacaagtgacaaccaaaggtcatcccgctgttgttgcagcgaaagcagcagtagatcactacacgggcgtgatggattgtcttacaaaaattgtgaagaaggaaggattttcgcatctttacaagggtatcacatcgcctatattaatggaggctccgaaaagagcaattaagttctccggaaacgatacattccaaacgttttataaaaagattttccccacgcccaatggggagatgactcaaaaaatcgccatatacagtggtgcgtccgctggcgccgtggaagcctttgtcgtcgcgccttttgaactagtgaagattagattacaggatgtgaattcacagttcaagacacccattgaagttgtaaagaatagtgttgtgaaaggtggtgttttgtcacttttcaatgggttggaagccactatctggagacacgttctttggaatgccggttatttcggtataatattccaaattcggaagcttttgccggcggctaaaacaagcacggaaaagaccagaaatgatttgatcgcaggtgctattggtggcactgtcgggtgcttgttgaatacaccatttgacgtggtaaaatctaggatccaaagaagttccgggccgctgaggaagtacaactggtccctgccttcagtgctgttagtttaccgtgaggaagggtttaaagcattgtataagggatttgcgccaaaggtcatgagacttgcccccggtggtgggttattgttggtagttttcacgaacgtcatggattttttcagagaagtcaagtatggtaaaaaacaatga

SEQ ID NO: 2012 - DNA, 933 bp, Saccharomyces cerevisiae
atgagtacaaatacggaaatcataaaaaatagtgatttgcaaagtttaatcaatgataagaggaggttaataaatgaaataaaagactttaataaatccattaaacccttggagtttgaatcgtatcaggattatttcctgataaaaacgttcaaaaaaggaatatctgcaagtggccatgtggatattgacagtttaagaaataaagaatatggaatatactacaagaaaatcaagaggaactctacacaagaagtcggcgaaccaatccctcgcaacacatcctcctcctcctcttctactagatcaaactcatcagctgatatcagcgatacagaatattcaggtgagaacactcctacaactactggtgctgccagtcgaagaagacgtacgagatctcgagctattcaaagagaaaatagtctaccagcatctttaccctcaattagtgaagcgaatgcaaacaatgatgatgttactatttctgaaataaatggaagtgaattgccatttccaattccaatatcagaagtggaaaatattgacattgcttcagatataactgaaagggatggtattagaaggagatcatcaaggatatcagaaagagacaaaagacgttcacagtctagactggggtcagaagaagatgaagaaggcgacggacatgacggagatgaaggggagaccaaaatccaagacctatatgagagtttggtacccaaaattttggagtcacgtagaaggtctgattggatcctccctcctaaggcaagatatacaccagaaaagcaaatgaggaccaaaccgtcattcaagagcataaagattaatgaacttgtcgggaataaaagaatacgaagtatattatctagatttgaaggtggtgtagcgggtatacgcaaaagagattgggactctacccaatag

SEQ ID NO: 2013 - DNA, 933 bp, Saccharomyces cerevisiae
atgatctctgaaaaggctgctaccgctttagctactatagcaacagtttgctggtgtgtccagctaattccgcaaataatatataattggaaaaaaaaggactgtacggggctgccaccactgatgatgttcctctgggttgtttccggaattccatttgccatatatttctgtgttagtaaaggtaatgtcattttacaagttcaaccacacctttttatgttcttctgttctataagtttcgtccaatcgtgttattatccaccaatcagtatggcgagatccaaaatagtaatgattgtagctgctattattgcggctgatgttggcatggaagttggctttatattatggctgaggcccctttacgagaagggtgttaaatggcccgatctgatttttggtatttctgcatctgttttgttagctgtcggactgcttccaccttactttgaactagccaaaaggaaaggtcgtgttattggcatcaactttgccttcttattcatcgattcattaggtgcttggctatctatcatcagtgttatcctaggtaatatggatattatgggtattatattatactcaatagttgctggaatggagttaggaattttcgcgtctcatttcatatggtggtgtaggtttagattcctagctaaaggcaatacttttgacgaagaaagtggccaagctcaaaaggaagaacccgatgaaaaaatcgaacaagatattagcaagagtgaccgaaatgttactaactataacctggataactgttcaatccccgacgatgcttcgagctttgcagacgattttaatatatacgatagtactgatggggggacgttatcaagagcccaaacattgcatgctgtccatggagttgtggttagaacagatcctgatcgttattcgaggctaagtgtgtaa

SEQ ID NO: 2014 - DNA, 933 bp, Saccharomyces cerevisiae
atgattagatctacactaagtagttggagagaatatcttacccccataacgcacaaatctacctttttaaccacaggtcaaataactcctgaggagtttgtacaagcaggtgattatttatgtcatatgtttcccacctggaagtggaacgaagagtcgtcagatattagttacagagattttttaccgaagaataagcagtttctgataattagaaaagttccctgtgataaacgtgccgagcaatgtgtcgaagttgaagggccagatgtaatcatgaaaggttttgcagaagatggagatgaagatgatgttctggaatacataggatctgaaactgaacatgtgcaaagtacgcctgcgggggggaccaaggactcatctatcgatgatattgatgagctaatacaagacatggaaataaaagaggaggatgaaaatgacgatacagaagaatttaatgctaaaggtggcctagccaaagatatggcgcaagaaaggtattacgacctttatattgcgtactcgacatcttatagggtccctaaaatgtatatagtggggtttaattctaatggttcaccactaagccctgagcagatgttcgaagatatatcagcagattatagaacaaagacagccaccattgaaaagctacctttttacaagaattcagtgttatctgtttccattcatccatgtaagcatgctaatgtaatgaaaatattgctagataaggttcgtgtggttagacaacgaagaaggaaagagctgcaggaagaacaagagctggacggtgtcggagactgggaggatttacaagacgatattgatgattcgttacgggtagaccaatacttgattgttttcttaaagtttattactagtgttacaccgagtatacaacatgactataccatggaaggttggtaa

SEQ ID NO: 2015 - DNA, 933 bp, Saccharomyces cerevisiae
atgccgtccaataatagcagttttttagatattgacgatgatctcgagggtgtagatgattttggcaacgagcccaacccatttgatgatgccaccgtacctgatagcccaaacatgaataactcgactgctggaaagggtagcgaattttataacacaacgggcagtaaggcagaatccgcaccattacagggtcaaatggacccaccagcgtacgaccaagtgataggacagaatgacaacgacggtcttgggcgtaatggattgaggccaggattgataaactactattctaaatacttccagatcgatttgacgcagttcaaaaagagattgtccgcggtactgacgtttagaaacgatcataattccgaaagtaacgaagataacactgatttatacggtgctgtatggatcactgccacggtggtaatgatcaattttaccatgagtagggggttaaattttattatcagtgacgtaattgagggcgtcaagactggtgaggacatcgacagggccagtcagtttaagaagctactgcattctatttggctattttacgggtacacgttcggcgtaccatttattaccatgcaagtattgaatagagatgagcactcggagcgcaatagaagcttcaaaagtgttcctgaattgatttccgtttacgggtacgctaacttgatctggatacccgtttgtgttatattgaatatattggatatgtccaagcgcctgaggactgttcaagcaattcaatgggcaattgtggctcttgggtgggcacagtcgtcttatttcttgaattctcaaatatcgagtaataataatacggagacacaatcgaacgggaaattttcgctgtccatcatcgttgtcgttgcgctgcatactttattctgtctattgttcaggtttataatattttga

SEQ ID NO: 2016 - DNA, 933 bp, Saccharomyces cerevisiae
atgcctatcaccataaaaagccgctctaaagggttaagggacactgaaattgacttatccaaaaagcctactttagatgatgttttgaaaaaaatctctgctaataaccacaatatcagcaagtacaggataagattaacctacaaaaaggaatctaaacaagttccggttatttcagaatcgttttttcaagaagaggctgatgactcaatggaattcttcatcaaagatttgggtccccaaatttcatggagattagtcttcttttgtgagtatttgggtccagtcttggttcactcccttttttattatctatctaccattcccacagttgttgatagatggcacagtgctagctccgactataatccatttttaaacagggttgcatattttttaattttaggacattatggaaagagattatttgaaaccttatttgttcaccaattctctttagctactatgccaattttcaacctgttcaaaaattgtttccattactgggttctaagcggtctcatttcattcggttactttggctacggcttcccctttgggaatgctaagttattcaaatactattcatatttgaaattggatgacttgagtacattaattggtcttttcgtgctttcagaactatggaacttttattgccacattaaattgcgcctatggggtgactatcaaaagaagcatggtaacgctaagatccgtgtcccattgaatcaaggtattttcaatctttttgttgctcccaactatacttttgaagtttggtcttggatttggtttacttttgtgttcaagttcaatttatttgccgttttatttttgactgtttcaacagctcaaatgtacgcatgggctcaaaagaaaaacaaaaagtatcataccagaagagcattcttgattccatttgtattttga

SEQ ID NO: 2017 - DNA, 933 bp, Saccharomyces cerevisiae
atgcgtttaatcagtaaagttttggtgaaaacaaattgcctagaggtaggtatgaggagggccccacaatggtattctcactactctactacagcgggcaatgctcgtgtgaacaagaagggcagcaaagtagtgcctgtgttaacagggttagcactggcatccatattcgcgaagaaatggtatgacgattcccagatcaaaaaggcggatgccaccagcgttgcagtggacgcatccatctctgcgttccctaagaagatgggccccccacagtggcccttctccacgcaatatgagctgattggtaagggtgtacgttgtgtctcatcgatcactttcaaagcatatggtctgggcatatatgtggccgctgaagacaaacatctggtctctgaagtactggactcaaagttcctgtctcaggcgttcatcgacactgcggcacccccatcaccggaaaactcacatcaggataatttgcgtgcggctttgaacgatcctgctaaggcccctatcctgattaataacctcttagacagcggaatcagactaatgtccaagaatactccgataaaagcaggttccttcaagttattgatggacggcaccaaaaagagcgtcctaaagaacccagattctcagtctcaagacaaagaccggctggaagctggattccaagaattgcatgactgtttcaggagcgtaaaaggacttgtggctcgagatgatgattttttcattgagctgaataaggactgctctatgaatttgtcttactacgcaagaaagaaggatgaatttgtgatattgggcacagtgaaggaaccccttattggaaagctcttatttgcccactacctagctgctgtggatcctccttctccggaggctaggaaggaagtaatcgatgcactcgtctctctatcttag

SEQ ID NO: 2018 - DNA, 933 bp, Saccharomyces cerevisiae
atggaattcttttatgaagaacaagtagcttgtatcgaagatgataaaataagcaactctcataccaaggaaactggatcaacagaaaacactgaaaataacgaacttcagagccgagatgacaaaacaaatgaggccttccaaaagttagaagaggaagtcaataaacgatatgaaaagactacaagtgcattcaaaaagttagtaatcgagaaagatgacggaattgaaattaacttgccaattagcaatgaaactacagagactgcacaaaagtatttgaagaaactagacgagaatattcacagcgtggaaagtctagcccagtcatattggagcaaaatgaaaactaagaatttttggtctggcttcagtagcttcgataatgctgcagaaaatgactctaatgacaaggatgagaattcgaaagaaaatgaaattgctgtgggtggaaatagaacagaagccgaactaaggacattatctaaagataaatcggtttatttagacaataaaatggatttgcaactggacccgtttgacgtggatgaaaaaactgaggagatatgttctattttacagggcgacaaagatatctccaaattaatgaacgacatcgtaccccataaaatcagctataaagatttctggcacatctatttcttacaaagaaacaaaattctagataaagaaagtaaaaggaaagaaatattgtccaaaaaggaaaaggaaacggaggaaaaagaagttgagtgggatgacgaagaagaagaagaagatgatgacaaagtagaagcagtagctgacaacaaatctaaaggggagacgaaagttgctgtgtctcaagagggattgaaagatgttagtgaccatgttggcctcgccaacaaggatgagagcaaggacgacgacgacgatgatgactgggaatga

SEQ ID NO: 2019 - DNA, 933 bp, Saccharomyces cerevisiae
atgggtaagagcagcaaagataaaagagatttgtactatagaaaagcaaaagagcagggctatagggctagatctgctttcaaactacttcaactcaatgaccaatttcatttcctggatgatccaaacttaaaaagagttgtagatttgtgtgcagcaccaggttcatggtcacaagtgctctcgagaaaactgtttgatgaaagtcccagttcagataaggaggacaggaaaattgtctctgtcgatttacaaccgatgtcccccatacctcatgtgacaacgttgcaagccgatatcactcatcctaaaacattggcgaggattctaaaactgtttggcaacgaaaaggccgattttgtttgtagtgatggtgcacctgatgttactgggttacacgatcttgacgaatacgtgcaacaacagttaattatgagtgcgctgcaacttactgcatgcattctgaaaaaaggtggaacttttgtggcaaagatcttcagaggtcgtgatatagatatgctatattcccaattgggctatctattcgataaaatcgtttgcgcaaagccaagatcatcaagaggtacatctctggaagcttttattgtttgtttaggctataacccaccatccaattggacaccaaaattagatgtaaatacatccgttgatgaattttttcaaggctgttttttgaataaattgtgtatatcagacaaattgtctcattggaatgaagaggagagaaacatagccgaatttatggcttgtggaagtcttcaaagtttcgactcagatgccacttatcatgacctaccttcttcggttgcaggcacttcatcgtccttagatcctgttcaaagcccgacgaaccctccctacaagaaagctttggaattaaaaaggagcgggaaactcactagatcagtttga

SEQ ID NO: 2020 - DNA, 933 bp, Saccharomyces cerevisiae
atggtaagtgattggaaaaatttttgcctcgagaaagcctctaggtttcgcccaacaatagataggcctttttttaatatttatttgtgggactatttcaatcgtgcggttgggtgggccactgcaggtcgcttccagccaaaggattttgagtttaccgttgggaagcagcctttgagtgaacctcgtccggtactgctttttattgccatgtattatgtggttatatttggcgggaggtccctggtaaagtcatgtaaacctctcaagttgagatttatttctcaagtccataacttgatgttgacttctgtttcctttttatggttgattttgatggtggaacagatgctacccatagtgtatcgccatgggctgtattttgctgtttgtaatgttgaatcgtggacgcaaccgatggagacattatattatctcaactatatgacaaagtttgtggagttcgcagacactgtcttgatggtgttgaaacatagaaagttgactttcctacatacataccatcatggtgctacagctttactgtgctataatcaattggttggttacacagcagttacatgggttcctgtcaccttaaacttagctgttcacgttcttatgtattggtattatttcctttctgctagcggaattcgtgtttggtggaaagcctgggttacaagactacaaattgtgcagttcatgcttgatctcattgtcgtttattacgtgctttatcagaagattgttgctgcatatttcaaaaatgcttgtactccacagtgtgaggattgcttaggttcaatgacggctattgctgctggtgcagccattcttacatcctacttgtttttgttcatctctttctatattgaggtttacaaacgtggaagtgctagtggtaagaagaagatcaacaaaaacaattaa

SEQ ID NO: 2021 - DNA, 933 bp, Saccharomyces cerevisiae
atgtcgtcaaataataggaagaaactgcttctgatgggccggtccggctccggtaaatcgtcaatgaggtcgatcatctttagtaactactccgcttttgacactaggagattgggtgccaccattgatgtagagcactcccatttgagatttcttgggaatatgactctaaatctgtgggactgtggtgggcaggacgtgtttatggagaattatttcaccaagcaaaaagaccacattttccagatggtgcaggtgttaattcacgtttttgatgtagagtcaactgaagttctcaaggatattgaaatatttgcaaaagctttgaagcaattaaggaagtactctcccgacgccaaaatttttgttcttctgcataagatggatcttgttcagttggataagagagaggagctgttccaaatcatgatgaaaaacctgagtgaaacgtcttcggaatttgggtttcccaatctgataggttttcctacttcgatttgggatgagagtttatacaaggcatggtcgcagattgtatgctcgctaatacccaatatgtccaaccatcaaagtaatttgaagaagtttaaggagattatgaacgcccttgaaattattcttttcgaaagaacaactttcttagtgatatgctccagtaatggcgaaaatagtaatgaaaatcatgatagttcggataataataatgtcttgctagacccgaagcgattcgaaaagatatccaatataatgaaaaacttcaagcagagttgcacgaaattgaagagcggattcaagactttaatattgaacaacaacatctacgtcagcgagttatcgtccaatatggtgtgttttatagtgttgaaagatatgaatattccacaagaattagtattggaaaacatcaaaaaagccaaagagtttttccaatga

SEQ ID NO: 2022 - DNA, 933 bp, Saccharomyces cerevisiae
atgtcttacagaggacctattggaaattttggcggtatgccaatgtcatcatcgcaaggaccatactctggcggtgcacaattcagatcaaaccagaaccaatccacttctggcatcttaaagcaatggaagcattcttttgaaaagtttgcctccagaattgaggggctcactgacaatgcagttgtttataaattgaagccttacattccaagtttgtcaagatttttcattgtggccaccttttatgaagattcgtttaggatcttatcacaatggtcagatcaaattttttatctgaataagtggaagcattacccatacttctttgtcgttgtgtttctagtggttgttaccgtttccatgttgattggcgccagtttgttagttttaagaaagcaaaccaattatgccaccggtgtgttatgtgcttgcgttatttctcaagcattagtttatgggttgtttacgggttcatcatttgtcctaagaaactttagtgttattggtgggttgttaattgcattcagcgattcaattgttcaaaacaagacaacattcggtatgcttcctgaattaaacagcaaaaacgacaaagcgaagggttacctgttgtttgctggtagaattttaattgttttaatgtttatcgctttcactttcagtaaatcatggtttactgttgttttgaccattatcggcacaatatgtttcgccattggttacaagacaaaattcgcatccattatgttgggtttgatactaactttttacaatatcacgctaaacaactactggttttataacaatactaagagagatttcttgaagtatgagttttaccagaacttaagcatcattggtgggcttctattagttactaatactggcgctggtgaattatccgttgatgaaaagaagaagatttactag

SEQ ID NO: 2023 - DNA, 936 bp, Saccharomyces cerevisiae
atgactgcaagcacaccatccaatgtcatgacattgttcttgttaaggcatggacaaagtgaattgaatcacgagaatatattctgtggttggattgacgctaagctaaccgaaaaaggtaaagaacaagctcgtcattctgccgagctaatcgaacaatattgtaaagctaataatttgagattaccccagattggttacacctcacgtttaattaggacccaacagaccatagaaacgatgtgtgaagaatttaagttaaagccacaactgcaggttgtttacgactttaataaaatcaaacttggagacgaatttggcagtgatgacaaggataatatgaaaatcccgattcttcaaacttggaggctaaatgaacgtcattacggttcctggcagggccagaggaaaccgaatgttttaaaagaatatggtaaggataaatatatgttcattaggagagattacgagggtaagccaccacctgtagatcttgaccgtgagatgattcaacaagaaaatgagaagggctcttctactgggtacgaattcaaggagccaaacagacaaataaaatatgaattggaatgcagcaatcatgacattgtattaccggattccgaatctcttcgtgaagtggtttatagattgaatccttttctacaaaatgtcatattaaaattagccaatcaatatgatgaatcttcatgcctgattgtgggccatggaagttcagtgagatcgctactgaaaattctggagggtatatcagatgatgacatcaagaatgttgatattccaaatggtatccccttagtcgttgaattagataagaataatggtcttaagtttatcagaaaattctacctagatcctgaatctgctaagatcaatgctgagaaagtccgtaatgagggtttcataaaaaatccttaa

SEQ ID NO: 2024 - DNA, 936 bp, Saccharomyces cerevisiae
atgagtgatatcttgaacgtaagtcaacaacgtgaagcaattaccaaggccgctgcgtatatttctgctattttagaaccacatttcaaaaatacaacaaatttcgagcctccgagaactttgattatatgtggttcagggcttggtggaatatctaccaagctgtctagagacaatccacccccggtaacagtcccataccaagacatcccaggattcaagaaaagtacggttccaggtcattccggtacactaatgttcggatctatgaatggttcaccagtagtattaatgaatggtcgtcttcatggatatgaaggcaacacattgtttgagactacttttcctattagagtgcttaaccacatgggtcatgttcgtaatttaattgtcactaatgccgctggtggtataaacgcgaaatatcaagcctgcgatttgatgtgcatttatgatcatttaaatatccctggccttgctggccagcacccattgagaggtcctaacttggatgaagatggacctcgttttttagccttgagtgatgcatatgatctggagttgaggaagcttttatttaagaaatggaaagagctcaagattcaaaggccactgcatgaaggtacttatacttttgtatctggacccactttcgaaacaagagcagaatccaaaatgataaggatgttgggaggagatgctgtcggaatgagtactgttcccgaagtcattgttgcaagacattgcggatggagggttttggccttaagtttgattaccaatacttgcgtggtggatagccctgccagtgcgttggacgaatcacctgtacccttagaaaaaggcaaagcgactcacgctgaagtactggagaatggtaaaatcgcctctaatgacgtgcaaaacttaattgctgccgtaatgggggaattataa

SEQ ID NO: 2025 - DNA, 936 bp, Saccharomyces cerevisiae
atgctacgtataactgtcaaaactttgcagcagcgggcatccttccatcatagcttcaaacatattagcgttcctgatcttcatacccgtgctcaaaatgatcaaacaaactgttattgccaagaaataaacgcaaggctgccttcaaaaactgatccattagatcctcatatcaagcttcctcatagaacgcccaattacaataagcatgttttgctgttatcaccgggtgataggtttgctcaaccatggaaggtagcatggaatcataatttggatactaatacaaatcggccatataatgccattagtaaattgcgctcccatttaggtggttctccaggaatactaataaatgcggtgcatttgcaaaatgaatttattccaaggccaaaacaacacgatgaatggctttatttttttgttattcctgacatgaagctttatgtaattaaggaaacggacatcgaggaatttgcatcttttttagatgaaggagctattcaagcaccaaagctatccttccaggattatttaagcggtaaggccaaggcttcccaacaggttcatgaagtgcatcatagaaagcttacaaggtttcagggtgaaacttttctaagagattggaacttagtctgtgggcattataagagagatgctaagtgtggagaaatgggacccgacataattgcagcatttcaagatgaaaagctttttcctgagaataatctagccttaatttctcatattgggggtcatatttttgctggtaatgtcattttctataaactattcggcagagaaaagatgcaaaacaagctggattcattatggtttggtaaagtttacccacacaacttgaagctgttatgtgaaaacttggaaaacggtaaaatcatcgacgaaatgtacagaggtggcatatcgatgaattaa

SEQ ID NO: 2026 - DNA, 936 bp, Saccharomyces cerevisiae
atggaaaaagcttccttgaacattgctcagacaaaggaaataccactgacagataggcgaatggggctccgaggatggaaggcgtgcagtaggccgcatttactaggtcgaatattgcttttcatgagcatactatttattacaagtgcggaattaagtagcgacgtaagctccagagaagtatatatgccgatattcaataataagctgtcgttcaaagtgccgcctattaaacgctcgttgctgctaggagcagccctgtacgaagatttcgaatatagctctaacaacagtgcttctgacggagcgttctgtaccgtgtttaatgcaggcatgaatgacgcgtctagggaggttgtttttgaaatccatgtaatggacgtgttgcaagaagaaacagactccagcaggttcggaggaaccagtcacgagcgtgggaggcaatcactgggcttcagtgtttttaataacaagaatggtgatttgttaagaagcaagaaaaatctagcgagcgggacgtcggtcatcgaagttaatcctgggaactgtaatgagttcttgatatgtttcataaatttagtctatgacggatcgtggagctcgattgatactgaaaaatctgtaacgataaagatgacctacaatgataagctcgatcctgacatgttgttgcatttggtcaatcaaatgacaccgcaggtggtgaaagcattgaataccgtctctgacggccttttccagatagtgagcgataccacacttcttcaaatggaaagtgataggcgagatataaatgaggcgacgtatagttatctgattgtggggtttgtgtcgcttatggtagcacagctgatatccaatattatagttactacctatttgattattaagatcaaaagtaatccttcatctcatatcaaaaagaaaggtttgtaa

SEQ ID NO: 2027 - DNA, 936 bp, Saccharomyces cerevisiae
atggcggttcaacaaagaaagaagaaagagggtagaaagtccgataaaaatgccccatcggtcccacaagtagatgcatcattagacaaaccacttgatattgatgctcctcctactatttacagtgttaatttgaaaccagaatatggtacagctgcattgaatttgtccgcggatttcatcagacaagaacaggcattggctaataagtatttgttcttccatcccgtcatccttgttgttctaaccattgggctgcttatttacttgacgccaagaattgtctttccgataaggaatacaggatccgttgctggatggttctaccagctggctcgtattaataagaaggtcgtcctcagcggtttagtgttcaccgcaattggtgcatctttcttgttcaccctcctctcacgtgtatctgactcgtatttcaagtcgaagatcaaccaacttgttggttctaaaggtgagaaagttttcggcatcaatttgaatgatttggtggcaagacatgaaacaaaggatccagtggtgaacaatacgcatatcatcgtttatagagaaacgcccattgcattgatttcgttagcccctaacatgacattaagtactgatgaaaatttagtcatgagtgttactactgtgggttgtcgtcgtgtatatgtaaaaagtggcattatcgaagatttgattgattgggctatgctacactccaaaaatattagaagcagcggcaaatacggggagaccatgaaactcttgattgatgtctactcattcgatagcacgcttaaggaaattttgaagaaaaaagggttcacttatattcaaagcattagagtctctgaaaatcgactactaggcggtttgttcggtgtgaagaaggaattatggggtttgcaattccattttaaagccgaacacaaggactag

SEQ ID NO: 2028 - DNA, 936 bp, Saccharomyces cerevisiae
atggtatctagaggccccgacgaatggcttgaaacaataaagaaatgccaggcgctaactgaaaacgagatgaaacaactgtgtgaaatggtgaaagaacttttgatggaggaaagtaacatccagccggtacagacccccgttactgtatgtggagacatacacggccaatttcatgacttgttagagctattccgtacggcgggtggctttcctgacgatataaactacatttttctcggtgattacgtggatcgtggctactatagtctggaaacttttacgcttttaatgtgtctgaaagtcaagtacccggcaaagataactttggtcagaggaaaccatgagtccagacaaattactcaagtttacgggttctacgaggaatgcctgaataagtacggatctaccaccgtatggaagtattgctgtcaagtttttgatttcctgacgctggccgctataattgacggtaagatcttatgtgtccatggagggttatctcccgagattagaatgctcgatcaaatcagagtcttgtcaagagctcaagaagtgccacacgagggtgggttctcggacctgctttggtcagaccctgacaatgtagaggcttggcaagtttcccctcgtggtgcaggatggctctttggcagtaaagttgctagagagtttaaccacgttaatggactgaaccttattgcccgggctcaccaactggttatggaggggttcaagtaccattttcctgaaaaggacgttgtaaccgtgtggtccgcgccaaattactgttatagatgtggtaatgtcgcgagtgtaatgaaggtcgatgaggatctggaacctactttcaaaattttctcggctgttcccgatgactacataagagaatccacggcaaaccataataatcaaagagccggctatttcttataa

SEQ ID NO: 2029 - DNA, 936 bp, Saccharomyces cerevisiae
atggtcgatcaccagtggacgccactgcagaaggaggttatctcaggtctgtccgcgggatccgtcaccacattggtagtgcatccattagatttactgaaggttcgtttgcaattatccgctacaagcgcacaaaaggcccattacggcccatttatggtaatcaaagagattatacgttcgtcggcgaatagtggacgtagtgttacgaacgaactgtatcgcggattaagcataaatttgtttggaaatgccattgcatggggagtttatttcggtttatatggtgtcacgaaagaattgatatacaagtcagtggcaaagccaggggaaacacagcttaaaggtgttgggaacgaccacaaaatgaattcgcttatttatttgtctgccggtgcttccagtgggttgatgacagctatcctaacaaaccctatctgggttataaagaccaggataatgtctacaagtaaaggcgcccaaggagcgtacacttctatgtacaacggtgtccaacaactgttacgaactgatggcttccagggcctatggaagggccttgtacccgcactgtttggtgtttcgcaaggtgccttatattttgcagtttacgataccttaaagcaaagaaaattgcgacggaagagggaaaatgggcttgacatccatttaacaaatcttgaaaccattgaaatcacatcgttgggaaaaatggtctccgtcactttggtttacccttttcaattattgaaatcaaacttacaaagtttcagggccaatgagcaaaaatttaggctctttcctttgataaaattaatcattgctaatgatggttttgttggactttataagggcctatctgcaaacttagtacgggccattccatccacttgcattaccttttgtgtatacgagaaccttaagcataggctttag

SEQ ID NO: 2030 - DNA, 936 bp, Saccharomyces cerevisiae
atgtctgtgtctgctgctcctgctattccacagtactctgtctctgactacatgaaattcgccctagccggcgccatagggtgcgggtcgactcactccagtatggtcccgatcgatgtcgttaagacgagaatccaactggaacctaccgtgtacaacaagggtatggtcggctctttcaagcaaatcatcgccggagaaggtgctggtgcgttgttgaccgggtttggtcctactttgttgggttactctatccaaggtgccttcaagttcggtggttacgaagtgttcaagaagttcttcattgacaacttgggttacgataccgcctctcgctacaagaactctgtttacatgggttctgctgccatggccgaattcttggcagacattgccttgtgtcccctagaagccactagaatcagattggtctcccaaccacagttcgctaatggactcgtcggagggttttccagaattttgaaagaagaaggtatcggctctttctacagtgggttcactccaattttgttcaagcaaattccttacaacattgctaaattcttggtctttgaacgtgcctccgagttctactacgggttcgccggtccaaaagaaaaattgtcctctacttccactactttgttgaatttgctttccggtttgactgctggtttggccgctgccattgtttcccagccagcagacactctgttgtccaaggtcaacaagactaagaaggctcctggccaatccacagtcggtttgttggctcagttggccaaacagttaggatttttcggttcctttgctgggttgcctactcgtttggtcatggttggtaccttgacctccttgcaatttggtatttatggttctttaaagagcactttgggttgcccaccaaccattgaaattggtggtggtggtcattag

SEQ ID NO: 2031 - DNA, 936 bp, Saccharomyces cerevisiae
atgttgtcaagaattgtatcaaacaatgcaacacgctccgtaatgtgccaccaagcgcaagtgggtattctttataagactaacccagtgagaacttatgctactttgaaagaagtggaaatgcgtttgaaatctatcaaaaatattgagaagatcacaaaaactatgaagattgttgcatctacaagattgagtaaagctgaaaaggctaaaatttccgcaaagaagatggatgaagcagagcagttgttttacaagaacgccgaaaccaaaaatttggatgttgaggctactgaaacaggtgctcctaaagagttgattgttgctatcacctctgataaggggttgtgtggttctatccactctcaattggctaaagctgtgagaagacatttgaatgatcaaccaaacgccgatatagtcactattggtgataaaattaaaatgcagctattgagaacccatcctaacaacattaaattgtctattaatggaattggtaaagatgccccaactttccaagaatctgctttgattgccgataagttattgagtgtcatgaaggccggcacttacccaaagatttccattttctacaatgacccagtgtcttccctatcttttgaaccatctgaaaaaccgatctttaacgccaagaccattgaacaatccccatcattcggcaaatttgagatcgacacggacgcaaacgttccaagagatttgtttgaatatactttggctaaccaaatgttgacagcaatggctcaaggttatgctgctgaaatttccgccagaagaaacgctatggataacgcttccaagaatgccggtgatatgatcaatcgttactctatcttgtacaacagaacaagacaagctgtcattactaatgaactggttgatattattactggtgcttcctctttgggatga

SEQ ID NO: 2032 - DNA, 939 bp, Saccharomyces cerevisiae
atgaatataatgaaaagacaattatgcacctcctctaagcgatttttttctacagcaaaaaacgttgtcaaatataatacgattcaggatatcaggaacaaatattttactggtacgcctttgtcgatgtgtactgcgtatgacttcattactgcaacatgggttaacaaggctaattgtgatttactcttagtcggagattctttggcgatgacttcattggggtacgatagcacaattacactatccttgaatgagtttaaatatcatgttgcctctgtgtgcagagctgaaggttcttccatggtagtggtagacatgccattcggtacgtttgaatcgggcatatctgatggcttgaagaatgccatagatatcatgaaattggacagtaaagtcacctcagtcaaagttgaagtcggttcttacaccaaagacaaatatgcaatgaaatttattgaagaactgtgctcccggggtatacctgttatggctcatataggactaactccccaaaaagttcattcacttggaggttataaagtgcaaggtagcaaaagtctattacaaatgcaggagctgtatgaaaccgccatgcaactacaaaaaattggctgttggtctatcctgattgaatgtgtcccccataagatggctcagttcataacatctaaactctcagtaccaacaataggtatcggtgcaggtaacggtaccagtggacaagttctagttatatctgaccttctcgggatgcaaggcgattctgtcccaaaatttgtgaagcaagctgtaaatatgacagatattgccactcagggcttgaaggagtacattgcaagtgtagaggataggacatttcctgagagaggtactcatactttcaaagttaaggaggacttatggaatgaattcctctcttcaattaacgaaaagtaa

SEQ ID NO: 2033 - DNA, 939 bp, Saccharomyces cerevisiae
atgactgctcaacaaggtgtaccaataaagataaccaataaggagattgctcaagaattcttggacaaatatgacacgtttctgttcgattgtgatggtgtattatggttaggttctcaagcattaccatacaccctggaaattctaaaccttttgaagcaattgggcaaacaactgatcttcgttacgaataactctaccaagtcccgtttagcatacacgaaaaagtttgcttcgtttggtattgatgtcaaagaagaacagattttcacctctggttatgcgtcagctgtttatattcgtgactttctgaaattgcagcctggcaaagataaggtatgggtatttggagaaagcggtattggtgaagaattgaaactaatggggtacgaatctctaggaggtgccgattccagattggatacgccgttcgatgcagctaaatcaccatttttggtgaacggccttgataaggatgttagttgtgttattgctgggttagacacgaaggtaaattaccaccgtttggctgttacactgcagtatttgcagaaggattctgttcactttgttggtacaaatgttgattctactttcccgcaaaagggttatacatttcccggtgcaggctccatgattgaatcattggcattctcatctaataggaggccatcgtactgtggtaagccaaatcaaaatatgctaaacagcattatatcggcattcaacctggatagatcaaagtgctgtatggttggtgacagattaaacaccgatatgaaattcggtgttgaaggtgggttaggtggcacactactcgttttgagtggtattgaaaccgaagagagagccttgaagatttcgcacgattatccaagacctaaattttacattgataaacttggtgacatctacaccttaaccaataatgagttatag

SEQ ID NO: 2034 - DNA, 939 bp, Saccharomyces cerevisiae
atgagaatacaactaaatacaattgatttgcaatgtattattgcactttcctgtctggggcaatttgttcacgcggaagctaatagggaagatttaaagcagatagactttcaatttcctgtattggaaagggcagctacaaaaacgccttttccggattggcttagtgcatttaccgggttaaaagaatggcctgggttagatccaccttatatacctttagatttcattgatttcagtcaaattccagattataaggaatatgatcaaaaccattgcgacagtgttccaagggactcgtgctctttcgattgccatcactgcaccgaacacgatgatgtgtacacatgttccaaactttcccagacatttgacgatggtccttctgcttccactactaaattattggaccggttgaagcataattccaccttcttcaatttaggtgtcaatatagttcaacatccagatatctatcaaagaatgcaaaaggagggacacttaatcggctcacatacctggtctcacgtatatttgccaaatgtatcgaatgaaaaaattatagctcaaattgaatggtccatctgggcgatgaatgctactggcaaccatacccccaaatggttcagacctccatatggcggaatagataatagagtaagagcaataacaaggcaatttggcttacaagccgtcttatgggatcacgatacttttgattggagcctccttctcaatgattctgtcataactgaacaagaaattcttcaaaatgtaataaactggaacaagtcaggaaccggattaatattagaacacgattcaacggaaaaaactgtcgatcttgccattaaaataaataagttgataggtgatgatcaatcaacagtttctcattgtgtcggcggaattgattacataaaagaattcttgtcctaa

SEQ ID NO: 2035 - DNA, 939 bp, Saccharomyces cerevisiae
atgcctcgtctcttggccacgcagtctcatgttgtacatggatatgtgggaaataaggctgcaacgtttcccttacagtgtctaggctgggatgtggattgttgtaacagtgttcagttttccaaccataccggatatggtttagataaagtgtttgggactataacgagggaaacagatttgaaggaactcttatcaggtctttttgataatttttcccaagactaccaagccttactttcaggctacttgcccaataagaattccgttcgatgtatgggaacatactacgctaaatttaaagaggcgaatccagaaatgatatggcttatggatcctgttatgggtgacgaaggacaattatatgttagtgaggatgtcataccagaatatagaaagctggctttgtctccaaaacagctagtcgatataataactccgaatcaatttgagctggagatactttatgggggggaaatcaagactaaagaacatttgaagaaggccttaaagaaattacaccaaactatcccagtgatcattgtcacatcctgtgactgtaagatgtttgatgacaaagattttatttattgcgtagcttcaatggagggtaaaacccccattgtttacagagtgccgtttattgattcgtatttcactggggttggtgatttgttttctgctttgttattggatcgagtgtataagatcttatcgaaccctacaacaacattaaaatttgaagaccaagtcaataatgttcttaatgttattcagaaggttttgaaaattactaggagctatgcttcaggaaaaatgaaagcaaaaatgggttccgccttggaaatgaaagaaatggaattgcgtcttattgaatcaagagatatatatgaaacaatcaacattcatcaaacagattatatttacgcaaggttgtga

SEQ ID NO: 2036 - DNA, 939 bp, Saccharomyces cerevisiae
atgcctgctacgttaaagaattcttctgctacattaaaactaaatactggtgcctccattccagtgttgggtttcggcacttggcgttccgttgacaataacggttaccattctgtaattgcagctttgaaagctggatacagacacattgatgctgcggctatctatttgaatgaagaagaagttggcagggctattaaagattccggagtccctcgtgaggaaatttttattactactaagctttggggtacggaacaacgtgatccggaagctgctctaaacaagtctttgaaaagactaggcttggattatgttgacctatatctgatgcattggccagtgcctttgaaaaccgacagagttactgatggtaacgttctgtgcattccaacattagaagatggcactgttgacatcgatactaaggaatggaattttatcaagacgtgggagttgatgcaagagttgccaaagacgggcaaaactaaagccgttggtgtctctaatttttctattaacaacattaaagaattattagaatctccaaataacaaggtggtaccagctactaatcaaattgaaattcatccattgctaccacaagacgaattgattgccttttgtaaggaaaagggtattgttgttgaagcctactcaccatttgggagtgctaatgctcctttactaaaagagcaagcaattattgatatggctaaaaagcacggcgttgagccagcacagcttattatcagttggagtattcaaagaggctacgttgttctggccaaatcggttaatcctgaaagaattgtatccaattttaagattttcactctgcctgaggatgatttcaagactattagtaacctatccaaagtgcatggtacaaagagagtcgttgatatgaagtggggatccttcccaattttccaatga

SEQ ID NO: 2037 - DNA, 939 bp, Saccharomyces cerevisiae
atgcctgctactttacatgattctacgaaaatcctttctctaaatactggagcccaaatccctcaaataggtttaggtacgtggcagtcgaaagagaacgatgcttataaggctgttttaaccgctttgaaagatggctaccgacacattgatactgctgctatttaccgtaatgaagaccaagtcggtcaagccatcaaggattcaggtgttcctcgggaagaaatctttgttactacaaagttatggtgtacacaacaccacgaacctgaagtagcgctggatcaatcactaaagaggttaggattggactacgtagacttatatttgatgcattggcctgccagattagatccagcctacatcaaaaatgaagacatcttgagtgtgccaacaaagaaggatggttctcgtgcagtggatatcaccaattggaatttcatcaaaacctgggaattaatgcaggaactaccaaagactggtaaaactaaggccgttggagtctccaacttttctataaataacctgaaagatctattagcatctcaaggtaataagcttacgccagctgctaaccaagtcgaaatacatccattactacctcaagacgaattgattaatttttgtaaaagtaaaggcattgtggttgaagcttattctccgttaggtagtaccgatgctccactattgaaggaaccggttatccttgaaattgcgaagaaaaataacgttcaacccggacacgttgttattagctggcacgtccaaagaggttatgttgtcttgccaaaatctgtgaatcccgatcgaatcaaaacgaacaggaaaatatttactttgtctactgaggactttgaagctatcaataacatatcgaaggaaaagggcgaaaaaagggttgtacatccaaattggtctcctttcgaagtattcaagtaa

SEQ ID NO: 2038 - DNA, 939 bp, Saccharomyces cerevisiae
atggataattgtaatgcctgggacaaattattgtctcagaatgaatccacaatcaacagcacagagactgctacgataacagcaatcatatattccccatcaagtaaaacactgcatcaatttataaatatctgttttccagagggaagcaattcaatactggataccactttgattaattacgccaccataggatggaccaacgacttaaaggaaaattattctgtcgatgtttacacgctaataagaaacactgacgatgcactagatcttctaaagccgtttttacaagaacatagttcgaaggttcgctggctcatattattagattggacactgaacgaccaaaagttgtggctgaatgaactatcctacgcattcaataaaattaagcaactgaatgacgataatgaattttctgtatggtgcttaaacagtggcgaaatattaaacttacaaagacacactacagtatggcagtcagtacatattgacttcattttgcaaacgttaagatcgttttgctattttaatgatagctcactattctatatatgcgaagaccataccgaagagaaacgagaggaagcacaaaggcttaaataccaagagcttctaaagcatttttgtgaagatagagatatgaaagatcatattgaaatggtcaaacgcagtgagatattaataccgaaggggtgcgattctattggattgataaaaacagtagacgaaagatttgagcctactgaggtgaaagagcaacactttttggcccgatatatggactttataccaacaattgataaaatcagagaagataggaaaacaacctctggtatcgaccttgataaactatatcctttagaagttttcaaagttaatattcaagaggaattaggcaaaatgttcgcaaaatatagggaaaattcgaggatttag

SEQ ID NO: 2039 - DNA, 939 bp, Saccharomyces cerevisiae
atgggaggcattcgtgaaaagaaagctgaatactttgctaaattaagagaatacttggaagaatacaagtctttgttcgttgttggtgttgacaatgtttcttcccaacaaatgcacgaagtcagaaaggaattgagaggcagagctgtcgtcttgatgggtaagaacaccatggttagaagagccatcagaggtttcttatccgacttgccagacttcgaaaagttgttgccttttgtcaaaggtaacgttggtttcgttttcactaacgaaccattgactgaaatcaagaacgttattgtctctaacagagttgctgctccagccagagctggtgccgttgctccagaagacatctgggttagagccgtcaacactggtatggaaccaggtaagacttctttcttccaagctttgggtgtcccaaccaagattgccagaggtaccattgaaattgtttctgatgtcaaggtcgttgacgccggtaacaaggtcggtcaatctgaagcttccttgttgaacttgttgaacatctctccattcactttcggtttgactgttgttcaagtttacgacaacggtcaagtgttcccatcttctatcttggatatcaccgatgaagaattggtttctcacttcgtttccgctgtcagcaccattgcttctatctctttggctattggttacccaaccttgccatctgtcggtcacactttgatcaacaactacaaggacttgttagctgttgccattgctgcttcctaccactaccctgaaattgaagatttggttgacagaattgaaaacccagaaaagtacgctgctgctgctccagctgctacctccgctgcttccggtgacgctgctccagctgaagaagctgctgctgaagaagaagaagaatctgatgacgacatgggtttcggtttattcgattaa

SEQ ID NO: 2040 - DNA, 939 bp, Saccharomyces cerevisiae
atgggccgtacaacttctgagggaatacacggttttgtggacgatctagagcccaagagcagcattcttgataaagtcggagactttatcaccgtaaacacgaaacggcatgatgggcgcgaggacttcaacgagcaaaacgacgagctgaacagtcaagagaaccacaacagcagtgagaatgggaacgagaatgaaaatgaacaagacagtctcgcgttggacgacctagaccgcgcctttgagctggtggaaggtatggatatggactggatgatgccctcgcatgcgcaccactccccagctacaactgctacaatcaagccgcggctattatattcgccgctaatacacacgcaaagtgcggttcccgtaaccatttcgccgaacttggtcgctactgctacttccaccacatccgctaacaaagtcactaaaaacaagagtaatagtagtccgtatttgaacaagcgcagaggtaaacccgggccggattcggccacttcgctgttcgaattgcccgacagcgttatcccaactccgaaaccgaaaccgaaaccaaagcaatatccgaaagttattctgccgtcgaacagcacaagacgcgtatcaccggtcacggccaagaccagcagcagcgcagaaggcgtggtcgtagcaagtgagtctcctgtaatcgcgccgcacggatcgagccattcgcggtcgctgagtaagcgacggtcatcgggcgcgctcgtggacgatgacaagcgcgaatcacacaagcatgcagagcaagcacggcgtaatcgattagcggtcgcgctgcacgaactggcgtctttaatccccgcggagtggaaacagcaaaatgtgtcggccgcgccgtccaaagcgaccaccgtggaggcggcctgccggtacatccgtcacctacagcagaacgtgagcacgtga

SEQ ID NO: 2041 - DNA, 939 bp, Saccharomyces cerevisiae
atggttcctgctgaatctaatgctgtacaagcgaaactcgctaaaaccttacaaagattcgaaaataagatcaaagctggagattattacgaagcgcatcaaacgttgagaactattgctaatagatatgttagaagtaaatcatacgagcatgccatagaactaattagtcaaggggccctttcatttttaaaggcgaagcagggcggttcaggcacggatttgatcttctatcttttagaagtttatgatttagcggaagttaaagttgatgacatctcagttgctagattggttagattaatagccgaattggatcctagcgagcccaatttaaaggacgttattactggtatgaacaattggtctatcaaatttagtgaatacaaatttggagatccttacttgcacaacaccattggtagcaaactattagagggagatttcgtttatgaagctgagagatattttatgttaggtacacatgattcaatgatcaaatatgtcgatttactatgggactggttatgccaagttgatgatatcgaagatagcacggtggctgagttcttcagcagattggttttcaactatttattcatctctaacatatcatttgcacatgaatcaaaagacatttttttggaaagatttattgagaaatttcaccccaagtacgagaaaattgataaaaatggttatgaaatagttttttttgaagattattccgacctaaattttttgcaattgttgctaattacctgtcagactaaggataagagctatttcttgaatttaaagaaccattatttagatttttctcaagcttacaaaagtgagttagaatttttgggccaggaatatttcaatattgttgctcctaaacaaacgaatttcctacaagacatgatgtcgggattcctgggcggatcgaagtga

SEQ ID NO: 2042 - DNA, 939 bp, Saccharomyces cerevisiae
atggtttcattgactacaatagagcaaagcccagtcaaatgcgagacaaccactgagaaagagagcaatgatactagggggacagattcgaacgagaatgcagagacaaaagaaacaaagaagggttttccattccatgacttggcaaaattgcagaaacagtacaaaaataaatccagtaggaacgagtcactagtagcactaatatatctcttgggttcgatgctgtcattttgtctcctaatatttttcacggacttttatttgatacctttgttccccaccaccactacaatgacagactacattgtattcaatttttatttattgaacgtttttgtattttgtatggtgcatttcatttatcacttcgtcaaaaatatttctctacaacaacatctcgaacattggcagaagttttcgtatttatcgaatatcaacttattgatatcatcacaaatcacaattctttattatctattctatgattacgtgtttttcttcaaaatttttacccttttaatgaacttcataggattagtggcatacttttttatattgacggacaaactcatttcctcgaaaagattcaataaaacagttttcttcatttcggtatcagtagtgtgttgttccttgccactattaaccgcaataatcacctttgatggtttagaaaacctgaaagagaggataaaagtgaacgcaattacgtgggaacttgtggctttggtagcggcatctataatttacgttaccaggttccctgaatcattgttcagacgaaataaaaaggaagaaggttggaatcattccgagtaccttttccatctcttgatttctggtacggctttttaccattttttcattttgattcaatcttatattttgatgcattcaagtttgaatcagcccgaattaattaatttcaagtcttag

SEQ ID NO: 2043 - DNA, 939 bp, Saccharomyces cerevisiae
atgtcaaaagaagacatagaaggaactaacattctagacgaacctgtccacgggatctatattcctgccgcgctattcgttgttggtgttgcaatcaccacgtatatgtctggtgaattgaaaatcctgtggagtttacccattctcttcatgatcatcttcgtcagagcatactctgcctacaaaagaagaagatcactgtatccagataggtggacttcgttagaattggaagatcaaaccataatttccaagaataccgccctgtatcgttttaagttgaagacaagactggaaagcttggacattcccgctggtcatcatgttgctgtacgcgttccaattgacggcaaacaagaggtcagatactataatccgatcagttctaaactagaaagtggatacttggatttggtggtgaaagcatacgttgatggtaaagtctccaaatatttcgctggcttaaattctggtgacaccgtggatttcaaggggccaataggtactttgaactacgaaccaaattcctccaagcatttaggtatcgtagccggtggttctggtatcacgccagtcctacagatcttgaatgaaatcatcaccgttcctgaagatttgacgaaagtctccctgctatatgccaatgagactgaaaatgacattctattgaaggacgaactggatgagatggccgaaaaatacccacatttccaggtccattacgtggtacactatccatccgacagatggaccggagatgtcggctacatcaccaaggaccagatgaacaggtatctgccggaatattcggaggataacagactcttgatctgtggacctgatggaatgaacaacttggcccttcaatacgctaaagaactgggctggaaggtcaattcaacgagaagttctggcgacgatcaagtcttcgtcttttaa

SEQ ID NO: 2044 - DNA, 939 bp, Saccharomyces cerevisiae
atgtcatttcaccaacagttctttaccttgaataatggaaataaaatccccgcaatcgccatcattgggacaggtactagatggtataaaaacgaagaaacggatgctaccttttcgaacagtttggtcgaacagattgtttatgctctgaagttacctggcattattcacattgatgctgctgagatctacagaacatatccagaagttgggaaggcacttagcctcaccgaaaaaccaagaaatgcaatattcttgacagacaagtactcacctcaaatcaagatgtcagattccccagcggatggactagatttagctttgaagaagatgggcactgactatgtcgatctataccttttgcatagcccatttgtttccaaagaggtcaacgggttaagtttggaggaagcctggaaggacatggagcaattgtacaaatcaggtaaagctaaaaatatcggtgtttccaactttgctgtggaagacttgcaaagaattctgaaagttgcggaagtcaagccccaagttaatcaaattgagttcagtcccttcttgcagaatcaaacaccagggatctacaaattttgccaagaacatgatatattggtagaagcatactcgccactaggtcccttacaaaagaaaacagcacaagatgactctcaaccgtttttcgaatacgtgaaagagttatccgagaaatatatcaaatctgaagcccaaattatcctacgttgggtgaccaaacgtggcgtgttgcctgtaaccacctcttccaaacctcaaagaatttctgacgcgcaaaatttattctctttcgacttgacggctgaggaagtcgataagataacggagttgggcttggaacatgaaccgctaagattgtattggaataaattgtacggtaaatacaactacgctgctcaaaaagtataa

SEQ ID NO: 2045 - DNA, 939 bp, Saccharomyces cerevisiae
atgtcgatagtagagacatgcatatcttttgtttcgacaaatccgttttatccattttgtactggattgcttctgaattgtgtggttacacctctttacttttggaaaacgcaaaatggtagaatcgtggtcgtttcattgctgcaattcgtagtactttatgccacagcgtttatttcgattggaactgataaatctctttacagaaataaatgggtcgcgctaccgctatccaagaagacccgcatttctcgtaatactagtctgtactgcttcaagttaaagtacccatttgaaagattgcatattcccatgggataccacctggcagtaagggttacaataaatggtgagcgattagtgaggtactatacgccagtaaatgttcctaatacggagggtcacttggaattagtagtcaagacgtataaacatggtgtcgtttctaagtattttgataaattaaaaattcgccagtatgttgaatttaaagggccgttaggtgagctggaatatgatcaggacaccgcaacagagttgggtataatcgcaggggggtctggtataacccctgtattgcaagtgctgcaagaaatcataccctctccagaagacctaacacacatttctttgatatacgcaaacgaaacagaggatgacattctcatgaaatcgcaactagaccacatggctaaggagtacccgcattttaaagttcattatgtaattcataagccaaacggtaaatggaacggtgatgttgggtacgtaactctagaggaaatgaaaagatacctacctaaacaagcggaggaccatcgtttattgatttgcggaccacctaaaatgaatgaaatggttttgaattatgcaaaggagttggggtggagtaatgggtttcacaaaggtaatggaaccgataaagtttttgttttttaa

SEQ ID NO: 2046 - DNA, 939 bp, Saccharomyces cerevisiae
atgtgcattttaatggccacaagggcacatcctgactatgaactcatcttaatatctaacagagacgaattcttggcaagaaaaacacatgctacatgctggcataacaatgattttatcctttcaccctacgatctggccaaaacctcagcagaaaaacaaatatttggcacttggtctggcataaataaagaaggaaaattagccactattcttaatttaaaacttgacaatgagcaaaataatacgaaatcaagatcccgtggtctgttaccatttatatttttgtcgatccataaagcagattttgaagattgggataattacaaaaagtttgaaggtcactatgatgggttgaagtccacaggtgattttaattttttttacggcgacgttatcaaaaagcaatataaagttattgattctctaggaagaacttttgatgtgttgagttctacctgtaggaaagatcttgattcttacatggttgtttctaatggtaaattttatgacagctccagtataccagggcaggcttgggaaaaagtaaaggtagcacgtgatagtttagaaaatctagttttagagaatattgaatcagatgaggagaaaataatatcaagttgctttcaactcgcctcgaagtcttcccttccaagcactatttcaaacccagatgtcttgcagatggtagatccaaatgtaaccatgaataccatatacgtaccacctttacggaggcctcccagggatgacttaggtgcctcaattcctgatggtgattactacggaactcgctctcaaatagttttactcgtgagtaaggattcaacgagagttacctttatagaaagggtcctttatagctcagatgaagacgtgcgcaagtattcggtaacctcacctaaggaggaaaaaaggtttaaattcaaattgtaa

SEQ ID NO: 2047 - DNA, 939 bp, Saccharomyces cerevisiae
atgttaattggtgtaagtggtacgaaattttgcggatgcgaagatgttattaacatgttggttgatcattttcattttgaattactcaatcacctagataatccagaggagatattagattatgctacgaaaaattacacaaaaaattcagttatattcctagaaaaattatcattactggagaaactggaaaagagaccattttttgttcatctttctatcgacgctcctgtcactacaagggtagcattatacaggaaaacgactcaagcagaaagcttatcattagaacaaataatacaagccattgatcaacatgactttcagcctgaaggcatcaaattaagggagaaatcccatttgagatttaaaatagttaatgaggaccgcagaggaaggagacagagcttgattaataacattaccacacaattaaagattctcgatgacaaagagaaacaaatggctccattaatgaggcctagttgggatagctattttatgaagttagccacactagcagcatctcgttccaattgcatgaaacgtagagttggttgcgtgattgtgagagaatgcagagtgattgctactggctataatgggactcctcgacatttaacaaattgtttcaatggcggttgcccacgttgcaatgacggtgattctagaaatctgcacacttgcttatgcttacatgcagaagagaatgcactactggaagctggcagggatcgtgtaggtcaaaatgcgaccttatactgtgatacttgcccttgcttaacatgttctgtaaagattgttcaaacaggcatcagtgaagtagtttatagccaaagttatagaatggacgaggaaagtttcaaggtcttgaagaatgcgggaataaccgtccggcaattcagctttacggaagaaccaagaattgtgatgatttaa

SEQ ID NO: 2048 - DNA, 939 bp, Saccharomyces cerevisiae
atgttgttaagatctagatttttgaaggttattcatgtgaggaaacaattgagcgcctgttcaagatttgcaattcaaacacaaacgagatgtaagagcacagatgcttctgaagatgaagtgaagcatttccaggagctagcccctacttggtgggatacagacggatcacaaagaattctacacaaaatgaatctaactaggttagattttgtgcagaggactgtgaggaaccaggttaaaattcagaatcctgaaatatttgtccctggatttaattacaaggagtttctaccagaatacgtctgcgacaatattcagcgggaaatgcaggaaagcatagagactaatctagataagaggccagaagtgagcgtcttggatgttggatgcggtggtggcattttgagtgaatcgctcgcgagactaaaatgggtgaagaatgttcaagggatcgatctgactcgcgattgtatcatggtagcaaaagagcatgccaagaaagaccccatgctggagggaaagataaattatgagtgcaaggctctggaggatgttactggacaatttgatattatcacctgtatggaaatgctagagcacgtggatatgcctagtgaaattttaaggcattgttggtcgaggttaaatcccgaaaaaggtatactctttttaagtactataaacagagatctcatctcatggtttactacaatttttatgggtgaaaacgtcttgaagatcgtcccaaagggtactcatcatttgagcaaatacataaactcaaaggaaatccttgcctggttcaatgacaactacagtggccaatttcgcttgttggatctcaaggggaccatgtacctcccatatcaagggtgggttgagcacgattgttccgatgtcggtaattattttatggctattcagagactgaattga

SEQ ID NO: 2049 - DNA, 939 bp, Saccharomyces cerevisiae
atgtttagtaaatacctcgtaactgcatcttccctctttgtggctttgacctctgcagcatctaccgttgatctagatgctctgcttcttctaccaggggtcgagtcccacgacggcgttgatactgtattttcgaccaaagacttttatcaagtgtcattcgtcaaatccattgctcctgctatcgtaaacagctccgtaatcttccacgatgtttctcgtggtgtggctatgggcaatgtcaagagcagagcaagtatcttcaacccagaggaaacgtattacgattgggaacagtaccaagtagtaaataacggagactggcgaaccgaatgggcacctgcctctgactgcatttggagggaggagaaggataacagcgacgaaacaccggacagattccccatctcggtgccatataattggacgtcacagtactcaattgtagattatgacacagacgctaacgaagacaatttagatttcaggtttattaaatcattgctagataagaaaaattggttgaaaaaaattaaccagactgtttcccaatccagtattatggtagcaccaatgattaggccatacaatgtggtccagctttggtattcaaaagatatggtttgggcaaacgtccaaagacaatattgtagcggtgtttatccaggagggactcaatgtagcgcttggtccaggtactaccatgttgatgcacccacctgcgatgagcctgtcgcctcttacatgaccaaaatgttggaaaatgaggttcagtgtcccaatgagagaaacgcaactaccctagagcctctccgcctgaataagcagggagactctgatttttctttgactttcgaggaagaggaagaggaagagacaggatctaaatctctttggagtacattgaaaaaaattttctctaaaagaagtataagttga

SEQ ID NO: 2050 - DNA, 942 bp, Saccharomyces cerevisiae
atgaagtttttgggtgtaatactgctagcaagttttcttttgattgctaccttcctcatagggcttatcccattgtattatattgataaacaaaaaagttccattgtcacaaaccaagaaggtgctgactcaatttctgattttactacgaacgcagatactcaaacgatcaatgacgatgttagtagttaccgtgtgaagattgccgttctatcacaattcggtataggaatgttgttaggtacatcatttatgttggtaataccggaaggtatcaaagcgtgtgtcgaacatgatggaaacgttggtgtgaatttattaattgggtttctaggtgtttatgttcttgataggttggttacactatgggtttctagaaagcaaacggtctatacgcatgatgctgtcaaatttcaaagctggaaagatataataaaccatccaagacaaatatggatgaacttaatacaaaacaatgttgtctttgccttattcattcatggactatctgatggaattgcattaggtacgacaacgaacaatgattcactgctcatagtggtgttaattgctatagttattcataaaattcctgccgttctttccctcactagtttgatggtatcgagacaaaacttaatgaaatgggaggtgatctgtaacgttttcttgtttgcgtcatcgactccgatcggatacatagtgttatcccttttgaatctgagtcattcgccaacgatggattggataagtggaaatcttctgcttatgagtggtggcagtttactatatgcgtctttcacagcatttgttggtggagattctcatgatcacgatctcagcgttgaacaggaagtcgttttacctcatgatgaatccgtttatgttttgataggtgtctgcataccgttggtgatatcgtactgcatctctgaagaataa

SEQ ID NO: 2051 - DNA, 942 bp, Saccharomyces cerevisiae
atgaataaacttgttgatgcccactgtcatgttataaccgacccagacaacacattctgcggtgatgatggagggtcccagggtacgttgcgttgcgttatgtcatcaaacccatatgactggaacaatttgaaaaaattggctggcagaagcacaagtaaaaacgatatatgcgtgggatttggtgtgcatccttggtacagccacttattttatgtgggaagtcggcgcgacaaggtttctcactatcaagatgtactggagtataagaatgaagaacagttcgacagtttggttcaggtgcttcccgaacctctagatcttgaagagtatataaaaagagagtttaacgacactttggttagtgtgattggagaaatcggtcttgataagctcttcagacttcctgcaaatggtttctacatgcagaacgagaaggcaaggcttacgacagtgaaggtcaaactatcgcatcaagaaacagtattcaggcgattttgccgactggcaaggcacacaagcaagcccatctctatacacgatgtaaagtgccacgggaaactaaacgatatctgcaatgaagagctcttgacgtatcactctgtcaagatatgtttacattcgtacacaggctccaaggaaacgcttctgggccaatggctcaagaagtttcccccggatcgtatttttgtgagcctatccaaatggattaattttaaggacccagaagagggagatgccctggtcaggagcttgccctcaacttgcatacttactgaaaccgactatcctattgacaatccagatccgtcataccaaaaggcccttacagagcagctgcagtatttgaatgcacaaatcgcacgagcatgggacgagacactggatgcctcacaagccgctttgcgtgtatacgaaaactttcagaaatttatcaagtga

SEQ ID NO: 2052 - DNA, 942 bp, Saccharomyces cerevisiae
atgatgcgtcgcacgctattacattcattcgctacgctgctactttctttgtcgttgtggtcagctgcggtcatggcagctgtgacaactcaggttacagtggtaacaaatgtcgcaggggccctggttacggagaccacaatatgggaccctgccaccgctgctgctgctgctacaactaccgctcaaacaggtttcttcactacggtattcactaccactaacgatgtcggaaccaccgtcactcttactcagacagtcaacagagccactatgctaccaaccacgacgacttctacctcatctactggtaagacaaccaccactgttcctaccgcaacttcatcgttgtcttcgggactgtatttatctacagttaccacgacaaacgatttgggtaccacagttacattgactcaaacgttcacacattctagcaccagtgctacttcatccgcctcctcgtctgtgtcctcgtctgtatcttcgtctggttcatcctccagtgtaaagacgaccacatcgacagggagcgcagtagctgaaacaggcaccaggccagacccctccacagacttcacagaacctcctgtgtctgctgtcactagtctatctattgactcatacattaccatcactgaaggtacaacctccacttacacaaccacacgtgcgccaacgtccatgtgggtcactgttgttagacagggcaacactatcactgtgcaaactacttttgtccagcgtttctcctcccagtacgtaacagtcgcttctccctccgtggggtctattgggatgggtactttaaccggtactgtaggcgttattaaatctgcaataaagaaaacagtttcgcataatgaggcccagcatctaggtatgagttcgtttacttcaattttgggtgggctattaacggttttaatttggttcttataa

SEQ ID NO: 2053 - DNA, 942 bp, Saccharomyces cerevisiae
atgccactggtgctttttacgggatacccatgtagtggtaagacaacgcttgctaaacatttggtacaactactacagtccaagatcgatgcaaccccatcattaagtaaatattccataacctatcattcagatgaatctttaggcataaaacattcagattatataacttcccaagatgaaagaaaattgaggtcggagatcatctccgcagtgaaaagagatctatctaaaaacaagatagtcattgtagactcgttgaattatatcaagggtttccggtatcaacttcactgcgaggtgaaaaatttgtccaccacattttgtgtaattcaaacactgtgtccaccagagactatattcgagtggaataagacttcaaacccgaacccttgggaacccgagttattgaatcaattgattcaacgatacgaagagcctaactcaagcaaccgatgggactctccactctttgctattcttactcctcaggacaacataactgactacatcgacgatatttgtaaagtagtctttcaaacttccaaatcggctaaaaacagtggacacaatgatccgttgagtaagggcttacaaaaaccgaactcagccacggtactaaagcctgcgtctcagtccaatttcatccaggttctcgacatcgaaactagtaagataataaaaaccataatgaaccacatcaaaagcctgacttctattggcggggtaagtaacggaacaagagtcattgtttccgaagggattaccgatatcaatgatgatggttgcttcttcgtagacttgcccattggtaacgtcgttacgttggcgcaattgcagagattgaaaaggcaattcattaacttcaacaaactaagagatatagatcaagataggatcggtccgcttttcgctgattatcttaacaaaaacttgaattga

SEQ ID NO: 2054 - DNA, 942 bp, Saccharomyces cerevisiae
atgcgtttctctactacactcgctactgcagctactgcgctatttttcacagcctcccaagtttcagctattggtgaactagcctttaacttgggtgtcaagaacaacgatggtacttgtaagtccacttccgactatgaaaccgaattacaagctttgaagagctacacttccaccgtcaaagtttacgctgcctcagattgtaacactttgcaaaacttaggtcctgctgctgaagctgagggatttactatctttgtcggtgtttggccaacagacgacagtcattacgctgctgaaaaggctgctttgcaaacctatttgccaaaaattaaagaatccactgttgctggtttcttggttggttctgaagccttataccgtaacgatttgactgcctctcaattatcagacaaaattaatgacgtccgtagtgtcgttgctgacatttccgattctgacggaaagtcatactctggtaagcaagtcggtactgtcgattcctggaatgttttggttgctggttacaattctgccgttatcgaagcttccgattttgttatggctaacgcgttctcctactggcaaggtcaaaccatgcaaaatgcctcttactcattctttgatgatattatgcaagctctacaggttatccaatctactaaaggttctaccgatattaccttctgggttggtgagaccggttggccaactgatggtaccaactttgaaagttcttacccatctgttgacaacgccaaacaattctggaaagaaggtatctgttccatgagagcttggggtgttaacgttattgtttttgaagcctttgatgaagattggaagccaaacacctctggtacctctgatgtcgagaagcactggggtgttttcacttcaagtgacaatttgaaatactccttggactgtgacttttcatga

SEQ ID NO: 2055 - DNA, 942 bp, Saccharomyces cerevisiae
atgctgagtagcagtagcaatagacccatatctgcccatctaaccatccattacaaggctattcaggaggaagagggggaggatatgagaagcggtgccggaagtggtggccatcatgacgactattttctggagagtaacagatctcccactcctaataagaaacatgagttcattaaaacggtgctcaatatcaacgataacgactctgaattttcggaatcgtgctcaccaagagagaagttacataacgagggggcttgtaatacagacctgttcggggacttcatgtctaaaagacaacagaggctgtctaattctatgaacatttacgacctttatcagtgtgtacataacctgtcgcctagcaacaacaaccatcagttcatagcaagaaggttcagcgattctcatattccctccttgcatcaccgccagcagcaacagaaggtaacaacaaaaaactttgtacagcccacgaaggacattcaaaggatcgcctcgtacgctgcggattcagaccagagagtcaagtatttaccaaactatcatcagtctgctccttctactgcactgtctgcggctgaatcgaaagcggctgtaccaagaaagctccctgacagagacagtacacaaaattacgtactaaaattgcaactctcgtcacccaactctcaaccaatgtcaccaaggactcgcccgggctaccgcccctcttgctcttcttccaattgctcgtcatcttcctcatcatcagcatgttcatccgtttccatctcagatccgaacaacataacagcatacgaaacgaataatgtcaaccctcagttccccagtaaccagccattagatatttctagtccttgtgcaaggcatcaccatagaagaaattctattgctgtaaaatttgacaaggctttatataagaaaacaacaggatag

SEQ ID NO: 2056 - DNA, 942 bp, Saccharomyces cerevisiae
atggctccgtatccatacaaagtgcagacgacagtacctgaacttcaatacgaaaactttgatggtgctaagttcgggtacatgttctggcctgttcaaaatggcaccaatgaggtcagaggtagagttttactgattcatgggtttggcgagtacacaaagattcaattccggcttatggaccacttatcactcaatggttacgagtcatttacgtttgatcaaaggggtgctggtgttacatcgccgggcagatcgaaaggtgtaactgatgagtaccatgtgtttaacgatcttgagcattttgtggagaagaacttgagtgaatgtaaggccaaaggcatacccttgttcatgtgggggcattcaatgggcggtggtatctgcctaaactatgcctgccaaggtaagcacaaaaacgaaataagcggatatatcgggtcaggcccattaataattttacatccgcatacaatgtataacaagccgacccaaattattgctccattattggcgaaatttttaccaagggtaaggatcgacactggtttagatcttaaaggaatcacatctgataaagcctatcgtgctttcctcggaagcgatcctatgtctgttccactatatgggtcgtttaggcaaatacacgactttatgcaacgtggtgccaagctctacaagaatgaaaacaattatattcagaagaacttcgctaaagacaaacccgttattattatgcatggacaagacgacacaatcaacgatcctaagggctctgaaaagttcattcaggactgtccttctgctgacaaagaattaaagctgtatccgggcgcaagacattcgattttctcactagagacagataaagtcttcaacacggtgttcaatgatatgaagcaatggttggacaaacacaccacgaccgaagctaaaccataa

SEQ ID NO: 2057 - DNA, 942 bp, Saccharomyces cerevisiae
atgggaaaaggtaaaaataagatgcacgaacccaaaaatggaagaccacagagaggcgctaatgggcacagttccaggcaaaaccataggcgcatggaaatgaagtacgataattcagaaaaaatgaagtttcctgttaaactggctatgtgggattttgatcattgcgatccaaagagatgcagtggtaaaaaacttgaaaggttgggcttaattaaatcattgagagttggacagaaatttcaaggtattgtcgtttcgccaaacggcaaaggtgttgtttgccctgatgatctagaaattgtcgaacaacacggcgcttcggtggtcgagtgttcttgggcacgtttagaagaggtacccttcaataaaataggcggtaagcacgaaaggctgctgccgtatttagtggccgctaatcaagtaaattacgggagaccatggaggctcaattgcgttgaggcattagcggcttgttttgctatcgtcgggagaatggattgggccagtgaattgttatcacacttctcgtggggaatgggatttttagaattaaacaaagaattgcttgaaatctatcagcagtgcactgactgcgactctgtaaagagggctgaagaggaatggttgcaaaaattagaaaaggaaactcaagaacgaaaatcccgagctaaagaagaagatatatggatgatgggtaacataaatagaaggggtaatggttcgcaatctgacacatcagagagtgaggaaaactcagaacaatctgatttggaaggcaataatcaatgtattgaatatgactctttaggtaatgctattcgtatagataacatgaaaagcagggaagcgcaatctgaggaatcagaagacgaggaaagtggttcaaaagaaaatggagagcctttaagttatgaccccttaggcaatttaattcgatag

SEQ ID NO: 2058 - DNA, 945 bp, Saccharomyces cerevisiae
atgacagccagtttaactaccaagttcttgaacaatacctatgaaaacccatttatgaatgcatccggtgttcattgcatgactacacaagaattagatgaattagcaaactctaaagctggcgcattcattacaaagagtgctacaaccttagaaagagaaggtaaccctgaaccacgttacatttctgtccctctaggcagtatcaactccatgggtttaccaaacgaaggtatcgactactatttgtcctatgtattaaaccgtcaaaagaattatcctgatgcacctgctattttcttctcagttgctggtatgagcattgatgaaaatttaaatttgttgaggaaaatccaagatagcgaattcaacggtattaccgagttaaacttgtcttgtcctaatgtgcctgggaaaccacaagttgcttatgactttgacttgacaaaggaaaccttggaaaaggtttttgcctttttcaaaaaacctcttggtgtcaagttgcctccttattttgattttgcccattttgatatcatggcaaaaatattgaacgagttcccattagcttatgtcaactctatcaatagtataggaaatggtcttttcattgatgtggagaaggagagtgtagtagtgaagccaaagaatggtttcgggggtattggaggtgaatatgttaagccaaccgcgctcgccaatgttcgtgcattttacactcgtttgagacctgaaatcaaagttatcggtacaggtggaattaagtccggtaaggatgcatttgaacatcttctatgtggtgcctctatgctacagattggtacagaattacaaaaagagggcgtcaagatttttgaacgtatcgaaaaagaattaaaagacataatggaagctaagggttatacatccatagatcagttccgtgggaagttgaacagcatttaa

SEQ ID NO: 2059 - DNA, 945 bp, Saccharomyces cerevisiae
atgactgaaggaaagaggctgcaacagatggagcttcctcaaatgaaatccatttggattgacgaggatcaggaaatggaaaaattgtatggattccaagtaaggcaacgattcatgaatggacctagtacggattccgatgaagacgccgacgaagatttaggaattgttctcgttgacagtaaaaagctggctttgccgaacaagaacaacatcaaattgccccctttgcccaattacatgacgatcaaccctaacataaattccaatcacaagtcattaactaataaaaagaagaatttcctgggcatgttcaaaaaaaaggacctgttgtcgaggagacatgggtctgccaaaaccgcaaaacagtcaagtatatctacaccatttgattttcaccatatttcgcatgctaatggtaaaagggaagacaaccctcttgagtcgcacgaagaaaaacatgatgtagaatcattagtcaaattcacgtctttggcaccgcaaccccgaccagattcaaacgtctcttctaaatattccaatgttgtgatgaacgattcgagcagaatagtgtcttcctccacaatagctacaacgatggattctcaccacgatggtaacgaaaccaacaataccccaaatggcaataagcaattagactcgcctacagatttggaaatgaccttggaagacttgagaaattatacatttccttctgttcttggagatagcgtcagcgaaaagaccaatccttcctctccctctgtttcatcattttctggcaaattcaagccaagagagttgagtgcgctacatacgcccgaattaggaaattgtttcaatgtagatcagtcgctaaattcccctggtaacagaatatctgtggatgacgtgctaaaattctactatcaatgtagtgaaactagtactcctcgaaatacctga

SEQ ID NO: 2060 - DNA, 945 bp, Saccharomyces cerevisiae
atgatgcggttaatacgtacattgccgcttcgatgcttcaaaactagaatacggcggcaaggctcgttgttgtgtttgcggtgctttagttcgtattcaaaaccacttttgcagaaatcaatgtcattgaaaaatatccagttatcagacctatcctcatcgccattatccaagaacaaggagaagcaggagaagccagagaaggaaaacgaaggaaagcactccattggcctgttagacagattttcagaggactttattactcagggcaatggattgaaacctactacttcacaaaatcaattggatactataaagttttatcaaatgcttcgtgaaagaggcaatttttccgatgaacaatgtaaaattatcatagctctattgttgcaactactaaatgatcagttttattcctgttacaatgatttgttcttaagggatatggagctgaataaacaatcacatttgttcagctcgctagaaacagaattgaaattcgcaattcaaaactctagagacacgcaactaaatgagcaccacttgcaattattaaaactcaagagagaacttaactcaatccatgatgaactgaatgaaatcataatagatcttttgcaaaaggacgctaaattagaatttaacaatcaaaaattagaaaacacccttttgtatcgacaattaaacctgaaattgaacgactgttctaacaagattcaaaccaagatactgggggatatcaggtcacatatcgaaaatttaagatggcagacaaccagaagcggtcttttggtaatattagtccttgtttgttcgattatgatcggtgtaagcgcatctaagaaggaacgcccaggtttacaggaacctgaggaacctgaaattttagcaccaaaggaagacattgatactaccttccctcaagatcaacatgatatagattaa

SEQ ID NO: 2061 - DNA, 945 bp, Saccharomyces cerevisiae
atgccatctaccactaatactgctgcagcaaacgtaatagaaaaaaagccagtctcgttttctaatatcctattgggtgcctgtttaaacttgtcagaggtgactacattagggcaacctttggaggttgttaagaccacaatggctgcaaacagaaacttcacatttttagaatctgttaagcatgtctggtcaagaggtggtatcttgggttactaccaaggtttgattccatgggcatggatcgaagcctccactaaaggtgctgtgttgctgttcgtgtcagctgaggctgagtatcgtttcaaaagtttggggttgaacaactttgcctcaggtatattaggtggtgtcacgggtggtgtcactcaagcctacttaaccatggggttctgtacctgtatgaaaacggtggaaattacaagacataaatctgcctccgcaggtggtgtcccacaatcttcttggagtgtgttcaagaatatttataaaaaggaaggtattagaggtattaataagggtgttaatgctgttgctattagacaaatgaccaactggggttctcgttttggtttgtccagactagtggaagatggtatcagaaagatcaccgggaaaaccaataaagacgacaagttgaatccgttcgagaaaattggtgccagtgctttaggtggtggtttaagtgcttggaatcaaccaatcgaagtcattagagttgaaatgcaatctaagaaggaagatccaaacagaccaaaaaatttgactgttggtaagacatttaaatacatctatcaatcaaatggtctaaagggtctttaccgtggtgtcaccccaagaattggtttaggtatctggcaaactgtcttcatggttggttttggtgatatggcgaaggaatttgtcgccagaatgactggtgaaaccccagttgccaaacattag

SEQ ID NO: 2062 - DNA, 945 bp, Saccharomyces cerevisiae
atgcctcgaatatctacatcattgataagaaaagcttcgagaatacgacctggtttgcatcttttgcttccagaatgtaggactctcgagcaagcgaaactcgagtacaaatggctcaccgaagagctgcctccggataaatcaatccgctgggcttgcttacagagatacaaacacgtcccattgcagtacatcttaagatcgcaaccgtttggggccttggacatagtttgcaagcctggtgttcttataccaagatgggaaaccgaggaatgggtgatggccataataagagctctaaacaactctatgctttcaaggcatactataccactgcatatttgtgatacgtttacaggaacagggtgtattgctctcgctttgagtcatggtatagcaaattgcacgttcactgccattgacgtgtcaacaagagcaattaagttggttaaagaaaatatgctgaaaaacaaggtgagtggtggtaagctcgtgcaacataatatattgtcctcaaaagctagcgatgaatatccatcccatatagatatattaaccggtaaccccccctacattcgaaagcgtgacttcaatagagatgttaaaacttccgtaaagctgttcgaaccaaggctagcgctagtgggtgagcttgaatgctatataaatctagtaaattattggctgccgaagacagactccttcttttatgagattggagacgttgaacagtttaattacgtggagaggcgcattaaagaagattcatatctcagccgtatttggtctattggtttgaaatatgactcgaatgggaaagcaagagtcgtatatgggtttaaggccactcccaaagggcgaatactacaccagatttttgcatcctttgggactataagacatttagcaaccgcactcagtgggcacaaagctaattgcaactaa

SEQ ID NO: 2063 - DNA, 945 bp, Saccharomyces cerevisiae
atggaacaactgtgtaagaggtacgtgcatacaccggcggcttttatacaaaacattgttgctaacactaaaagaacaacgctagccacgcaattatctgttgaaaaagctaaaaaaaaagttcccaagacagctcttaaaaagaaacttaatagtaggccaaaagaaaggcttccgaattggctaaaactaaacgatgtttttaacatacattacgaaaagccatctaactctgatataaataaggttaacagattcttcaacaaggctaaagtggaatttgaatggtgtgcagctagttttgatgacataccagaaaatcccttcctgaataagaaatctcataaggacatattgaaagatcatggggaatgtggaactacattgattgatactttgccagaagtcatctttctcggaggaactaatgtggggaagtcctctatcttgaacaacataaccacctcgcatgtaagcagagatttaggaagtttggcaagagtgtctaaaacaacaggattcacaaaaactctcaactgttataatgtgggaaatagactcagaatgatcgattcgcctggttatggctttaatagtagtaaagagcaaggaaaagtcactttgcagtacctcctggagaggaaacaacttgtcagatgctttctcttactcgctggagataaggagataaataacacagataatatgatcattcaatacattcatgaacacggagttccttttgaagttgtttttacgaaaatggacaaggttaaagatttaaataagtttaagaagaaggttatgagttcagggttaatggacttaccaactctacccagacttgtattgactaactcgcttacgtccagtacatctcctaaacggttcggtatagatcttctaagatatgtaatatttcaaagctgtggtttgattttatga

SEQ ID NO: 2064 - DNA, 945 bp, Saccharomyces cerevisiae
atggtagaaaactcgtcgagtaataattcaacaaggccaattccagcaatacctatggatctacccgattatgaggcgctccccacccacgcgccattgtaccatcaacttatagcgggtgcatttgctggtataatggaacattcagtgatgttcccgatagatgcccttaagacgcgaatacaatcagccaacgcgaaatcgctgtctgccaagaatatgctttcgcaaatatctcacatctctacttccgaaggaactctagccctatggaagggtgttcagtctgtcatactaggtgcgggacctgcgcatgcagtgtattttggtacgtatgagttctgcaaaaaaaatcttatcgattcgagtgatacgcaaacgcaccatccttttaagacagctatcagtggtgcctgtgccaccacggcatctgacgcattaatgaacccattcgacacaataaaacagagaatccaactcaatacctcggcatcagtatggcaaaccacaaagcagatttaccaatctgaaggtttggcagcattttattattcttacccaaccaccctagtaatgaacatcccatttgcagcatttaatttcgtcatatatgaatcatccacaaaatttttaaacccatcaaatgagtacaaccccctcatacattgtctgtgtggcagtatcagcggatcgacatgtgcggcgatcacaacacctttagactgcataaagacagtactgcagataaggggcagtcaaacagtttcgttggaaattatgagaaaggcggatacttttagtaaagcagccagtgccatatatcaagtttatggctggaaagggttttggagaggttggaaaccaaggatagtggcaaacatgccggctactgctatatcatggacagcttatgaatgtgcaaaacatttcctaatgacgtattag

SEQ ID NO: 2065 - DNA, 945 bp, Saccharomyces cerevisiae
atgtcttataatccgtacgcatatgcaacaagtgagcagaatggcgttaacgatcgcttttcccacactccacaacagcaacgaccaatgcaaattccgaggaacacgcccgtgaatggccaaggtaatgcgaatatgaatgcaaacgtaaatggcagtggcggtggttttccattccaagatcctcgtggttcgatggcattccaactagggcagagcgcattttctaattttattggtcaggataactttaaccagtttcaagaaacggtcaataaagccactgcaaacgctgccggctctcaacaaatttcaacgtattttcaagtcagcacccgttatgtcatcaataaattgaaactcatcctagttccttttcttaacggaaccaagaactggcaacgaattatggactctggcaactttttgccaccaagggatgacgtgaactccccagacatgtacatgcctattatgggactagttacctatattctcatctggaatacgcagcaaggtctgaagggttcattcaaccccgaagacttgtactacaaactgtcttctactctggcgtttgtgtgtttagatttgttgattttgaagcttggcttgtatcttttgatcgattctaagattccaagcttcagtttggtcgaactgttgtgctatgtcggctacaaatttgttccattgattctcgcccagcttttgaccaacgtgaccatgccatttaacctgaatattttgataaaattttacttatttattgcctttggcgtattcctactaagatccgtcaagttcaatttactaagccgctccggtgctgaagacgatgatatacacgtttccatcagcaaatcgaccgtcaagaagtgcaattacttcctattcgtctatggcttcatttggcaaaatgttctaatgtggttaatgggttga

SEQ ID NO: 2066 - DNA, 945 bp, Saccharomyces cerevisiae
atgttcaaagaggaggactcgttaagaaaagggcaaaatgtggccgcgtggaaaactttgttggctggcgccgtatccgggctgcttgcccgtagcataactgctcccatggataccattaagatcagattgcaattgacccctgcaaatgggctgaagcccttcggaagtcaggtcatggaggtggccagaagcatgataaagaacgaaggcatccggtccttttggaagggtaacatacccggttctttgctgtacgttacctatggctcagcgcagtttagttcatactccctttttaatagatatttaactccatttggactagaggcgcgcttacatagtcttgttgtcggagcctttgctggcataaccagttccatcgtttcctacccgttcgatgttttacggacccgactagttgccaacaaccagatgcactcaatgagcatcacgagagaagtgcgtgatatctggaaactagaaggtctccccggatttttcaagggctccatcgcgtcaatgacaaccataactctaaccgcatctataatgttcggaacatacgaaacaatcaggatatactgtgacgaaaacgaaaaaacgaccgccgcgcataaaaaatgggaactggctactttaaatcacagcgctggtaccattggcggcgtcattgctaagatcattactttccccctcgaaacgatccgtaggcgaatgcagttcatgaattcgaagcatctggaaaagttctcccgtcattcgtctgtatacggttcttataaagggtacggattcgcaagaatcggtttacagattttgaaacaagaaggtgtgagttcgctttacagaggtattctggtggccctttccaagacaatacccaccacttttgtgagtttctgggggtatgaaactgccatccattatttgcggatgtactaa

SEQ ID NO: 2067 - DNA, 946 bp, Saccharomyces cerevisiae
atgagtgcccaaaaagtatgttcctacatgttaatttcgagggggagatgtcaatttacattcacgaaggcataagttttgaaatttgatatgatgccatcaatctcagacatatccatacaagaaacaataagatcaggacgtcgaacaaaataatacaatgaaaactgataaatgacgttatacagtgtacagtgaggataaatgattaaggcagtatacctttcaacacaatgttaatactatgagtgagaaggtgagcaaagcaataaggtatatcgaccctagctcatgattatttagtttccaaacaaaggcccacgttacagtttcaaatcgctaggcataatctctccctataaaaatttatcaccattcgcaaatcaagaatactaacattagtcgtttgatatttcttttttccatttaggctccaaagtggtatccatccgaagacgtcgctgctctaaagaagaccagaaaggctgctcgcccacaaaagttgcgtgcctctctagttccaggtaccgtcttgatcttactagctggtcgtttcagaggtaagagagttgtttacttgaagcatctagaagacaacactttgttgatttctggtccattcaaggtcaatggtgttcctttgagaagagtcaatgctcgttacgtcattgctacctctactaaggtttctgtcgaaggtgtcaacgttgaaaaattcaatgtcgaatactttgctaaggaaaaattgactaagaaggaaaagaaggaagctaacttgttcccagaacaacaaaacaaggaaatcaaggctgaacgtgttgaagaccaaaaggttgtcgacaaggctttgattgctgaaatcaagaagactccattattgaagcaatacttgtctgcttctttctctttgaagaacggtgacaagccacacatgttgaaattttaa

SEQ ID NO: 2068 - DNA, 948 bp, Saccharomyces cerevisiae
atgaaatcctcagagccagcgccagcgaccccgaccgggttcagaaattccatctggttcatcatcttctaccttttcgtcatccaagcgctaggttctgcaataatctcgggcggcatcgagtttgccatcgcatatgccatgtaccattcccgtgtagatcttatcaccttatgggcatttcctcacaccatttcaggcgattgtgcactaagtttattcatccaggtgggtcttacatgggctagcgaggaaattttagttggattcgatgactacaagaggcctgttttcagattgaataaatggattacgaaaccgtcaccactgaaaaccgaatctaacgaagaaataccaccccctaaaaagcgtttcattgtggattacttcgaatccaaagacaacgtcgttgcgaagcagaacactctgtatcataagcataattggctctttggctatttagaggtcaatagaggaatcattcccaaaggtaaagaagctacgttgaaaggttttctcacatctcagttcattcatgattctactcagtccaaattcatgaactttatagaatggtttgtgcagaaattcatcagatctatgatcctagccattgccatgttcattgtcatttggccagtcactatgggtatccttgctggtataggccataaggtcgggtcccacgactactacttcaacgattatccactaccgcaggtcatgaagttgatttatgccgttgtaattgcctttgtatgcactccagtggccatcatcgtcattgtgttgagaaaccagtttcacgaggaactttactatgaaggcttagcaaacggtacgctacagcaggatcaagaagtttgctccacgggtaatcgcagctcgggatcaaccgatcaagatatcagtactaccaaacaacagtctcaagaagcggtagcgtga

SEQ ID NO: 2069 - DNA, 948 bp, Saccharomyces cerevisiae
atgactacgacggtacccaagatattcgcgtttcacgagttttcagacgtggcagaggccgtagctgaccatgtagtccacgcgcaagacggtgcattggctccaaagaacgagaggaaacactctgttcccaacatcagcatgaatgcactggatatgacgagagaggcctcttgcaaaagcacagcatctgccgcggaagggaaaagtggtagcagtggtagtggcagtggtagcagtaagcccaaaaaggagaaacggttcaagattgctctctccggtgggtcattgatcgaagtgctacacgaaggtctgctaaaacgagacgatgtacggtggggagactgggacatttactttgcagacgagagacttgtacccttcagctcgaatgaaagcaattatggatgcgccaaaaggaagattttggacctgatagacacggcgaagtatggaactccgaaggtgtaccacattgacgagtcattgattgacgacccgcaagaatgcgctgataactatgaaaaggtgctaatccgcgggtttgccggtagagattccgtcaaacttccgatgttcgacttgttcctgcttggttgtgcccccgatggtcatatcgcatcactcttccctaacttccaggacaatctacgtgagaaacttgcatgggtggtgcccgtggagaacgctcctagtgggccctcgaccagaatttcgctgactatacctgtaatctgccattctcacagggttactttcgttgtcgaaggtgcaaccaaggcgcccatcatcaagaccattatggaaaggcctgaaaagggcctacctagcagtattgtcaacgaaggtgctgctggtcgtgtatcatggtttgttgacgacgatgctcttacggacgtcctcgtcaccaaaaaaaagtataaattccaccaaggtttgtctatttaa

SEQ ID NO: 2070 - DNA, 948 bp, Saccharomyces cerevisiae
atgagtatgtaatagaatgtattgtatgcttgtggaatgaatgtcaatgtagctattttatatggtgagctcaaattgaatgaacatatcgtggaaatttaaaatactgaagaatacccaataagtcaatgcaacctgtgaatgtttttcctgaaatacgccgaatactgaatacgattattaccataaattgcttctagaaggaaggcggtgtaccatttaatactgatgatatggttaatatcatttgagaagtcttcacatgaggactatagaactaccatccaggaattatagaggaaattaactgaatcagagatctattttgaaacattcatttacatgtaattgtctgcaataaagcaatatttttgaaatatgcaagtttactaacaagaataaattcttttttgatttttatctttaacagtggctcatttcaaagaataccaagtcattggtcgtcgtttaccaactgaatccgttccagaaccaaagttgttcagaatgagaatttttgcttcaaatgaagtcatcgccaagtctcgttactggtatttcttgcaaaaattgcacaaggttaagaaggcttctggtgaaattgtttccatcaaccaaatcaacgaagctcacccaaccaaggtcaagaacttcggtgtttgggttagatacgattccagatctggtactcacaacatgtacaaggaaatcagagacgtatccagagttgctgccgtcgaaaccttataccaagacatggctgctagacacagagctagatttagatctattcacatcttgaaggttgctgaaattgaaaagactgctgatgtcaagagacaatacgtcaagcaattcttgaccaaggatttaaaattcccattacctcacagagtccaaaaatctaccaagactttctcttacaagagaccatcaaccttctactaa

SEQ ID NO: 2071 - DNA, 948 bp, Saccharomyces cerevisiae
atgctacaattctcaacatttctagtgctcctatacatctccatatcctatgtgctaccgctatatgcaacttcacaaccagaagggtctaaacgagataatcctcgaacgattaaatctcgcatgcaaaaacttacaattatgctaatttccaacctttttttggtgccttttttacaatctcaattatctagtaccacttcacatataagtttcaaggacgcatttttaggcttaggtattatcccaggttattacgctgcattgccaaacccttggcaattcagccagttcgtgaaagacttaacgaaatgtgttgcgatgttattgaccttatattgtggacccgttttagattttgtattatatcatttattaaatccaaagagctctatacttgaagatttttaccatgaattcctgaatatttggagtttcaggaattttatatttgcaccaataactgaggaaatattttacacgtcaatgcttttgactacgtacttaaacctaataccgcattcgcaactaagctatcaacagttattttggcaaccatcgcttttttttggacttgcgcacgcacaccatgcttatgagcaattacaggaaggctccatgacaactgtttccattctgctgacaacatgcttccaaattttatacacaacactttttggagggttaaccaagtttgtattcgtaagaacaggcgggaacctatggtgctgcataatcctgcatgccctttgcaatatcatggggtttcctggtccttcaagattgaatttacatttcacagtagtagacaagaaagctggacgcatttccaaattggtctcaatctggaataagtgctacttcgcactgctggtccttggattaatatccctgaaggataccttacaaactctggtaggaactcctggttatagaataaccctttag

SEQ ID NO: 2072 - DNA, 948 bp, Saccharomyces cerevisiae
atggatgttttattgtcgcttcctcaaccggaattatttaagaccacggtgattccgttcttggcaaatcgcaatataatcaagtcggaagcgattctctccaacttgcactcaattttttatgttgctatattctaccatatttggtttctttttggcaaatggatcttattcccacatttggttaaatggaaattggactatgaccaaaaacataacgtcaagaaagatgagaagacaacttcggaacgtcaagctcaacattacaaaaagaagtacacttctttgatcaatcaaagttcagtccacttaatatccctactgcaaagcatagtggtcctgtactactcattgaagttcttgcttgatccaaaagcctcggccgagccctaccaaacctcacactctcgagtgtttacagaaaatcgagacactcaagtcatctgtatttttgctattggttatttcgtctgggatatctatatttccaccatgtattctactttccccttcgttgtgcacggaataatctccaccgtcgtgttttgcatcggattgaaaccgtacatccaatattacgccccagtgttcttgatgttcgaactttccaatccctccttgaactttagatggttcggtatcaaatttctaccccagaaaagcaaattctgctctctactgctgctgttgaacaatttgacgctcatggtcgtcttctttgccgctagaatcgcctgggggtggtttcaaattggaaaactatgttacgacttttaccaggtgcgcaatgaacctggtttcttagtctttgacaccattgttatccttgcaggcaatttcgtcctggacatcttgaatgttatttggttttctaccatggtgtctgtggctgcaaaggtcttgaagaagggggagtctgtagacaaagtcactaagaatgaacaataa

SEQ ID NO: 2073 - DNA, 948 bp, Saccharomyces cerevisiae
atgggaaggacatttattcatgcttcgaaaataaaacatgcggcacgcaaaagaaaacatcattccaactttagaactctgatcaaattattgaacaatgatgcctataagatagaatcatcaaaaccgttgaaaaatggtaaacttttcaaatactggaaaaataggcgtagattgttttcaaagatagattcggcgtcgatatatatgactgatgagctgtggttcagtgtgacgcccgaaagaattgcctgcttcctggcaaattttgttaaggcatgcatgccaaatgccgaaagaatactggatgttttctgtggtgggggcgggaacaccatacaatttgccatgcaatttccttacgtctatggagtggactacagtattgaacacatatattgtactgcgaaaaacgcccaaagctacggtgtggacgacagaatatggctgaagcggggatcctggaaaaagctagtctctaagcagaaactttccaaaataaagtacgactgtgtatttggatcacccccgtggggtggtccagaatacttaagaaacgatgtgtatgacttagagcaacatctaaagcctatggggattaccaagatgttgaaaagttttcttaaactaagccctaatgtgattatgtttttgccaaggaactctgatttgaaccagctttctcgagctacgaggaaagtactaggtccatttgccaaatgtaaagtattatatgtaaaggagaatggatatatgaaaggaatattttgcatgtggggggaatgcttttttaactacgaaccagcaagtacggagaatagtcgaagggagtcgtccgaaaaggaagagctgagttctgaaaacgaagagctctcgaaaagaaaaaagcatgaatccacaacaacgaccaaagataatactgtagacatttacgacgtaaatggttaa

SEQ ID NO: 2074 - DNA, 948 bp, Saccharomyces cerevisiae
atgttccagtttgttactcctgtgggaacacagaatggattgaaagctacttgtgcgaaaatatctcctgatgggcagtttcttgctataacacaaggacttaacatcctgatatacgacattaacagacgaactgtatcacaaacactagtcacatcacatgccaggcctttctcagagttatgctggtctccagatggacagtgcatagctactgcatcggatgatttttctgtggaaatcattcatttatcttatgggctgctgcacacttttatcggccatacagcgccagtgatatctctgacattcaatagaaaggggaacttgctgtttacatcctcaatggacgaaagtatcaaaatatgggacacactgaacgggtctttgatgaaaacaatatctgcacactcagaagcagttgtgtcggtggacgtacccatgaatgattcatccattctgagttcaggttcatatgacgggctcatacggatctttgatgcagagacgggccattgtttgaagacattgacctatgacaaggattggaaaagagaaaatggtgtggtacccatctcccaagttaagttttctgagaatgcaagatatctcctggtgaaatcgctggacggtgtagtgaaaatatgggattgcatcgggggttgtgtagttcgtactttccaggttcagcctcttgaaaagggcgtactgcatcattcctgcggtatggacttcttaaatcctgaagatggatccactcctttggtgatcagcggttatgaaaatggcgatatatattgttggaattctgatacaaaaagcctcttacagttgctcgatggttctttatatcaccacagcagccctgtaatgagcatacattgcttcggtaatataatgtgttcccttgcattgaatggagattgctgtttatggagatgggtttaa

SEQ ID NO: 2075 - DNA, 951 bp, Saccharomyces cerevisiae
atgagtatcaccactactagaagaagaaaccaagatagtgtctgctgcaaggcaacgagagcctccattaaggtggaagctgtctcaggccagacagtttttgaaaagcaaaaactgctacacaatttcgatgagttgccagaatggcaaaaagataatgacaaaattctcaccgggtacgttcgtgaaacactgtcatggaaaaagtgcttatattctttattttattggaacaacgagactgtgaacatttatacacatttggtaccggctatcgtatacttcgtgtttgccattacgttgaccaactactttctaattcccgttttcccctccacttcctggtccgattacaccgttataaacattttcttgatgggcgctttctcatgtctcatgtgcagtagctgtttccactgcatgaagcaacactctgaaaagcaaagcaatttctggagcaagctcgactacttggggattatcagtttgatttcctgttctatgatccctataatatactttggttacttcgaccacatatcctacttcagtcttttcacgattgttactttagtcctggcaacattttgtacagtctgtgtcctccacgacaagtttaacacttccacatttcgtccatttagggccatgtttttcatattgtttggatttagtggcttactcccattgaccacagggtttttcaagttcggtatccaaggggttcttaacagaataaaagtcagctttgtgttttgggaagctctcttttacatttcaggggctgtaatctacgggtttaggattcctgaaactttggctccagggaagttcgatttcttcggtagctctcatcaaatatttcatattatggtggttcttggttctgtatgccacttgaaagccattatcgattcttacaaattaatgcattctcatatccacccttga

SEQ ID NO: 2076 - DNA, 951 bp, Saccharomyces cerevisiae
atgagtgaaaaagtaaatagtgactttgaagacttttcctcagatgaggaaaccgatcaacataacgtcttaattcagaccaagaaaaaaatttctagtaaggatgatatcttcagtaagaaggtagaagacatcgaaagtgaaaacgagtcagacatagaagaagagcaaaaacaagaagaaaaagaggatgtagaacaaccagataaagagaatggagaaaagctcgatcgagaagtagaagaacaagcttcgtccaccacttcactggatttaaaaacagaaaaactaaggcaactggtaaaatcaaaggccgccaagaagtctaaacacaagactggggtggtatacttctccagtattccaccttacatgaaacctgcaaaaatgagacaaatattaactcgttttggtgaggtagatagactatttctaaagaaagaggacgatcaaaagtacaagcaaagagttaaaggtggaggaaacaagaaaaacaagtatgaagaaggttgggccgagtttattaggaaaagagacgccaaattgtgtgcggagacgttgaacgggaacattattggtggcaagaaaggtactttctaccatgatgatatcctgaacgtgaagtacctcccaggtttcaaatgggcagatttgactgaacagattgcccgcgagaacgatatcagacaggccaagttggagatggaaatctcgcaggccaacaaactgaacgcggaattcattagaaacgtggagcaaagtaagatgatacaaaacattaagaactctaggaagcgcgccggaaaagaaggagagtctgcagattctcaccctcacagggaatttaaacaacgtcgtgtggaaacaagccgtgccaatgctccctctgatatcaagcagcaatcctctgggtccaaagacttgggtaatgttctcaccaatttactataa

SEQ ID NO: 2077 - DNA, 951 bp, Saccharomyces cerevisiae
atgctgaaagaggagtataatttgagcggtgctgataacatggcatctgctgagttgtcatttaaaaagcaaaaagtggtattgaaaaagttcatgatagcgcaagtgactaaggggattatgcagcggtatgcgagcctattagttaccatgcctagtgatgatgacaatgcaattattggcacaaatcatttgaaaacaaccaaatttttagaaataatcctacacagagccaaatcatcgcatttacagttcaaaaaggtctgttgcattgtcatcaagtttctagattgctgctcgaaggaaactaactacatgaagtttttaaagttcagcttacacaaactatttgtagctgctttcatcttaagtgtgccaaatgttgtaggcgatgaccgcgacaggattaccacgagggatgaaacctatcatctctattcccagataacaggcttgccactggaagaagtgataaattgttgttctattgtgaggcctgtacttattcggcggagtagacaacaacgcaggcaaatgttatctcgacgtgaacaacattcgtacttcctcagaagttcttttatgaactccaattcatcagcatcaccttttttctctaccaataggtcagctgatgatctacatgtacatacaagggcatactcgcttcatagccattccgatggggaaggccaagataggcggtcggaacatgaagaaacgcatagcatgggggctgatgccgatacatatcgacaaactacgtttatcccagacacaccaaatggtttgcattctagatcattaattgagtgtgggatcgaacccacccaagtaagtgactctggtgaatggtcgggtcaaagtaacggatatgttttggtgacagaattacaggagtttaacaaaatgggtaaaaagttagtacaagaagcttttaggatagtttaa

SEQ ID NO: 2078 - DNA, 951 bp, Saccharomyces cerevisiae
atggaggagtacgattattcagacgttaaacctttgcccattgagacagacttgcaggatgaactgtgcaggattatgtataccgaggattataagcggttgatgggactcgcaagggctctgatcagccttaacgaactgtcacccagggcactacagctaacagccgaaattatcgacgtggcgccagccttctacaccatatggaactaccgattcaatatcgtcaggcacatgatgagtgaatccgaagacactgtcttgtacctgaacaaggaattagactggctagatgaagttacgctgaataatccaaagaactatcagatctggtcctatagacagtctcttttgaagctacatccgtctccttccttcaaaagagagctgcctatcttaaaactgatgattgatgatgattccaagaattatcacgtttggtcgtacagaaagtggtgctgtttgttcttcagtgactttcaacatgagctcgcctacgccagcgacctcatcgagacagacatttataacaacagcgcatggactcataggatgttttactgggtgaacgctaaagatgtcatttcaaaagtggaattggccgacgagctccagttcattatggacaagattcaattggttccgcagaacatcagtccgtggacctacctccgtggtttccaagagctattccatgataggctacagtgggatagcaaagtagtcgacttcgccacaaccttcatcggtgacgtattgtcacttccaattggctcaccagaggatttgcccgagatcgagtcctcatatgccctggaattcctggcatatcactggggggcagacccttgtacccgagacaacgctgttaaggcctatagcttgctagcaatcaaatacgatcctattagaaaaaacttgtggcaccacaaaataaataatctgaactga

SEQ ID NO: 2079 - DNA, 951 bp, Saccharomyces cerevisiae
atggcagctaattctgtagggaaaatgagtgaaaagttaagaatcaaggtggacgatgttaaaatcaaccccaagtatgttttatacggtgttagtacaccaaacaagcgcctttacaaaaggtattccgagttttggaaactgaagacacgattggagagagatgtaggaagcaccatcccatatgacttccctgaaaagcccggtgtattggacaggaggtggcaaagaagatatgatgatccggaaatgatcgatgaaagacggatcggactagagaggttcctcaatgaattgtataacgatcgttttgattctcgatggagagacacaaaaatagcgcaagacttcctgcagttgtcaaagccaaatgtttctcaagaaaagtcacagcagcatctagaaactgctgacgaagtgggatgggatgagatgataagagatattaaattggatttagataaggagagtgatggcacacccagcgtgcgtggagcactaagggcacgtacgaagctccacaagttacgagagcgactagaacaggatgtgcaaaagaagtctcttccaagcacggaagtgactcgtcgcgccgctctattgaggtccttgctcaaggaatgcgatgacattggtacagcaaacatagctcaggaccgtggacgacttctgggggttgccaccagtgacaactcttcaaccacggaagttcaaggaagaacgaataacgatttgcaacaggggcagatgcaaatggtgcgcgatcaagaacaagagttggttgcactgcaccgaattatccaggcacaacgtggattggccttagagatgaacgaggagctgcaaacacagaatgagctacttacagcacttgaagatgacgtcgataacactggtaggaggttacagatagccaacaagaaggctagacattttaacaacagtgcttga

SEQ ID NO: 2080 - DNA, 951 bp, Saccharomyces cerevisiae
atggcatttagtgattttgctgccatatgctcaaagaccccgttgccattatgttcggtaataaagtctaaaacccatctaatactttcgaactcaacaattatacatgattttgatcctttaaatttgaatgtcggtgtactgccacgctgttatgctcggtcgattgatcttgccaatacagtcatctttgatgtcgggaacgcattcataaatattggtgctctaggtgtcattttaatcatactttataacataagacagaagtatactgctattggcaggtctgaatatctctactttttccaactaacattgctattgataatatttaccttggtggtagactgtggtgtatctccccccggctctgggtcatatccatacttcgtggctatacaaataggactggcgggtgcatgttgctgggccttattgataatcgggtttttaggtttcaatttatgggaagatgggactacaaagtccatgctgttggtccgtggaacgtccatgctaggattcatagccaattttttagcctctattttaaccttcaaagcatggatcaccgaccataaagtagcaacaatgaacgcttcagggatgattgtcgtcgtttacataataaacgccattttcttattcgttttcgttatttgtcaattactggtatccctattggtagttcgaaacttatgggtcacaggagctatctttttggggctatttttctttgtagcaggccaggtattggtttatgccttctctacacaaatttgtgaagggttcaagcactacttagatggcctcttttttggaagcatctgtaatgtgttcacattaatgatggtttacaagacttgggatatgactaccgacgacgacttggaatttggtgtaagtgttagcaaggacggtgacgtggtgtatgataatggatttatgtga

SEQ ID NO: 2081 - DNA, 951 bp, Saccharomyces cerevisiae
atggcttttttgaatattttcaagcaaaaacgtggtgatgaagcttcacaactgagcgcaaagggacgggaggaaatttctcaatcgattaagatatgcaaaagtgacgatgctgctaacgaacatagctgctctggtgattgcaaaacagaaattgaagaaggagagcaggcctttgcgaaactaaagatcgaacatgaaactcctttgttgaactcttctaaaacgccaaaaattcacttcgttgtccccacctctcaaatcgattggcagcatgatgcctgcctcgaggacccaaagtcagtacagtataaaatttcccagtggtgtgataagaattcagctaaattttccaacgtgggcacaggcaagacactaaactgtgcagtttcatctttacctaaagatatcatggatattgatgttatgcggggaaccaagaataatgtacttattttgccttacttcatttggctgaacgaccttagatcagatgacgtcgaagcaacgctggatggtttagttcctgacttattagacgagaatatttcaagagagaaattgctagaaacacgaccaaatgttgccgttgcacgtgaacgtgcatttgtatttatatgttcacatactacgagggataaacgatgcgggattacggcaccctatttaaagaaagtttttgacagtaaattacaggaacatgggctgtatagggacaattcggattacagggcagagggtgtcaaaattgcatttgttaatcatgttggtggtcacaaatttgctgcaaatgttcaaatttatttacgaaatccaaataccttaatttggttgggaagagtaactccaaccatagttccttctattgtcgaacatctgattgttcctgaagaaccaacgttgccgtttcccgaaaaagttcgctgtattaagaaatatcaaagctggtaa

SEQ ID NO: 2082 - DNA, 951 bp, Saccharomyces cerevisiae
atgggaatatttcgttggaactatccagagagttctgtccccggcgtttggggagaaacaacttccactattgactggtgtgaggagaactatgtcgtttctccctatattgccgagtggtcaaacactttaactaacagcgtattcatactgtcagcgatttacacaacttactctgcttacaagaataaattagaaaaaaggtttttacttattggcttcgggtacggtttggtcggagtaggatcatggctatttcatatgacactgaagtatagattccaactattggatgaacttccaatgatatacgccatgtgcattccgacatggagtttagtatgcgaggccaaagaggcattacttaacggagataatcacaagaaggttcctctatttgaacagatattcatcggcgtaattatcggcctggccgttacaacagcaagcatactctacgttatttacaaaaatgtcgatatccatcaaattttgtttggcgtacagattgtagttgtggctgctactgcaggaagtttgacgtacagatacgtccatgatccacttgccaaaagaaatctcaaggcttcaatggcgctcggcgcaattttgttcttatctggctacatttcgtggctacttgatatacactattgttcgttctgggtgcacgttagaagaagtattttggctttaccacttggtgtactgcttgaaccacacggatggtggcatatattaactggtatggggatttatttctacattgtttctttggaacatttaagggtcattacgctcaacgtcagctgcaattaccagttcatctggagatggaaagtcttccctgaactgatatggaaagggcgcaaaccctcaacaagatattcacttgaactatttggcccatacgtagaagatcaatcaattgaagttaaaaaggagaagtaa

SEQ ID NO: 2083 - DNA, 951 bp, Saccharomyces cerevisiae
atggtgtctacacataacagagataaaccttgggatacggatgatattgataaatggaagatagaggagtttaaggaagaggataacgcatccggtcaaccttttgctgaagagtccagttttatgactttgtttcctaaatacagagaaagttacttgaagacgatttggaatgatgtaacaagggctctagacaaacacaacatagcgtgtgttctagatttagtcgaaggttctatgacagtaaaaacaactagaaaaacatacgatcccgctatcattttgaaagccagagatttgatcaaattattggcgagatccgttcctttcccgcaagccgttaagatcctacaagatgacatggcatgcgacgttattaaaattggtaatttcgttactaacaaagaaaggtttgtcaagagaagacaacgtcttgtaggccctaacggtaatactttaaaggctttggaacttctaactaaatgttacattctagtacaaggtaacacagtaagtgccatgggtcccttcaagggcttgaaggaggtccgtcgagtagtagaagattgtatgaaaaatattcaccctatctatcatatcaaggaattaatgataaaaagagaattggcaaaaaggccagagttagccaatgaagattggtcaagattcttgcccatgtttaagaagaggaatgtggccagaaagaaacccaagaagatcagaaacgtcgaaaagaaggtctatactccatttcctcctgcccaattgcctagaaaggttgatttggaaattgaaagtggtgagtatttcttaagcaagagagaaaagcaaatgaagaaattaaatgagcaaaaggaaaagcaaatggaaagagaaatcgaaaggcaggaagagagagcaaaagatttcatagctccggaagaagaagcatacaagccaaaccaaaattag

SEQ ID NO: 2084 - DNA, 951 bp, Saccharomyces cerevisiae
atggttaagaaaaactttatcccgtctgtatcgctggtcagaagagaccttcctactttagttactactacaactagttcaaccgccctgtcaaagcccacgtcaagtgtagtgtccgaaacgagttccaagtcccttccatcgttaacatcttcggctttctcaacttccagtggagcaacatcctcctcatcactaattgtcgcaagtataacacccccatctacagcaggaaacccatttattttaaatgctgctgataaaccaaatggaactgtatacattgctgtgggtgctgtcataggtgccatttttatcagtattcttatatggtggttagtgtccagttatttgtctcgtcgtttcacaatgacaaattcttatgcaaatgatagtaaaaatttgtacaggggacaccacaagcatagttcttctttacaaagcaatccctttgacatcaatgatgagaaatcatatatgcaggatgattgggattctatgagccaattagaatctagccaatacgaggatgctgcctcaccattcaacccaattcaggatccgttcacagacaacagaagatccttatttatatctcctactttacaagtgtcacaatatgaaaaaagtcatagccgccatcaatcaaaagacactaacatttttattgacgatccatttttatacgtaggtacctatctagaagaagaagaagaagaagaagaagagagaaagctgaacctcaatagaccacaaagagcagcgtcacctgaaagaaaggaaaagaaaattaactcaatggaaggctaccataagagaaaccaatcctccttgggcctcataccagtcgcttctgctacctcaaatactagctctcctaaaaaggctcataaaagacaggcgccatcgatgtttttggatgatgtcctgaatggtagagaaataatctag

SEQ ID NO: 2085 - DNA, 951 bp, Saccharomyces cerevisiae
atgtcatctacggacatctggatatccaatgatgcatctacttttcaaaaggcacagctgcctactcaattacggcacgtcaaagtgattaaaattcgtgaagattctatcggaaggatcatccttcttatatcgacagaaatcacaaatgaggaaaatgctgatccagatctctcagagattttcatatcagattcgcaagggttgaaattctcacctgttgaatggacaccaaaccatcagtttggaaattttaggctcacttttcctgatttcttgaaagggacaatatttggatcgtttcatccttccattgactattctaatcaccaagtaaactatactgaaaatatagccggaggagaaaccaaaatatccgttgataacggcctcacatggtcaaatttgaaagttgttgatgaagaaaatgccgattcgttcggctgtgatatcactaggcctgagagatgttcacttcagggttatttttacaatctaaaactttcaaatccttctgctgggatcatattaatgacaggttctgttggcgatgacaatgaattcgatcggaaggaccgaaaaactttcatttctagagacggtggtctaacatggagggtggcccataattcttctggattatatgctactggtgatctgggaaatattattgtatatatcccgtctccttcatataaagatggtgatgtacaatccaaactttatttttccttggaccaaggtagaacatggaatcaatatgagcttgttgacgctttattttatatccatccattagagttgattaatacaacgccagatggatcaggctcaaaatttattttaagcggacatctcattactacggctagtcaagaaggaaacaacaccaacatctcatatattgcaagaagtgtcctgtatgcgatcgatttttctgctgcattttga

SEQ ID NO: 2086 - DNA, 951 bp, Saccharomyces cerevisiae
atgttaaagaggttagccaatcgtcaaaatggttttgcgtcattctcgtgcagctcagtcggtctgcgatatggtaggactaatccaagtacaaagagaagcttttcactttttcaaagtgtagcggacacgtttttaacagtgcatgaagcctcacatataccatggatagtgcttgttcctttgactactatgacccttagaaccctcgtgacgctgccattcagtatatggcagcggaggagaattttgaaacaacaagaactgaggaaattagtacagccaataacgcccattattaaacttcgactggcagccgttactaataaaaagtctagaaatgccgccagaattagctccaacggttctttcatgccgttacaactacagaatgctggcgttttgacaccagaacaaattacactattggcagtgaaagagacaagaaagaggcagaaaaaattattcaagaagtacaatgtacccctatggaaaaatgccttactgccaatggtgcaaattcctctttgggtcacagtctccatgggcatcaggaccctaacagagacacagcttatagaaagtttttatccttcctggttttccgcactgggtttcagttcctttgatctaagctcaccgctagtagcaatgcctctactagcgcccattttggtggggactctggcggtattaaacgtggaactcaatggccgactgatgtttagctcaagtttgtcatcgcaaggtataaagacaatttcaaggaattcgacaagagtccaagaggcaatgactagtatactgaacgtatcgagactcggttgtgtcgttatgctagcaatgtcctcacaggctccattccttctttcgctctattggatatcatcacagctattctccctggtgcaaaatatcatattaaattggatttatccttaccaacgatga

SEQ ID NO: 2087 - DNA, 954 bp, Saccharomyces cerevisiae
atgaaaaccattattatttcagattttgatgaaacaatcacaagagttgacacaatctgcaccattgctaaattaccgtatctactgaacccgcggttgaaacctgagtggggtcattttaccaagacatatatggacggataccataaatacaaatacaatggaacgagatcactgccgttgttatcttcaggcgtacctacgataatttcgcagtctaacttcaataagttgtttgcggacgaattaaaatatcaaaatcataacagggttgttgagttaaatagtgtaaatgaaattacaaaacaacagatttttaagtcgatttctttggatcaaatgaaaacgttcgccagagatcagaatcacgaagattgtttactaagagatggtttcaaaacgttttgctcttcagttgtcaaaaattttgaaagtgatttttacgttttatctataaattggtcaaaagagtttattcatgaagtcattggtgacagaagacttaaaaatagtcatattttttgtaacgatctaaaaaaagttagtgacaagtgttctcaaagctacaatggtgaatttgattgtcggttattgacaggctctgataaggtcaagatactgggtgaaatattagataagatcgactcaggttgcaataaagaaggaaattcttgcagctattggtatataggggatagtgagactgacttgttgtccatattacatccatctactaatggtgtactgctaataaacccgcaagaaaatccttccaaattcataaaaattaccgaaaagattattggtatcccaaaggataaaatctcgagttttgaagctgataatggtccagcgtggttacagttttgtgaaaaggaaggcggtaaaggtgcctaccttgtgaaatcctgggactctttaaaagatttgatcatgcaggtaacaaaaatgtag

SEQ ID NO: 2088 - DNA, 954 bp, Saccharomyces cerevisiae
atgaaacgagttactggagttttcttaacacttttgagattttctcaatttgcatcatcggttttggtgatgtcacttttggcgtatgccatccacgcctatggaaatagaggtaataagaaaaccaacttcacattggcaacaggtgtcattagtgtgttttatctgattgccttaggtattttgtgtctggccctacccacattgatctacataggaatgtacttctgtgccgaattgatcgtttgtatgctatggctagcagctttcgttgttcttgccaaagctcaaggtgaacgtagctgtagcaacactaatgcagacggattatactataatccgtacagtggccaatatactgctgacagtcatagaagagcatgtaattcttctcaggcggcaatcgccttttctggcctttgctttgtactgtttttgatcagtgtgatattactgggaattaatgtcttaacacctatcaggaagcgttatcaaacccaaggaatgtggagaagcggcgcttctatgggtacaaagctccataggtggagcggactagctttaagcgagccttttgaagaaacagctgcttacgataacaccaatgttaggaccggtgatgtcgaagcaggtgcaggtgataatgctgcttacacatctgaaccgaatggcgacgcacgctatgcaactaatgaccccaatgggcagtaccatactaccaccaccaacacacgttacaccacaacaacagcggaccctaagacgcgttacaccaccaacgatcgtaatcctggttctgcgaatgtcgctaacagtgcagtggaccagcacgcttactctacggatgagtcaggtgatcggtcttatcaagaaaaggtcacagaaggagctcactctggcgctatgagtggtagcactgcagaaccaaacaggaacgtcaatcaaatgccataa

SEQ ID NO: 2089 - DNA, 954 bp, Saccharomyces cerevisiae
atgaatttttccctttcaaagcaaagttcagaaaaacaatcatcatatacagacaagtcaagatctcctaatataggaatgtgtacagtcaattataaatcgaacctcccccttcaagtgtccgcagttgatcagctgagcactggtaaggggactcaattttatggccacaatagctacaaaaatgaacgggaatgttataatagtacgaaaataaacttaccaccaatttcatcccttttgcctaattttgaaaataatacaccacctaacgtagattcaagggttcaattccctccacagcaagtttatcaaagcatgaatgttgtacccattgttaatgagatctacaccccaatttccatgaacgcaacatctgatcaatatcctatctactatacggaaagtcagcaaccaataccacatagccagtctcctcatttgacctcctctgctcccttgatgatgccagtcatggtcccaacagtatataaaccattgacaccatacgacaaagaaccaataacaattgcctccgaacctaacttcactgcaatatcaatggcgagtcacccaaacgctgccttagagctatgccacgataggccaaaatcagtcccacctgggtatggcgtacttccaaccatgcaggaagccagtaacggcagaacaaaaagcgaacctggtgccgtgttgaacggttcagcaacattttctgattggaaaactgacacccgaatatcatccacaaagctgagaaagcagtgcccagtatgtggaaaaatttgttcgaggccctcaacgctgaagacacattacttaattcatacgggagatactcctttcaaatgtacttgggagggttgcacaaaatccttcaatgtgaaaagcaatatgctgagacatttgaaaagccatgaaaggaaaagaaacaaagtcttaaacactacatag

SEQ ID NO: 2090 - DNA, 954 bp, Saccharomyces cerevisiae
atgaccagtacattacatacgacaaaaaaagtgctctccattcaatcacacgtcatacatggctacgtgggaaacaaggccgctacgttcccacttcaatacagaggttgggatgtggacgtattgaacacagttcagttttctaaccactcggggtacgcccacttcacaggcttcaaatgcagcactgaggagttggtagacattgtagagaagggcttgattgggtctcttagaatcaagtatgatgccgtacttagtggctatttacccaatgttcaagccctgcaaaaggtagcaggaatagtgggtcaattatgtgaggggagtgaaaacgtcaagtggatattagatcctgtactgggcgataatggaaggctgtacgtggatcgagaatgtgttgcggtataccaagacattttacaaaacttcaaaatttttttggccacaccaaatcagtttgaaatggaactgttggtggggatgtcaattcgtaccttagacgacgctaagcaggcatttaaactatttcataaaaagtaccctcgagtaagccgaatagttgtcactagtctggaattatctgaattcctgagcaacgacacttacgtagtagcagggtttgattgctcggccagtgaagagatattcttctatgaaatccccaagatcaacgcaaaatttagtggaagtggtgatttaatcagcgccatgctcactgactcgttactaggcgaccgccgctgcacacagctgtcattaagcgcatccttgggccaagtgctgtggctcgtcaccagtatcctacaaaaaacgtatgatttaaacatagctgagcggggcccacaagattccacgatagatatcaaggatttaaagctgattcagtgtagagacatcctaaagcaagatctcataccctccattggcaagccaaaaaccattaaaatatga

SEQ ID NO: 2091 - DNA, 954 bp, Saccharomyces cerevisiae
atgagcagcacgaggaagttcaaaaaggttgagaaacctctatcacaaaccagacattattcactctgtatccccacgacattggtatcggactgtcgcaacctctctcaaatcacgcataaggtgtaccaagtggccaagtttgcatcgctgtttaatgtttctgaggttgtcattcttgaggacaattcccaggtcgatgccaccaaaaaaaaaatctccactgctaaattaatactggcacttttacaatacttcgtcacgcctccatatcttcgcaatactgtcttcaacgaaaaattcagaccttatttgaccgccgcttcaaaattaccaagattatccacacttcctttcaccaggtaccaaaagcaagatcacggtcggtacagagaaggcctcactatcaagatgcagaaacccaccttggctcgcaaaaagattggtaaggtattcaagcaaaccaaatatattaatatagggaaaagcaaagcactggctctacaaagtcagctggtgccgataaacgcaagggtcaccatcgacacaataacgaggaaaattgtatctcctcaggaagcttacggtgatttcaccggattggactcgcagtatggctactatactcgtatagcgtcatcgttcacagacttgtttatgaaggggcctttaaaagagggttatacacaatcagtatatgttcccttaaccacgagagacacctctattcccgagttatcatcactgcctaccgccgaaactaatccccacatcttattggtattctcaacgtgggacactcttgctcgagcattcaaactggatcaagatcaattcgtagattgtcaaggtcctcaagagttctttgatgctcagctaccatgccccgtatccaattcggacgttgcagatgcaatccccatgacactgacaactctttcaactgtattttaa

SEQ ID NO: 2092 - DNA, 954 bp, Saccharomyces cerevisiae
atgagtggaatgatagaaaatgggttacagctatcggacaatgctaaaaccttacatagccagatgatgtcgaaaggaataggcgcattatttacacagcaagaactccaaaaacaaatgggaatcgggtcgttaacagacttgatgtccattgtacaggaattgctagacaagaacttgatcaaattagtaaaacaaaacgacgaattaaaatttcaaggtgtcttagaatctgaggcgcaaaagaaagccaccatgtcggctgaagaggcactggtatattcttatatcgaggctagcggtagagaagggatatggtccaagactatcaaggcaagaaccaatctccatcagcatgtagttcttaaatgcttgaagagtttagaatcccaaagatacgtgaagagtgttaagagtgtaaagtttcccacaaggaaaatctacatgttgtacagcttacaaccctctgtggacatcacaggaggtccatggttcacagatggagagctggatatagaatttatcaatagtttattgactattgtttggaggttcatatcagagaacaccttccctaatggcttcaagaatttcgaaaatggacccaaaaaaaacgtcttttatgctccaaacgtaaaaaattactctaccacacaagaaattttggaatttattacagcggcacaagtggccaatgtcgagttaaccccttcaaatatcagatctttgtgtgaagtcttagtgtacgacgacaagctggaaaaagtcacgcatgactgctatagagtgaccttagagagcattctacaaatgaaccaaggtgagggcgagccggaggcaggtaataaggctttggaggatgaagaagaattttccatctttaactacttcaagatgtttccggcttcaaaacacgacaaggaagtggtctatttcgatgaatggacaatttga

SEQ ID NO: 2093 - DNA, 954 bp, Saccharomyces cerevisiae
atgctgttcagctggccttatccagaagccccgattgaaggttattggggcaagccaacttctctgattgattggtgcgaggagaattatgtcgtatccccctatattgcagaatggtcaaatactattaccaatagtatattcttaatgaccgccttctattctacatatagcgcttggcgtaataagttagaaacaaggtatatattgataggaatggggttctcgctggttggtattggttcgtggttatttcatatgactttacagtatcgttatcaattgctagacgaactaccaatgctgtatgcgaccatcatcccatcgtggagtatttttgcagaaactcaagaaatcttgattaaggatgagaagaaaaggaaggaaagctcatttagaatccaaatggtcatttcttttatcatgtgtggtatagtcaccattttaacctggatttacgttgtcgtccaaaagccagcaattttccaagtcctttatggtatattgacgcttctagttgtggttctttctggctggctgacctactatcacgttcatgattcatttgcaaagaaaaatctttttattactatggttatgggcatgattccttttgtcattgggttcatttgctggcaactagatattcacctgtgttctttttggatctatatccggagaacatatttggccctgccattaggtgttctattggaactgcatgcttggtggcatcttttgaccggtactggtgtctatatcttcgtcgtgtatttgcaatatttgagaatattaacccatggaaatccaaatgacttcttatttatatggaggtggggatttttccctgagctggtaagaaagggcttaccgattggtacttcttattcactggagtatctggggccaattgtaaatacacaggtagatgatgaaacaaaaaagaataactaa

SEQ ID NO: 2094 - DNA, 954 bp, Saccharomyces cerevisiae
atggaggacagtagcaatacaatcataccctcacccactgacgtgggggcgctagcaaacagaatcaactttcaaaccagagatgcccacaataaaatcaataccttcatgggcataaagatggccatcgccatgagacatggctttatatacagacagggtattctggcgtactattatgtgttcgatgccatcgagcaagagatagatcgcctactgaatgaccccgtaacggaggaggagctgcaaacttcgaccattctgaagcagttttggctcgaagattttagaagatctacgcagatctataaggacctgaagctgctatactcaaacacgtttaaaagcacagaatcattaaacgaattcctggctacgttccagaagccaccgctactacagcagtttatcaataacatccacgaaaacatacacaaggagccatgcaccattctttcttactgtcacgttctgtacttggcgcttttcgccggcggcaagctaatacgatcgaatttgtacagaagactggggctcttccccaacttcgagaagctatcacagaaggaactggtcaaaaagggcacaaacttcttcaccttcagcgatctgggtcccactgaagaaacacgcttgaaatgggaatacaagaagaactatgagctggccaccaggacggaattgaccgaagcacaaaagttgcagatcattagcgtcgcagaaggcatttttgattggaacttcaacatcgttgcagaaattggagagttgaatcgtcgcgagttaatgggcaagttcagcttcaagtgtattacgtacttgtacgaagaatggatgttcaacaaggattctgctactagaagagcactccacacggtcatgctgctggtgctttctattatcgcgatctgggttctttacttcttggtaaagagttttcttagcatagtataa

SEQ ID NO: 2095 - DNA, 954 bp, Saccharomyces cerevisiae
atggatcaagattttgacagtttattactaggtttcaatgactccgatagtgtccaaaaagacccaactgtaccaaatggcttggatggttcagtagttgatcctaccattgcggatccaaccgcaattacagctagaaagagaaggcctcaagtaaaattaacagccgaaaaactactcagtgataaaggtttaccatatgttttgaaaaatgcacataaaaggatacgaatttcctcaaaaaaaaactcatatgacaacttatcaaatattattcagttttaccagctttgggcacatgaattgtttcccaaggcaaaatttaaggattttatgaagatctgtcaaacagtaggtaaaacagatccagttcttagagaatatagagtcagcctttttagggacgagatgggcatgagtttcgatgttggcacacgggagactgggcaagacctggaaagacaatcacctatggttgaagaacatgtcacttccgcggaagagaggcctattgtcgcagatagttttgcgcaagacaaaaggaatgtaaacaatgtcgattacgataatgacgaagatgacgatatctatcacctttcttatcgcaacagaagaggacgagttttggacgaacgtgggaataatgaaacggtacttaacaacgttgtgccgcctaaggaagatttggatgcattattgaagacattcagggtacaagggcccgttggccttgaagaaaatgagaagaagctcttattaggatggctagatgcgcatagaaaaatggaaaaaggctctatgactgaagaagacgttcaactgattcaaagtttggaagagtgggaaatgaatgatatagagggacaacatactcattatgatttattgccagggggagatgagtttggcgtagatcaagatgagttggatgctatgaaggaaatgggcttttag

SEQ ID NO: 2096 - DNA, 954 bp, Saccharomyces cerevisiae
atggcaaaagacggcttcgagttatatagatacactccggaattaggtgcgagtatactttttacggtactttttgcagtatcaggggtagcatttgtaattttactattccattattctgtgaaaagtaaaaggagagttggctctcttatgaagtcccaacccgtattgcggtattacggtacggtaaacttagcaggagcgtacattccctttatatttgggtgttttgttgagtgtgtgggctttgcgtttagatgtaaatcaagcaaagacaccacactactaaacccctatattattcaaacggttttcttgctggtgtctccaacattatatgctgccagtatttacatgatttttggtagaatggctactctgctgttcgcagaaaacttaatgatcatgcccgctagattcaatactacaatatttgtgattggcgatgtaggcagtcttctattacaagcaattggtggtgctatgatgtctaaagtgacaagtgcatcttctggttctcatctcgttacagctggtttgttcattcaaattgctttttttggtctcttcattataaatgaggttttgttcattttcaagatgagcaaaaaaccaaccaatgtatcggtaaggtatggtagttggaaatacctaaacattgctttattggtgaacagtttcctgattttaattaggtcgatcgtcagagctgttgaatttattcagggttatgacggagaaattgcctcgcacgagtggtatctttatatttttgatggtttaccaatgtttttactcgtattaatttttattgtggcgttcccactaattaacatttttagaatacatgaagagtctattcaagcgcaacaatcagcaagatttgacggcaccgactatcctgacgttgaggtgacgtctatcgaagaagatctcgcttcaaagagcgaataa

SEQ ID NO: 2097 - DNA, 954 bp, Saccharomyces cerevisiae
atgtatgtttaacagtgatactaaattttgaacctttcacaagatttatctttaaatatgttatgaatgtcatcctttggagagaaatagataaggaaaaaaattgaggatacagcatccggtggtcgcatagttggtagcaacatccatagaagaacctcagataaatttcaagcttgtacgaattgccgcgtttattacaaactatagaattatcgcagcaatggtacgtgtctgttcctgcaagcgttaattcgattgatagataaagtaattcattaacctttgcgaatatgctctttactgttaggtttcaggattttaaaaatgaagcaactttactaacatcaatatgcaaataaatctgcaaaaactttttttcacagggctaacttgcgtactcaaaagagacttgccgcttctgttgtcggtgttggtaagagaaaggtttggttagacccaaacgaaacttctgaaattgcccaagccaactctagaaatgccattagaaaattggtcaagaacggaaccatcgtcaagaaggccgttactgtccactctaaatctagaactagagcccatgctcaatccaagagagaaggtcgtcacagtggttacggtaagagaaagggtactagagaagctcgtttaccatcccaagtcgtctggatcagaagattacgtgtcttgagaagattattggccaagtaccgtgacgctggtaagattgacaagcatttgtaccacgttttgtacaaggaatccaagggtaacgccttcaagcacaagagagctttggttgaacacattattcaagctaaggctgatgctcaacgtgaaaaggctttgaacgaagaagctgaagctagaagattgaagaacagagctgctcgtgacagaagagctcaaagagttgctgaaaagagagacgctttgctaaaggaagacgcttaa

SEQ ID NO: 2098 - DNA, 954 bp, Saccharomyces cerevisiae
atgtcaactttattagaaaggactaagagtgtgcaagagctgaagaagagagctgcagggaaaacatccgcaaatcccgcagaggtcgctaaagctaaaaaagtactaagaaggctatatagttgggatgaaattccggaatggcaaagagacaatgattttattttacatggatacgtgaaagaaactagtagcttcattgaaacttttaaaagtttgttttatttgcataatgaaagtgtcaatatttattcacatttaattcctgctctcgggttcttcactgtactgttgctagataaatctactatcaaagtgtttgcaacaactacatggctagatcatatggtaatcgacctcttttattcgggggcgtttgcatgtttaatattgagtagctcctttcattgtctaaagagtcactccttaagaattgctaccttaggaaataagttggactaccttggtatttgtatattgattgttacgtcaatggtcagtattttgtactacggctattttgagaaattttccctattttgcctatttgcgcttattaccgttagctttgggatcgcgtgtagtattgtgtcactaaaagataagtttcggaaaagagagtggagaccttacagagctgggctatttgtttgttttggtttatcctcaattattccaatattcagcggcctttactgctatagtttttcagaaatttggacccaaattcagctcttttgggtattacttgggggtgtcctatatataattggcgctgttctttatggaatgcggtttcctgaaaagatttgccccggtaaatttgatatttggggtcattctcaccaacttttccattttctagttgttattgcggcattgtgccacttgagaggtttattaaatagttatgagttagtccatataaagatggagaacgggattgtctcctag

SEQ ID NO: 2099 - DNA, 954 bp, Saccharomyces cerevisiae
atgtcgtgctcaaacggcatctggcctactgtatctaatttgtgcggatcattatccttcttcacctctgttatttcattgtttccacaaataattgagacttatcgagataaatctgtcgatgggctatcgccatattttttgctggcttggttatgtggggatattacctcgctgataggggcaaagctaacagggcaattgttatttcagatacttttagcaatttattttctattgaatgattcttttgtatgtggtcaatattattactatggcgtgctgcatgaaaataaattggcgactgtcggccatgagcctaaacctcttcttcccgaactggttgaaaatggtgagcttttgagggaggaagaggacatgatacaaggtggtagcagtgcagaaagccctagaagcagtagaagaaggtctgccattacagcagccttggctatagctcatactataagtacagctagcgcatatccgctaaatgtaggctccacccaatcacaagtggggcctcccggagatggtaaaaacagccagctgggtacaattttatcttggattggcgcttccttctacgtaggcgcacgtatcccacaactaatcaagaattacaatagaaagtctacagacggcttatctcccttcctatttgctactacactactctgcaatatcacgtataatttgagcatcttcacaagctgtagatttttagataatcagaacaagagggaattcatcgtgaatgagttgccctttatatttggaagtgctggaacaattgcgtttgatttgatatacttctaccaatactatatcctttatgcaactgatatgcaactacgtgaactggaaagagaactatacagtcctgaagaagacagtgcagcgcaactagtgacagaacgtacatcactgttgtctggtgaaacgcaaacatag

SEQ ID NO: 2100 - DNA, 957 bp, Saccharomyces cerevisiae
atgacagtaatcaccattgccaagagaggccttccaaaattaaccacttccacttcttcgacaacaactgccagttcaagtagtacgataacatctgttgcttcttcttcatcttctttaccacttttgtccaactctacatcctcttctattataccaagtattactcctccctctagaaatggtaatccttatattttggattccggggatatgcctaatggaacagttttcattgtagtggggggaatcgcgggagtgatttttttggcaatattgctatggtgggtaataacaacttattcttcgcataggttgaccagaagtgttcaggactacgaatcaaagatgttttccacacaacatacccagttttacggcgattccccatatatggattatcccgccaaagaaaatttccaagatcaggtccatatcagcgagtccgatattagtcccggaaataaggatgaatcggtgaaagatgcacttgtatctcatactaataatgaaaaaccattcttaagtaatttcgaaaggccgctattctctcttgcatccgaatccaacagaaattcacttttcatttcaccaacaggtgatatcttatacaaaacaaggctatctaaactttaccaagaaagccctagattattacagaaacctgtgattatgacaagtgataatgtatctacaaattctctggtgtctacaatctcttcatcatccgcatcgtcgctcgataacggtaatgaaaaggaggtgggtgaagacataaggaaacccgcaaaaattgcatcttcaccaagtcgaaagctgcttaattcaccagaaagtgatggtagcgtaaatcgtaaccatagtaagggtaatttgttggtcgtacagtccaaaagaaaacctacaccttcgacttatctcgagcacatgctggaggggaaagaacaggatgagtaa

SEQ ID NO: 2101 - DNA, 957 bp, Saccharomyces cerevisiae
atgagtgaagaaggtcctcaagttaaaataagagaagctagtaaagataacgtcgactttatactatccaatgtggatttggctatggccaattctctccgtagagtcatgatagcagagattcccactttagccattgattcagtcgaagtcgaaacaaatactacggttttggccgatgaatttattgcacacagattaggtttaatacctctacaaagtatggatatcgaacaactagaatacagtcgtgattgtttttgtgaggaccactgtgataagtgttcagtggtgttaacattgcaagcgttcggcgaaagcgaaagtactacaaacgtctacagcaaggacttggtaattgtgtctaatctcatgggccgtaatattgggcatcctattatacaagataaagaaggtaacggtgttcttatttgtaaattgagaaaaggtcaagaattgaaactgacatgcgttgcgaaaaagggtatagccaaagagcacgccaagtggggtccagcagcagccatagagttcgagtatgatccttggaataagctcaaacataccgattactggtatgaacaggattctgccaaagaatggcctcagtctaaaaattgtgaatacgaagatcctccaaacgaaggtgaccccttcgattataaggctcaggcagatacattttatatgaatgtagaatctgtggggtctattcccgttgatcaagttgtcgtcagaggtatcgatacattacagaaaaaggttgcctcaatattgttagctctgacacagatggatcaagacaaagttaattttgcatcgggtgataacaacaccgcttcaaatatgctgggaagtaacgaagacgtaatgatgacgggcgctgagcaagatccttactccaatgcatctcaaatgggtaatactggatcaggagggtatgataatgcttggtag

SEQ ID NO: 2102 - DNA, 957 bp, Saccharomyces cerevisiae
atgggaaaggctgcgaaaaagaagtactccggagcaacttcgtccaaacaagtctctgccgagaaacatttgagttcagtatttaaattcaacacagatctaggtcagcatattttgaaaaatcctttggtggcgcaaggtattgttgataaggcacagattagaccctcagatgttgttttggaggttggtcctggtacaggtaacctaactgtaaggatcctcgaacaagcaaaaaacgtagtggcagtagaaatggatcccagaatggctgcagaattaactaagagggtacgtggcacacctgtggagaaaaagttagaaatcatgcttggagattttatgaagactgaattaccatactttgatatctgtattagtaacactccttaccagatctcatcgcctctggttttcaaattaattaaccaaccaagaccaccaagagtatctattcttatgtttcaaagagagtttgctttaagattactggcaagaccaggtgactcattatactgtagattatccgccaatgtacaaatgtgggctaatgttacacacatcatgaaagtgggtaagaataacttcagaccgccaccacaagtggaatccagcgttgttagactagagattaaaaatccaagaccgcaagtggattacaacgaatgggatggtttgttgagaatcgtctttgtgaggaaaaacagaacgatttcagctggcttcaaatcgaccaccgtgatggacattctggagaagaattataagacatttttggcgatgaacaacgaaatggtggatgatacaaagggttctatgcacgatgtcgtcaaggaaaagattgacacagttctgaaggagaccgacttaggcgacaaaagagcgggtaaatgtgatcaaaatgatttcctaaggctattatatgcttttcaccaggttggtatccatttttcatga

SEQ ID NO: 2103 - DNA, 957 bp, Saccharomyces cerevisiae
atggggaaaggtgcggccaagtatggttttaaaagtggggttttccccacaacaaggtccattctgaagagccccactacaaagcagactgatattattaataaggtaaaatcacccaagcccaagggtgttcttggtattgggtatgccaaaggtgtaaaacatccaaaaggatcacatagattatcacccaaggtaaactttatcgacgtggataatctcattgcgaagaccgttgctgaaccccagagtataaaatccagtaacggttcagcacagaaagtgagattacaaaaagctgaattaagaagaaagtttttgattgaagcatttcgcaaggaagaggctaggctattacacaaacacgagtatttgcagaagaggacaaaggaactggaaaaagcaaaagaactggagctagaaaaactaaataaggaaaaatcttcagacttgactattatgactctagacaaaatgatgtctcaacctcttttaaggaacagatcaccagaagagagcgaattgttgaagttgaaaaggaattacaatcgatcgttgttgaactttcaggcgcacaagaaaaagctaaacgaattattaaacctctaccatgtcgctaatgaattcatcgttacagaatcccaactactaaagaaaattgataaggtttttaacgatgaaacggaggaattcactgatgcctatgatgtaacttctaacttcacgcaatttggaaatagaaaattattactttcaggtaacaccaccctacaaacccaaattaacaacgcaataatgggctctttgtcaaacgaaaagtttttcgatatttctttagtggattcatatctgaacaaggatttaaaaaacatttccaataaaattgattccaaattaaaccccacctctaatggagctggaaataatggtaataataataatacaaccaacttgtaa

SEQ ID NO: 2104 - DNA, 957 bp, Saccharomyces cerevisiae
atgtctacaaacagtattaagttgttagctggtaactcacatcctgggcttgctgagcttatttcccaaaggcttggtgtaccgttatctaaagtgggggtatatcagtattcaaataaagagacgtctgttacaataggggaaagcattcgtgatgaagacgtatatatcatccaaactggttacggggaacatgaaatcaacgatttcttaatggaattacttatcttaattcacgcttgtaagacggcatcagtcagaagaattacggcagtaataccaaatttcccttatgctagacaagataagaaggataaatcgcgggcgcccatcactgcgaagctgattgccaatcttttggaaactgcgggttgtgatcatgttattactatggatctccatgcttcacaaattcaagggttttttcatatcccggttgataatttatacggtgaaccaagtgtgttgaattacataaggaccaaaacagatttcaataatgcgatactggtatcgcctgatgctggtggtgcgaaaagggtggcttctttagcggacaagctggatatgaattttgccttgattcataaggagaggcaaaaagctaatgaagtttcgcgaatgctgcttgtcggtgatgttgctggtaagtcatgcttgttgattgacgatatggctgacacgtgtggtacgctggtgaaagcctgtgacacattaatggatcacggtgctaaggaggttatcgctattgtcacacatggtatattttctggctcagctagggagaagttaataaatagtaggttatcaagaattgtttgcaccaacacggtacctgttgatttggatttggacattgtcgatcaggtggatatcagccctacgattgcagaagctatcagaagattgcataatggagaatcagtctcatatttatttacacatgcgcctgtttaa

SEQ ID NO: 2105 - DNA, 957 bp, Saccharomyces cerevisiae
atgtcttccaacgcccaagtcaaaaccccattacctccagccccagctccaaagaaggaatctaactttttgattgatttcttaatgggtggtgtcagtgccgctgtcgccaaaactgctgcatctcccatcgaaagagttaaacttttgatccaaaaccaagatgaaatgttaaaacaaggtactttggacagaaaatacgcaggtatcttagactgtttcaagagaaccgctacacaggaaggtgttatctcattctggagaggtaacactgctaacgttatccgttatttccccactcaagctttgaatttcgccttcaaggacaagatcaaggccatgtttggtttcaagaaggaagaaggttacgccaaatggtttgccggtaacttggcatctggtggtgctgctggtgccttgtcattactatttgtttactctttggattatgcaagaactagattggctgctgactccaagtcctctaaaaagggtggtgctcgtcaattcaacggtttgatcgatgtctacaagaagaccttaaaatctgatggtgttgctggtctttacagaggtttcttaccttctgtcgttggtattgttgtctacagaggtctatacttcggtatgtacgattctttgaagcctctattgttgactggttctttggaaggttcattcttggcttcattcttgttgggttgggttgttactactggtgcttctacatgttcttacccattggataccgttagaagaagaatgatgatgacctccggtcaagctgttaagtacgacggtgcctttgactgtttgaggaagattgttgctgctgaaggtgttggttctctattcaagggttgtggtgctaacatcttaagaggtgtcgcaggtgctggtgttatctcaatgtacgaccaactgcaaatgatcttgtttggtaagaagttcaaataa

SEQ ID NO: 2106 - DNA, 957 bp, Saccharomyces cerevisiae
atgtggagactaaccagaaaaatcggcactagaatccatatttctaatcagctgtcgcccatttttaacaaggcaattggaacagttcctgtttttcgtttttattcttccagcccagagcagaagtatagaaagaaacttttggaagaggctcaaaaacaaggttttaacagcatagaagagttgaaaaatcatttgaaagagactatagagtctaagaagcgggaatttaataaaatcgaccccctgaaagaactagaggattaccaacaaaaaactcaaatggaaaataacaactccaagcatttgatgacgaaatcaagaagtcctctcgatccaagtgctcctaaagttcccttcaaaacattggactcttttttggatgttggaaaactgaaggacttatcgaaacaggaagtagagtttctttggagagcaagatgggcacaaaaagataatacattatgcgctgtgattcctgtctccgtttatgataagatgatggcaaatgccaggaataaccctatattcgtgttgccacttcctagacaagttcaatctgaggatgcaaaaccgaacgaagaacagggaatggaactacactacatccaatggcagtttgtcggaccccaaacaacacattgtatgatgacttccctagcagaatacaaactacaccaggaatttgcaaggccacatactaccttgcagttccattctgatttggtcaaggataagggaattgtttttatgaatggccatgttgaaccggatacaaacgtgaatgtacaggatgcacagctgttattgctaaacgtgcaaaggttttatggtgcaatgggtgaagaaactccagttgctaaacagagagtgcagttgttaagagatttctctaaggcctctccgggattcaccgtcgagaaattgatttcgctatcacagtccatggaaaattaa

SEQ ID NO: 2107 - DNA, 957 bp, Saccharomyces cerevisiae
atgtggttgaaatccttgctgctctgcctgtactccttagtactctgccaagtccacgctgcaccttcatcagggaagcagattacctccaaggatgttgatcttcagaaaaaatatgagcccagtccccccgccacacatcgtggaataatcactatcgaatactttgatcccgtttcgaagtcgatgaaagaggcggatctgacttttgagttgtacggtactgtcgtgcccaaaactgtgaacaactttgctatgctggcccatggtgttaaggcagttatcgaagggaaagatcccaatgatatacatacttactcgtaccgtaagaccaaaatcaacaaggtttaccctaacaagtatatccagggtggtgtggttgccccagatgtgggtcctttcaccgtctatgggcccaaatttgatgacgaaaacttttacttaaaacatgacaggcctgaaagactcgcaatggcctattttggacctgattctaacacctcggaattcatcatcaccactaaagccgatggaaatgaggaattggatggcaaaagtgtcgtgtttggtcaaataacttctggtctagatcaactaatggatgctattcaatacacagaaacagacgaatatggaaagcctcagcatgaattacggttcctgtatttcgttctagaaatcttaaaaattagtaacatcttagatttgcacgctgcgtacacagaaaaagtcgagaagtttagaaatggcgatgtgtctgttggctccactttggaaaacatcttccgtaacgataaagcctacacacctttaaccacctccactggaaccaccgcctatgatttaaaccacccaatttccagagccttgatgtgtttaactgttcttggcctttgtttcattgcctacaagggcatgcacgaaaagcctcatacggtttcattaagacacaagtaa

SEQ ID NO: 2108 - DNA, 957 bp, Saccharomyces cerevisiae
atgttatttcttaatattattaagctccttttgggactttttattatgaatgaagtaaaggcgcaaaacttttacgattccgatcctcatatatcagagttaacgccaaaaagcttcgataaagcgatccataacacaaattacacatcattagtggaattttatgctccgtggtgcggccattgtaagaagctctctagtacgttccgcaaggcagcaaaaagattggatggtgtagtccaagttgctgctgtaaactgtgaccttaacaagaataaggctttgtgtgctaaatacgacgtaaacggatttcccacgttaatggtatttaggcccccaaaaattgacctatctaagccaatagataacgccaaaaaaagtttcagcgctcatgccaatgaagtgtactcaggtgcaagaactctcgcgcctattgttgatttttctctttcaagaataaggtcatatgtcaaaaagtttgtccgtatagatacacttggctctttacttagaaagtcacccaaactttccgtggtgttgttttccaaacaagacaaaatttcaccggtttataaaagcattgcccttgattggttaggaaagttcgatttttattcaatttcaaacaaaaaactcaagcaactaaccgatatgaacccaacatatgaaaaaactcctgagattttcaaatatttgcagaaggtcattcctgaacagcgacagagcgataaaagtaagcttgtcgtttttgatgcagacaaagataaattttgggagtatgaagggaactcaatcaacaaaaatgacatttccaaatttctgcgggacacttttagtattacccccaatgagggtccttttagtagacgttctgaatatattgcttacttaaaaactggcaagaagccaattaaaaagaaccattcctcctcaggaaacaagcacgacgaattgtag

SEQ ID NO: 2109 - DNA, 960 bp, Saccharomyces cerevisiae
atgaaagtaccattggggttatggaaagtctctcggggtaatttgtggagcacccagaaaagggttttgacaatgtctagatgtttgaacagtgatgctggtaatgaagctaaaactgtgagagaaggaccagctttttcagcagatctctatatgcatcccgaaaaatggaagggtttacctcctcaaagaattttagagttatattgggagagaatggctagattgggttcagagtataaacctaacaaagacgaactgaatgccttattaaccacttctgagtactcaaatgtacctgttaacgatattaaaaagctatatcacagaggagaacaaggcgctattgatataaaaggtggaaacgtgaatcgcgataacagtcttagaccgtttatgtttgatgaattgccatcgcaagctcaggaattggttgcccaacatcgtgaacaaaggttctataatcgattagccgcatatgagttaccgctattagctcaatatcgccaggaatacaagagaccatctccagaaagtcatccggtcacttatagatacactagttatgttggcgaagagcatcccaattcgaggaaggttgtattaagcgttaaaaccaaggaattgggcctggaggaaaaatcattacataagttcagaatattagccaggtcgcgttatgatcatactacagatatttttaaaatgtctagtgacaaatttgagcatgcatcacaaaatgcacgttatttgcatgatattcttcaaaggctgttagcggagtcaaaagatttgacggaggacgattttagcgatgttccccttgacacaaggcatactatagctaagagtttacgtaaaaagaagcgggattatgagtttcctgaacactggaaacgccctgaagatgcaccaaagaagaaatttgatattgtagatcaattattgagcactctttaa

SEQ ID NO: 2110 - DNA, 960 bp, Saccharomyces cerevisiae
atgacgataaaaagaaatttggtgaaagtacgtatcagaggatcgtccctcgctctttttccatttggttgtcgattttctgaagatgaatccgtatactaacattacaaccattttatgcaatagactttacaatctatacgctaccaagctaccactgccaccgcacatgcagaatccacgttaaaccctctgccaaacgcagccattcctcccaaatacgccttagttaccgttcgctcctttccatcattagaaccattgacatttgtgccggtccccacatcaactgtagctgctccattaaggcgtgatatactatggagagccgtagtttatgaaaacgataatagaagagtaggcgcctcaaatcctcccgggagaagtgaaaacgggttttccagacgtaaattgatgccccaaaagggttctggtagggcaagagtcggggatgctaactctccaacaagacataatggtggtagggcattggcaagaactgcaccaaacgactatactacagagctaccatccaaggtttattccatggctttcaacaacgctttgagccaccaatataaaagtggaaagttgtttgttattggtggtgaaaaggtcgacttaatatctcccacaccagaactcgacttgaacaggctggatcttgtgaatacaaacacagttgagggcaaagagatttttgagggcgaagtcatcttcagaaaattcttggaggaatttcaacttaaaggtaagagattacttttcattacagacaagactagggaagggctgataaagagttctgatccatacaaacaaaaagtagatgttatacagaaagaacttgttgaggtaaatgacatactaagagcccaagctgtttttatcgaattggaagctcttgaatatctagcaatggcccatcagaaagaaatccttcactccgtgtctaactga

SEQ ID NO: 2111 - DNA, 960 bp, Saccharomyces cerevisiae
atgactattctagaggagcttaatgattcaagcattcctcagaggctagataatcacatatttttcggctccgtacattcactgacgcatacagatttcctagtagaaaataacattaggtttttcataaacgttgatttatcgactgaactaatatcacatatctatcatgaggtccgctcaaagtttgcccatgaaatagtaattgtcaacatcgacaatgactctcaaataccaatagaaagcgatttggtgcgttccttccattggcacaacacttcccttttgcaacaattgatccatcatctcgattttctcagcggtattaataatcacggcgaaccattaactccaccaccagaatctcattacagaaatgcgtatgttcaattcgaccatccaagtgactcagtatcgatattagataaacttttatatggtaataagtcagaatactcgcgtacaaatattttccaagttaccaacgaagcgaagtttcaagtcttcaacgacctaattacaattttcaaatactctatcgctcaaggcgggaataccaatagtaacatacttgttctctcagaaaacggcagcaccgatgaaaatttgataagtttactgatgtctaccgtattgaaagaaaacccaactttcaacgtttaccaggccctccaattcgttaagtctattgcagtaattcctgatacggtaagagatgaaaaaatcttatgggtcacaggatttatcaactatcaagaattaatcaagaaaaatgaaatgtattggggcctaggttcgcaaaagggtcgcaaacttacgtcctttgcgtccccaatatcgaaagtggaaagaaaacaaagaagacgtgacgaccagaatatcatgcgatcaaagctaccacaacagagacaaaaccccttctgctcaacagagagacctaaaagggctcgctgcgattag

SEQ ID NO: 2112 - DNA, 960 bp, Saccharomyces cerevisiae
atgagcgaggagtgtattgaaaatcctgaacgtattaaaattggtactgatttaatcaacatccgaaataaaatgaacttaaaagaactaatccatccaaacgaggatgaaaactctaccctactcatacttaatcaaaaaattgacattcctagaccgttgttttacaaaatttggaagctgcatgacttgaaggtctgtgcagatggtgcagccaatagattatatgactacctagatgatgacgaaaccctaaggataaaatatcttcccaattatattattggcgatctggattcactatcagaaaaggtttacaagtattataggaaaaacaaagtaactataataaaacaaactacacaatattcgactgatttcacgaagtgcgttaatttgatctctctacacttcaattcaccagaatttcgttctttaatatcgaataaagacaatcttcagtcaaatcatggaattgaactggaaaagggtattcacacattatacaatactatgaccgagtccttggttttctcgaaagtgactccaattagtctattagcactaggaggaattggtggtagatttgatcagacggttcactcaataacgcaattgtataccttatccgagaatgcaagctatttcaagctttgttacatgactccaacagacttaatattcttaatcaaaaaaaatggaactttgattgagtatgatccccaatttaggaacacttgtataggaaattgtgggttgttgcctattggagaggctactttggttaaggaaacccgtggtttaaagtgggatgttaaaaactggccaactagcgtggtcaccggaagagtcagcagtagtaacagatttgttggggataattgttgtttcattgataccaaagatgacatcattttgaatgtagaaatattcgttgataaattaatagattttttgtaa

SEQ ID NO: 2113 - DNA, 960 bp, Saccharomyces cerevisiae
atgatggggtttgaatggggttttaaacccagcagtaaaataacacagagtacagtcagttcacaaggcacaggcaatgtaatgattccaactgctggagtgaaacaaaaaaggcggtatgccaacgaggagcaagaagaggaagaactacctcgtaacaagaatgtgatgaaatatgggggcgtctccaagaggaggcctcagccaggatcgctcatcagagggcagcctctgcccttgcaacgaggcatggaactaatgaacaagaaccaattacagcagttgttggtggatttgatgacaaaacatccagaaatacaacaaagcgtacatacgagagtcatcggattagacttcagtatacaaaagtgtctggacatgttgaaacaaaaatcagaagccgtttaccagagcataccttacaataggtcttatgagagtaataaattagatgactatgctttcgtgagaatgaaacctcaaattctggagttcttaaactgtttggtggatttcatactggataacattccaccacgtttggaaaatttgcacgcatcattaaaattcttagacatttgcacggaattagttatcaaattgcccagatttgaattagctagtaataattactactacgataaatgcattgaacaattgtctcacgtatggtgtacgcttattgaacatgttgcccgtgacaggataattttattagcagataatagctccgtctggaaaagtcatatgacaagattacaggtatacaatgaacattcaaatgggttattggaacgcccactccagctgttcaaatctttagatatgggtagcccttcagcagcatcgtcatcaacattatcacttcaagaaagtattatttaccaccacgataccatgacagcaaacgaaaacaataacaatagtggtagcgctgctactgattcgccctttaactaa

SEQ ID NO: 2114 - DNA, 960 bp, Saccharomyces cerevisiae
atgctaaaatccgtacagggactgtggaaagatttttttggaatacgagatgatggcaggaaacgagaatacgggtcccttgatgaagtgagaaaacgatctgccttaaggagcagaagaaagcagatgcgtcctacgggtaaaagcgttctaaaaagacctagaaaggtgacagataggaaaactgaagaaaaaattcgtactaacaggaggaaaacacccaaacgaaggttaacaaagatattccagacaatcagagatgttttttccaatgataatgaaaatatgagcaagatgcaaaatgtttgtggcgacatgactagaattttgaagaagagatcccagggaagaccttcttatatggacacagatacagccaaatctaggatcctaaggagtgatgcctttaagagaaagatatcggagttgaaatacaataagcaacggatcagtgaactaagaagtggtagttctgacgggtcgagtggaaaagatagaaatcaatcattatacttagatagagaaattcttctacagcggcaaattaagaaaagagatgagaaaataaaagccttggaaagcaagctacaatcattacaagaagcattgaattactcaaatgagaagtacaggattttggaggatttactagattcttcaaacattcatccatcatacaccaaatctaggagaaccatgtctaatctagctagagaaaacgatgagattaagcccttgaaaattgatctttccccgtctccaataagaagaacgaattcattattcacttccagccccatgaaaacatataatcgggatggaaatataccagagatgcagccgttacaggaaaacatatctcccgcctgtcccactccaccctatcgttcaagggaaactgaaaaagaggatgaaacactttcaccaatctcagtggacttttcaagttatttatcttaa

SEQ ID NO: 2115 - DNA, 960 bp, Saccharomyces cerevisiae
atggttcacaacaaagttactatcattggttcaggtccagctgcacacaccgccgccatctatttggccagggcagaaatcaagccaatcctatatgaaggtatgatggcgaacggtattgctgccggtggccagctaaccaccactacagaaatcgaaaacttcccaggtttcccagatggtctaacaggtagcgaactgatggacagaatgagagaacaatccacgaagtttggcactgaaattatcacggaaacagtttccaaagttgatctgtcttccaaaccattcaagctatggaccgaatttaacgaagacgcagaacctgtgacgactgacgctataatcttggccacaggcgcttctgctaagagaatgcatttgccgggcgaggaaacctactggcaaaaaggtatttctgcctgtgccgtgtgtgatggtgccgtccccattttcagaaacaagccattggccgtcattggtggtggtgactctgcatgtgaagaagctcagttcttgaccaagtacggctcaaaagtgtttatgcttgtcagaaaagaccatttgcgtgcttctaccattatgcaaaagcgtgctgagaagaacgaaaaaattgaaatcctttacaacactgttgcgctagaagctaagggggatggtaaattattgaatgccttgaggattaagaacactaaaaagaatgaagaaaccgatttgccagtcagcggtttattttatgcaattggccacactccagcaacaaagattgtcgctggccaagtcgacactgatgaagcgggctacattaaaactgtcccaggcagctcattaacctccgttccaggatttttcgctgctggtgatgttcaggattctaaatacagacaagctattacttctgctggctctggttgtatggccgctttggatgctgagaaatacttaacttccctagaatag

SEQ ID NO: 2116 - DNA, 960 bp, Saccharomyces cerevisiae
atgtggaagagatcgttccactcccaaggagggcccctgcgtgccagaacaaagtttaccaaaccaaagccaaaacaaccggtgcttcccaaagacaaaataagaccgcccactcaattgactcatcactccaacaacctgaggattaccgaaccaatcccaccaacaacctcaaacctgcgctgtcccgacgaccacccgctgtggcagttcttctccaacaagaaattcatcaggtccgccgacgacttgccgccttccagccatatcagaccctggagcatcccagagttgaggcacaagtcctttaacgacttgcattccctttggtacaactgcctcagggagcaaaatgtgcttgctcgcgaaaaccatctcttgaaaaacattgttggctccacgcatgacgaattcagtgagctctctaactctatcagaaccaccatgtggcaaataagacatgtacttaacgaaagagagctggcctatagcgcttcacgcgaatttttacaggatgaatcggagaggaaaaagttcttggatactttggccaacgattacttcttgaacaaggatatccctgatgacgaagtcgcctccatgctcacacgattccagttggccattttcggcatatcggaaaccatccaggataatacagtcgacattaacttcatcgacgggatcaagttcttggcaaacttaaaactacagcggttcaaggactccaatgacctcatatccgaaatatcacaagaaccgatcacagacgtgggcgagtcgttcatcttattcacttccgacttcgaacctcatgccgttcaagaggcttgtgtcgccatcaaagacctgagaaagtccccagataataaagtccctaaattagacgaactccccaccgtgagaaaatacttgaaacagctaattcatgcaagctccgtggagcaagcaactgcatga

SEQ ID NO: 2117 - DNA, 961 bp, Saccharomyces cerevisiae
atgccttccagattcactaagactagaaagcacagaggtcacgtctcaggtatgtagttccatttggaagagggaatgaaagaaccaagacggtgactttttttttagtgttgtgcaaccaatatgtcgtgtgtatatcatggtacaggagaatgtcaatcagctaagtgtactcaacatatttctttgtgttttgattgcgaactttgtattaccatctcactgttgagacggcttatttgaggtaatagctcgagtaaatgtactcttccatcgcaaactgagcaaaaagaaagtgtgcatagcctttgtcatacttctcctttattataccatgatattcagaacagtcatactgtctactcattttacggctataaaaggtaactttcatttagattatggaaagcactaattatcgctgtatcaaatggttgtagagagcgcaattatgaaaaagagttaccacgtttcttttgtttcgataaaatgtccagttgaaaacctgttttactaacgatttaaaaattgtatttcattacaatattttttttgtacagccggtaaaggtcgtatcggtaagcacagaaagcaccccggtggtagaggtatggccggtggtcaacatcaccacagaattaacatggataaataccatccaggttatttcggtaaggttggtatgagatacttccacaagcaacaagctcatttctggaagccagtcttgaacttggacaaattgtggacattgatcccagaagacaagagagaccaatacttgaaatctgcttctaaggaaactgctccagttattgacactttggcagccggttacggtaagatcttgggtaagggtagaattccaaatgttccagttatcgtcaaagctagattcgtctccaagttggctgaagaaaaaatcagagctgctggtggtgttgttgaattgatcgcttaa

SEQ ID NO: 2118 - DNA, 963 bp, Saccharomyces cerevisiae
atgaagtttacgttagaagaccaagttgtgttgatcactggtggttcacaaggtcttggaaaggaattcgccaaaaaatattataatgaggctgaaaacacaaagattattatcgtcagtaggtcagaggctagactgctggacacatgcaacgaaattaggattgaagctcacctgagaagggaaaccactgacgagggccaagtgcaacataagttggctgcgcccttggaccttgagcaacggttattttactacccatgcgacttgtcctgctacgaatccgtggaatgtttgttcaatgccctgagagacttggatttactccctacacaaacgttatgctgtgcagggggggctgttcctaagttatttcgtgggctaagcggacatgagttgaacttgggtatggacatcaactataaaacaactttgaacgtggcacatcagattgcccttgcagagcaaaccaaggaacaccacctcatcatcttttctagtgccaccgcgctttacccatttgtgggctattcccagtatgcgcctgcaaaagctgcaatcaaatcactggtagcaatcttaagacaagaactgacgaacttccgtatcagttgtgtttatcctggtaattttgaaagcgaaggtttcactgtagagcagctaacgaaacccgaaattacaaagttgatcgaaggcccctcagacgctatcccatgcaaacaagcatgtgatatcattgccaagtcgctggccagaggtgatgatgacgtttttacagattttgtcggatggatgataatggggatggaccttgggctcaccgcaaagaaaagccgctttgttccgttgcaatggatttttggtgtcctatcaaacattctggtcgtgccattctacatggttggctgttcctggtatatcaggaaatggtttcgtgaaaatgacggcaagaaggccaactga

SEQ ID NO: 2119 - DNA, 963 bp, Saccharomyces cerevisiae
atgatacgttcaatatttataccgccaactagtataactgccacttctcgactgttctacggaatgagggcgtattcaacaaaacttgaaaaggcttcactccaaaaatatctgcatgatcctgttaaagtgactgtgataccaataacggacaaagaatcattcatttactataagcataccgataatctctttaatagtcagtctagaatattaaaagcagaaaagtggatcgttgagaaatcagcaaagctttggagaaaactgaaaaagtcccctaaatcgtataataaaaaaatagtgtccatggtgcagtctctgttaaatagcacaccctggtcagaaaatagtctgttaaccataccaagtgaaagctatatattgaagagaattaagggagagaaagataagacccaagagattcgactcacattgaaagattataccgtaaaggcagaacaggtcgatactcaacccttacacgtgtattatccccctggaatttctagccctgatgagtgcttgagacaaatgaaaaagctctaccaagaaggcttaatttatcacaaaaaatggactttatattgccttttaggtctcccgctgacaattcctctaattttaataccgcttataccaaatgttccagggttctacctatcttatagagcttatgttaatatcaaagcttaccttggtgctaagcacttgaagagtctactggaaagttcaaaacaaaatttagaattcagggaactgttgggatatacggaagtatataaacgtgggaccagcagccgtacgcagggcaatcaaaaggaatcaaaaggtgcaccagaattactacttaacaagaaaacccttccgttgatcttagatttcttagaggttcatgaactagaaagcgacttgaacaaagtcatccttcaagaatcgaaatctcaagagaaaaacaaaatttaa

SEQ ID NO: 2120 - DNA, 963 bp, Saccharomyces cerevisiae
atgattttagtgtacaatcgtatcaggagtataatatcgtcttctttaggtcgaatacatgtacggtataattctaactcacaaaacagatggctgaatagacaactgaaggatccctacacaaaagaggccaaggtccaaaatctgaggtctagagccgcattcaagcttatgcagattgatgataaatatcggctttttagcaaaaacaggaccgatcagagaattctagatcttgggtatgcccctggggcttggtcccaagtagcacggcaaagaagttcacctaattcaatgatactgggcgttgacattctcccttgtgaacctccgcatggtgtgaactctattcaagctaatatattggccaaaagaactcatgatcttatacggctctttttttctaagcatttccaattgaacagacacgatgatttgcataaggaccatggctatttccagaacatgctcgaggaggagctaacccatgtgaaagatactgaattgtaccgtgaaattttcacctctgatgacatttatgaaactccgaatacgaatagtaccctaatagaacgagaaaaattcccagttgatgtgattataagtgatatgtatgaaccctggccccaaacaaccggtttttggaacaacattactaatcaagcttattttaggatggctaatacatctggtgtcagtataagagaccattaccaatctattgatttatgtgacgcagccttagttacggctatagatttattacggccattaggttcgtttgtttgtaaactatacaccggcgaagaagaaaacctatttaaaaaaagaatgcaggcagttttcactaacgttcataagttcaagcctgacgcttctagagacgaatcaaaggagacctattatatcggattaaagaagaaaagaaatgtagataaactggacgtgtttagtaattcataa

SEQ ID NO: 2121 - DNA, 963 bp, Saccharomyces cerevisiae
atgccaacaaattccatcaaattattagcaccagatgtccaccgaggtttagctgaacttgttgccaaaaggctaggtctacagttaacaagcagcaaactaaagagagatccaaccggtgaggtttccttttctattggagaatctgttagggaccaagatatctttatcatcacgcaaattggctctggtgtcgtgaacgatcgtgttctagaactactgatcatgatcaatgcttcgaagactgcgtctgcaagaagaatcactgctattattccaaatttcccatatgcaagacaagatagaaaggataagtctcgtgctcctattaccgctaaattgatggccgatatgttaacaacagccgggtgtgatcatgttattactatggatttgcatgcttcccaaattcaagggttcttcgacgtcccagtagataatttatatgcagaaccaagcgtagttaggtatatcaaggaaaatgtcaactatatggattcaataataatttcgccagatgctggtggggcaaaacgtgctgccactttggctgatcgtttggatctaaattttgcattgatccataaggaaagagctcgtgccaatgaggtttctcgtatggttcttgttggggatgttactgataagatttgtatcattgttgatgatatggccgatacttgtggtactttagctaaggctgctgaaattcttttggagaatagagctaaatctgttattgctattgtcacgcacggtgttttatcaggcagagctattgaaaatattaacaattctaaactggatagagttgtttgcacaaatactgttccatttgaagaaaaaatcaagaagtgcccaaaactggcagtcattgacatcagtagtgtgctggctgaaagtattcgtcgtttgcataatggtgaaagtatttcttatttatttaagaattatcccttataa

SEQ ID NO: 2122 - DNA, 963 bp, Saccharomyces cerevisiae
atggacagtgaagcaagtgacattgaggcagagttatccgacagcgtctcagctggtggggaagaatacattgacgatgatgattatacggaagatattgacgatcagatagtcacagccaaatcatctagaagaacagcacgtaggagtgtacctaagggtgtaagaacctcaaaacgcattagagataaagaactttctgtggaggttgatgaagattatgatgaggaggaagatgtattgagcccttctaagaagcgccatctacacaccagatcaatggacaaaaggcaagttgccgcaacagcttctgaaaaatctgatattggtgatagtaaaggtaatgatggcgaaatagaagacggtatattggaagaagaagagagcttagagaaggaactgaatagaggtggaggaaaggaggtagagaaaagtgaagaatcttactacgcccaaaacgatgttggacagaagggggaggaagaacaagacggggaatctggaggctatgaagataatgaacccagtataagtaaagagtcagacgaattggtctctgtggtaaacggtaacggtaacgaagaggatgatgaagtggaggcaacaaaagaaaatacaacagattctactagaagtactacgactcgaagcaagatgctgttagatttgctggaagatggtgggtctaaaaagaaattaacagatgaagaaatccagctgcgaagagccgaaaatgcacgtaaaaggaagaaccttagcgagaagagactggaagaggagaagcaggacacaatcaataagcttttgaagaaaagggccggtaagtctaggagccacttgccaaatgatgatgaaaagaatgatggctcttcaagtttcgtgaaaccacgcaggccttacaatagcgagggtatgacaagaattctgcggagatatgaagaagacttattttgtacattttaa

SEQ ID NO: 2123 - DNA, 963 bp, Saccharomyces cerevisiae
atgggtgatataagaacttttgttttcgctatagaagatacggaaacaacacaaggtttgtgtaaaaccattggccgttcgagttcatttgatcaaaatagtctatgtaagccgtacaatctatattttgatgagccagaactaagcagacagcatgctgtcctatgtataaagacaccaatacccaaaattgaaggagttccctctatagaacaactccgcatctgcattcgggatttgaataacaagactggtacagtaaacttagtgtctgatgggccaaatgatgaaattgatttgaaaaatggtgatgcttttggtttgattgcaattgataatcatccttttcgcgacaaccatcatttagccgccaagttaattttccgaattgaacttgagtatttcgatgaagcaagggaaatcgtaaagtgcactattacaaatgtaacatttggaaagaataatacagtgtcatctttccctattcattctgcaacatccacagaagatagcgattcaagttggtacggattgtcggaagcgagtacgcaaacggaagttgcagatgagtgtcatgaaacgaacaccatattgactcgaggtggtaggttttctatcctttcgttgagaaaaagaggcagcaagcaagaccagaagatctgcagtaactttgatagaaaaatacatgaaacgagttctttcgaagaagaaatcgaagtttgcactgacacagacaccacagaagaaaaagaagaagaagaagaaaaagaagaaggggatgatgaggaaggagaaatagaacttgaaattattagagtaaaaagaataaagggcaggacgaagataaagaagacgcttacttgcttctcgaaaaacaagaaaattattacccctcagcactccaatagtatgtggttactactaatagtaatcttgatttttgaccgcctactatcgaattaa

SEQ ID NO: 2124 - DNA, 963 bp, Saccharomyces cerevisiae
atgtcgaagcctggtcgtactattttagcaagcaaggtcgccgaaactttcaataccgaaataattaacaacgtagaggaatacaagaagacacataatggtcaaggtccccttcttgtgggattcctagctaataatgatcctgctgcaaagatgtatgctacatggactcaaaagactagcgagtcaatggggttccgctatgacttaagggtcattgaagataaggattttttggaagaagcgataatacaagctaacggcgatgactctgtgaacggtatcatggtatactttcctgttttcggtaatgctcaagatcagtatttgcaacaggttgtgtgcaaggaaaaagatgtagaagggttaaatcatgtttactaccaaaacctgtaccataatgtcagatacctggacaaagaaaaccgtttgaaatccattctaccttgcacaccactagctatcgttaagatattggaattcttgaaaatttacaacaatttgttaccagaaggaaacagactgtatgggaagaaatgcatagtaattaacaggtcagaaatcgtcggtagaccactggcggcgctattagccaatgacggtgccacagtatactctgtggacgttaacaacattcaaaaattcacccgtggtgaaagtttgaaattaaacaagcatcatgtggaagaccttggggagtactctgaagatctgttgaaaaagtgttctcttgattcagatgtggtcatcactggtgtccctagtgaaaattacaaattccccaccgaatacatcaaagaaggtgccgtctgcatcaattttgcatgcaccaaaaattttagcgatgatgtcaaggaaaaagcttctctttacgttccaatgactggtaaagttaccattgcaatgttgttgagaaacatgttacgtttagtaaggaacgtagaactgtctaaagaaaaatag

SEQ ID NO: 2125 - DNA, 963 bp, Saccharomyces cerevisiae
atgtctacctttgaaactttaattaaaagaggtggtaacgaagccatcaaaattaaccctccaaccggtgcggatttccacatcactagtcgtggttccgattggttctggacatgtttctgttgttacctattatttggtttaattttaacattcttaatgttcagaaaaccagtcaatgacagattcttttaccttaccggtattgctccaaactttttcatgtgtatcgcttatttcaccatggcttctaacttaggttggattccagtcaaggctaagtacaaccatgtccaaacttctactcaaaaagaacatccaggttacagacaaatcttctactctagattcgttggttggttcttagctttgccatggccaattattcaaatctgtatgctagctggtaccccattctggcaaatggctttcaatgtttgtattactgaattcttcactgtttgttggttgatcgctgcctgtgttcactccacttacaaatggggttactacaccatcggtctaggtgctgctattgtcgttagtatcagtgttatgaccaccagttacaacttggtgaaacaaagagataacgatatcaggttgacattccttgttttcttcagcattattatgttcttgtggattattgcttacccaacttgtttcggtattaccgatggtggtaacgttttgcagccagactctgccggtattttctatggtatcattgatcttattttgatgtgtttcattccaactttattggttccaattgctaaccacttcggtgctgacaaattgggctaccatttcggacctagtgatgccgaagcagtgatggctccaaaagctccagttgctagtccaagacctgctgctacaccaaacttgagtaaggacaagaaaaagaagtctaagaagagcaagaaatctaagaagtctaagaagtctgaagaataa

SEQ ID NO: 2126 - DNA, 963 bp, Saccharomyces cerevisiae
atgtctgaccaacccgagactccttccaatagtagaaattctcatgaaaatgttggcgcaaagaaagctgacgctaatgttgcctcgaaattcagaagcttgcatatctctgaaaccactaagccattaacatcaactagagctttatacaaaaccacaagaaacaattcaagaggtgcgacagaattccataaacatgtttgtaagttagcatggaaatatcttgcttgtattgataaatcgtcgatatcacacattgaaatcgaaatgaaatttggtgttataacagacaaaaggacacatcgcaggatgacaccacacaacaagccctttattgttcaaaacagaaatggccgcttagtgtctaacgttcctgagcaaatgttctcgagtttccaggagctactccgctcaaaatcggagaatccaagtaaatgtgccccaagagtagtaaaacaggtacaaaagtatacgaaagattctatatataactgcaacaatgcctcgaaagttggcaaattaacttcatggcgttgttcggaagaccttagaaacaaagaacttaaacttacttacatcaaaaaggtccgggtcaaggattttctcattcgctatcctcaaagttcattagacgctaaaattagcatcagccttgaagtgcctgaatacgaaacttctgccgctttcaggaatggctttattttacaaagaaccaaaagccgttccacctacacctttaatgataaaatgcctttacacttggatttgacaaaggttactaccacgcgaaggaactcccatcaatacacgtcccatgaagtggaggtagaaatggatcctatattcaaggagacaatttccgctaatgatagggagaagtttaatgagtatatgtgctcgtttttgaatgccagcgaccttatacgtaaggctgcagaacgcgataacatgttaacgacatga

SEQ ID NO: 2127 - DNA, 963 bp, Saccharomyces cerevisiae
atgttgggaaaagaagaagaacagcaatatggccagaatggtaagggaatggaaaatgaactaccctttatgaagaggccttggtttaaaaaggcttatgaaaatgctattgaatttcatgaaaaagacgaattgctggatgcaagagacaggctggagttatcgaaggcctatagatccattgctaaagctgagatgtggggtggttggcttgggttttcagctgtatttttaactccatttgcctatcgttactacaagaccaaggctattaaaggtgttaaggtgccgaggaattttgtcttgggtgtaatggctttattttttgctacaaattttgctggtaggtccatgtatacacgacagttgaacgaacgtgaccccacaggtgttttgaaggataactattccaacaaatatggtgacaacgactttggagcctttcaacatgatcaaacaaaagaaattccgagaaatcaaaggcagtacaatatgatgcgcttattagattcaggctccccctcaaggtggtcgatgtacttttacataacgtaccaaaatccggagagaagattgccagacccgaaagtcaaactgcagcaaatgaaaaaaggcggagtttttaacggctcgccctttatgaaccaaagggatcctataggattgtatcgtaataagggtagaaaatctcctgacccaattgaaggagagcaaaacgacagtcctgttctgtcttcctgggaaaaaatcaggaacggcgacaacagttcgtcttcatcatgggaaaatataaggaacaccagtagagatcagtcgcaggaatcagatgcttcagtggatcatgaatccgatatatttatctcaggattttctgacgatggtaatgctaccgataattcctcttctgatgacaaatatcagcgtttactgcagagcgggagatatggtgggaaccgctcctag

SEQ ID NO: 2128 - DNA, 965 bp, Saccharomyces cerevisiae
atgggtatgtctactataaaataattcaaatcacttttgtcatttcatagaccaaagaagctcgcttgttaccttagaggattatactagtgcacaaaggcatgcataatacaacacacgttattgatgaacctagagaggctaaagttattttctaataaatcatgagatttttctcctttttacaataactgagcagtcatagtaatggccaagcaaattcgagacaggacctttgtaccactatttgctgaactcattgttagagtcttcttagataatatgataaatttggtgtctaattgaaacgtccacttttctgtatactaacaatttttaaaatgggatctaccaattgaattatatcagccatttccaagaatttaccaatcttaaagaatcatttcagaaagcactggcaagaacgtgttaaagtgcacttcgaccaagctggtaagaaggtttctagacgtaatgctagagctaccagagccgctaagattgctccaagacctctagatctcttgagacctgttgttagagccccaactgttaagtataacagaaaggtcagagctggcagaggtttcaccttggctgaagttaaggccgctggtttgactgctgcttatgccagaactatcggtatcgccgttgaccacagacgtcaaaacagaaaccaagaaatctttgatgctaacgttcaaagattaaaggaataccaatctaagattattgttttcccaagaaatggtaaggccccagaagctgaacaagttttgtctgctgctgctactttcccaattgctcaaccagctaccgatgttgaagctagagctgtccaagacaatggtgaatctgctttcagaaccttgagattagccagatctgagaagaaattcagaggtatcagagaaaagagagctagagaaaaggctgaagctgaagctgaaaagaagaaatag

SEQ ID NO: 2129 - DNA, 966 bp, Saccharomyces cerevisiae
atgacaacaaccgtacctaaagtgtttgcattccatgaatttgcaggagtagctgaggcagttgccgatcatgttattcacgcacaaaactctgcccttaagaagggcaaagtctcaaggtccacacagatgtccggaacgagccttaacggaaatggtaacacagaatccaaaacgatggagagagtaaattctgtaaggagtaatgcctccagccgtggtggtagtgaagacggcgccactaagaaattgaaaaaggagaaagaaaggcgcttcaagattgcgttgtccggtggttcgttaatccaagtgttgcacgaaggattgttgaaaagagacgacgttcaatggggtaaatgggacatttactttgctgatgaaagactagtgccctttagctccagtgaaagcaattacggtcttgctaagagaaaaatattcgatttaatagatacggagaagtacggaactccgaaaatttatcacattgatgagtcattgattaacgaccctcaagagtgtgcagataactatgagaaaattctaattaaaggatttgccggtagagattctgtgaaactaccgatgtttgatctgtttctgcttggctgcgctcctgacggtcacatagcctcgttattccccaattttcaagagaatctacgtgaaaatctggcatgggtcatacctgtagaaaatgcacccagcggaccttcgaataggatttcactgaccatcccagtgatttgtcactctcatagagtcacctttgttgtagagggcgccacaaaggcgcctgtaatcaagacaataatggaaaggcctgaaaagggattgcctagtagtattgtcaatgagggcgccgccggtcgtgtttcatggtttgtagacgacgatgctttgaaagatgtctttgtaattaagaagaagtacaagttttatgatgatgagaatttgactgagtag

SEQ ID NO: 2130 - DNA, 966 bp, Saccharomyces cerevisiae
atgactatcgctaaagattacagaacaatttatagaaaccaaatcaaaaagcagatacgactaaatcaggagcatttgcaaagcttgacacatctaggctcacaaatcaatttcgaggtggatcctcccaaattaccggatccggatcctgctcgaaaagtatttttctttgatatcgataacactttgtacagaaaatctacgaaggtacaattgctcatgcaacaatcattatcaaatttctttaaatacgaattggggtttgacgacgatgaggcagaacgcctaatcgaatcgtattatcaagaatatggattatccgtgaaaggtttaataaagaataaacaaattgatgacgtcctacaatataatacattcatcgatgattccttacctttgcaagactatttaaagcctgattggaagttaagggagctgctgatcaatttaaagaaaaagaagctcggcaaatttgacaaactatggctgtttacaaactcgtacaaaaatcatgccatcagatgtgttaaaatattaggtattgctgatctatttgacggcataacctattgccactacgacagacccatcgaggaagaattcatttgcaagccagatccaaaattcttcgaaacagctaaattgcaaagtgggttgtcgagctttgcaaatgcctggtttattgatgacaacgaaagcaatgtgcggagcgcgttgagcatggggatgggccatgttatccatttgatagaggattaccaatatgagtcagaaaatattgttactaaggaccacaaaaataagcaacaattttccatattgaaagatatccttgagattccattgataatggacgttgaagtttaccgtccatcctctattgccataaaggaaatggaagagttggaagaggaaggggaagcagtcaactggtcaaatcaacagatcaatgttcagtcatcatga

SEQ ID NO: 2131 - DNA, 966 bp, Saccharomyces cerevisiae
atgactcgtcccccattggttcgtggaatcttttcgttaggtctttctgtagccgttttgaaaggtgttgaaaaaacagttcgtaagcatttggaaagacagggatggatagagccccagaaagtggactatgagttaattttcactatagataggttgaaaaacttggtagataataagcgtgaggctttaactgcggaacaacccgacgctggtgaactgagctggcgtaaagtatttaatttcatttccagacaatccagcgaattggacacacgaatatacgttcttatactactcctatcctttctactacctatcgcgtggactgtactggacggtgatcgcgagaccacgctagaagataaggataacgattgtaatgtagatcttattgaaaacgaaaggaggctgaagcattacaacgatggtgaaagagcagtattgcaatttggtaaaaatagatccgaacctattatattaagctataaggacatgaacgttttggaaggggaacatgagtttacctccaaagaggaacacagtaacagccatttgacaagcaagagcgaaaatgcactaaaccaagtagggagtgaagatttgttaggttgtcacctggaaaagcaattggaagaagacaaaaatgaaccgaatggagaagcagacggtgaggatgataataaccgggaaaaggattgcagctccagttcagaagttgagtcgcagagtaaatgccgaaaggaaagtactgcagagcctgactctctctcacgggataccagaacaacctcttcccttaaatcaagtacatcattccccatatcattcaagggctcgatagaccttaagtcgttaaaccagccttcatcattgttgcatatacaagtatctcccacaaaatctagtaatctagatgcacaagtgaacactgaacaagcatactctcaaccatttagatactaa

SEQ ID NO: 2132 - DNA, 966 bp, Saccharomyces cerevisiae
atgagtatccccgctgacattgcatctttaattagtgacaagtacaaaagtgccttcgataatggtaacttaaaatttatccagactgaaacaacgaaaacaaaggacccaaaaaccagcatgccatacttgattagtcacatgccaagtctgatcgaaaagccagagcgtggccaaactccagaaggagaggatccactaggcaaacctgaggaagaattaacggttatcccagaatttggtggtgccgataacaaagcgtataaattgctattaaacaaattccctgtaatccctgaacacactttattggtaactaacgaataccaacatcaaactgatgccttgaccccaaccgatttattgactgcttataagttgctgtgtgccttggacaatgaagaatccgacaagagacacatggtcttttacaattctggtccagccagtggttcttcattggaccacaaacatttgcaaattctgcaaatgcctgaaaagttcgtcactttccaagatagactatgtaatggtaaagaacatttcctaccaactttcaatactgaacctttgcaagatgctaaagtctcgttcgctcattttgtcttgccaatgccggagtctgaagaaactgttgatgaagacctattagctatgtgttacatctccatattgcaaagagctttgacctttttccaggactggttgaacgaaaatccagaactaaagaaatcctacaatcttatgttaaccaaggaatggatctgtgtcgttccacgctcgaaggccttttctgatgaaatgaagataggtttcaactccacaggttattgtggtatgatcttaaccaaaaatgatgaagttttctccaagattactgaaaaacctgaattgattaacgatatcttattggaatgtggtttcccaaacacttctggtcaaaaaccaaacgaatacaactattga

SEQ ID NO: 2133 - DNA, 966 bp, Saccharomyces cerevisiae
atgatttgcataacgtgcatgcggcccgtagattccctttatacagtgtactcgaatgaccacattcagctgacagattgtccatattgccaagagacagtagacaaatatgttgagatagataatgtcctgttattcattgatttgcttctattaaaagcaggtgcatatagacacttggtattcaatgctttggaattgcatctctcaaaatatccgaaaagaaaagcgctaaatgattgccagtgtttgcgtgactatacgcaagctttgttatttaacgtaaagaactggttttgtaaatatgaccggttaaatcgcctttggcttctactattatcattcgagatttatttaacttgggttactgaggagagtaaatacatctactatttgaaccgtaacaataatgatggtaagctcatcatgctttcaaaaaaattaccagagagcttcaaatgggactcggcaatcatgcgcaataccattacaagtaaagtgtttacctggagcccaccaatacaatatctttactttgcaagttattgtattcttgacgtttctttattccacacctttacccagtatttcatactgaaaaagttgcattggaagcactattccgtttcttcaaaggatgtcatatcatatacgatcttattatcgtacggtgccaaaatttttccgatattgatgttgatatggccttatgatactctaatttcgatgagtatcattaagtgggtagctaatctctatattattgaatcgttgaagattgtaactaatctttcctattggaatatcataaagatttttataagtgtgtctttattacgatatttcatggttaagccaatacttatagttttcgtggcaaagtttaacttttcagttattaagaatttaatacatcaggagtttatactactactacagaagtcaggaacttatttattgttataa

SEQ ID NO: 2134 - DNA, 966 bp, Saccharomyces cerevisiae
atgccagagcaagaactacttatagggcaagaaatgaatacacttcatgcaggttcatctactgatggcataaatgtcggaaacgcaggacgaactagagacacacaaactggcgtagaaggggaaacggaaatagggtctgacgaggaagatagcatagaggacgagggaagcagcagtggaggaaatagtacgacagaaagactagtaccacaccagctgagggaacaagcagccagacatataggaaaaataggaagacattttaatattcttgatagactttttaagaaacgtacacaacagtcttcggatatacaacaaggtgccatgtttgatggtgtctttagcaatttaagcgcaaaaccagataccacagagactgaaggtaataacgaacaagacataccacctacatacgacgaagctgctgctgatatggccccctcgtattatggaatggatttgaacaattcagatatctactacgacgaaatatgcattgaggggcttcctgtaggaaatatagcaaatttattatggaatatcatcgtaagcacgagttttcagttcattggatttttaataacctacattttacacacatctcacgcagcaaagcaaggttcaaggtttggattagggttaacgttcattggatatggttattcaatgattcccaatgatgttacttcaaaagtcggcaaaaataaaagcttaaatagaatggaattagaggatccaaatgaattcgatgatgttcgtctaaattcacaatcaacgacacaagataaatttgaatcacatttgaatcacggtctggatgaagaaaaacaaaacataccatggttggctgtttttgtggcatttcttgggctatttatcaccctgaagagtatatacgactacattcaagtcaaaaaattggaaaagaaatacctcaaccaaagtcaaaatcaagcataa

SEQ ID NO: 2135 - DNA, 966 bp, Saccharomyces cerevisiae
atgcttatggatgagtatgaggaaaacaaggacatgtgtccgatctgtaagacagatcgatacctttctccggatgtgaaatttttggtgaatcctgaatgctatcacaggatctgtgagtcgtgtgttgatcgaatatttagtctcggtcctgcccagtgtccatataaagggtgtgacaagattcttagaaagaataagttcaagacccaaatattcgatgatgtggaagttgagaaagaagttgacatcaggaagagagtgttcaatgtgttcaacaaaactatcgatgacttcaatggtgaccttgtggaatataacaaatatttggaagaggtggaagacattatatacaaactagatcacgggatcgatgtggctaagaccgaggagaaactacgcacctacgaggaattaaacaagcaactgattatgaataacttggagagaagcagaacagagatagaaagtttcgaacagagacaaaaattcgaaaaggagatgaaattgaagaagcgactgttggaaagacaaatcgaagaggaggaaagaatgaacaaagagtggacaaagaaagaaatcgtcaaccggttgagtacgaccacccaggatatcaatgaaacaatcgaaggcgttaaaaatacggttaaattgaaaaaatcgtccgctagaaggaaattggaagaactaaatagagttctgaaaaacaatccatatttcaattcaaatgtgaacgtacagaattcgagactcaaagatgctgtaccgttcacgccgtttaacggtgatagagaagcacacccaaggtttacgttgaaaggttcagtatacaatgacccattcatcaaagatcttgagcacaggaaagaatttattgcgtctgggttcaacactaattatgcgtacgaaagggtgttgacagaggcatttatgggcttaggatgtgttatatccgaggagctttaa

SEQ ID NO: 2136 - DNA, 966 bp, Saccharomyces cerevisiae
atgcttcgctttactggtgctcgcgctattagaaagtactctactaggtatgcactcgagcacctgaaagaaggtgctcctctgaaagggctgttttctattgaaggattacagaaagcatggttcgaccgagtgaaatatctcgatgcaaaattgaacgattgtacaaatgaagcgcaacaaaaacccttagaaactctcatccatgaaaattcgaaatctgcttcaaagaaacatatcgtgaactatgcgtcatcattgtacaacttgaaatttagcatgtcttcccttcagggatgtatcaggactccgccagaggaatgccccaggctaggtccagaggcgctacttcagacccctgatttcaataggacaataagcaatgagccattgaccactggcaacgaacgtttgcaagcagctctaatttcttcatttgggtctttgatggagttcagaacattattaataaattcaaatcttgctatatcaggcgacgggtttacgtggttagtcgcaagacggcagctcgacaaacgtgctatgcgcaacgacatgccaaacagggatattgaatatgataagctgtttatattgaatacgtacaatgcgggaactcccttcaacttctctacatctggggtaatgaatgagctcaataaccaatataccaacatggaaaaacaacgagccaaagaagccggtaatcttgaagattctgagatgactgccaagcaagccaagacaaaatttatttatgaaacccaacagaaaggtttttctgggaaagaggtttcatatatcccgcttttagccattgatgcgtcaccaaaaacatggttaactgattatggcgtatttgggaaacgagaatatttagaaagggtatgggactctatagaatggaaaattgtagagtcaaggttacctcaacgtactaagatccaagcattcaacacgttatga

SEQ ID NO: 2137 - DNA, 966 bp, Saccharomyces cerevisiae
atggacagaggaaggtgcgccaatatgctaaaatcactccagcgaacactagctaaatgtcagaaatctccatcaaccaaccattggcaatgtttcaaaagaaattttactagtatacgagccactaaataccctgggcgttctaattcgacgttccactattggccctggtttgcggcgtcaacattgctcgctacttcgttatactaccgtgatcgtccggtacaaaatgacgataaaactgatgcttttccttctcatactgaatcgatacaggtagactctagcgtatcagatttcccactaacgattactgctttaaatttccctgtctctacaacttttaaattactgggatatggtcaaaggcacgtcacgtttttgaggttcaaggtctatgccttgggtctttatctagctgaaaatgacgaaaaccttgtttcagacactctaaatgaaacttatttacataaatatttccttgatgtggatgattctaagactcctaaggagaatctagctagattattgaaacgtgatgactcaaaatccgttatgatgattgatgacttactggattctggaatgagaatgctagccaagataactcccgtaaggaatacagattttaagcatcttaaggagggcctggtcaaaactatttctaaacatcccgatgtggccaataataaagacacactggcgaagggcctaagtgagttaaatgatgccttttcacgtaagggatccgtcaggaaaaatgacgatttgatcatcgaattattagccaacggcgctttacaattttcatatcatgacagtaaaaacaacgaatttgaggtcatgggagtagttaataatcaactcgtcggaaaattcttatttagccaatatttatgtggcgaaaaatctccttctccacaagccaaaaaaacagctatcgacaaattgatcacactcctctaa

SEQ ID NO: 2138 - DNA, 966 bp, Saccharomyces cerevisiae
atggttgaaattgtgggccacagagcttttaaagcaagatatcctgaaaatacgctactagcatttgagaaggcttatgcagcaggtgctgatgtaatagaaacggatttacaaatgaccagcgatggtatggtggtggtaaaccatgactcagacactggtcggatgtgggataagaacttggtgattggcgagtcgacttgggaggaggttaagcgattgcgctgcaaagaggatggttccttagcaatgatgacattgaaggaaattctaacatgggcagtgtgccatccaggagctaaattgatgttggacatcaaatttaccaacgagaaaatcatcatgatcaagacctttgttatcatgttagaggttaagaatgatcttaaattttggcaggagaggatcacgtgggggctttggttgctggattggtacgatttcggtattgaaactggtgttctgaaggatttcaaagttattgtgataagtctgtctttagatatcgcctcgcaatttgtgaagcgctctttgacactgaatgatcctcactataaactttttggtatcagcgtccattttgtctcctcgtggacaagccaatttagattgagattactacctgtgcttatgaagaatgatatcaaggtctatttatggactgtcaacaaacctatagatttcaaatatctgtgcgaattgcctatccatggtgctatcacggatgatccgatcaaggcaagaaagttatgcgatggtcataccgtggcgaagaagcctactgctgaaaaaaagtttgttgcgcccagtctggcatctgtagatgggctaagattccatgcttttatcaaagtttataacatcctttgcacgcttctatattccaaatgggtccatattaagttgtgcggttggtctattgcttatgtgatttttttgttccttcgaaccattcattttctttga

SEQ ID NO: 2139 - DNA, 966 bp, Saccharomyces cerevisiae
atggttgacgctaggggtagtacgccatgtttaattggtgattctataagaaacgttaatgatggaaatagtctggatttccagtatactaatcagtttaatgaggaaagtgaggcttcgaggttactaacgccacaaacgagttccaatcacgccctaagcaagatgcagaaggatgatgatattcgagatagatcttatacatctgtagcggaattgaatcgtgagggtgctttgctgaccgacgaagttgatttggagaatgttgatgcttcgaaagttcgcagcaatagagacgacctagaggcagaggagaaaaggaaaaaactactcttgttgaaaaaaaagcaaagaaataaatccatcaactcggaaagtttttcctctccttctctgcgtgcttccaaatctaattcactgattacatcaactgatcctgtcgaagatcacatcagtaagtactcttcatcaggcacccctgaaaatattacaggtgaggcagacgacgaagacgaagacataatcagaaactcttacgggcaaatgatcaaaaacaattccaacaggccacatttggcgaagggtgaatcgtaccagtccgcagaacaggaaatagatcatacggcgcctgaaaaatcagagaaaagacaagaaagaagcggtagatcctttgatagacaaaaatcttcggctgagtttctaagatccttatcgaggtcaataagtcgtggacccacaaagaacaaaacggtttcgccctctaagggagaagactctagaatgtatagtaccagcaactactctatatcattagttgatttggagaacggacccaaaattatcccggaaactttagaagaagagcaggaggacgccgaaaaggagggtgttttgatggaagacgagggtaatgaagaatacaccaaagatttggaagaagcagctaacaaagctcaaccacagtag

SEQ ID NO: 2140 - DNA, 968 bp, Saccharomyces cerevisiae
atgttgttgttagcattaagtgatgcacatattcctgatagagcaactgtatgtgttattctcctttcttctctggttagctgtagtggaacctataacggccattgcgccacaacttcctttaacattaatactaacatattgataacgacttcaattgcaagtaggatttacctgtaaaattcaaaaaattactaagcgttcctgataaaatatctcaggtcgctttattaggtaatagtacaaagtcttatgactttttgaaatttgtcaatcagatatctaacaatataacaatcgtaagaggagaatttgataatgggcacttaccaagcacgaagaaagataaagcatcagataactctagaccgatggaagaaattcctatgaatagtataataaggcaaggtgctttgaaaatcggctgttgtagcggttataccgttgtgccaaagaacgaccccttatctttgttagcattggcacgccagttggatgtagacattttattgtggggtggtactcataacgttgaagcttataccttagagggaaaatttttcgttaatccaggtagctgtacgggtgcttttaatacagattggccaattgtctttgatgttgaggatagcgatgaagctgtgacatcagaggtggacaagccgactaaggagaatcagtcggaggatgacgatgccaagggtggatcaacaggaaaggaacaacctgggtcttacacgcctaaagaaggcactgctggggaacgtgagaatgagaatgaaagcaacgttaagcctgaaaaccaatttaaggaagacgaggttgatatgtcagattcggatataaatgggtctaattcaccaagtttctgcctcttggatattcaaggcaatacctgcacgttatacatttatttatacgttaatggagaagtgaaggtcgataaagtggtttatgaaaaggaatag

SEQ ID NO: 2141 - DNA, 969 bp, Saccharomyces cerevisiae
atgaaaccgacacaggattcacaagaaaaggtttctattgaacagcagttagctgtagaatcgataaggaagtttttgaactcgaaaacatcttatgacgtgttgcctgtttcttaccgtttaattgtcttggacacctcgttgttagtgaagaaatcactgaatgttcttttgcaaaatagcattgtctctgcgccattatgggactccaagacttccaggttcgctggacttctaactactacagattttattaatgtcatccagtattacttctccaatccagataagttcgaattagtagacaaattacagttagatggattaaaagatatagagcgtgctctcggtgttgatcaactagatacagcttcaattcatccttctagacccttatttgaggcgtgtcttaagatgttagaatcaagaagtggtagaataccactgatcgatcaagatgaagagacacatagagaaattgtcgttagtgttcttacgcaatatagaattctgaagttcgttgctttaaattgcagggaaacacattttctaaagattccaattggggacttgaacattattacgcaagataacatgaaaagctgtcaaatgaccactccggtcatagacgtcattcagatgcttacccaaggtcgggtttcttccgtccctattattgacgaaaacggctacttaatcaacgtatatgaagcatacgatgtcctaggcttgataaaaggaggcatctacaacgacctgtcattgagcgtcggagaagcccttatgaggagaagtgatgattttgagggtgtttatacatgcactaagaatgataaattatctactattatggataacatcagaaaagcaagggtgcatagattctttgtagttgatgacgtcggacggttggttggtgtcttgacgttaagcgatattctcaaatatatccttctaggtagcaactga

SEQ ID NO: 2142 - DNA, 969 bp, Saccharomyces cerevisiae
atgaaagcggaaaggcaaacaggattaagaaatagttttacaaccgtaatcggtcgcaaactaataaacacttttgttccgtccatgatgttaactagcgtagctggtaacgatatttttttccgaggtttattcaaatcgccggtattagcatttcaaagttatcgttatgtttcgattttgggacaattgaaaccgtcagatggttctacaaagtctttcaaaagacttgggcgtggtccttccagcggtttaggtaagacatcagggcgtggtcaaaagggtcaaaaggcgcgtggtaaagtaaaatcgtggtttgaaggtggtcaaactccaatttacaagctatttcctaaaattggatttaccaacgttggcgccaaaccattaaaggaattaaacttgaaacgcattcaatggtttcatgataaaaataggcttcatttgcaaccaggcgaggttttagacatgaataagatgagaaagcttggtctggtaactggtcccataaagtacggagttaaaattctagccagcggaaagttccactacaatctaccgattgctttggaggcttctagagcatccgctaaggctattgcggctattgaaaaagcaggaggtaagtttacagctcgttactacacaccgttgggtctaagggcacatctcaacccccagtggtttcttgagaagaggggaagagtaccactacaggctagacccacgaaaagaagggatattgatttctatagtaaagaagagaaaagaggttacctagtaatggaaaaagataaactcttacaagatatcaaagaagctcaaaataagggttctagacactttttaaaacagaatgtaaaaaagagctcattagaaatagagctagaagaactgtctccagagaaggattgggtgccagttgtgtctaattctaaagtcatgaacatcaaggctttggaccactaa

SEQ ID NO: 2143 - DNA, 969 bp, Saccharomyces cerevisiae
atgcctttgaacaagtcgaacataagagagtacaagctagtcgtcgttggtggtggtggtgttggtaaatctgctttgaccatacaattgacccaatcgcactttgtagatgaatacgatcccacaattgaggattcatacaggaagcaagtggtgattgatgatgaagtgtctatattggacattttggatactgcagggcaggaagaatactctgctatgagggaacaatacatgcgcaacggcgaaggattcctattggtttactctataacgtccaagtcgtctcttgatgagcttatgacttactatcaacagatattgagagtcaaagataccgactatgttccaattgtggttgttggtaacaaatctgatttagaaaacgaaaaacaggtctcttaccaggacgggttgaacatggcaaagcaaatgaacgctcctttcttggagacatctgctaagcaagcaatcaacgtggaagaggcgttttacactctagcacgtttagttagagacgaaggcggcaagtacaacaagactttgacggaaaatgacaactccaagcaaacttctcaagatacaaaagggagcggtgccaactctgtgcctagaaatagcggtggccacaggaagatgagcaatgctgccaacggtaaaaatgtgaacagtagcacaactgtcgtgaatgccaggaatgcaagcatagagagtaagacagggttggcaggcaaccaggcgacaaatggtaagacacaaactgatcgcaccaatatagacaattccacgggccaagctggtcaggccaacgctcaaagcgctaatacggttaataatcgtgtaaataataatagtaaggccggtcaagtttcaaatgctaaacaggctaggaagcagcaagctgcacccggcggtaacaccagtgaagcctccaagagcggatcgggtggctgttgtattataagttaa

SEQ ID NO: 2144 - DNA, 969 bp, Saccharomyces cerevisiae
atggaaatgactgattttgaactaactagtaattcgcaatcgaacttggctatccctaccaacttcaagtcgactctgcctccaaggaaaagagccaagacaaaagaggaaaaggaacagcgaaggatcgagcgtattttgagaaacagaagagctgctcaccagagcagagagaaaaaaagactacatctgcagtatctcgagagaaaatgttctcttttggaaaatttactgaacagcgtcaaccttgaaaaactggctgaccacgaagacgcgttgacttgcagccacgacgcttttgttgcttctcttgacgagtacagggatttccagagcacgaggggcgcttcactggacaccagggccagttcgcactcgtcgtctgatacgttcacaccttcacctctgaactgtacaatggagcctgcgactttgtcgcccaagagtatgcgcgattccgcgtcggaccaagagacttcatgggagctgcagatgtttaagacggaaaatgtaccagagtcgacgacgctacctgccgtagacaacaacaatttgtttgatgcggtggcctcgccgttggcagacccactctgcgacgatatagcgggaaacagtctaccctttgacaattcaattgatcttgacaattggcgtaatccagccgtgattacgatgaccaggaaactacagtgaacaagaacactagccccagcttttgctttctgctttttttctttttttttttttttagtcgtggttctctgatgggggaggagccggttaaagtaccttcaaaagcagaatgcagggttattggaagctttctttttttcttttatgctagtttttcctgaacaaatagagccattcttttcttattactaagaaatggacggcttgcttgtactgtccgaagcgcagtcaggtttgaattcatttgaattgaatgatttcttcatcacttcatga

SEQ ID NO: 2145 - DNA, 969 bp, Saccharomyces cerevisiae
atggatcctctcagctcagtacagcctgcttcttatgttggttttgataccatcacgaatcagatcgaacatcgtctgttgaagaaaggttttcaatttaatataatggttgttggccaatccggattgggtaaaagtactctaataaatacgttatttgcctcacatttgattgattctgctactggtgatgatatttctgccctgcctgttacaaaaacaactgaaatgaaaatttctactcatactcttgtggaggaccgcgttcgcttgaatattaatgttatagatacacctggatttggtgactttattgacaattctaaagcttgggagcctattgtgaagtacattaaggaacaacattctcaatacttacgtaaagaattgacagcccaacgtgaaaggtttattactgatacaagagttcatgcaattctttatttcctgcaaccaaatggaaaggagttgagccgccttgacgttgaagccttgaaaagattgacagaaatagcaaatgttataccagttattggcaagtcggatacattgactttagatgaaagaacggagtttagggagcttattcaaaatgaattcgaaaaatacaatttcaagatttatccttatgattcggaagaactaactgacgaggaattagaactaaacagaagtgttagatctatcattccgtttgcagtggttggttctgagaatgagattgaaataaacggtgaaaccttcaggggaagaaaaactcgttggagcgctattaatgttgaggatatcaaccagtgtgattttgtatatttaagggaatttttgattcgaactcatctccaagacttaatcgaaacaacttcctacattcattatgaagggttcagagcaagacaattaattgccttgaaagaaaatgcgaatagtcgttcctcagctcatatgtctagcaacgccattcaacgttga

SEQ ID NO: 2146 - DNA, 969 bp, Saccharomyces cerevisiae
atggcgatcaagaaaagaaataaaattaggttaccaagtggttctcctgaggaggttggaattgatggttctgcgcataagccaatgcagcaaattaagcccctagtgtcgaacgattctgaagatgatgacaacgacatttgtgtattacaaccaataaagtttaaaaaagttcctaagcgcgacattacctttgatggcgaacaagcaataaaggaggataattcgcattatgaagatctttaccattcaaagaaaaataccaatgcatcgacgcgaaacaaagatgatttgctaattctcaatatggaggacttgatggaggggaatcatcatctattaagtgattcttcagaggctggcagtagctccgaaggtgagcacattagtagtataccaacccgaggagaaattgcaaaactgaaagcacagaagtcattatctagaaggaaaattagtgagagtgatgttacaacagaaagagattatgtaaaattgttggacagtgaggataaacgcgaaattatggagacaataagattaaatggtggtctgaaacgtaacaatgaaaaggagattacgaacttcagtgacgatgaaatgcaaggctttcaagacgaaatgctagccctcacggataatcaaattgctattcaaaaggattctaaaagaaagattatagagaaggccataaatgaagtgccctacagaactaatgaagaatgggaaacccagcttttaagcaaaggaaatataaacaaatcgaatgagaaaatcatcacgcccttaccggtacttttcccagacgatgatgaaagtgggaacagcattgagagaataaacgagatggtttcgaagatctgcttgcaaaggaagaaggttgagatgaggttgcaagcgttagaaaaaacaaaaattgacttggaaaaatctaaagcaagcctaataaataagctcattggtaactga

SEQ ID NO: 2147 - DNA, 969 bp, Saccharomyces cerevisiae
atgtccattgtagcactaaagaacgcagtggtgacccttatacagaaagcgaaaggtagtggtggaacctcagagttgggggggtctgaatcaactcccttgttgaggggtagtaatagcaatagttcaaggcatgataacttatcctcatctagctcggatattatctatggtagaaattcagcgcaggatctagaaaactcaccgatgtcagtagggaaagataataggaatggcgataacggttcggataacgaaaaggcgaacctagggttcttccaatcagtagatcctcgcgtaattagcgatttgattatcgggctaagcgacggtttaaccgtcccctttgctctaacagctggtctatcttcacttggtgatgcgaaattggtcattaccggtggctttgctgagttgatctcaggtgcgatttctatgggccttggtggctatttgggagcgaagagtgaatctgattattatcatgctgaagtaaagaaggagaaaaggaaattttacgataactccaacctaattaacagagaaattgaagacattctgttagagattaaccctaatttctcggacgaaacaatcgtttcgttcatcaaagatttacaaagaacacctgagctaatggttgacttcattatcaggtacggtaggggtctagacgaacctgccgagaatagagaactaatcagtgcagtcactatcggtggcggttatctacttggtgggctagtaccactagtgccatatttttttgtctcagatgtgggcacaggtctcatttattctataatagtcatggttgtaacattattctggtttggttacgtaaagacaaaactatccatgggtagtggcagttcgacttcaaagaaagttacggaaggtgttgaaatggttgttgtgggtggtgtagcagcaggtgcggcttggttctttgttaagttactgggttaa

SEQ ID NO: 2148 - DNA, 969 bp, Saccharomyces cerevisiae
atgtctatggagcctcctgtggggcttacggctatgcccgtcaccaagctagccatgatcacgacgcttgtggttcccttagttgcctcgattgcaagttacaaacatatatttctattgcaatatgatccttttctgcagacctaccatcaatactaccgtctgctcatattccagttctgcgccatcaatgaatccgatacagtaatactggcgttgatatggtatctgtttaggcatttagaacggctactaggatcccacaagtacttgaccttgattgttttgtcatgggcctacaccaccttaggaatttggggattgaatctgatctggaacgcatttattggacagtacaagtggcttcaatggaacaattttagtacaggttcactgcccattgttttaagcttagtacatttttacaaagaatacacccctcagatttacgaatggaatataagattactaggacctcgaggaggagcatcaagtcacaatgataacaagcgagaagacaagagcgccgtagagtggaaaatcaacgatcagtttcttttaaatgggttaattctcctgcttatattaaatcaggggtttgcaggaatactatgcggattcataagctggatgtgtggtattttcatcgataagggcctgttaccgggattagaccattggagaataccgtttgtatcctatttcatctctcaaggcccacccacgagggctaacgttgctatagcggccaatgcggccacgaatacagcagcagcaagagccactgtagaagcagctactgctgctacaggaaatggaaatacaggcaactctgggcctacaagcctaccgcttcgtggttcaagcaccacccctacaaatacctctagcgctggtgatgacgagcctggtgccgatgaacctgcaagaccactgggagtccaatttttggatacctttaggagatga

SEQ ID NO: 2149 - DNA, 969 bp, Saccharomyces cerevisiae
atgtctcaaaaaaagaaggcttcccatccagccatcaatctcatggctggcggcacagcaggtttatttgaagcattgtgttgtcatcctttagatacaattaaggtgagaatgcaaatatacagacgggtagctggtattgaacatgttaaacccccaggatttattaaaactgggcgtaccatttatcaaaaagaaggtttcttggctctgtataaaggtctaggtgctgtggtcatcggtattatacctaagatggcaatccgtttctcgtcttatgaattctatagaaccttattggttaacaaggaatcaggaattgtgtctaccggtaatacttttgttgctggtgttggggctggtatcaccgaagctgttcttgtcgtgaacccgatggaagttgtaaagattaggttacaagctcagcatttaactccgagtgagccaaatgctggtcctaaatataacaacgccattcatgcagcctacactattgtcaaagaagaaggtgtttctgccttatatagaggcgtttccttaactgcggcaaggcaagcaactaatcagggtgctaacttcacagtttattctaaactgaaggagtttttgcagaattaccatcagatggatgtcctaccttcatgggaaacttcttgcataggtttgatttcgggtgctattgggccgttttccaacgctccattggatactataaagacaaggctgcaaaaggataagtccatctcattggaaaaacagtccggtatgaagaaaatcataaccattggtgctcaactactgaaagaagaaggttttagagctttgtacaagggtattaccccaagagtgatgagggtggctccaggtcaggctgtcacctttaccgtttatgaatatgtaagggagcatttagaaaatttgggtatattcaagaagaatgacacaccaaagccaaagccattaaagtag

SEQ ID NO: 2150 - DNA, 969 bp, Saccharomyces cerevisiae
atgtcttcaactcaagacagtaaagcgcaaactcttaattctaatccagaaattcttttgaggaaaagaagaaatgctgatagaactagaatcgaaagacaagaattagctaagaaaaagagggaagaacaaatcaaaaaaaagagaagtaataagaacaaatttgtcagagctgaaagtatagttgcaaagactttggctacctctagggaaaaggaaagaattaaaagagtgtctatattagaagataagaaggcaaagaatgaaacgcagcatattgcatctgggaaagattttattctgaaaataacagaaaaagctaatggcgccgaagagaactctgtcgacttggaggagactgaagaagaagaagacgatggtttaatcagagaaaagactacttacgatggcaaacctgctttacttttcattgtcagagtaagaggtccgcttgctgtaaatattccaaacaaagcatttaagattttgtctttgctaagattagttgaaactaatactggtgttttcgtcaaattgaccaaaaacgtatatccgttgctcaaggttattgcgccatacgtagtgattggcaagccttctttatcttctatccgttccttgattcaaaagagaggtagaataatctataagggtgagaatgaggctgaacctcacgaaatagttcttaatgacaacaatattgtcgaggagcaattaggagatcatggaataatttgtgttgaagatattattcatgagattgccactatgggtgagtctttttctgtttgtaacttcttcttacaaccattcaagttgaatagagaagtatctggatttggttctttgaataggctaaggaaaataaaacagcgggaggctgaatcaagaactcgtcaattttcaaatgcagctacagcaccagttatcgaagttgacattgactctttattagccaagttgaattaa

SEQ ID NO: 2151 - DNA, 970 bp, Saccharomyces cerevisiae
atgttttgtacctgggatagctggtcagtggtaattgagagtatagctcttcaatatattcatcagagcctttggtgtaaccggctaatcttgtcttcaaactttcgaaacgaggatccgattcaattaaatcggtaagtgcataatctggagcggccatatttcgaaacaagtttgttcttatccgttttttgtaacctgcattcttccacttcccttagccatgcgtttccgatgctttatatagttccaacccatcatcgctcaactccgcaattaatattgagttccctcgttttgactccaacccatcatcggcggctcggcgttaaagactgacggtccggaggatgttctgaaaaatttggttaatataaataaattgtgtcttttgatactaactactttttcttattagctgataactgcctcaattgtcaaaagaagtagtttgcgtaaagctaaccatatatatacgtacttatttgcttagctgtaaggcgtcgttaaagccgtctacaataacgtcagggacaccgggacttctagaaaatcccattccccccacagaaactgtttggccgtaagattcttgcaacttcctttcagctctttcttgccatgcgtcataacctacatgaaatcttggcagacatctatcggcgatagtgaattcccactgaccagcttccagatccttgttactgatgccgaggtggttgttcagcgcatctttgactgcattaatggttacctccctggatggcactacaggaacaccgtgttcattgagcatacaacctcctatcatcgcagtcacttttgtatatttgttgagggcgtttgggtttgtggagagtttgtcaaaaagtggtttgaaattcctttcgataacagaatcgaaaattacaccaagcaatttccctggattcttattggatttgggaaccaagtatccaaagccttgtag

SEQ ID NO: 2152 - DNA, 972 bp, Saccharomyces cerevisiae
atgaataaagaagagcaagaagacccacagcaagagcaaatatcaactgttcaggaaaatgatcccaggaatttgcagcaactgggaatgctgttagtatctccagggcttgatgaagacagattgagtgagaaaatgatttcgaagatcaaaaaatccagggatatcgaaaaaaatcaaaaattgctcatatctaggctgtcgcaaaaagaggaagatcatagtggtaagcctcctaccattacgacttctccagcagagaaaaccgtaccctttaagtcgctgaatcattctttaaagaggaaaagggtacctccagcgctaaatttttccgatatacaagcatcttctcatttgcatggatctaaaagtgctccaccaaacataacaagatttccgcagcacaaaaatagccttagggtcagatatatgggtaggatggctcctacgaatcaagattatcatccttcagtggccaattcatatatgacagcaacctacccttatccatatactggactgccaccagtaccatgctacccatattcttcaactccaacacaaacgcacgcatacgaaggctattattccccgatgtatcccggccccttgtataataatggtataataccagccgactaccatgcaaagaggaagaagttggctggtagatcaccacacttggaagatttgacatcgagaaaaagaacctttgtctccaaacaccacaacggagacccaatcataagtaagactgatgaagacattgaatgctctgtcacgaaaaattcattaagtgagggcgcttcacttaacgacgatgccgatgatgacaacgacaaagaaaggatcattattggagaaatctctctgtatgatgatgttttcaaatttgaagttcgcgacgacaaaaatgactatatgaaagcatgtgaaacaatctggactgaatggcataacttgaagaaatga

SEQ ID NO: 2153 - DNA, 972 bp, Saccharomyces cerevisiae
atgacggtaaacttagatccggataaagtttggatagacggctgctttgatttcacacatcatgggcatgcgggagccattttgcaggctcgtcgaacagtttcaaaagaaaatggtaaactattctgtggtgtgcataccgatgaagatattcagcataacaaaggaacaccagtaatgaactcttcagaaagatatgagcatactagatcaaataggtggtgttcggaagtggttgaagcggcgccatatgttacagatcccaattggatggataaatatcagtgccaatatgttgttcatggtgatgatatcaccatagatgctaatggagaagactgctataagttggtgaaagagatggggcgcttcaaggtagttaaaagaacatatggcgtaagtactaccgagattatacatagaatattgacgaaaaaatctttgccaccgactcatcctgattattatcccaccacccaggaattgagtttctattctgtcgcccaagatgccgtttcaaaacattgttatgtctttcagagggatttggacaatgtcttggtcaatggtggatacaaattcgatgcagaagattgtgtttatgttgacggggattttgacttattccatatgggggatattgatcagttaagaaagctgaaaatggatcttcaccccgataagaaattgattgttggtattaccacaagcgattactcgagtaccattatgacgatgaaggaacgcgtcttgagcgttttaagttgtaaatatgttgatgccgttattatcgatgctgacgccacctcaatgtctcagtataactgcgagaagtatcatattggcacggctgtcctcactgctgccggaaaattcagtgaatacttgactaaagagcttattgtgaagagggtggaatcgcaaagggaggtttacattgcgaggaaccaaaaaaagggaatgtccatataa

SEQ ID NO: 2154 - DNA, 972 bp, Saccharomyces cerevisiae
atgcctagcacgtttgaatcccagctttttttttcgagaccgtttctgtctaaaaggcaaattcaaagagcccaaaagaatacaatatcggactatcgaaattacaaccagaaaaaacttgccgtgttcaaatttctaagtgacttgtgtgttcagctgaaatttccacggaagactttagaaacagcagtatacttttaccaaagataccacctctttaatcgcttcgagaccgaggtttgctacactgtagcgacaagctgcctgactttgggctgtaaagaagttgagacaattaaaaaaacaaatgatatatgtactttgtcattacgattgaggaatgtggttaaaatcaatacggacattttggaaaattttaaaaaaagggtatttcaaatagaacttcggatattagagtcatgctcattcgattatagagtcaacaattacgttcatattgatgaatatgttataaaaattggtagggagctatcctttgattataagttgtgcaatctggcttgggtaattgcttatgatgctttgaagctagaaactattttagtcataccccaacattccattgcattggccattttgaaaatagcatatgaattactagataataagaattggtcaagtaaaaggtattctttatttgaaacagacgagaaatccgtaaatgaagcttattttgatatagtcaatttttacatcaattcattcgatatgtgcgatctacaacgtcatttaccggctgatttgctgccgattggcgttgaaaggtttatggaactgaaaaaaaacgcaggaccagaatctggattgccgcaaataccagatcacctgttgaatgccgatccttatatcactattactagagataataatgtccaagaaagaagatatgtactttcactggagctaattaatggcgagtccagcataaatagttctacaagacatgcatag

SEQ ID NO: 2155 - DNA, 972 bp, Saccharomyces cerevisiae
atggctaagttcttgaaagctggtaaagttggtacgtatcattttcagtttttggacatcaacaaaaaaccgtgcaactgtggtattagaaatccaagttattagcagttgatgttgtataatttgagtttgaattcgagtattgtatcttcatatgggagtagggaggaaaaagcgtggagatgttagatctgggaaaaaacctttaaatttgaatgatagcttattaatagaaatattggacaaaaagatgaatgatttaggagcgaaactaacgattattcatattcattgagctatacgaggcagtggaagggttatcaaaaagttgtaatttaaaagaaaaaagcatcaatagccaccaaataagatggtgaaagttccgcgatatatttgctaagaccataggcacatgtacgcaggcgaccagggccttttatttactgtagttctttccatgccctattaaaaattcgtgggcctatgataatttttctctccctagtattgaagaacaaaattgagaattcgccaaactttaagaagggttcacatttactaactatttcttttccttcctttttttacacagctgtcgttgtccgtggtcgttacgccggtaagaaggttgttatcgttaaaccacatgatgaaggttccaagtctcacccatttggtcacgctttggttgccggtattgaaagatacccattgaaggtcaccaagaagcacggtgccaagaaggttgctaagagaaccaagatcaagcctttcatcaaggtcgtcaactacaaccatttattgccaaccagatacactttagatgttgaagctttcaaatccgttgtttctactgaaactttcgaacaaccttcccaacgtgaagaagctaagaaagtcgtcaagaaggctttcgaagaaagacaccaagctggtaagaaccaatggttcttctctaagttgagattttaa

SEQ ID NO: 2156 - DNA, 972 bp, Saccharomyces cerevisiae
atgtccaaaactttatctttgcaacttccatgggttgagaaataccgtccccaagttttatctgatatagtcggtaataaagagaccattgatagacttcagcaaatcgctaaagatggtaacatgccccatatgatcatatcaggtatgccaggtataggtaagaccacttcggtacattgccttgctcacgagctccttggccgctcttatgctgacggtgttttagagttgaacgcttcagatgacagaggtattgatgtcgtcagaaaccaaataaaacattttgcccagaagaaactacatttgcctccagggaaacataaaatcgttattcttgatgaggcggattccatgactgctggtgctcagcaagcgttgagaaggaccatggagctatattcgaactctacaaggtttgcatttgcttgtaatcaatcaaacaagatcattgagccgctgcaaagtagatgtgcgattttgaggtattctaaactatccgatgaagacgttctaaaacgtcttttacaaatcataaagctagaggatgttaagtatacaaatgatgggttagaagcaatcatttttacagcggagggtgacatgagacaggccataaacaatctacaaagtacagtagcaggacacggtttagtgaacgcagacaatgtcttcaaaattgttgattctcctcaccctctaatagtgaagaaaatgttactagcctccaacctagaagattcaattcaaatcttaagaacagatctttggaaaaagggttattcctcgattgatatcgtcacaacatctttccgcgttaccaaaaacttagcacaagtgaaagaatcagtaagattggaaatgataaaagaaatcggtttgacccatatgagaattctggagggtgttggaacgtacttgcaactggctagtatgttagcgaaaattcataaactaaataataaagcctga

SEQ ID NO: 2157 - DNA, 972 bp, Saccharomyces cerevisiae
atgtcggggagcttctggacatctacacaaaggcatcattggcaatataccaaggcatcattggctaaagagaggcagaagttatggctattggagtgccagctgtttcctcaaggtttgaatattgtaatggattcgaagcaaaacggcatcgaacaatccatcacaaagaatataccaataactcaccgagacttacactatgataaagattataatctaaggatctactgctatttcctgataatgaagcttggaaggagactaaatataagacagtatgcactggctacagcacatatttatctatcaaggtttttaataaaggcttcagttagagaaataaacctatatatgctggttactacgtgtgtatatttagcatgcaaagttgaagaatgcccgcaatatatcagaactttggtaagtgaagcccgtaccttatggcccgaatttattcctcctgaccctactaaagttactgagtttgagttctacttactagaagaattggaaagttacttaattgtccaccacccttatcaatccttaaagcaaattgttcaagtcttaaagcaaccgccatttcaaataacactatcgtcagatgatctacaaaactgttggtccttaatcaacgacagttatataaatgatgttcatttgctttaccctcctcatattatcgctgttgcatgtttattcattacgatttccattcatgggaaaccaaccaaaggatcatcgttagcatctgcggcttctgaagccatcagagatcctaaaaattctagttctcctgttcaaatagcttttaatcgttttatggcagaatctcttgtagatcttgaggaggttatggatacgattcaagagcaaattacattatacgatcattgggacaagtaccacgaacaatggataaagtttctgctacatactttgtatcttagaccagcatctgcaatttaa

SEQ ID NO: 2158 - DNA, 974 bp, Saccharomyces cerevisiae
atgtctgctccacaagccaagattttgtctcaagctccaactgaattggaattacaagttgctcaagctttcgttgaattggaaaattcttctccagaattgaaagctgagttgagacctttgcaattcaagtccatcagagaagtatgttattaatttgaatctaaacttaagaataatggagagtaacaaaggaaaaaagtgtgaacgggacgataccagaatgtttcaatctagaaaagtataaaagataaggactaggactcaaatgtatttggctgactatcgcctgaaccttgatgctaagcaaataccatatcttcaagaaaaagcctactccagtgtttaagaagaagggaacgatttactagatcatgctatacgcagtaaggttctgatagttaattacaatcggtccaagttctaagcggtgtcgtccatgcatatatcatttacaagttactggcgtcaactcttcaaatattcaaaatatcacctaatcaaacttactaacattttccttttttgttttccttcttttatagatcgacgttgctggtggtaagaaggctttggccatttttgttccagtcccatctttggctggtttccacaaggttcaaactaagttgacccgtgaattggaaaagaaattccaagaccgtcatgtcatcttcttggctgaaagaagaatcttgccaaagccatctagaacatctagacaagtccaaaagagaccaagatccagaaccttgactgctgttcatgacaagatcttggaagacttagtcttcccaactgaaatcgttggtaagagagttagatatttggttggtggtaacaagatccaaaaggttttgttagactcaaaggatgtccaacaaatcgactacaaattggaatctttccaagctgtttacaacaaattgactggtaagcaaattgttttcgaaattccaagtgaaactcattag

SEQ ID NO: 2159 - DNA, 975 bp, Saccharomyces cerevisiae
atgaagcgcattccaatcaaagaactaatagttgagcaccccggaaaagttcttatccttgatggtggacagggtacagaattggaaaacagaggcattaacataaatagtccggtatggtctgcagctccttttacgagcgaatccttttgggagccatcttctcaagagcgaaaggtggtagaagaaatgtacagagactttatgattgctggcgcaaacatattaatgacaattacttaccaggcaaactttcaaagcatatctgagaatacctcgattaaaactctggctgcttacaagcgttttctcgataaaatcgtgtcatttactcgtgaatttattggtgaggaaaggtacttaatcgggagtattggcccatgggcagcacatgtatcctgtgaatatactggtgactatggtccccatcctgagaatattgattactacggctttttcaaaccccagctggagaacttcaaccaaaatagagatattgatcttattggttttgaaacgattccaaattttcatgagttaaaggctattttatcctgggatgaagatattatttcgaagcccttttatattgggttgtcggtggatgacaatagtttgctacgagacggtaccactttggaagaaatttctgtccatataaaaggcctcggaaataaaattaacaagaatctcttattaatgggagttaactgtgtcagtttcaatcaatcggcattaattcttaaaatgttgcacgagcatctacctggcatgcctctgctagtttacccaaacagtggagaaatctacaatcccaaagagaagacatggcaccggccgactaataagttggatgactgggagaccacggttaagaaattcgttgataatggtgcgcgcattattggcggttgttgtagaacgtctcctaaagatatcgccgaaattgcatcagctgtagataaatactcctaa

SEQ ID NO: 2160 - DNA, 975 bp, Saccharomyces cerevisiae
atgcgtataggtatggaagagcttagaagggcgctggcgctgctaaatggtcaaggatatgagtttatggtgttcataaaggaaaaagaccatttaataagtgagtcaattccaaaaaacttgttctcagagagttttatatcatcttcaattgaaaaaaaccctccactcacgttcgatccattggtaaataggaaaagaataactgtttatgaagaaaatatccaaccagcgatcatgctacccttagatcaacccctactaatacagaattatctgtatacggcttttaaattattaagacaggtcccatgcaaggcgattgctaagttgtggataaaaattattgagccaaggaagaaaaccaggtttccatacattaaaggcaatgctggaaggccggaatggtggccaaaagatgtagaacataaagagccggaccacctccagaaagcggatcgactgaaattgatgtgcacgataattatgaatgttctaccgcaatctcccttcagccttgagattttggacgagcttacaggagtgaccgccgcaatgaccatttttaagaaagaaactgtgaagaaagtaatcatgaaaaatgttttcgaaattgcgaaatgcttgtgcaacaaagatttcaagcagaagaccatatcacttgatgatttaaatgacctagcccaaaaacagaaaaaatcataccatagtcgtcgatttgatgtaaataaaatggttaaggtagaaaaagatttgttacaacagtcaagtggaagcgattcttcaccctcgatgatccttccttcaaaagaaagtgacacagagtatttccccagggaatatccgaaagaccctgtatcggaggattattcgaatagcatatctcgattagaaaatttagtggaatttgatccgttattcctcactaaattggatgaattaactagtagcgatgattgtaaagattttatttga

SEQ ID NO: 2161 - DNA, 975 bp, Saccharomyces cerevisiae
atggatagagacactaaattagcttttaggctgaggggcagtcattcaagaaggacagacgatatagatgatgatgttattgtatttaagacgccaaatgctgtttatagagaggagaactcacctattcaatctcctgttcaacccattttgtcttcaccaaaacttgcgaattctttcgagtttcctattaccactaataacgtaaatgcgcaggaccgtcatgaacatgggtatcagcccttggatgcagaagactatcccatgatcgactctgaaaataaaagtcttataagcgaatcgccgcaaaatgttagaaatgatgaagaccttactactcgttacaatttcgatgatatacccattagacagctatcatcgtctatcacttctgtgaccacaattgatgttttatcttctttattcataaacttatttgaaaatgatttgattccgcaagctttgaaggatttcaataaaagtgatgatgatcaatttaggaaactattgtacaaattagatctgcgactctttcaaacgatatcagaccaaatgaccagagacttgaaagacatattagatatcaacgtgtcgaataatgagctctgctaccaactgaagcaggtacttgctcgaaaagaagatttgaaccagcagataatatcggtacgaaatgaaattcaagagttgaaagccggtaaagactggcatgacttacaaaatgaacaagccaaactgaacgacaaagtgaagctaaataagaggctaaatgatttgacttctactttgctaggcaaatacgagggagatcgcaaaattatgagccaagatagcgaggacgattcaatacgggatgactcaaatattctggatattgcacatttcgtagacttgatggatccatataacggacttctgaaaaagataaataaaattaatgaaaatctttctaacgaattacaaccaagtctatag

SEQ ID NO: 2162 - DNA, 975 bp, Saccharomyces cerevisiae
atgtcatctgacaactctaaacaagataaacaaattgaaaaaacagccgcccagaagatatcgaagtttggttcgtttgtggctggtgggctagcagcatgtatagctgttacagttactaatccgatcgaattgattaaaatcagaatgcagcttcaaggtgaaatgtcagcatcagctgcaaaagtttataaaaatccaatccaaggtatggcggtaattttcaaaaacgaaggtataaaaggtctgcaaaaagggttaaatgctgcttatatctatcaaattgggctaaatggttccagattagggttttatgagccaatcagatcatcattaaatcagcttttcttcccagatcaagagccacataaggtacagagcgtcggagttaacgtcttttctggtgccgcatctggtataattggtgcagtcattggctctccattattcttggtgaaaacaagacttcaatcatattccgagtttataaaaattggtgaacaaacgcactacaccggtgtttggaacgggttagtaaccatttttaaaaccgaaggtgttaagggtctattcagaggtattgatgcggcaattttaaggacaggtgctggttcctctgttcaactacctatctacaacacagcaaagaacattttggtcaaaaatgatctgatgaaagatggcccagcattacatttaactgctagtactatctctgggttaggtgttgccgtcgttatgaacccatgggatgtcattttgacaagaatctataatcaaaaaggtgacttgtacaagggacctatagattgtttggtcaaaactgttagaatcgaaggtgtaaccgctttgtataagggttttgcagctcaagtgttcagaatcgcacctcatacaatcatgtgtttgaccttcatggaacagacaatgaaactagtttattcgatagagtcgagagttttaggccataattaa

SEQ ID NO: 2163 - DNA, 976 bp, Saccharomyces cerevisiae
atgtcagctgtcccaagtgttcaagtatgttttcagttctgcagaatgatgtttgatagtatcgataatggagtgagatcaagagaaaaaaaatgaatatgtcagccaaccaagttctgagtaggcagtaaatgagtacgcatagtgtatttatccaaaggaaagaattgttatttttacaagccgaattgagatccaattaggcaatgttttggggagagtattttgacaagattggttaaactactacggtcagttccgtaaccagtacgattgtacacataaggaaacaactgtaaagataaacaataagggcttccaatgccattgtaagatatcatattcctaaacaaaaatgtacagcgaatataaagccagcgtcagtgtcttcctggaaggttgcgcaactaaagaagttgaaattaaaatggcaagcgctacattttcatccattttcactcatcagatgtccaagattttcgaaaaataaatattctcatttttctctcaatgaaataattgttactaacattgaatttcctcgtaactaattgcattacttctttagacttttggtaagaagaaatcagctactgctgttgcccatgtcaaggccggtaagggtttgatcaaggttaatggttctccaatcactttggttgaaccagaaatcttaagattcaaggtttacgaaccattattgttagttggtttggacaaattctccaacatcgatattagagttagagttactggtggtggtcatgtttcccaagtttacgccatcagacaagctattgctaaaggtttagttgcttaccatcaaaaatatgtcgatgaacaatccaagaacgaattgaagaaggctttcacttcttacgacagaaccttgttgattgctgattctagaagaccagaaccaaagaaattcggtggtaagggtgctcgttccagattccaaaaatcttaccgttaa

SEQ ID NO: 2164 - DNA, 978 bp, Saccharomyces cerevisiae
atgaaatttaatttttctacaattttcaatatcttattctttttattcaccttaattgaagccaacagcaatggggaaacagtcaaacttattacttctgatggtattgtttacagttatgctgtctacacaaagactcttgcgccggcaagggttgtggttaaaacgatttcatatactactacaagggtatatccgattactttagctaattccgtcgtttcttccactactgaaaagataacagaggtttcaacggtgtcagcttcagaacaagttagtgctactcaaacaaactcattggtttctacttctactgtttccactatcagtccaacgatttcatctggttcttcaacatcctctagctctacatacgatatcgaatcatctcaaagtatcgaatcgtcaggtacatcttccgctacagccgaaccatctgcgtcttcaggttttcgtttgacttctagttctgcttttgtttcatctactgcacctttctcttcccaactttcttcatcttcatcttctgaaacatcatcctcatcattttcaacatcatcatcatctgcccctctttccttaacttcttcttcttcttcttcttcttctttcgccactattattaccttggcaccatcgagctcaaaaagcggaaactctcaactaactttggcgtcatcgtcttccacttccgcagttgagtcatcccaaacagggtccactatagcaagaactacctctacactggtaccctcttctagcgtagatacaacgtctagagcaacgacatccatgccattagaatcgtcttctacgcaatcgatatccgtctccagctcggatggcacttgttacgttttttatgatgatgatgactactatagtactgtctacttaactaacccgtctcaatccgttgatgccgccaccactataactagtacaaacacaatttatgctacggttaccatttag

SEQ ID NO: 2165 - DNA, 978 bp, Saccharomyces cerevisiae
atgagttttacaggttcattagcgctggcaggtattggtggtttggtgtacaagtttggcggaggccaatcgtatgaaaaactgccatatgtcaacatccccttcaatcagtacttggataaagtttacaagaagcacttcagcaaagttatgagccgtaccagatacgtgctaatgaactttttcaaagatgcattcacaggaggtgcattcatgtacccgttcaaagggtttttagagttcaacaccaataagagcagttactcaacgactatgttaggtatattatcgagttacttgataatgtttgccctggtaagctttgtgtattgggctacaattacgccaatgtacacagcttttttgattgtgctgggccctattgggcttttcattgccatttttcattcctttttgcaagcaaatgttttcactttattgtttatgagactcagtcattttaataatcatttagtggaggtgtgcttagagaagaatggtttagaggagaatttgagtgaagtcaaaccaatcaagtactatgcacctattaactcgatatatttctgggcttactatttcccattcaagttggtcaagtacatgttaggcctgtcggttctttttgtgctgttggttatatcttttttcccacttattggaccaatcctttttcatattttaatttctcctttcatcactcaaatttacttcacgaaagttttacgtttacaaaatttcgacaacatacaaagacgtgaaaatatttatctccacgctggccaatatgcctcatttggtttcttggccggtttgattgagtccgtgcccattttagcgggctttgccatttctacaaatactattggtagcgttttatttaaccttgatcatccaatggtccctgaaaatttagtagaaactcaagctgaaattgaagcagcaccacaagatatcaatcaacaaccgaatcaataa

SEQ ID NO: 2166 - DNA, 978 bp, Saccharomyces cerevisiae
atgatgccgaatgttgctccaaacagctactatttaaacataccgaatgccaattcgacctcaacgactacgtcctcgatcttttctgatctcaacaaggagtacgagtcaaagattaaagaaatcgaagaatattatataaagacactgctcaatgaaaataccgataatgatgacagcagcagctccgaggggcataatataaatgaaacggacattttaagtgaatactcaccaaggccttctccttggttaccatccaaaccaaactgttatcatccgttgggagattttaaagacttgatcatatcagattccagacctacaaatacattacctattaataaccctttcgcaggcaataataacatctcaacacttgctacaactgagaaaaaacgtaagaaaaggtcactcgaagttgagattaaccctacttacacgacaagtgcattttcattacccctgacagcggagaatttacaaaaactatctcaggtggattctcagtctactggacttccatacacacttccaattcagaaaacaacaaaactggaaccttgtagaagggcacctttgcagcttcctcaattagtcaataagaccttatacaaaactgagctctgtgaatcttttactattaaaggctattgtaagtatggaaataaatgccaatttgctcatggtcttaatgaactgaaattcaagaaaaaatcaaacaattatagaactaaaccttgcataaattggtcgaagttaggctactgtccgtacggtaagcgttgctgtttcaaacacggtgatgataaggacgttgaaatatatcaaaatgctaacgatggaagaagtaaggatacggcgttgactccacttcctacttccctagccccaagcaacaacgataatatcactaatttgagtaagcctaggaacttacatactagtgttaaagcattgcaaaggatgacttggtag

SEQ ID NO: 2167 - DNA, 978 bp, Saccharomyces cerevisiae
atgattgaagagaatttgaaacagaaaatccacgataagttcgttgcagccaaaaagaatgggcatctgaaagtaacgcatgcagaatccaagaagttgaaagatcctcaaacgacgacacaatattgggtgacatttgctccatctttggcacttaagccagacgctaacaagaatagcgattcaaaggcggaggacccgttcgccaatcccgacgaagaactagtggtgactgaagatctaaatggtgacggagaatataagctgctactcaacaaatttcctgtggtccctgaacatagtctcctagtgacaagcgagtttaaagaccagagatctgctttgacgccaagtgacttgatgactgcttataatgtgctctgttctctccaaggagacaaggacgatgatgtcacttgtgaaaggtatctggtcttttataattgtggacctcatagcggttcctcacaagatcacaaacacttgcagatcatgcaaatgcctgaaaaatttataccttttcaggacgtattgtgcaacggaaaggatcatttcttgcccaccttcaacgcagagccattacaagatgataaggtttcctttgctcatttcgtcttgccgctgccggaatcgtctgatcaagtggacgaagatcttcttgctatgtgttacgtatctttgatgcagagagcacttacatttttccaagattggaccaatgagtctccggagttgaccaagtcatacaatgtgctactgaccaagaaatggatctgtgtagttccaagatcgcatgccaagagtggaccgccattgatgttaaacattaactccacggggtactgtggtatgatcctcgttaaagacagagaaaaactagagaacctcactgaagatcctcatcttgtggacaagtcgttactgcaatgcggtttccccaacacagcaggccaaaaaccaacagagtatcactattaa

SEQ ID NO: 2168 - DNA, 978 bp, Saccharomyces cerevisiae
atgcaatataaaaagccattagtcgtctccgctttagctgctacatctttagctgcctatgctccaaaggacccgtggtccactttaactccatcagctacttacaagggtggtataacagattactcttcgagtttcggtattgctattgaagccgtggctaccagtgcttcctccgtcgcctcatctaaagcaaagagagccgcctctcagataggtgatggtcaagtacaggctgccactactactgctgctgtttctaagaaatccaccgctgctgctgtttctcaaataactgacggtcaagttcaagctgctaagtctactgccgctgctgtttcccaaataactgacggtcaagttcaagctgctaagtctactgccgctgccgtttctcaaataactgacggtcaagttcaagctgctaagtctactgccgctgccgtttctcaaataactgatggtcaagttcaagctgccaagtctactgctgccgctgcctctcagatttctgacggccaagttcaggccactacctctactaaggctgctgcatcccaaattacagatgggcagatacaagcatctaaaactaccagtggcgctagtcaagtaagtgatggccaagtccaggctactgctgaagtgaaagacgctaacgatccagtcgatgttgtttcctgtaataacaatagtaccttgtcaatgagtttaagcaagggtatcttaaccgataggaagggtagaattggctctatcgttgccaacagacagttccaattcgatggtcctccaccacaagctggtgctatctatgctgctggttggtccatcaccccagaaggtaacttagctcttggtgaccaggatactttttaccaatgtttgtctggtgacttctataacttgtatgataagcacattggttctcagtgccatgaagtttatttgcaagctatagatttaattgactgttga

SEQ ID NO: 2169 - DNA, 978 bp, Saccharomyces cerevisiae
atgctgccatcattaaggaagggatgcttcattgtgaattccataagattgaaactgccccgattctactcattaaatgcccagccactggggacagacaacacgattgagaataacactcctacggaaacaaatagattgagcaaaacttcacagaagttttgggaaaaggtgtcactaaatagggatgttgagaaaggaaagattgctctacaattagatggcaggactataaaaactcctctaggaaatggaattatagttgataatgcaaagtctctcttagcatacctattaaaactggagtggtcgtccctatccagtctttccatcaaaactcactctttgccactaacttcattagtggcaagatgcatagatttacaaatgacaaatgagcctggctgtgaccctcaattagttgcaaagattggaggcaacagtgatgttataaaaaatcagttgttaagatatttagataccgatactttattggtcttttcccctatgaatgagtttgaaggaagattacgcaatgcgcaaaatgagttatatatacccatcatcaaaggaatggaagagtttttacgcaacttttcatccgagtctaatattcgactacaaattttagatgccgacatccatgggttacgaggcaatcagcagtcggatatcgttaagaatgcagcaaaaaaatatatgagcagcttatcaccatgggatcttgcaattcttgaaaaaactgtattaaccacaaagtccttcatttgcggcgtgctattattagaaaataaaaaagatactgcgaacttaattcccgccttgaaaactgatatggataatattgtacgtgccgccaccttagaaacaatcttccaagttgaaaagtggggagaggttgaagatactcatgacgttgacaaaagagacatcagaagaaaaattcatactgctgcgattgctgcttttaagcaataa

SEQ ID NO: 2170 - DNA, 978 bp, Saccharomyces cerevisiae
atggcacgtcttcctctaaagcagttcttagcggataaccccaaaaaagttcttgttcttgacggtggtcaaggaacagaactggaaaacagaggtatcaaagttgcaaatcccgtgtggtctactattccatttattagcgaatcattttggtctgatgagtcatctgctaacagaaaaattgtcaaagaaatgttcaacgatttcttgaatgctggcgcagaaatattgatgactacaacataccaaacgagttataaatcagtttctgaaaacaccccaatcagaactttatccgagtacaataaccttttaaacaggattgtcgatttttctcgtaattgtattggcgaagacaaatatttgattggctgtattggcccatggggtgctcatatttgtcgtgagtttacaggcgactatggtgctgagccagaaaatattgatttctaccaatacttcaagcctcagttggagaatttcaataaaaatgacaaattggatttgattgggtttgaaaccattcctaacatccatgaactgaaagctatcttatcttgggatgagagtatcctgtctagacccttctatatcgggttgtctgtgcatgagcacggtgtcttgagagacggcactaccatggaagaaatcgcacaagttattaaggacttgggcgacaaaataaatcctaacttctcgttcttaggaatcaactgcgtcagcttcaaccaatcacccgacattcttgagtctctacatcaagcactaccaaatatggccttgcttgcttatccaaacagtggtgaagtttatgatactgaaaagaagatatggttgccaaatagcgataagctgaacagttgggatacggttgttaaacagtacattagcagcggtgcccgtatcattggtggttgttgcagaacaagtccaaaagacatccaagagatttctgcagccgtcaagaaatacacgtaa

SEQ ID NO: 2171 - DNA, 978 bp, Saccharomyces cerevisiae
atgtcaggatctcttacgctacttaaggaaaagcatatacgttatattgaatcattggatacaaagaagcataattttgaatactggcttaccgagcatcttcgtttgaatgggatatattggggacttactgccttgtgtgtgcttgattctccagagacatttgtgaaagaagaggttatatcatttgttctgagctgttgggacgacaaatacggcgctttcgcaccatttccaagacatgatgcacatttattaactacattgtccgccgtacagatcttggccacttatgatgctttggatgttcttggaaaagatcgtaaggttcgcttgatttccttcatccgtgggaatcaattggaagatggttcgttccagggtgacaggtttggggaggtagatacaaggtttgtttatacagccttgagtgcactatcaattttgggtgaattaacgtctgaagttgttgaccctgctgtagactttgtactcaagtgttataattttgatggtggctttggattatgtcctaatgctgaatcccatgcagctcaagcttttacctgtcttggcgctttggcaattgctaacaaattggatatgcttagtgacgaccaactagaagaaattgggtggtggctttgcgaacgacaattaccagaaggtggactaaacggtaggccaagtaaactgcccgatgtttgctatagttggtgggttttatcttcattagctattattggtagactagattggataaattatgagaagctaactgagtttatactcaaatgtcaagatgagaagaagggtggaataagcgacaggcctgaaaatgaagtggatgtcttccatacagtttttggtgttgctggtttaagtttaatgggatacgacaatttagtccccatagatcccatatattgtatgccgaaatccgttacatcaaaattcaaaaagtatccatacaaatag

SEQ ID NO: 2172 - DNA, 978 bp, Saccharomyces cerevisiae
atgtccttcttcaacttcaagtatgttcacactgttgtcgttttattttcttctggacctgcgttatcattttactaactagccaacacacctaatcaaatcatttgatcctacgtgtatactttgcaaaacagagcattcggaagaaactcaaagaaaaataaaaaccagccccttaatgttgctcagccgccagcaatgaacaccatttattcaagcccccacagcagcaattccagattatcgttaagaaataaacatcattcgcctaagaggcattctcaaacaagtttccccgcacaaaagtctacgccgcaatcacagcaattgacatctaccacaccacagtctcaacagcaagaagctagtgagagatcagaatcacaacagataatgtttctcagcgaaccgttcgtaagaactgctttagtgaaaggttcatttaaaacaatagtacaattgcccaaatatgtggacctgggagagtggatagcgttgaacgttttcgaattcttcacaaacttgaaccaattttacggagtagtagcggagtacgtaacgcctgacgcgtatccaacaatgaacgctggccctcacacggattatttatggctggacgcaaacaatagacaggtttcactgccagctagtcagtacatagatttggccctcacgtggataaataacaaagtgaacgataaaaacttgtttccgaccaaaaatgggctaccattcccgcagcaattttcgagagatgtgcagagaatcatggtacagatgttcaggatattcgcacatatttatcaccaccactttgacaaaattgtgcacttgtcattagaagctcattggaattcatttttctctcatttcattagttttgcaaaggagtttaagatcattgacagaaaggaaatggctccgctgctaccgttaattgaaagctttgaaaaacagggcaaaattatttataattag

SEQ ID NO: 2173 - DNA, 978 bp, Saccharomyces cerevisiae
atgtctactaactttgaaaaacatttccaagaaaacgtcgatgaatgcactctagagcaactaagggacatcttagtcaacaagtccggcaaaacagttttggccaacagatttagagctctgttcaacttaaagactgttgctgaagaatttgccactaagccagaggaagccaaaaaggccatcgaatacattgccgaatccttcgtcaatgacaagtctgagttgttgaagcacgaagtggcctacgtgttgggtcaaaccaagaacttggacgctgctccaactttaagacacgttatgttagatcaaaatcaagaaccaatggtgagacacgaagccgctgaggctttgggtgccctaggtgacaaggattcgttggatgacctaaataaggctgctaaggaggatccacacgttgctgtgagagaaacctgtgaactggccattaacagaatcaactggacccatggaggtgccaaggataaggaaaacttgcaacaatccctatactcgagtattgacccagccccacctctaccattagaaaaggatgctaccatcccagaactacaggccttattgaatgatcctaagcaacctttgttccaaagatacagagccatgttcagactgagagatatcggtactgatgaagcaatcctggccttggccactggtttcagtgcagaatcctcccttttcaagcatgaaatcgcctacgtcttcggtcaaataggtagtccggctgctgtcccaagtttgattgaagttttgggcagaaaggaagaagctccaatggttaggcatgaagctgctgaagccttgggtgccattgcttctccagaagttgtcgacgtcttgaaatcttacctcaacgatgaagtcgatgtcgtcagagaatcttgtatcgttgcgctagatatgtatgattacgaaaacagcaacgaactagaatatgctccaactgctaattag

SEQ ID NO: 2174 - DNA, 981 bp, Saccharomyces cerevisiae
atgaaaaatgataataaagctaatgatataataatagactccgtcaaagttcctgattcgtacaagcccccaaaaaatcctattgtattttgccatggtttatcaggatttgacaaattaattctaatcccttctgtattccatctgacaaacctaatttccaattcaatagtacataatatggcagaaaatttcatgcaggatgacgaagataagagtgataacaagtacacaaatttgttggagattgaatattggattggcgttaaaaaatttcttcaatctaagggatgtactgttatcaccactaaggtaccaggttttggtagcatcgaggaaagagcaatggctttggatgctcagttacagaaagaagtaaagaaaatcgagtcgaaggataagcgacattcgttaaatctaatcgcacactcaatggggggactagactgccgatatctaatttgcaatataaaaaataggaattacgatatattgagcctaaccactatttcaactccacatagagggtcagaaatggccgattacgtagtcgacctttttgaaaatctaaatgccttgagagttagccaaaagatattgccaatatgtttctaccaactcacgactgcgtatatgaaatatttcaatttggttacgccaaatagtccaaaagtctcttatttttcgtatggatgctcctttgtgcctaagtggtacaatgtcttttgtactccctggaaaattgtttatgaaaggtctaaaggttgccccaacgatggccttgtaaccataaatagtagtaaatggggtgaatacagggggactttgaaggacatggatcatctggacgtcatcaattggaaaaataagttacaggatgattggagtaaattttttcgtaccactactgtcggagagaaggttgacatcctgaatttttacttgaagataaccgatgacttggcaagaaaaggattttaa

SEQ ID NO: 2175 - DNA, 981 bp, Saccharomyces cerevisiae
atgaaattcacatcagtgctagcattttttcttgcaactttaacagcttctgcaacaccactttacaagaggcagaacgttacttctggcggcggtacggtccccgtgatcatcacgggtggacctgctgtatctggtagccagtcaaacgttactaccacaacgctattcaactctacttccaccttaaacatcactcaactttaccaaattgctactcaagttaatcagactttacaaagcgaatcgtcttccggcattataatcgtcacaaactggcgttccattgaaactttgagtttcttctgctcaatcgtttttaatacatcaaagaccattgtcattactgagaatttcttatggggtgtaccaatattgagtagttcggacgcggaaggtagaggcactttggttgccggtagagataaagttgtgtattctggtgttttccctccttacactgttcctgtgggcgttttgtctggtcagaagaatgttcaatggttctttgatgcctgtgagccaactctgattgccagcaactccacaatcagaactcaatactcgaattttacgagcgcacaaatatcttctaatgcctcctccgggaccaatacatcctcatcatcctccagtccattggttccaattatatacgaagaaggatattctcaaagcttaattcaatcactaagttctagtatccaaggtttggttgttgtcagctctggtacaagtcacaacagtaccgtggcatcatggacatcggtcgacttccctgtcgtttatgcaagtgatggatccagtggtcatgatggttcaggaattgggttcataagtaacacaagtattccacaaggtgcaatttctgctgggtacttgtcaccaatccaagcgcaaactttgttgtctattgctatccataatcaagtcacaagtagtagcgagttacaacaaatcttccctgttagtcaacaataa

SEQ ID NO: 2176 - DNA, 981 bp, Saccharomyces cerevisiae
atgaattcagagtctcgagaagatatggctataaatagtatcaaattgctagcgggaaactcccatcctgatttggctgaacaaatatcgaaaaagttaggtattccactttccaaagttggtgtgtaccagtattctaataaagaaacctctgtcaccataggtgagagccttcgcgacgaagatgtgtatattatccaaactggaataggtgaacaagaaattaatgatttcttgatggaattattaattttaattcatgcttgcaaaattgcatctgcaagaaagatcactactgtaatacccaattttccatatgcaagacaagacaagaaagataaatcccgggcgcccattaccgcaaagttggttgccaatttattgcaaactgctggtgctgatcatgtcatcacaatggatctccatgcctcccaaattcaagggtttttccatatcccggttgacaacctatatgcagaaccaagtgttttaaattatattagaacgaaaacagatttcgacaatgctattttggtgtcgcctgatgcaggtggtgctaagagagtagctgctttggctgacaagttagatttaaattttgctttgattcacaaagagaggcaaaaagctaacgaggtttcaaaaatggtgcttgttggtgatgttaccaataaatcatgtttattagttgatgatatggcggatacttgtggtacgttggtaaaagcttgtgatacgttgatggagcatggtgccaaagaagttatagctattgttacacacggtattttctccggttcagcaagagaaaagctaagaaatagtagattgtctagaattgtttgcacaaataccgttccggtagatttggatttacctattgctgaccagatcgatattagtcccacgttcgctgaagctataagaagactacacaatggtgaatccgtgtcatatttgttcacccatgctccagtatag

SEQ ID NO: 2177 - DNA, 981 bp, Saccharomyces cerevisiae
atgattgttcccacttatggagacgttttggatgccagcaacagaattaaagaatatgtaaataaaacaccggttctcacttcacgaatgcttaatgatcgacttggagcacaaatatactttaaaggtgagaatttccaacgagtgggagcgttcaagtttcgtggagcaatgaatgctgtttcaaaattaagtgatgaaaaaagaagtaagggagtaattgccttctcatcaggaaaccatgcacaggctattgctcttagtgcaaaactattaaatgtacctgcaacaattgttatgcccgaggatgcgcccgcccttaaagttgctgctacagccggttacggagcacatatcataaggtataacaggtatactgaagatcgcgagcagattgggcgtcaactagcagccgaacatggttttgcattgattccgccctacgatcatcctgatgttattgcagggcaaggtacgtcggcaaaagagctattagaagaggttggacaacttgatgcattatttgttcctttgggcggtggtgggctcctttcaggatctgcacttgccgctagaagcctttctccaggctgcaaaatttttggggttgaacctgaagctggtaacgatggacaacaatccttcagatcgggttccattgttcatatcaatacgccaaaaactatcgcagatggcgctcaaacacaacacctcggtgagtacacatttgccattattcgcgaaaatgtcgatgatattttaacggttagcgaccaagagctagtaaaatgcatgcactttcttgcggaacgcatgaaggtggttgttgagcccacagcttgtttgggatttgcaggtgcacttctaaaaaaggaagagctagttgggaagaaagtaggcataatactaagtggaggtaatgtagacatgaagagatatgctactttaatctctgggaaggaagatggcccaacgatttag

SEQ ID NO: 2178 - DNA, 981 bp, Saccharomyces cerevisiae
atggaagataagcggaaaagacgagccgctacacttagtacagcattgatattatttgtggcatgctgcgtttatacactatatatattcaagtttgataaccctcggttgtctccaccagtttccttattgcctacaattagcaccttgaagaaaattgagcatgtaacagatttaaataaggagtacgtttttgttggtgacgttcatggtaactatgatgagttcatagaactcattgatgacaagattggaggactaggagaaaatataacaatgatattgctgggtgactttattcacaagggcccggactcagacaaggtcgtgtcgtatattctaaatcacaaggatcaagtcaagtgcgttttgggcaatcatgaaatattggtcatgatggcctatttaaacccagacttctcgaaatgggtaagacgccccaaattaatgacacctttaactttcagtacggagactaatttcataccacaagacatctctaaaatcagcaacgcacatggacggttagctcgcgaacttgggttttccaaattaagtcagctagcggaacattgttctatggccatagaactagatctggatattaccggtgatatactctttggtgcacatgcagggatggttccgggagacttcatgaagcccaaccaaattccgggcgtgagctctctgtcaaacatgaagtacgttgataagaagaactggtcaaaaacatcacgtgaaaaggaaaacaagaattatgtgagatggtacacactgtgggacaaatacggagaccactttagtaacgccaaagtattttacgggcacgatgcatccatgggactaaacctacggagacagaccaaaggtttggacacagcatgtataaagaacaatctgctttcatctatgaaagtgaagtacgatattaagaaggggcaatatgactatgaattaattcaagtacaatgctcttaa

SEQ ID NO: 2179 - DNA, 981 bp, Saccharomyces cerevisiae
atggcagaagtactgaccgtcctcgagcagccgaactcaattaaagattttctcaagcaggattcaaatattgcgtttctagctggtggagtagctggcgcggtttcccgaaccgttgtttcaccttttgagagagttaaaatactgctgcaagttcaaagttcaaccacttcttataaccgaggtatctttagctctatacggcaggtttaccatgaggagggaaccaaaggtttattcagaggaaatggtttgaactgcataagaatttttccctatagtgcagtccagtttgtagtatacgaagcttgtaagaaaaagttattccatgtaaatggcaataatggacaagaacaactaacgaacacccaaagactattcagtggtgcattgtgtggtggttgtagtgtggtggctacttacccgttggacttgatcaaaacaagactatcgattcagacagcaaatttgagcagtttaaaccgctcaaaggcaaaaagtatatcaaagcctccggggatctggcaattactaagcgaaacttacagactcgaaggcggtctcaggggattatataggggtgtatggccaacgagtcttggtgttgttccatatgtagcactaaactttgcagtttacgaacaattgagagaattcggtgtcaattcctccgatgctcagccttcctggaaaagtaacctctataaattaacaattggcgccataagtggaggggttgcgcaaacaatcacttatccctttgatctgctaagaagaagatttcaagttctcgcaatgggcggaaatgaactgggatttagatacacgagtgtctgggatgcgctcgtgacaatcggcagagcagaaggcgttagcggttactacaaaggcttagctgcaaacctttttaaagttgttccttcaactgcagtgagttggctagtttacgaagttgtatgtgattctgtaagaaattggtga

SEQ ID NO: 2180 - DNA, 981 bp, Saccharomyces cerevisiae
atgtcacaagtaaaaagagccaatgagaaccgcgaaaccgcaaggttcatcaagaaacacaaaaaacaggttacaaacccaattgatgagaaaaatggaacttccaactgtatagtgcgtgttcccattgctctctatgtttctttggcaccaatgtatttagaaaatcccttgcaaggtgtcatgaagcagcacttgaacccattagtaatgaaatataacaacaaagttggaggtgttgtgctaggttatgaagggttgaaaattcttgatgctgatcctttaagcaaagaagatacatcagaaaaactaataaaaatcacacccgataccccttttggatttacttggtgccatgtaaacctatacgtttggcagccacaagttggagatgttttggaaggttacattttcattcaatccgcctcacacattggtcttttgattcatgatgcgtttaatgctagtatcaaaaagaataatatccctgtggattggacctttgtccataacgacgtggaagaagatgctgacgtgataaacacagatgaaaataatggaaacaataataacgaagataacaaggatagcaatggtggaagcaatagtttgggcaaattttcctttggaaacagatctttgggccactgggtagattctaatggtgaacccattgacggtaaattgaggttcacagtgagaaatgttcatactacaggaagagttgtttctgtggacggtacattaataagtgacgccgacgaagaaggcaatggctataacagctctcgttcccaagctgaaagtttacctatagtttcaaacaaaaaaattgtatttgatgacgaagtttcaatcgaaaacaaagagagccacaaggaactagacttacctgaagtaaaagaagataatggttcagagatcgtatacgaggaaaacaccagtgaaagcaatgatggtgaatcgagtgatagtgattag

SEQ ID NO: 2181 - DNA, 981 bp, Saccharomyces cerevisiae
atgtccactgatagtacacgctatccaattcagattgagaaagcctcgaatgatccaacccttctgcttaatcacacatgtttaagagtcaaggatccagcaaggaccgttaagttctacaccgaacacttcggtatgaagctattaagcagaaaggattttgaagaagcaaaatttagcttgtactttttaagctttccaaaagacgacatacccaaaaataagaatggagagcctgatgtttttagcgcacacggtgtcttagaactaactcacaattggggtactgaaaaaaacccagactacaagatcaacaacgggaatgaggaacctcatcgtggatttgggcacatctgtttttctgtatccgatatcaataaaacctgcgaagagctagaatctcagggtgtcaaattcaagaagagactctctgaaggaagacagaaggacattgcgtttgctttaggccctgatggatactggattgagttgatcacatattctagagagggtcaggaatacccaaagggctcagtaggtaacaagttcaatcataccatgattcgtattaaaaacccaacccggtctttagaattctaccagaatgtgttgggcatgaaattattaagaactagtgagcacgaaagtgcaaaatttacgttatactttcttggttatggcgttccaaagaccgacagcgttttttcatgtgaaagtgtgttggagttaactcataattggggaactgagaatgatccaaacttccactatcataacggtaactcagagccccagggttatggtcacatctgcataagttgtgatgacgctggcgccctttgtaaagaaattgaagtgaaatacggcgataagatccaatggtctcctaaatttaaccaaggcagaatgaagaatattgcctttttgaaggatcctgatggttattccattgaagtcgttcctcatggtttgattgcctaa

SEQ ID NO: 2182 - DNA, 981 bp, Saccharomyces cerevisiae
atgtcgtttaatgccttcgccagctctttgagcaagaaattacaggaaatatccacaagtgtttccgaaaaaacccaggaattgcccagtttggcgcaatccacccaaagaatggtccaggaacgtttgggccaggtgacggacatctcccaattgccaagagagtacacagagctggaagataaggttgacaccatcaaactgatttacaaccacttcttgggtgtaactgctatctacgaaaacggatcgtacgattaccctaaatacatcaacgaatccgtcaacgagttttcaagaagcgtggcttccaagttgacagagttgactcatgctacatctgcgtctgaggcacaaaacatcttagttgctccaggccccatcaaagaacccaagacgttgaactacgccctcagtaaagtggctttgaactccagtgaatgtttgaacaagatgttccccaccgaggaacaacccttggcttcggcactcttgcaattcagtgatgtgcaggctaagattgctcaagctagaattcaacaagataccttgattcaaaccaaattcaataaaaatttgagggaaaggctctcttttgagatcggtaaggccgataagtgccgcaaggatgtccattccatgagattaagatatgacgtggcaagaactaacttggcaaacaacaagaagccagaaaaggaagcttccttgagagtccaaatggagactttggaagaccagtttgctcaagtcactgaagacgctactgtgtgcttgcaggaggttatttctcacgctaacttcagtgaagatttgaaggaattggccaaggctcaagctgagtattttgaaacctcggctggcctaatgaaagagttcctatccaactcatttgcggaagagccggaagcaaagcctgaggttgcagaagaagaaaagccacagacagctatctctatgaatgacgaagacgacgcttaa

SEQ ID NO: 2183 - DNA, 981 bp, Saccharomyces cerevisiae
atgtctgctacctctactgctacttccacaagtgcctctcaattgcacttaaactctactccagttactcactgcttatctgacatcgttaagaaagaagattggtctgactttaaatttgctcccatccgcgaatccactgtctctcgtgctatgacttctcgttatttcaaggatcttgacaagtttgccgtttctgacgtgattattgtcggtgcgggctcttcaggtttatccgccgcttacgtcatcgccaagaacagaccagacttgaaggtttgtattatcgaaagttcagttgcaccaggtggtggtagttggttgggtggtcaattatttagtgccatggttatgagaaaaccagctcatttgttcttacaagagttggaaatcccttacgaagacgaaggtgactatgttgtcgttaagcatgccgctttgttcatctctactgtcctttcaaaggtcttgcaattaccaaatgttaaactgttcaatgctacctgtgttgaagatttggttaccagaccacctaccgaaaagggcgaagtcaccgttgctggtgttgtcaccaactggacgttagttacccaagctcacggtactcaatgttgcatggaccctaacgtaattgaattggcaggttacaaaaatgacggaactcgtgacttgagtcaaaagcatggtgtcattttatccactaccggtcatgatggtccatttggtgctttctgcgccaagagaatcgtcgacattgatcaaaaccaaaaattgggcggtatgaagggtctggacatgaaccatgccgaacacgatgtcgttattcactctggtgcatacgccggtgttgacaacatgtactttgctggtatggaagttgctgaactggatggattaaaccgtatgggtccaacttttggagctatggctttgagtggtgttcatgctgctgagcaaattttgaaacactttgctgcttag

SEQ ID NO: 2184 - DNA, 982 bp, Saccharomyces cerevisiae
atgtccactgaattaactgttcaatctgaaagagctttccaaaaggtatgaaagaattataacctgaatgaggtaatcaatgaaatattcagtacggaaaggaaaattgctcgaggtaatattataattttaatgggaatttccagatttatcaacataaacgttagcaagcgcagtaccatcaagtaaaagtttactggtgaaaagcaggacctcgaatgattgagatttcgttacacagtacgagtaaaatataaattatttcaagaagaagagaacttttgatctgaaaatgaaaatgtaaccacggagaaatgttgagaatacataaataaccatgaggccaaaacaccttaatatgaagtataacttttactgtgctcaatgactatttcacccgactaatgccaagtaaggaggatctccatcatacggaacaattttccaaccgccacgacacagttaacgatttccttttcgcctaaaaatagtaggaatgaagttcatgattatattttagatcaaccggtttactaacatgctatttttcatacagcaacctcacatcttcaacaatccaaaggtcaagacttccaagagaaccaagagatggtataagaatgccggtttgggattcaagaccccaaagaccgctattgaaggttcttacattgataagaaatgtccattcactggtttagtttccatccgtggtaagatcttgaccggtaccgtcgtctccaccaagatgcaccgtaccattgtcatcagaagagcttacttgcattacattccaaagtacaacagatacgaaaagagacacaagaacgtcccagtccacgtctccccagctttccgtgtccaagttggtgacattgttaccgttggtcaatgtagaccaatctccaagactgttagattcaacgtcgtcaaggtctctgctgctgccggtaaggccaacaagcaatttgctaaattttaa

SEQ ID NO: 2185 - DNA, 984 bp, Saccharomyces cerevisiae
atgagctccagtgaagacgaagacgacaagttcttgtatggttccgactccgaattagcactaccttcatctaaacgatcaagagatgatgaagcagacgcaggtgcgtccagtaatcctgatatagttaaaaggcaaaaattcgactctcccgtggaagaaactccagctactgccagagatgatcgttctgatgaagatatctactctgactcctcagatgacgatagtgattctgacctagaggttatcataagtctgggtcctgaccctactaggttagatgcaaaactactcgattcttattctaccgcagcgacatcttcaagcaaagacgtaattagcgtagctacagatgtatccaataccatcacaaagacatcagatgaaagactaataacagaaggagaagcaaatcaaggtgtaacggcaacgaccgtaaaagctacagagagcgatggaaatgtaccgaaagcaatgactggttctatagacctggataaagagggaatctttgatagtgttggcataacgacaatagatcctgaagtattaaaggagaaaccctggaggcaaccgggggccaacttaagtgattatttcaattacggttttaacgaatttacctggatggagtatttacatagacaggaaaaactacaacaagattataatcctaggaggatcctaatgggcctattatccctccaacagcaagggaagttgaattccgcgaatgatacagactcaaacctcggtaatataattgataacaacaacaacgtaaacaatgcaaatatgtctaatctgaacagtaatatgggtaatagtatgtctggaacaccaaaccctcccgctccaccaatgcatccaagcttcccacccttacctatgtttggtagctttccaccattccccatgccaggtatgatgccacccatgaaccaacagcctaatcaaaatcaaaatcaaaattcgaaatga

SEQ ID NO: 2186 - DNA, 984 bp, Saccharomyces cerevisiae
atgagtgagaccaatggtggcaatgcagccagggaaaattctgaggtgaaacaaactgcagttgaaaatcctatcgataaactagatggaactcctaagagaccgagggaaaaagatcaggatgaacaagcggaagaaacgagtgacaaatcagaagcacccaataaaaatgatgaggagaaaaaggaggaaggtaaaaaagaccaagaaccatcgcataagaagatcaaggttgacgacggaaagaccgtagaatctggtattgtggaagatgacaaaaaggaggataaattcgtgtttggtgccgcatctaaatttggaactgggtttggtgttgccaaaaaggacacgaaagatggagatgcaactaccagtactgaaagtttaccagcctctgacagcaaaacaaagaagccatttgcatttggttcaggtttatcatttggcagcggcttcaacatactgaaaaacaaaacagaaaataactctgaaagtgaaaagaaagctactgatgttgacaaagataaagtccatagtggatctgaacaactagcgaatgcctcagaagatacaaaagacaaaccaaaacccctcaaattgcagaaacaggaagtcaagtctggtgaagagtctgaggagtgcatatatcaagtcaatgcgaagctgtaccaactttccaacataaaagaaggctggaaggaaagaggtgttggtatcatcaaaatcaataaaagtaaggacgacgtcgagaagacgcgtattgttatgaggtctcgtggtatcttaaaagtcattttaaacatccaactggtcaaggggttcactgtgcaaaaaggatttacaggttctttgcaaagcgaaaaattcataagattactagcagtagatgataacggtgatcctgcacagtacgccataaagactggtaagaaggaaaccacggatgaattgtataacattatagttaaatccgttcctaaataa

SEQ ID NO: 2187 - DNA, 984 bp, Saccharomyces cerevisiae
atgcatagaacggcaatatttctaacttaccgatcatgtatgagaaatttcagtacactgagtaaaacattaacggtttcttctggtaaagtaatcagaaacggtccatttaggagagtaattcgtgaaaagaaccaaataacgaaggcgccatcagtaaaagcatttaaagaaaatagcaatagcgggataataaaagtacatgatcctatagctactacgatacttaatgaaccgacagttattatcgaaaggcaaatagaatttatgaacgtttttctaggtttcgagcaggctaataggtatgccataatggatgtgaacggaaacaaaatagcatcaatgatggaaagagatttttctataacaaaggccataatgcggcagttttatcgtctacatcgtccttttttggtagatgtctttgataattggggaaatgtaataatgacgattaaaaggcccttttcgttcatcaattctcatataaagactatcatacctccttccgcgtatgttgataatggcagtgactccactcactatcacgacggtaaagaaggaacgacagtaggagagaccattcagaactggcatctctggaggcgtcgttacgaattattccagaaagatggagtagaaggatccacttttgaccaatttggtaagatagatgcacctttcttatcatttgattttcctgtaacagatgctgatggtaagataatggcgagtgtagacagaaattgggttggtttaggaagagaaatgtttaccgatactggtgtttatgttgttagatttgattcgcagagatgctttgataatatttatcctactgagatgctaagttctcaagtactaactttggatcaaagggccgtgttattagcaaacgctgtgtccatcgatttcgattatttttcgagacattccagacaaactggaggtttcctttcttttggcggtggctatgatgagtag

SEQ ID NO: 2188 - DNA, 984 bp, Saccharomyces cerevisiae
atggcatcatcagtcccagggcccatcgatttgcccgaatcccgctatgacttatccacgtattggggtagaatccgccattgcgcagagatttccgaccccactatgttgttaactactgagaaggacctggcgcatgctagagaaatcatcagtgcgtatcgtcacggtgaactaaaagagactactccggagttctggcgagccaagaaacaactggactccaccgtgcatccggacacagggaagacagttcttttgcccttccgtatgtcttccaacgtgctatcaaacctagtcgttactgtaggtatgctgacgcctggtttgggtacggcagggactgtattttggcaatgggcaaatcaatcgctaaacgtcgccgttaattccgctaacgcaaacaaatctcatcctatgtccacgtcccaattgctcaccaattacgctgccgctgtaactgcgtcgtgtggtgttgcgttaggtctaaataacctagttcccaggttgaaaaacatttctccacattcaaagttgatcttgggccgtttggtgccatttgccgccgtggtcagtgccggtattgtcaacgtcttcctaatgagaggcaacgaaattagaaagggtatttctgtgtttgactctaacggtgacgaagtcggaaagtccaagaaggctgccttcatggcagttggtgaaactgcattaagtagagtgattaacgccactccaactatggtcatcccacctttgattttggttagactacaacgcggtgtcctcaaaggtaagtctctcggtgtgcaaactttggccaatttggggttgatctcagtcacaatgttctcagctttgccatttgcactcggtatcttccctcaaagacaagcaatccatttaaataaactagaacctgaactacatggcaagaaggataaggatgggaagccaattgaaaaggtctattttaacagaggtatttag

SEQ ID NO: 2189 - DNA, 984 bp, Saccharomyces cerevisiae
atggctattcaaaaggttagtaacaaggacttgtcccgcaaggacaaaagaagatttaatatcgaatctaaagttaataagatttatcaaaatttttactcagaaagagataatcaatataaagatagactgacagcattgcaaacggatttaacttctctgcatcaaggtgataatggccaatatgcccgccaagtacgagatttggaggaagaaagagatctagagttagtcaggttgcgcctgtttgaagagtaccgtgtttctcgttccggtatcgaatttcaagaagatattgaaaaggctaaggctgaacacgagaaactcattaaattatgcaaagaaagactgtattcgtctatagagcaaaaaataaagaaattacaggaggagaggttactaatggatgtggccaatgtgcactcctatgccatgaattatagcagaccgcaataccagaagaacacgagaagtcacacagtaagtggttgggattcttcgtccaacgaatatggaagagatacagcaaacgaaagtgctactgacacgggagctggaaacgatagaagaacgctaaggagaaggaatgcttctaaagacacgagaggtaacaacaacaatcaagatgaatctgattttcaaactggtaatggttctggaagtaatggccatggttctagacaagggtcgcaattcccccatttcaacaacctaacctacaagtcaggcatgaactctgactcagattttctacaaggtataaatgaaggtactgatctatatgcatttttgtttggcgaaaagaaccccaaagacaatgctaatgggaatgaaaagaaaaaaaaccgtggtgctcaacgatattccaccaaaacagctccacctttacagtctttgaaaccagatgaggtcacagaggatatttccttgatcagagaattaacaggtcagcctccggctcctttcagactaaggtctgactaa

SEQ ID NO: 2190 - DNA, 984 bp, Saccharomyces cerevisiae
atgggccctgaaactctacatattggtgggagaaaatcgaaattggcggtaatacaatccaaccatgttttaaaactgatcgaagaaaagtatccggactacgactgcaaggttttcactttgcaaactcttggtgaccagattcaattcaaacctttgtactcatttggcggtaaagctttatggacaaaggagttggaagaccatctttaccatgacgatccctcaaagaagcttgacttgatcgttcattctctgaaggacatgcccactttactaccagagggtttcgagctggggggtatcactaagcgggtcgatccaacagattgtcttgtcatgcccttttactctgcttataagtctctggatgaccttccagacggggggattgtgggaacctcatccgtgagaagatctgctcagctaaaaagaaaatacccacatttgaaatttgaaagtgtcagaggaaatatacaaactagattacaaaaactagacgacccaaaatctccgtaccaatgcatcatcttggcgtctgctgggttgatgcgtatggggttggaaaacagaattacgcagcgattccattcggatacaatgtaccatgcagttggacaaggcgccctgggtatagaaattagaaagggtgacaccaagatgatgaagattcttgacgaaatttgcgatctaaatgcaactatatgttgcctttcggagcgtgctttgatgagaactttagaggggggttgttccgttcctattggtgtggaatctaaatacaatgaagagactaaaaaattactattaaaggccattgtagttgacgttgaaggcacagaagcagtagaagacgaaattgaaatgctaatagaaaatgttaaagaagattccatggcgtgtggtaagatactagctgaaagaatgattgccgatggcgcaaagaaaattctggatgaaattaatttagacagaatcaaatga

SEQ ID NO: 2191 - DNA, 984 bp, Saccharomyces cerevisiae
atggttaaaggtagtgtgcatttatggggaaaggatggcaaagcatcgttgatttcagtggacagcattgcgcttgtatggtttatcaagttatgtacttcagaagaggcaaagagtatggttgcgggattgcagatcgtattctcaaacaatacagacctatcatcagatggaaaactaccagtgttaattttagataatggaacgaaagtatctggttacgtgaacatcgtacaattcttacataaaaatatatgtactagcaaatatgagaaaggtacggattatgaagaagatttagcaattgttagaaaaaaggatcgccttttagagtattccctattgaattatgttgacgttgaaatttccagactaacggactaccagctctttttgaacaccaaaaattacaatgaatataccaagaagttgttttcaaaattgctatattttcctatgtggtataatacgccattgcaactaagatcgcaagcacgtgaaaattgtgaggagattataggctcactgacccttgaggatgatgaagaatttgtagaaagtaaagcaatggagtcagcctcgcaactagcacaatcaaagaccttcaaaattgcgcataagaacaaaattaagggtaagcaagagctacaacaggtgaaatataatcttcaatttgataatagactacagagttgcgtcagcaattggttggctgcccgtaaaaaactggatgattctgtaatactttcctccgaccttcttttccttgcaaatctttacgttcagttaggcctacctgatggtaaccgcatccgttcaaaactggaacaaacctttggaagtgaattattgaatagtatgtcgaacaaaattgatgacttcgtccatagaccaagtaataacttggagcaaagagatcctcaatttagagagcaaggaaacgttgtgatgtcattatataatttagcctgtaaatacatataa

SEQ ID NO: 2192 - DNA, 984 bp, Saccharomyces cerevisiae
atgtcaattgcacaagataggggtatcgttttcaagcttctatcaatttatcgagcagcggctggtatcttcatggcgttggcacaattaattgtcatattttttggatattgcgattttaaaattaaagggtatcgcattgcctcttacaatgcaccgacatttgcctccagtttcataattcttgcagtatgccttttattagttgtcgttctggaaaatcctgaggttaaagttacaaattcggaaaatagccttttcagtgctctgaaacaattttttagagtcgaaagaaaaaaactcatctcctgcttgattttactatggagcatgttcctatcgtcatttattatgagcgaagtagtttattttatgccactattcctgacgctccacgttaactgggacaccaagtttcaaggcatagcgtttatggtcgcatctatacttggtgtgactggaagctatttcgctccaaagttaataaacgtcgggtgctcctgcggcagagccaaagatggcggattagaagagtcagatacaactggaagtgagaccgttgaggtaaagaaaaaagattcgctgtacagcggtcaagtttttctgtccatctttgcattgtttgtttcattgctgggacaagcttttatgattggagcatccgaagccttgaagcataaatcaatgccacccacaaattctggtatatttttttcagctgggatgtcgattacattgttagggtacaactttttggcttcgagcattccagcccttttttccatgtacatcgaccccaaactcaaggtccagttgatgccttcaattggagcaatctctgggattggtaaactggtggcaccgattgtattagcagctctttatggcacaagattggggctttcaattgcggttggatttggtatgattttggtagctgtttcaattccaccgcttatttggctcaggaaaaaaaggtgttag

SEQ ID NO: 2193 - DNA, 984 bp, Saccharomyces cerevisiae
atgtcattcagaccaggtagcagaggtggttcccgtggaggttccagaggtggcttcggtggtagaggcggttcccgtggtggtgctcgcggtggttccagaggtggcttcggtggtagaggcggttctcgtggtggtgcccgtggtggttccagaggcggcttcggtggtagaggcggttctcgtggtggtgcccgtggtggctccagaggtggtagaggtggcgctgctggtggtgcccgtggtggtgccaaggtcgttattgaaccacatagacatgccggtgtttacattgctagaggtaaagaagatttgctagttaccaagaacatggccccaggtgaatcagtttatggtgaaaagagaatctccgttgaagaaccatctaaggaagatggtgtcccaccaaccaaggtcgaataccgtgtatggaacccattcagatctaagttggctgccggtattatgggtggtctagatgaattatttattgccccaggcaagaaagttttatatttaggtgctgcttccggtacttctgtttctcacgtttcagatgttgttggtccagaaggtgttgtctacgccgtagaattttctcacagaccaggcagagaattgatttctatggcaaagaagagacctaatatcatcccaatcattgaagatgctagacacccacaaaaatacagaatgttgattggtatggttgactgtgtcttcgcagatgttgcccagcctgatcaagctcgtattattgcattgaactctcatatgttcttgaaggaccaaggtggtgttgttatctccattaaggctaactgtattgattctactgtagacgcggaaaccgtttttgctagagaagttcaaaagttacgtgaggaacgtattaagccattagaacaattgactttagagccatatgaaagagaccattgtatcgtcgttggtagatacatgagaagcggtttgaagaaataa

SEQ ID NO: 2194 - DNA, 984 bp, Saccharomyces cerevisiae
atgtcttcactggttactcttaataacggtctgaaaatgcccctagtcggcttagggtgctggaaaattgacaaaaaagtctgtgcgaatcaaatttatgaagctatcaaattaggctaccgtttattcgatggtgcttgcgactacggcaacgaaaaggaagttggtgaaggtatcaggaaagccatctccgaaggtcttgtttctagaaaggatatatttgttgtttcaaagttatggaacaattttcaccatcctgatcatgtaaaattagctttaaagaagaccttaagcgatatgggacttgattatttagacctgtattatattcacttcccaatcgccttcaaatatgttccatttgaagagaaataccctccaggattctatacgggcgcagatgacgagaagaaaggtcacatcaccgaagcacatgtaccaatcatagatacgtaccgggctctggaagaatgtgttgatgaaggcttgattaagtctattggtgtttccaactttcagggaagcttgattcaagatttattacgtggttgtagaatcaagcccgtggctttgcaaattgaacaccatccttatttgactcaagaacacctagttgagttttgtaaattacacgatatccaagtagttgcttactcctccttcggtcctcaatcattcattgagatggacttacagttggcaaaaaccacgccaactctgttcgagaatgatgtaatcaagaaggtctcacaaaaccatccaggcagtaccacttcccaagtattgcttagatgggcaactcagagaggcattgccgtcattccaaaatcttccaagaaggaaaggttacttggcaacctagaaatcgaaaaaaagttcactttaacggagcaagaattgaaggatatttctgcactaaatgccaacatcagatttaatgatccatggacctggttggatggtaaattccccacttttgcctga

SEQ ID NO: 2195 - DNA, 984 bp, Saccharomyces cerevisiae
atgtcttcagacacttcattatcagaatcttcattattgaaagaagagagtgggagcttgaccaagtctcgtccacctataaaatcaaaccctgtacgcgaaaatatcaaatcatttgtggccggtggagttggcggggtatgtgcggtgtttacgggtcatcccttcgatttgattaaagtgagatgtcaaaatggacaagcgaattccacggtacatgccattacaaatattataaaagaagcaaaaactcaagtaaagggcacattatttaccaattccgtaaaggggttctataaaggtgttatcccgcccttattaggtgttactcccatattcgctgtttctttctggggttacgatgtgggtaagaaactggttacttttaataacaagcaaggaggcagtaacgagttaactatgggacaaatggctgcagcaggatttatcagcgctattcctaccactttagtgactgcgccaacggaaagagtaaaggttgtcctgcaaacatcttctaagggctctttcattcaggcggctaaaaccattgttaaagaaggtggcatagcttctttatttaaaggttcattagccactttagcaagagatgggcctggctcagctctatattttgcatcttatgaaatttcaaaaaattacttgaatagtaggcaacctcgtcaagatgcgggcaaagatgaaccggtcaatatcttgaacgtgtgtcttgctggtggtattgctggtatgtcgatgtggctagctgttttccccatagacactataaagacaaaattgcaggcttcctccacgaggcagaatatgctttccgccacaaaggaaatttatctacaaagaggtggtatcaagggatttttccctggtttaggtcctgctttactaagatctttcccagccaatgcggccacatttttaggtgtggagatgactcattcactgttcaagaagtatggcatatga

SEQ ID NO: 2196 - DNA, 986 bp, Saccharomyces cerevisiae
atggcaggtgtttccgttaggtacgtataactttcactcattgaatgagtatttagagaatgaatggatattaggtggaaaacaacgagatgaaaacatatgggattgagaaaaaggatttagtgcagaatttcccattacctgataaattgaagttcatctttactgtgcatttaccgaacgaatgagttaaactattatgatataattgctgtaattgtggagagaatattttgagccaactatacaaaatgaagttctcagacgaagaggtaatcatttatttattggaattgattgataggaggttttaactaggtgggatgttttctaatgaaataggagaacctgaaccaagacgtttaagttggaaggaaatctgtaaccgtggtaatgcaaaagcaatgaaaagcgatttttatgccgttaatttaagcaacaacccgagaccacgatactgccgcaccaagaagttgtctcaataaacatttcactgagcattccatattctatttttacgagaaaactttttactaacaaaagcatttcaattgtgcattttttcaattagagacgttgcagctcaagatttcatcaatgcttacgcttctttcttgcaaagacaaggtaaattagaagtcccaggttacgttgacattgtcaagacctcttctggtaatgaaatgccaccacaagacgctgaaggttggttctacaagcgtgctgcctccgttgctagacacatttacatgagaaagcaagtcggtgttggtaagttgaacaaattgtacggtggtgccaagagcagaggtgtcagaccatacaagcacattgatgcttccggttctatcaacagaaaggtcttgcaagctttggaaaaaatcggtattgtcgaaatctctccaaagggtggtagaagaatctctgaaaacggtcaaagagatttggatcgtattgccgctcaaactttggaagaagacgaataa

SEQ ID NO: 2197 - DNA, 986 bp, Saccharomyces cerevisiae
atgtcagcgtatgtatataccttgtaatttacgtttccttaaatcttctttctactaacgttttcattattctatactctatgaccaataaaaacagactgtactttcaaaatttacccagtaggccagcaaataaagaaaattataccagattacttctgaaacacattaatcccaacaacaagtatgccattaatccgtcgctaccccttccccacaataaattacaaatatcatcacaaccgctgatgttactagatgatcaaatgggccttcttgaagtttctatttcaagatcatcaaagatgactaaccaagcatttttaacgtttgtcactcaagaagaagcagaccggtttctagaaaaatacacgacaacagcattaaaagttcaaggtcgtaaagtgagaatgggaaaggctcgaacaaattcgttattgggtctttcaatagaaatgcaaaaaaaaaaaggtaatgacgaaacgtacaaccttgatataaagaaggtgcttaaagcaaggaaacttaaacgcaagttacgtagtgatgatatatgcgccaaaaagttcaggcttaaaaggcaaataagacgcctgaagcataagctgagatcaagaaaggtagaggaggctgagattgataggattgtaaaagaatttgaaacccgtagattggaaaacatgaagtctcagcaagaaaatctaaaacaatcgcagaaacctcttaagcgggctaaagtgtccaatacaatggaaaatccaccgaacaaagtccttcttatacaaaatttgccaagcggcactaccgagcaattattgtcgcaaatacttggcaatgaggctttagttgaaatcagattagttagcgttcgtaacctagctttcgtggaatacgagaccgttgctgatgctacgaaaatcaagaatcagttaggctccacttacaagctacaaaacaatgacgttaccataggatttgctaagtag

SEQ ID NO: 2198 - DNA, 987 bp, Saccharomyces cerevisiae
atgactgagatactaccacatgtaaacgacgaagtgctaccagcagagtatgaacttaatcagccggaaccagaacactgtcctggtccagaatcagacatggcaggtaagtccgatgcttgtggtggctgcgccaataaagaaatatgtgaaagtcttccgaaaggccctgatccagatattccattgatcacagataacttgtcaggaatagaacataaaatattggttttatcaggcaaaggtggcgtaggcaagtcgacatttgccgcaatgctaagttgggcactttcagctgacgaagatttacaagtaggtgccatggatttagatatatgtggaccttctttgccacatatgttaggctgcattaaagaaaccgtccatgaatcgaactccggttggacacctgtctatgtgactgataatttagccaccatgtctattcaatatatgcttccagaagacgattccgccattatatggaggggttcaaaaaagaatttattgataaaaaaatttttaaaggatgttgattgggataaactcgattacttggtaatcgacacaccgcccggaacatctgatgagcacatttcaataaacaagtatatgagagaatctggcatagatggtgcccttgtggtcaccacacctcaggaagtagctttattagatgtacggaaagagatagatttctgtaagaaggctggtatcaatattcttggactagtggaaaatatgagcggatttgtatgtccaaattgcaaaggagagtcccaaatattcaaggctaccacaggtggaggtgaagcactttgtaaggaattgggcatcaaatttttggggtctgttccgttagatccgaggattggcaagagttgtgacatgggtgaaagtttcctggataactatcctgacagcccagcttcgagtgctgtacttaacgttgtggaggctctgcgagatgctgtgggggatgtatag

SEQ ID NO: 2199 - DNA, 987 bp, Saccharomyces cerevisiae
atgagccaacagaatatactacattatgatatggatgttacttccgtatcatgggtcaaggataacacataccagattactattcatgtcaaagccgtaaaagatatccctttgaaatatttatggtctttaaagattattggtgtcaacggtccctcaagcaccgtacaactttacggcaaaaatgagaagacatacctaatcagtgatccaacagattttacatccacttttcaggtttatgcttacccttcttctgacggttgcacagtttggatgccaaatttccaaatccagttcgaatatctacaaggtgatgctgctcagtactggcaaacttggcaatgggggacaaccaccttcgatttatcgacaggttgtaacaattatgacaatcaaggccactcacaaacggatttccctggattttattggacctaccagtgcaagggaaacaatgatggcacttgtacaaaagcctcgtcttcatccattactacttcatccattactacttcatccactactacttcatccactactacttcatccactactacttcatcctctactacttcatcctctactacttcatcctctactacttcatcctctactacttcatcctctactacttcatcctctactacttcatcctctactacttcatcctctactacttcatcctctactacttcatcctctactacttcatcctctactacttcatcctctacgaaaacttccactactacgtcatctactgtgaaaagctcttccactacatccattgattttactacttccgttgactcacatacttcatcaagcgtagccgatatttatcgttcaagaacatctactgatgtcaccacattagcagcttcaactagtcctttcagcagtttcacttcaagtgactctagtagttcaagcgatgtaaccagttcaaccattcaaactacttctgttgatccaaccacttaa

SEQ ID NO: 2200 - DNA, 987 bp, Saccharomyces cerevisiae
atgagtaaaaacagggaccctctactggctaatttgaacgctttcaaaagcaaagtgaagtctgccccggtgatcgcacccgctaaagttggacagaagaagaccaatgacacagtgattactatagatggaaacactaggaagaggacggcctccgaacgtgcgcaagaaaacactttgaactctgcgaaaaatcctgtgttagtggatatcaagaaagaagctgggagcaatagctctaatgctatttcattagatgacgacgatgacgacgaagattttggtagctctccttcaaaaaaagtaaggcctggctctattgctgcagccgctttacaagcaaatcaaacagatatttccaagagtcacgattcttcaaagttgctttgggcgactgaatacattcaaaagaaaggtaagcccgttttggtgaatgagttattggactacttgtcaatgaaaaaagatgacaaggttattgagcttttaaaaaaattagatagaatagagtttgaccccaagaaggggactttcaaatacctttccacctacgatgtccattccccttcggaactgctgaagttgttacgttcacaagtaacattcaaaggtatttcctgcaaagacttgaaagacggttggccacaatgcgatgaaacgattaaccaactggaggaagacagcaaaattttggtgttaagaactaaaaaggataaaactccaagatacgtttggtataacagcggtggtaacttgaaatgtattgacgaggagtttgttaaaatgtgggaaaatgtgcaattaccgcaatttgcagaattgccaagaaagctgcaagatttaggtctaaagcctgctagtgtcgatcctgctactatcaaaagacaaacaaagagagttgaagttaaaaagaagagacaaagaaagggtaagattactaacactcatatgaccggtatcttgaaagattattcccatagagtatga

SEQ ID NO: 2201 - DNA, 987 bp, Saccharomyces cerevisiae
atgatagcaggtgcgactgctccgtcaagtcagcatgaaattttgatcgcatcgaatctcatcaagaagccatcaacgtctcaaaataaaacgccgacagctcaatccagttcaggtaacaatggagctgctgatggtgcaccgcagggttaccatcatcaccatcatcaccatcgtcatttatggtggcctcggacaacagaccatcaatattggtgtgtcttgaggaaaaaccaatttgcctattacaaaactcgggatgaaagagaggctataagtgtcataccgagatttgacatacttaattttaagataagcgagctcgatggtatattaactgtttatactccatccaaggatttaatattcaaatttccacgagggcaaaatgagaaggttggtatggaactgatgcataattggaaaattgcccttgaaaaattcctctctagtcctagtggcaacgaaagtgtcactacaggtagtgattatgatgaagaagaggatgatgatgatttaattgtagttgacgaaaaggcgggtccttctagcagcaagcattcttgcagtttgacgatggatgagcaactgtctcgtgaagataaagaattttataggatgttcgatccaagaaatgcagagcaccaggtttgttctgggattctttacacaaaagtgaaaaagaagaaactgttcaatagggctaaatggcaaaagttcaatgtggaattgactaatacttcgttcaatttatactctttcaagactgggaagttaaagaaaagcattaaattggataaaattatcgattgtattgaacttgataataattcgaagatgaaaaatgacgacactaattttgcgctaattacatttgatgaaaggttatcttttaaagccgctaacgatcaagatatggtggattggataataaatttcaagagtggaattttgataagaaaaaaattaaaggccgaaaatatataa

SEQ ID NO: 2202 - DNA, 987 bp, Saccharomyces cerevisiae
atgcctgcccctcaagatccaaggaatcttccaattagacaacaaatggaagctcttatccgtcgcaaacaagctgaaatcacgcaaggtttggaatccatcgatactgttaagttccacgctgatacttggacccgtggtaacgatggtggtggtggtacctctatggttatccaagacggtacaactttcgaaaaaggtggtgttaatgtctccgttgtttatggtcaattgagcccagcggccgtttcagccatgaaagctgatcataagaatctgcgtctaccagaagatccaaagactggtttgccagttaccgacggtgtcaagttcttcgcttgtggtttaagtatggtcattcatcccgttaacccacacgctccaaccacgcacttaaactaccgttacttcgaaacttggaaccaagatgggaccccacaaacttggtggtttggtggtggtgctgatttgacaccttcttacttatacgaagaagacggtcaattattccaccaactgcacaaggatgccttggacaagcacgacactgctttgtacccacgtttcaagaaatggtgtgatgagtacttctacattacccaccgtaaggaaacacgtggtattggtggtatattctttgacgattatgatgaacgtgacccacaagaaatattgaagatggttgaagactgtttcgatgctttcttgccatcctacttgactatcgtcaagagaagaaaagatatgccatatacaaaggaagaacaacaatggcaggccattagacgtggtagatacgttgaattcaacttaatctacgatagaggtacccaattcggtttgagaaccccaggctctagagttgagtcaattttgatgagtttgcctgaacatgcttcatggttatacaaccaccaccctgctcctggttccagagaagctaaattactagaagttaccaccaaaccaagagagtgggttaaataa

SEQ ID NO: 2203 - DNA, 987 bp, Saccharomyces cerevisiae
atgcctgttgttcattgttcgtccaacctgcccatcactccatatatctatgagcgtctagtatattttattaaggcaagctctatatcaagctgcatatctgacaacttacttcttgttaataaaaccttcaacgacggaggttgtccaccacatattaacttctgcaatgatgagataattaacccaacagcgggtcaaacagtggttgaattagttcttaatgcaaaaaaaggtgaattaggctcgggttatctggctgttgaccacggaaaaaaggttgttattttagcatttagaggatccacaacaagacaagattggtttagtgattttgaaatatatcctgttaactattctcccctttgcgttaaggaatatcgtaagcttatagaggaaggaaaaatcagagaatgtgaaggttgtaaaatgcatagaggatttctaaggttcacagaaactctcgggatggacgtctttaaaaaaatggagtcgattctggaaagctttccggaatataggatcgttgtcactgggcactccttgggggcagcattagcaagtttggctgggattgaattaaagataagaggctttgatccgttagtgctgacattcgcaacaccaaagatatttaacagtgaaatgaaacaatgggtagacgagttatttgaaacagatgctatagaaaaggagtcaattcttaaagatgaaattcaatttcgtaagggctattttagggttgtgcatacaggtgattatattcctatggttccaccattctatcatccggctggtttagagatgtttattaacaaagttggtctacctcagaatgcggaagatattgaataccgtggtaaaaataacaggttaactttaaaggatggatttcgagagggtatgagcggtttggttgaagactggttacatgtctatgaacatcgagcctacttcattgacgtagtgggatgttctggactttaa

SEQ ID NO: 2204 - DNA, 987 bp, Saccharomyces cerevisiae
atggaaaaaaaacatgtcactgtgcaaatacaaagtgctcccccctcctatatcaaattggaagcaaatgaaaaattcgtatatattacaagtacaatgaacggcttatcttatcaaattgcggctatagtttcatacccagaaaagagaaattcatcaactgcaaataaagaagatggtaaattactgtgcaaggaaaataaactagcattgttactacacggaagtcaatctcacaagaacgctatttatcaaactttactagcaaaaaggctggccgaattcggatattgggtactaagaatagattttaggggccaaggtgattcctcagataactgcgaccctggccttggtaggacgctcgctcaggatcttgaagatttgagtacagtataccaaacagtatctgacaggtctcttagggtgcaattgtacaaaactagtacaatatcactggacgtggttgtggcacattctagaggatctcttgccatgttcaaattctgtctaaaattacatgcagctgaatctccattaccgtctcacctgatcaattgcgctggaagatatgatgggagaggacttattgaacgctgcacacgactgcacccgcattggcaagcagaaggtgggttttgggcgaatggtccacgaaatggcgaatacaaagacttttggataccattaagtgagacttatagtatcgctggcgtttgcgttccggaatttgccacgataccacaaacttgttcagtaatgtcctgctatggcatgtgtgatcacatagtgccaattagcgcagcctcaaattatgcaaggcttttcgagggcagacattcattgaaacttattgaaaatgcggaccacaattattatggcattgaaggtgatcccaacgcgctaggcttaccgataaggaggggtagagtcaactactcaccactagtagttgatctaattatggaatacctgcaagatacatag

SEQ ID NO: 2205 - DNA, 987 bp, Saccharomyces cerevisiae
atggagagaatcatacagcagactgactatgatgcgttgtcgtgcaaattagctgctatatcagtcggatatcttccttcaagcggcctgcaaagattgtcggtggacctatccaaaaagtatacagaatggcatcgcagctacttgattactctcaagaaatttagtaggcgagcttttggaaaagtagacaaagcaatgcggtcttccttcccggtaatgaactatgggacatacttgcgtactgtggggatagacgcggccatattggaatttttggttgcaaatgagaaggttcaagtggtaaatttaggttgcggttccgatttacgaatgctgcccctgttacaaatgttccctcatttagcttatgtggacattgactacaacgaatcagtagaattgaagaatagtattttgcgtgaaagtgagattttgcgtatctccctcggtttgtcaaaggaagatacagcaaaatcaccctttttgattgatcaaggaagatataaacttgctgcttgtgatttgaacgatatcactgaaacaacccgtttgttagacgtatgcactaagcgcgaaatacccactatcgtaatatctgagtgtcttttgtgctacatgcataataatgagtctcaattactaataaatacaatcatgtcgaagttttcacatggactatggatatcctacgatccaattggtggttctcaaccgaatgaccgatttggcgccattatgcagtccaacttgaaagaatcaaggaatttggaaatgcccacgttgatgacgtataattctaaagagaaatacgcttcgagatggtctgcggctcccaacgttattgtcaatgacatgtgggaaattttcaatgcacagattcccgaatctgaaagaaaaaggctcagatcattacagttcttggacgaattagaggaattaaaggttatgcaaactcattatatccttatgaaggctcagtggtga

SEQ ID NO: 2206 - DNA, 987 bp, Saccharomyces cerevisiae
atggcatccaccgatttctccaagattgaaactttgaaacaattaaacgcttctttggctgacaagtcatacattgaagggtatgttccgatttagtttactttatagatcgttgtttttctttcttttttttttttcctatggttacatgtaaagggaagttaactaataatgattactttttttcgcttatgtgaatgatgaatttaattctttggtccgtgtttatgatgggaagtaagacccccgatatgagtgacaaaagagatgtggttgactatcacagtatctgacgatagcacagagcagagtatcattattagttatctgttatttttttttccttttttgttcaaaaaaagaaagacagagtctaaagattgcattacaagaaaaaagttctcattactaacaagcaaaatgttttgtttctccttttaaaatagtactgctgtttctcaagctgacgtcactgtcttcaaggctttccaatctgcttacccagaattctccagatggttcaaccacatcgcttccaaggccgatgaattcgactctttcccagctgcctctgctgccgctgccgaagaagaagaagatgacgatgtcgatttattcggttccgacgatgaagaagctgacgctgaagctgaaaagttgaaggctgaaagaattgccgcatacaacgctaagaaggctgctaagccagctaagccagctgctaagtccattgtcactctagatgtcaagccatgggatgatgaaaccaatttggaagaaatggttgctaacgtcaaggccatcgaaatggaaggtttgacctggggtgctcaccaatttatcccaattggtttcggtatcaagaagttgcaaattaactgtgttgtcgaagatgacaaggtttccttggatgacttgcaacaaagcattgaagaagacgaagaccacgtccaatctaccgatattgctgctatgcaaaaattataa

SEQ ID NO: 2207 - DNA, 987 bp, Saccharomyces cerevisiae
atgtcgagactagcgcataataaagcgctaccttataaaataattgtcgatttatcattccatagaacgcgtttaccctcagatgtttcatcgctaataaaattcgagcaaagacctgcaattattaacatccatggccttttgggctcacacgtgatgtttcattctctcaataagcttctttcaaggaagcttgacgcggatattttttctgttgatgtaagaaatcatggcatttcaccaaaagcaataccttatgactacactacactgaccaatgatttgatttattttattgaaactcatattggcttggagagacctatttatttactgggattctctatgggtggtaaaattgcattattaaccacattgtacaagaatattaatatacgaaagtgtatatcaattgatttaccgccttatgaaaccccagaattagatcccatgatattacaaaactatgacttaataatgcggattatccgcagagatgtcaagattttaagaggttcccccagctggcagaaaaaagttcttgagcttttcaaaagtttggaatgtaataagaggaaatgtggtggagctgtggcactctactttgccaacggttttctttctgtaaaatccaataatgtacaccaagcacagttacactatgaacaacaacagcatgatccttatataaattactcaatgcctctctccagcatgccgaacctgttggatgaagtgaaaaaatggccggatctatcgaaccaaagggacttcttccaaaaaggcacagccagtcgtaaagttttattcatgaaaggcctgcagtctaactttattaacaatgattattccctcctgaggtataactttccctgtgctgatgtccgagaatttaatactgggcataatttactgttggagaatccagaggactcattcaaatgtattctgaacttttttgcggaggagacgctggattttgaataa

SEQ ID NO: 2208 - DNA, 987 bp, Saccharomyces cerevisiae
atgtcgaggtgtattcgccagtccgtatgcacaaacttcaatgtctgtaggcgacaatgctttagcacttatgcctctgctctcaaggaaatgacacatcctataaaaccctcagcgcaaacgctcagacatctacaattcactcaaagaataccttttcaaaaaggattggaaatacaggagacattagttagggcaaatttggacatcaaagacattcaatcgaagattgagagaaaattaatacaattggatgaagaatataagggcactgcaacaataaatgataacgaaaaaagaatattagacaaggttatggcaatgaaacctaatccgataatattaacgtttgagtttgagccaacttatacaggtgggaagaggattaagaaaactatgacgccagatcagatagcggcttatgaaagtttcattccagaaacgcaaaaggacaacccacgaccaaagtttgttcaagtggaaaggggtggacaagtaacatttcatggtccaggccaaattgttatttacattattttagatttgaaaacatttcaaagtttccctgctaaatgcttggtttcatgcattgagcaggccactatcagaacgttgaagaataccaagatgtgcgacgacactgacaagcctttgaacttagatgctatgactacaaaggacactggagtttgggttgaaaatggcaagaagaaagttgctagtgttggaatacacgtcagacgttccataacatcgcacggggtagcaattaatgttaatacagatctatcgtatatgaatagttttgaaatgtgcggtttgaaaaatacactgactacttcaattatggaacaacgacccgatgctgttgtaaatgtgcaaagtgtagcaattagttttgtcaaagaaatgacaaagctgctaggaataaaaactttggaaagaatgcaaattgacgacgtcaatattttgaaaaagaatccgtga

SEQ ID NO: 2209 - DNA, 987 bp, Saccharomyces cerevisiae
atgttaactctagagtctgcattaactggcgctgtggcttcggcaatggccaatattgcagtttatccgctggatttatcgaagacgatcattcagtcacaagtatctccttcttcaagtgaggatagtaacgaaggtaaagttttgcccaataggagatataagaatgttgtagattgcatgataaacatattcaaagaaaagggtattttgggtctgtatcaaggtatgacagtcactacggtggccacatttgtccagaattttgtttatttcttttggtacacatttatcagaaagtcctacatgaaacataagctgttaggactgcaatcactgaaaaaccgcgatggtcctatcacaccttctacgattgaagaattggtacttggggtagcagctgccagtatatcgcaactttttactagtcccatggctgtggtagctacaagacaacaaacagtccattctgcagagtctgccaaatttaccaacgttattaaggacatttaccgtgaaaataatggggacataactgctttttggaaaggtttaagaacaggtttagcattgacgataaatccttccatcacatatgcctcttttcaaagacttaaagaagtttttttccatgaccattccaacgatgctggcagtttgtcagcagtgcaaaatttcattttgggtgtcctttccaagatgatttcgactctagttacgcaacccttgattgtcgctaaagcaatgcttcaaagcgctggctctaaattcactactttccaagaagcgctactatacttgtacaaaaatgaagggttaaaatctctttggaagggagttcttcctcaattgacaaagggtgtcattgtgcaaggtctgttgtttgctttcagaggagaattgacaaaatctttaaagaggctaatattcttgtactcttcttttttcctaaagcacaacggacaacgcaagctggcttccacttga

SEQ ID NO: 2210 - DNA, 990 bp, Saccharomyces cerevisiae
atgaaattttctaaagtctcactactggccgcatctgcatctgtcgctttatctgccccagttgctgtgactgtcacgcaacatgtccaccaagctgccactgtagtggtacaaggtatagttcgtgtagaaaatggccagactctaacgacgttcattaccaagggcactcaaacggcttctgctagtcccgttgccacaacatcagctcctattgtggttgctaatgctcaagtggacagcatagctacttccgttatccaagaaagcgctgtcgtggctgaatctgcaacatttgaagaatcctctacagaaacatctgaagcattttctacagcaactgcaaccatacaagcggtgcaaacctccgcaagtgccacacaggatgatgtaaccacaactttaacatcttcaacacaacctaccagcacaactactccaacaaccactaccactagcccaaccactaccactagcccaactactaccgctagtccaactactactgctagcccaaccaccgctaccaccactcaatctaccgcctcaagcactcaatcctcaagctccgatttctcaacgtcaatggttaacgaacacaacactaaaagggcgttgcacaaggataccggttctttgacatggtctgacacactagcaacatatgcacaaaactacgctgactcctacgattgttcaggcaacctagtccactccggcggtccatacggtgaaaacttggcacttggttacggtacgaccggctctgttgatgcctggtataacgaaattaccagctacgactattccaaccctggttttagtgaaagcgcaggtcacttcacccaagtcgtatggaagggaacttctgaagttggttgcggtttgaaatcttgcggtggcgaatggggcgattacatcatttgttcctacaaagccgctggtaatgtcattggtgagtttgctgacaacgttatgccattagcttaa

SEQ ID NO: 2211 - DNA, 990 bp, Saccharomyces cerevisiae
atgaccaccgtgtccatcaataagcccaacctgctgaaattcaagcatgttaaaagctttcaacctcaagaaaaagactgcggacccgtaacctcattgaatttcgacgataatggccagtttctactgacctcttcttccaacgatacaatgcaattgtacagtgccacgaactgcaaattcttggacactatagcctctaagaaatatggctgtcactccgctatctttacgcacgcacaaaacgaatgtatctattcctctacaatgaaaaattttgacattaaataccttaatctggaaacaaaccaatatctaagatatttttccggtcatggcgccctagtgaatgatttgaagatgaaccccgtgaacgatacgtttctatcgtcgtcatacgatgaatccgttaggctttgggatttgaagatctctaaaccgcaagttattataccaagtctcgtaccaaattgtatcgcatatgatccaagtggccttgtattcgcattggggaacccagagaatttcgaaatagggctatataatctgaaaaaaattcaggagggtcctttcttgataattaaaattaatgatgcgactttcagtcaatggaataaattagaattttctaacaatggaaagtatttattagttggctcctcgataggaaagcatttaatttttgacgcattcacaggtcaacaattattcgaactaataggaacaagggccttcccgatgagagaatttctagattctggatctgcttgtttcacaccagatggtgaattcgtccttggaaccgattatgacggtaggattgccatttggaatcattctgattcaataagtaacaaagtattaaggccgcaagggttcattccctgtgtttctcatgagacctgccccaggtcaattgcattcaaccctaaatattcgatgtttgttaccgcagacgaaacagtagatttttacgtgtacgatgaatga

SEQ ID NO: 2212 - DNA, 990 bp, Saccharomyces cerevisiae
atgagtgaagaatttcctacgccgcagcttttggatgaattggaagatcaacagaaagttaccacgccgaatgagaagagagagttaagttctaatcgtgtgttgaaggatatttttgcgggtaccatcggtggtattgcacaagttcttgtagggcaaccgtttgatacaacaaaagttaggcttcaaacagccaccacaagaacaacaacgttggaggtattgcgtaacttggtaaagaatgagggtgtgtttgcattctacaaaggtgcgttaacaccgttattgggtgttggtatatgtgtctcagtacaatttggtgtgaatgaggcgatgaaaagatttttccaaaattacaacgcttctaagaacccgaatatgagctcacaggacgtagatctttcacgttcaaatactctgccactatcccagtactacgtttgtgggttgacaggtggtgtagtcaattcattcttggcatcgcccattgaacaaataagaattcgtttgcagacgcaaacatctaatggtggagacagagaattcaaaggtccttgggactgtattaaaaaattgaaagctcaaggtggattgatgaggggtttatttcccacaatgataagagccggacatgggcttggtacatattttcttgtctacgaagcattggttgccagagaaattggtacgggactaacaagaaacgaaattcctccttggaaattatgcttatttggtgcattttccgggacaatgttgtggttgacagtatacccattggacgttgtgaaatccattatacaaaacgatgatttacgaaaacctaaatacaagaattccatttcttacgtagcaaagaccatttatgcaaaagaaggtatcagagcctttttcaaagggtttgggccaacaatggttaggtccgcgcccgttaatggtgcgacattcctgacgtttgaattagtcatgagatttctgggggaagagtag

SEQ ID NO: 2213 - DNA, 990 bp, Saccharomyces cerevisiae
atgggctctatgaataaggaacaggcttttgaacttcttgatgctttttatgaagcaggaggtaattgcattgatactgcaaacagttaccaaaatgaagagtcagagatttggataggtgaatggatgaaatcaagaaagttgcgtgaccaaattgtaattgccaccaagtttaccggagattataagaagtatgaagtaggtggcggtaaaagtgccaactattgtggtaatcacaagcatagtttacatgtgagtgtgagggattctctccgcaaattgcaaactgattggattgatatactttacgttcactggtgggattatatgagttcaatcgaagaagttatggatagtttgcatattttagttcagcagggcaaagtcctctatttgggtgtgtctgatacacctgcttgggttgtttctgcggcaaactactacgccacatctcatgggaaaactccttttagtatctatcaaggtaaatggaatgtgttgaacagggactttgagcgcgatatcattccaatggccagacattttggtatggctctagccccatgggatgttatgggaggtggaagatttcagagtaaaaaagcaatggaggaacggaagaagaatggagagggtctgcgtactgtttcgggtacttctaaacagacggataaagaggttaagatcagtgaagcattggccaaggttgctgaggaacatggcactgagtctgttactgctattgctattgcctatgttcgctctaaggcgaaaaatgttttcccattggttggtggaaggaaaattgaacacctcaaacagaacattgaggctttaagtatcaaactgacaccagaacagatagaatacttagaaagtattattccttttgatgttggttttcctactaattttatcggtgatgatccggctgttaccaagaaggcttcacttctcacggcaatgtctgcgcagatttccttcgattaa

SEQ ID NO: 2214 - DNA, 990 bp, Saccharomyces cerevisiae
atggtaagttcattcagtgttcccatgccagtaaaacggatatttgacacatttccgttacaaacatatgctgcgcagactgacaaggacgaggccgttgcattagaaatacagcggaggtcctacacattcacagaacgcggtggtggaagctctgagttgactgtggaggggacgtacaagctaggtgtttacaacgtttttttggaggcaaatacaggggcggcattggccacagatccatggtgtctgtttgttcagcttgcgctgtgtcaaaagaatggtctagtcttacccacgcactcgcaggaacaaaccccatcgcatacctgtaaccatgaaatgctcgttctgtcccgtctttctaaccccgatgaggccctacctattctagttgagggttacaagaagagaattataagatccaccgtggcaatcagcgaaattatgaggtctcggatacttgatgatgctgagcagttgatgtactatacgttgctggataccgtgctgtacgattgttggatcacgcaaataattttctgtgcctcagatgcgcaattcatggaattgtactcttgccagaagttaagtggttcgatagtcactccattggacgtagaaaactctttattacagaagttgtccgcaaagagtttgaagatatccctaacaaagcggaacaagttccagttccgccatcgagaaatcgtcaagagtatgcaaggagtttatcacaaccatcacaactccgttaatcaagagcaggtcttgaacgttttgttcgagaatagcaagcaagttcttttaggtttaaaagatatgttgaaaagcgacgggcaacccacttacttacatctgaaaattgcaagttacattctttgtataacgaacgttaaggaacccataaagctaaagacatttgttgaaaacgaatgtaaagaattggtccagtttgcacaagacaccctgaagaacttcgttcagtaa

SEQ ID NO: 2215 - DNA, 990 bp, Saccharomyces cerevisiae
atgtgcagtaggatactcttgtccggtttagtcggactgggtgctggtactggcttaacctatcttcttttgaacaaacattctccaacgcaaatcattgagacaccttatccacctacccagaaacctaatagtaatattcaatctcactctttcaacgtcgatccttccgggttcttcaagtatggttttcctggtccgattcatgatctgcagaaccgcgaagagtttatctcatgttacaacagacaaactcaaaatccttattgggtcctcgaacatataacgccagaatcattggctgcaaggaatgctgacagaaaaaattcctttttcaaggaagatgaagtaattccagaaaagtttagaggtaaactaagagactattttaggtcgggctatgatcgaggccatcaagccccagctgcagacgcaaaattttctcaacaggccatggatgatacattctacttatccaatatgtgtcctcaagtaggagaaggttttaatagagactattgggcgcatttggagtacttttgtaggggattgactaagaaatataagagtgtaagaatcgtgactggtccattgtatctacccaaaaaggatcccatagataataaatttagggttaattatgaagttattggcaatccacccagtattgctgttccaacgcacttttttaaattgattgttgcagaagcaccaacagccaatcctgctagagaggatattgctgtcgcggcatttgtattgccaaacgaaccgatatcaaatgagacgaaattgactgactttgaagttcctatagatgctttagagagaagtactgggctagaacttctgcaaaaagtaccaccttcaaagaagaaggcattatgcaaagaggtaaattgtcaaattgtagtgagagatttctctaacgcggcgatcaaacaatcgaaagatgtgaaattgttacctcctccaaaaaaaaggaattga

SEQ ID NO: 2216 - DNA, 990 bp, Saccharomyces cerevisiae
atgttaagatctaccgtttcaaaagcttctctcaaaatttgtcgtcactttcacagagaatctattccttacgataagacgatcaaaaatttgctgcttcccaaggacaccaaggtgatctttcaggggttcacaggtaaacaaggtacttttcatgccagcatctctcaagaatatggtacaaatgttgtgggtggtacgaacccaaaaaaggcgggtcaaacacatttaggccaacctgtctttgcctctgtgaaggacgcgattaaggagactggagccactgccagtgccatctttgttcctccaccgatcgcagctgctgccattaaagaatctattgaagctgaaattccgttagctgtatgtatcactgaaggtattcctcaacatgacatgttatacattgcagaaatgttgcagacacaagataaaacaagattagttgggcccaactgccctggtatcattaacccagcaacaaaggtaagaattggtatccagcccccaaaaatttttcaagctggtaaaatcggtattatttccagatcgggaactttgacatacgaagctgttcagcaaactacaaaaactgaccttggtcaatcactggttattggtatgggtggtgatgcttttcccggtactgattttattgacgccttgaaattatttctagaagatgaaactacagaaggtattattatgttaggtgaaataggtggtaaggccgaaatcgaagctgctcaatttctcaaagaatacaactttagcaggagtaagccgatgccggtggcatctttcatcgcaggaactgttgctggtcaaatgaaaggtgttagaatgggtcactccggtgcaattgtagaaggatctggaactgatgcagaatccaaaaaacaagctttgagagatgttggtgttgccgtcgttgaatctccaggttacttaggtcaagctttactggatcaatttgccaaatttaaatga

SEQ ID NO: 2217 - DNA, 993 bp, Saccharomyces cerevisiae
atgacgccttctaatatggatgataataccagcggattcatgaaatttattaaccctcaatgccaagaggaggattgttgtatcagaaatagtctattccaagaagatagcaaatgtataaaacaacaaccagacctattgagcgagcaaacagcacccttcccaattttggaagaccagtgtcctgctttgaaccttgacagatcaaataatgatttgctattacagaacaacatatctttccctaagggtagtgatcttcaagcaattcaactaacccctatttcaggcgactactctacctatgttatggcagataacaataataatgataatgatagttatagtaatacaaattatttttctaaaaataatggtatatctccaagttcgaggagtccctcagttgctcataatgagaatgttccagatgactctaaggcaaagaaaaaggctcaaaacagagccgcccaaaaagccttcagagagagaaaagaagccagaatgaaagaattacaagataaattgttagaaagtgaaaggaaccgccaaagtttattgaaagaaattgaggaactaagaaaggcaaatactgaaatcaacgcagagaacagactgctactgcggagtggtaatgaaaatttttcaaaggacatagaagatgataccaactacaaatattctttcccaacgaaagatgaattttttacctctatggtcctggaaagcaaactgaatcacaaaggcaagtattcgctaaaggataatgaaattatgaagcgaaatacccagtatactgacgaagcaggaagacatgtactaacagtccccgccacctgggagtatctttacaaactttcagaagagagggactttgatgtgacatacgttatgagcaaattgcaaggacaagaatgttgtcatacccatggacctgcgtatccaagaagtttaatcgattttctagtggaggaagctactttgaatgaatga

SEQ ID NO: 2218 - DNA, 993 bp, Saccharomyces cerevisiae
atgagttcaccagcgaacctattccctggattaaacgacataactgacgtgctggaggaattcccactggccacctccagatatttaacattactacacgaaatagatgcaaaatgtgtgcattctatgccgaatttgaacgagaggatagataagttcttgaagaaagacttcaataaagatcaccaaacacaagtaagactgctcaataatatcaacaagatttatgaagaactgatgccatcgctggaggagaaaatgcatgtctcatccattatgctggataatctagacagattgacgtcccggttagaattggcgtatgaagtcgcaatcaagaacacagaaattcctagaggtttaagactgggtgtggacaaccatccagcaatgcacctccatcatgaactaatggaaaaaatagagagcaaatcaaacagcaaatcgtcgcaggcactgaagagcgaatcaagaagagaagccatggctgccaacaggaggcagggcgaacattactccgccagcacacaccaacaagacgactcaaagaacgacgcaaactacggaggcagcaggcacgagagccaagaccacactggtaacaacacaaactcaagaaaaagagccaacgctgccaataccaacaacgccgatccagagaccaaaaaacgcaagaggagagttgccaccacagccgtttcaccaagcactatcagcacggcaactgccgtcaataatggcaggataggtacatctacagcgtccaggggagttagcagcgtcggaaacagcaacaacagcaggatatcaagaccaaaaaccaacgactacggcgaaccgctctactgctactgtaaccaagtggcatacggggaaatggtggggtgtgatggcgcagactgtgagctagaatggttccatttgccatgtattggactcgaaactctacctaagggcaagtggtattgcgacgactgcaaaaaaaaactgtga

SEQ ID NO: 2219 - DNA, 993 bp, Saccharomyces cerevisiae
atggcgtctatcaatctgattaagtctttgaaactttacaaggaaaagatatggtcttttgacttttctcaaggtatattagcaacaggttcaactgatcgaaaaattaagctagttagcgtgaaatatgacgattttacgttaattgatgtgctagatgagactgctcataaaaaggcgattcgatctgtggcgtggagacctcacacttcgctgttagcggctggctcttttgattccactgtatctatctgggctaaggaagaatctgctgacagaactttcgagatggacctgctagctattatcgaaggtcacgaaaatgaagtaaaaggtgtagcgtggtcgaatgatggatattacctagcaacctgttccagagataaaagcgtgtggatatgggaaacagatgaaagtggcgaggaatatgagtgtattagtgttttgcaagaacattcacaagacgttaaacatgttatatggcatccatctgaagcattactggcttcaagttcttatgatgacaccgtcaggatatggaaagactatgacgatgactgggaatgtgttgctgtcttaaatggccatgaaggaactgtttggtcttctgattttgacaagactgagggcgtgtttagactgtgcagtggaagcgacgattccactgtacgggtatggaaatacatgggtgacgacgaggatgatcaacaagaatgggtttgtgaagctattctcccggatgtacacaaaagacaggtatacaatgttgcatggggctttaatggcctcattgctagtgtaggagcggatggagtactagcggtctatgaagaagtagacggagaatggaaagtttttgctaaacgtgcattatgtcatggagtttatgaaatcaacgttgtgaagtggttggagttaaatggtaaaactatacttgcaacaggcggtgacgacgggatcgtaaatttctggtctctagaaaaagcagcgtag

SEQ ID NO: 2220 - DNA, 993 bp, Saccharomyces cerevisiae
atggctagtaacgctgcaagggttgtcgctacagcgaaggattttgacaaagttgggttagggatcatcggatactatcttcagttatatgcggtggaattgatactgagtgaagaagatcggtcgcaagagatgaccgcactagcgacagaacttcttgatactattgaagcgtttaagaaggagattggcggcgagagtgaagcagaagacagtgacaaaagcttacacgttatgaacacgctaatacatgatcaagaaaaagccaaaatttatatgctaaattttacaatgtcgttgtataacgagaaactgaaacagctaaaagatggtccctgggatgttatgttaaaaagatcactttggtgttgtattgatttattttcatgcattttacacctgtggaaggaaaatataagtgaaacgagtacaaattcattacaaaaacgaattaagtattgcaaaatttatttgagtaaattggcaaagggtgaaattggttccagcgacgagaaaacgttagattatgcagattttgcggatgatagcgaggagattaaggatgaagatgttgatcaccagacaagcgatttggaaaacaataataatgataaagtcgaaggcctagccccaaaagaccaaacaacatcatacgagcctgtggatgaggtacctgaatttattgatgatgccgatagcgtaaacgaagaagaacagaccgtcgacaagaacgaagatgcaataacaaaagacgaacaacaagttgtgaagaaagaagtggatcttacgcgcccttctgcaccatcagaacctgctgcagcagagcataaatcgtatacaaaggatgagttgacaaaaattatggacagggccagtaaaatagagcaaattcaaaaacttgccaaatacgccataagcgcattgaattatgaagacctgcccaccgccaaagatgagttaactaaggcgttggatctgttaaattctatttga

SEQ ID NO: 2221 - DNA, 993 bp, Saccharomyces cerevisiae
atgggtattgatcacacttccaagcaacacaaaagatccggtcatagaaccgctccaaaatccgataacgtctatttgaaattattggtcaaactatacactttcctagctcgtatgtattgaaatctccctcccaattttcttcaggataaaaggattctgtgatattattaacttctagtcccggcgatcttctaatggcttcagtcttagtatcgttgcgtgcgacggatctcttagacaaaagtggaatttgttctcttttgtgttaaagatttccactagaacagaaagcggtagttttctggaaattctgcgagtactaaaggaagtacaatacgaccttcaagtgcggaccaactattaactgagcagaatcttttttcttcaaagagaaaaacaaattggtactttttcgttttgcactctttttggcttcaattaatggaagaaattaaaagctgcctatcgagaataccaacaaatcctttatccctttactaacataacgtaaaaacttttgtttttcttgtcttaatcacaggtcgtactgatgctccattcaacaaggttgttttgaaggctttgttcttgtctaagatcaacagaccacctgtttcagtctccagaattgctagagctttgaagcaagaaggtgctgccaacaagactgttgtcgttgttggtaccgttactgacgatgccaggatcttcgaattcccaaagaccactgttgctgctttgagattcactgctggtgccagagccaagatcgttaaggctggcggtgaatgtatcactttagatcaattagctgtcagagctcctaagggtcaaaacactttgatcttgagaggtccaagaaactccagagaagcggtcagacacttcggtatgggtccacacaagggtaaggctccaagaatcttgtccaccggtagaaagttcgaaagagctagaggtagaagaagatctaagggtttcaaggtgtaa

SEQ ID NO: 2222 - DNA, 993 bp, Saccharomyces cerevisiae
atgttagacccacgaatattgccatactacgacccggctgtggagaggaagattgctgtagtaacaggcggaaatacgggtattgggtggtatactgtcttgcatttgtatttgcatgggtttgtcgtttatatttgtgggagaaactctcacaagatttcgaaagcaatccaggagatactggcagaagcaaagaagaggtgccatgaagatgacgacggttcaagcccaggcgcgggcccaggtccaagcattcagcgtctagggtcactgcactatatccatttggatttgacagacttaaaatgtgtggagagagcggcacttaaaattctcaagctggaagaccacatagacgtgcttgttaacaatgcagggattatggcggtgcccttagaaatgacgaaggacggatttgaagtgcaattgcagactaactacatttcgcacttcatcttcacgatgagattattgcctttactgcgccattgtcgtggcaggatcatttccctgtcctcgataggccatcatctagagttcatgtactggaaactgagcaagacgtgggattacaaacctaatatgcttttcacatggtttaggtacgcgatgagtaaaaccgcgctaatccaatgcacgaagatgttggccatcaaataccctgacgttctttgtctctccgttcatccgggtctggtgatgaacacaaacttattcagttattggacaaggttacccatcgtcggtattttcttttggctgttgttccaggtcgtagggttctttttcggcgtatcgaacgaacaaggttcactagcttctttgaagtgtgcattggacccgaatttatctgtcgaaaaagataacgggaagtacttcaccacggggggtaaagaatctaaatcgagctacgtttctaacaatgtcgacgaagcggcatcgacttggatctggaccgttcatcaactaagagaccgtggtttcgatatataa

SEQ ID NO: 2223 - DNA, 995 bp, Saccharomyces cerevisiae
atgggtcgtatgcacagtgccgtatgtttattaacaccatagcgagatattaatgcaaaagttgcattgaatagttcgctaaatcagatgacactctaatgtggaattcaaaagtggatttctaatataatttgtctctgtcggatcacaattctattacaagttccggtgtgtacacaggtatagtttatactggagagtagtttctactcgctgtacattagctgggtgattccaatttcttttacaaatatgttgcattagtttaacaggttatactatctgccgtttctcagtataatttacgccggaaaattactgatggctagccgcctttatgaattagttttcacaaagctcataacataacacgttaacctatcggaggagaaccaagattgaagaatcacccggaatagttatactttaatggaattgtatggtctgaacgaggaaatatgtcatgatacacttttcttcaagccatatgaatcttcatgttactaacattcgataaattttttggaatatccaattccactaaatattactttaaacagggtaaaggtatttcttcttctgctattccatactctagaaatgctccagcttggttcaagttgtcctctgaatctgtcattgaacaaattgtcaagtacgcgagaaagggtttgactccatctcaaattggtgtcttgttgagagatgctcacggtgttacccaagctcgtgttatcactggtaacaagatcatgagaatcttgaagtccaatggtttggctccagaaatcccagaagatttgtactacttgattaagaaggctgtctctgttagaaagcacttggaaagaaacagaaaggacaaagacgctaagttcagattgattttgatcgaatctagaattcacagattggccagatactacagaactgttgctgtcttaccaccaaactggaagtacgaatccgccactgcctccgctttggtcaactag

SEQ ID NO: 2224 - DNA, 995 bp, Saccharomyces cerevisiae
atgtcagaccctgtagagttattgaaaagagtatgtagtagggaaatatatcaaaggaacaaaatgaaagctatgtgattccgtaatttacgaaggcaaattactaacattgaaatacgggaattgatatttcccgttgtgttaaggctgagaagaagggtgttccttcatcgggtttcatgaaattgtttagcggttctgattcatacaagtttgaggaggctgctgatctttgtgtccaagcagccaccatttaccgtctaagaaaagagttaaacttggcaggagactcgtttttgaaagctgctgactatcagaaaaaggctggtaatgaagacgaagcaggaaatacctacgtagaggcttataaatgctttaaaagcggtggaaactctgtgaacgccgtggattcattagaaaatgctattcaaatttttactcatagggggcagttccggagaggtgctaatttcaagtttgagcttggagaaattctagaaaatgatttgcatgactatgcaaaagctatagattgctatgagctcgctggtgagtggtatgcccaagaccagtcggtagcattatcgaataagtgttttatcaaatgcgcagatctaaaggctcttgacggtcaatatattgaagcaagtgatatatattcgaagttgatcaagagcagcatgggcaatagattgagccaatggagtttgaaggattacttcctaaaaaaagggctttgtcagctagctgctactgatgcagtcgctgctgcaagaactttacaagagggtcaaagtgaagatccgaattttgcggattcaagggagtcaaatttcttgaaaagtttaatcgatgctgttaatgaaggtgatagcgagcagctaagcgaacactgtaaggagtttgacaattttatgagactagataaatggaaaattaccattttgaataaaattaaggagtccatccagcaacaagaagatgatttgttatga

SEQ ID NO: 2225 - DNA, 996 bp, Saccharomyces cerevisiae
atgaggtctattaaatgtgtgataattggtgatggtgcagtaggtaaaacgtcacttctaatatcatatactaccaattcgttcccaacagactatgttccaacggtttttgataattattctactacgatagctatcccgaacggaactgcgagtagccccctagagcttgacaatggtaatgataaaagaggttcactttcatctgccagttcttcaccaagtacggacagaaaactatataaaatcaatttatgggacactgcaggacaggaagattacgatcgtttaagaccgttatgttatccccaaacagatatttttttaatatgtttctcagtaagcgaacatgctagttttgccaatgtcacagaaaaatggctacctgaactgaagcagacttccaatattgaaggtacctctctttatactaaattagggaagtatccaattctattggtaggcaccaaaagtgacctaagagatgatccggcaactcagaaaaaattgcaggaagcaaactccgattacgtgtctcaagaggaaatagatgaactcgtacaaagatgtgggtttatgggctataccgaatgttcagctgctacccaagcaggtgtccgggaagtctttgaacaggcggtgaggtacgctatctacgaaccagaatcccctaaccaaaaatcagcaaatcatactctaactgatgaattaacgactgcaacaaccaacaccaatggagataaaaatattcgagaacaaaaacagcaaccacaccataataatagtacagatagtactcttccgaaaggaagcttacagcaggagaaggaagctctcaatatcaaacccacaaaaaagggacaaaaagacaaaattcacgagcaatcaaaaagcaaaggtagtaaaattgcctcaaataatcatcacaacaagcaagctaaaccaaagacgagaaacgacaagaagaaaaagaagtcaaagtgtgtaatactttaa

SEQ ID NO: 2226 - DNA, 996 bp, Saccharomyces cerevisiae
atgctgatgccaaagtcagttgcattactcagaataagatacactttggaagccgctctggcaagaggtttcacaacagtgagagactgtgggggtgcagaaggctttctgaaagcagagattcgtcagggatccttgaatggtcccagattaattacgtgtggacatgccatttcccaaactggtggtcatggcgatctgagatctggtgccctacctgctagtgcctttgacagctgttcatgccactttggtcaagttggtgttgtagcagatggtgttcccgaatgctacaaagcggccagagaagagtttagaagaggtgcagactttattaagattatgggtggtggaggtgtggcctctccaactgacaaaatatcaaacaaacaattttgcgacgacgaaataaaagcacttgtagatgtcgcaaatagttaccacacatacgtaacagcacacgcctacactgcggaagcgatacaaaattgtatcaagttaggtgttaagggtatcgaacacggaaacttattagatgaacgtaccgcagagcttatggcagaattgggttgctacttgactccaacactagttacctacaaagtgatgggttctgatcaatttagtgcattcttgggacctgaaaatagtagaaaaaatacagaggtgctttacaaaggaattgatgcaatgaaaattgcccagaaaaaaaaagttaaaatttgttttggttcagatttattgggtcctctatatggttatcaaacgcaagagtttcgtattagagggaaagttcaaacgacacaagagattttgctctcagcaactgttactcctgccgaaatgaacggattaggcgataaattgggacagattaagccagggttcattgctgacctactgatgatgaaatcaaatccgttggacgatataacgattttggatgaacccgagagcaacatactatttgtcatgaaagagggaaggatatattga

SEQ ID NO: 2227 - DNA, 999 bp, Saccharomyces cerevisiae
atggttagagttgctattaacggtttcggtagaatcggtagattggtcatgagaattgctttgtctagaccaaacgtcgaagttgttgctttgaacgacccattcatcaccaacgactacgctgcttacatgttcaagtacgactccactcacggtagatacgctggtgaagtttcccacgatgacaagcacatcattgtcgatggtaagaagattgctacttaccaagaaagagacccagctaacttgccatggggttcttccaacgttgacatcgccattgactccactggtgttttcaaggaattagacactgctcaaaagcacattgacgctggtgccaagaaggttgttatcactgctccatcttccaccgccccaatgttcgtcatgggtgttaacgaagaaaaatacacttctgacttgaagattgtttccaacgcttcttgtaccaccaactgtttggctccattggccaaggttatcaacgatgctttcggtattgaagaaggtttgatgaccactgtccactctttgactgctactcaaaagactgttgacggtccatcccacaaggactggagaggtggtagaaccgcttccggtaacatcatcccatcctccaccggtgctgctaaggctgtcggtaaggtcttgccagaattgcaaggtaagttgaccggtatggctttcagagtcccaaccgtcgatgtctccgttgttgacttgactgtcaagttgaacaaggaaaccacctacgatgaaatcaagaaggttgttaaggctgccgctgaaggtaagttgaagggtgttttgggttacaccgaagacgctgttgtctcctctgacttcttgggtgactctcactcttccatcttcgatgcttccgctggtatccaattgtctccaaagttcgtcaagttggtctcctggtacgacaacgaatacggttactctaccagagttgtcgacttggttgaacacgttgccaaggcttaa

SEQ ID NO: 2228 - DNA, 999 bp, Saccharomyces cerevisiae
atgaacgatacgctatcaagctttttaaatcgtaacgaggctttagggcttaatccaccacatggcctggatatgcacattaccaagagaggttcggattggttatgggcagtgtttgcagtctttggctttatattgctatgctatgttgtgatgttcttcattgcggagaacaagggctccagattgactagatatgccttagctcctgcatttttgatcactttctttgaattttttgctttcttcacttatgcttctgatttaggttggactggtgttcaagctgaatttaaccacgtcaaggttagcaagtctatcacaggtgaagttcccggtattagacaaatcttttactcgaaatatattgcctggttcttgtcctggccatgccttttatttttaatcgagttagccgctagtactactggtgagaatgacgacatttccgccttggatatggtacattcgctgttaattcaaatcgtgggtaccttattctgggttgtttcgctattagttggttcattgatcaagtccacctacaagtggggttattacaccattggtgctgtcgctatgttggttacccaaggtgtgatatgccaacgtcaattcttcaatttgaaaactagagggttcaatgcacttatgctgtgtacctgcatggtaatcgtttggttgtactttatctgttggggtctaagtgatggtggtaaccgtattcaaccagacggtgaggctatcttttatggtgttttggatttatgtgtatttgccatttatccatgttacttgctaattgcagtcagccgtgatggcaaattgccaaggctatctttgacaggaggattctctcatcaccatgctacggacgatgtggaagatgcggctcctgaaacaaaagaagctgttccagagagcccaagagcatctggagagactgcaatccacgaacccgaacctgaagcagagcaagctgtcgaagatactgcttag

SEQ ID NO: 2229 - DNA, 999 bp, Saccharomyces cerevisiae
atgaagtggtgtagcacatacattattatatggctcgccattatattccataagtttcagaagtccacagccactgcatcccataatatagatgatattctacagttgaaagatgacaccggtgtgataacagtgaccgctgacaactacccactgttaagccgtggtgtcccaggttacttcaatatcttgtacatcacaatgaggggtacaaacagtaacggcatgagttgccaactatgccatgattttgaaaaaacctatcacgcagtggccgatgtaattcgctcgcaggccccacaatcactaaatttgttttttacagtggatgtcaacgaagtaccacaattggtcaaggatttaaagttgcaaaacgtacctcatcttgtggtatatccgccagcagaaagtaacaagcaatctcagttcgaatggaaaacatcacctttttatcagtactctttggtacctgaaaatgcggaaaacactttacaatttggcgattttctggctaaaatactcaatatttcgataacggttcctcaagccttcaacgttcaggaatttgtttattattttgttgcgtgtatggtagttttcatctttattaagaaagtaattctaccgaaggtaactaataaatggaagcttttctccatgatattgtcattaggcatacttctaccaagtattactggttacaagtttgtggaaatgaatgctatccctttcattgcacgtgatgctaagaatcgtataatgtattttagcggtggttcaggatggcagttcggtatagagattttttctgtatcattgatgtacattgtgatgtccgcactgtctgtgcttttaatttatgtgcccaaaatctcgtgtgtaagtgaaaaaatgagaggactattgtcgtcatttttggcatgtgttctattctacttcttttcttatttcattagttgttatttgataaagaatccagggtacccaattgttttttaa

SEQ ID NO: 2230 - DNA, 999 bp, Saccharomyces cerevisiae
atgagcggatacacgggaaataattatagcagatactcatccactcctccgagacaaagggggggttatcaccatgcgagacgaagtagaggtggagcaggcggatcgtattacagaggcggtaatgcgtcttatggcgcgagatacaacagtgactatgagcagccgccccaagagggagacttgagacaaaccggagcatactatcgaaacggatacacagatacaaggccgtactattcagctaatagcaggcattaccaagcacaaccatcccccaggtacaacaatggtacaaattcgtaccacctaccgcaacgtggcaatagtcaagatacgaacggcaggaccacgagcgcctcgcaagaagataatgacgaaaaaagagtcaagtccagataccggaacatgcaggcagatcatccacgccaacaaccgatgagcgttggcagcaccagcagcagaaatggtagtagtgggaacagcagcactagcagcaccagcaacgggcttccgccaccaccttcagtatcgtctataaccaacaatagatcatatcacagcagtgcttatccatattccagcagccatacttacaataattaccaccaccgtgagacaccaccgcctcccccatcgaatggctattatgcaaagggttacccagtacacgtaccagaaaatagaagtaacagcgacggctctagcagcagcgtcgtcaagaagaaaagaatactagatatgaaagattccccctttatttacttgacagattttgataaaaatgtgaaaaagacaaacaacaccgaaagtgaatgtgaaaaggcgagggaagttttcaaagagagcgattccatcgattccgctttggaagaactaaacctaaaaatcaattctaatgagctagaattgcggctcctaaataaccagtgcgacaagcatgcattaaatattcaactgacccaagaaaagctggactcattgttattaatgcagtag

SEQ ID NO: 2231 - DNA, 999 bp, Saccharomyces cerevisiae
atgagtgagtaaatacctactaaactatgccacaaaaatggaagagtaatgccatctacatcgcagaactaggctcggagcgatcatgaaatgaatgaccacactgcgtttaaaacttaagctactatcaccactaaaatagttcaactaggattacactctaaatatgtcaaggaaaacagcgagtttgttacgaccgaaaagaaatgaacgacgttaattgtaccatgctgaataatatgatcccatccatcctagaaatacgattgcaaaagaagtgtataggttctttttggttcaatgacgaaacacctgagttaaactttcatggatctttcaaatgtctaaaaggctattacctgaccttgcgaatgtgataataactcctccataaaagcttcccttttctcatgtgtcacatggacttcatactaacattcaaatttgtgatttttcatgaaaatccttgttattttatcagtggctcactttaaagaataccaagttattggccgtcgtttgccaactgaatctgttccagaaccaaagttgttcagaatgagaatctttgcttcaaatgaagttattgccaagtctcgttactggtatttcttgcaaaagttgcacaaggttaagaaggcttctggtgaaattgtttccatcaaccaaatcaacgaagctcatccaaccaaggtcaagaacttcggtgtctgggttagatacgactccagatctggtactcacaatatgtacaaggaaatcagagacgtctccagagttgctgccgtcgaaaccttataccaagacatggctgccagacacagagctagatttagatctattcacatcttgaaggttgctgaaattgaaaagactgctgacgtcaagagacaatacgttaagcaatttttgaccaaggacttgaaattcccattgcctcacagagtccaaaaatccaccaagactttctcctacaagagaccttccactttctactga

SEQ ID NO: 2232 - DNA, 999 bp, Saccharomyces cerevisiae
atgatcagaattgctattaacggtttcggtagaatcggtagattggtcttgagattggctttgcaaagaaaagacattgaggttgttgctgtcaacgatccatttatctctaacgattatgctgcttacatggtcaagtacgattctactcatggtagatacaagggtactgtttcccatgacgacaagcacatcatcattgatggtgtcaagatcgctacctaccaagaaagagacccagctaacttgccatggggttctctaaagatcgatgtcgctgttgactccactggtgttttcaaggaattggacaccgctcaaaagcacattgacgctggtgccaagaaggttgtcatcactgctccatcttcttctgctccaatgtttgttgttggtgttaaccacactaaatacactccagacaagaagattgtctccaacgcttcttgtaccaccaactgtttggctccattggccaaggttatcaacgatgctttcggtattgaagaaggtttgatgaccactgttcactccatgaccgccactcaaaagactgttgatggtccatcccacaaggactggagaggtggtagaaccgcttccggtaacattatcccatcctctaccggtgctgctaaggctgtcggtaaggtcttgccagaattgcaaggtaagttgaccggtatggctttcagagtcccaaccgtcgatgtttccgttgttgacttgactgtcaagttggaaaaggaagctacttacgaccaaatcaagaaggctgttaaggctgccgctgaaggtccaatgaagggtgttttgggttacaccgaagatgccgttgtctcctctgatttcttgggtgacactcacgcttccatcttcgatgcctccgctggtatccaattgtctccaaagttcgtcaagttgatttcctggtacgataacgaatacggttactccgccagagttgttgacttgatcgaatatgttgccaaggcttaa

SEQ ID NO: 2233 - DNA, 999 bp, Saccharomyces cerevisiae
atgggtgtcatcaagaagaaaagatcgcaccatggaaaggcttcgcgccaacaatactactctggggtacaggttgggggagtaggcagcatgggcgccataaacaataacatcccgtcgttgacgagcttcgcggaggaaaacaactatcagtacggatacagcggctccagtgccggcatgaatggcagatcgcttacgtacgcgcagcaacagcttaataagcaaagacaggacttcgaacgtgtacgacttagaccagaacagctcagcaatatcatacatgacgagagcgacacgatatcgttccgatccaaccttttgaagaactttataagctcgaacgacgcatttaacatgctgagtttgaccacggtaccgtgcgacagaattgagaagtccagattgttcagtgaaaaaacaataagatatctcatgcaaaaacaacacgaaatgaaaacacaagcggcagagttgcaagaaaagcctctgacgccacttaaatacacaaaacttatagctgcggcagaggacggaagccgtagcacaaaggatatgatagatgctgtcttcgagcaagatagtcatttgaggtaccagccggacggcgtggtcgtacatcgtgacgatcctgcgctggtgggtaaactccgcggagatctccgcgaagcgccggcggactactggacgcatgcttatagggatgttttggcgcaataccacgaggccaaggagcgtatcaggcagaaggaagtaactgcaggtgaagcacaggacgaagccagcttgcagcagcaacagcagcaagatttgcagcaacagcaacaagtagtgactacagttgcctcgcaaagtcctcatgcaactgcaacggaaaaggagccagtacccgccgtggttgacgacccactggagaacatgttcggagattattccaatgagccgttcaacaccaatttcgacgatgaatttggagatcttgatgctgtatttttttaa

SEQ ID NO: 2234 - DNA, 999 bp, Saccharomyces cerevisiae
atgtctactcaatccggtatagtcgcagaacaagccttgctgcattctctgaatgaaaatctttcagcagatggcatcgtcatcattatagccaaaatttcccctgattctacctcggtacatcaaacgcaagtcgcacgtagcttcgaggagctggtacagttggcatcacaagaaagagaaccgttgtacatcttctataagccggaagggcttgataagtacttctttgtgtcattcatccccgatggttctccggtaagatcaagaatgctttatgcctcgacgaagaacactctggcaagacaggtaggttcaaactctttatccaccgaacagccattgatcacagatgcacaggacttggtggatttgaaaaattttgatagtgcccgtcctgctggccagaataagcccttgacacatgatgaagaaatgcaaatcgaaatcaataagcaacaggcacttttaaggaaaaacacatccgtcaagttggtttctcaggacagtgcttcgcctttatcgttaactttcagggtcaattctgagaaacctatcaatgaaatactggatagcgagggtaaaaatttaatcatatttcaaatcgatccctcgaacgaaaccatccagatcgtgcaatctgatacatgtccctccgtagatgaactgtacattgacttgcccgggccaagttacacgattttcaggcagggtgattcaagtttctttatctactcttgtccctctggcagcaaagtcaaagatagaatgatatatgcttctaacaagaatggatttatcaactacttgaaaaatgatcaaaaaatcgcatttagtaaagtggtagaaattggcgattttgtggaactagacaagtccttacttatggcaacaaataaagaagatagcctcgatcatggatccaatccagatctcccaaacaaaagcaatttgaaattcaacaaaccaaagggcccattgaggaaaagaagaacatag

SEQ ID NO: 2235 - DNA, 1001 bp, Saccharomyces cerevisiae
atgccaagtacgtattagactatatcgaagaggagggaaattcttcactctgactcgttgattttgaaagaggttcgggtcctcataaatatttgagaatatgaaattccataatagtataccttcattgagtagcacgacaacagcctgaattactatccatattatgaatatctttatttacactgaactcccgacacttcagttaaacagggatacattagagatcaaggtgatctaatagggaacatctctctcgtaacaatgggacagtattttattttccaaggcggatacctaattatgcgtttttaatcatatctctacaatatttatgagcacttacttgggcccttgcagacttttgttccgggaaaacttttgactaacaagaatccaattttacttttttttttttaggagctccaagaacttactctaagacttactctacaccaaagagaccttacgaatcttctcgtttggacgcagaattgaagttggccggtgaattcggtttgaagaacaagagagaaatttacagaatttctttccaattgtctaaaattcgtcgtgctgccagagacttgttaactagagacgaaaaggacccaaagagattgttcgaaggtaatgccttgatcagaagattggttagagttggtgtcttgtccgaagacaagaagaagttggattatgttttggctttgaaggttgaagatttcttggaaagaagattgcaaactcaagtctacaagttgggtttggccaagtctgtccaccacgccagagttttaatcactcaaagacacattgctgttggtaagcaaatcgtcaacatcccatctttcatggtcagattggactctgaaaagcacattgacttcgctccaacttctccattcggtggtgctagaccaggtagagttgctagaagaaacgctgctagaaaggctgaagcttccggtgaagctgctgaagaagccgaagacgaagaataa

SEQ ID NO: 2236 - DNA, 1002 bp, Saccharomyces cerevisiae
atgaaagtgaatatggagtacacaaagggtatgtgggggttatatattgtcgtctttcttttaacattcaataatgatactaacgttgattaatgatgattcatcgcagaaaagaaagttggtgagggtacttatgcggttgtttacttgggttgtcaacactctactggaagaaagattgctattaaggagatcaaaacatccgaatttaaagatggtttagatatgtcagctatccgtgaagttaagtacctccaagaaatgcagcatccgaacgtcatagaactaatagacatatttatggcttatgataatttaaatctcgttctggagttcctaccaactgatctagaggtggtaataaaagacaaatcaatactgtttacaccagcagatattaaggcatggatgcttatgactttgaggggcgtgtatcattgccacagaaatttcattttgcacagggatctgaaaccaaacaatttattattttcacctgatggccagataaaagtagcagatttcggtctagcaagggcgataccggccccacatgagatactgacaagtaacgtcgtaacaagatggtatagagcgccagaattgttgtttggagctaaacattacacatcggctattgatatctggtcagtaggcgttatattcgcggaattaatgctaaggataccttatttaccaggacagaatgatgtcgatcaaatggaagtaacgttcagggccttagggacacctacagatagagattggcccgaagtttcttcctttatgacgtataacaagttacaaatatatccgcccccttcaagagatgaattgaggaaaaggttcattgctgctagcgaatacgccttagattttatgtgtggaatgctaacgatgaacccacaaaagaggtggaccgctgttcagtgtttagaaagtgattatttcaaagaattaccaccaccaagtgacccgtcttcaataaaaatacgtaactga

SEQ ID NO: 2237 - DNA, 1002 bp, Saccharomyces cerevisiae
atgagttgtgtgtatgcgtttgggtctaatgggcaaaggcaactgggactggggcacgatgaggatatggataccccacagaggtctgtgccaggagatgatggagcaatagtcaggaagatagcgtgcggtgggaaccacagcgtgatgctgacaaatgacgggaatctggtaggatgtggagataacagacggggagaactggatagtgcgcaagcactgcggcaggtgcatgactggaggcccgtggaagtaccggcacccgtggtggatgtggcgtgcggctgggacacgacagttattgtggatgctgatggccgtgtatggcagagaggaggcggttgctacgagttcactcagcaacatgtgccattgaattccaacgatgagcgcatcgcagtatacggatgtttccagaactttgtggtggtgcaaggcacccgagtatacggctggggcagcaacacaaagtgtcaattgcaagagcccaaatcccgatcactgaaagagcccgtattggtgtacgataccgggtctgtggccgtagactacgtggccatgggcaaggacttcatggtcatagtggacgagggcggccgcatagtgcacgcatccggtcgcctgcccactgggttcgagctcaaacaacagcaaaaaagacacaatctagtggtactgtgcatgtggacctcgatccacctgtggaatgcgcgcctcaatacggtagagtcgtttggtaggggcacacattcccaactcttcccgcaagagcgcctagacttccctattgtcggtgttgcaaccgggagtgagcacggtattctaactactgctaatcaagaaggcaagtctcactgttacaatgtatactgctggggctggggagagcatggcaactgcggcccgcaaaagggctcccagcctggactgcagctcgtgggccaatactctggaaaacctcgcgtgtttggcggatgtgccaccacgtggatcgtgctctag

SEQ ID NO: 2238 - DNA, 1002 bp, Saccharomyces cerevisiae
atgagttttctttccaaactttcccaaatacgaaaatcaacgactgcatcaaaagcccaagtgcaagatccattacccaagaagaatgacgaagagtattccttgttacccaaaaattacataagagacgaagatcctgcagtaaaaagattgaaggagctgaggcggcaggaactgttaaagaatggtgctttggctaaaaaaagtggtgtaaaacggaaacgtggcacctcatctggatctgagaaaaagaaaatagaaaggaatgacgatgatgaaggtggccttggaattaggtttaagaggtctattggagcaagtcatgcgccactcaagccagttgtaaggaagaaacctgaacctatcaaaaagatgtcatttgaagagctaatgaaacaagcggaaaataatgagaaacagcccccaaaagttaagtcatcggaacccgtaactaaggaacgcccacattttaacaagccaggtttcaaaagttcaaaaagaccacaaaagaaagcatcccctggcgcaacattgcgtggagtatcttctggaggcaatagcataaaatcatcagactcacccaagcccgtcaagctcaacttgcccacaaatggatttgctcaacctaataggagattaaaagaaaagttagaatctagaaaacagaaatcaagataccaggatgactatgatgaagaagataacgatatggatgattttatagaagacgatgaagatgaaggttaccacagcaaatcgaaacacagcaatggtcccggatatgatcgtgacgaaatttgggctatgttcaatagaggcaagaagcggtcagaatacgattacgatgagcttgaggatgatgatatggaagcaaatgagatggaaatcttggaagaggaggaaatggcaagaaaaatggcaaggttagaggataaacgtgaggaagcttggttaaaaaagcatgaagaggagaagagacgccgtaagaagggcatacgctaa

SEQ ID NO: 2239 - DNA, 1002 bp, Saccharomyces cerevisiae
atggaaacaggacctcattacaactactacaaaaatcgcgaattgtccatcgttctggctccattcagcggcggtcagggtaagcttggtgtcgagaagggccctaaatacatgcttaagcatggtctgcaaacaagcatagaggatttgggctggtctacggaattagagccctcaatggacgaggcccaatttgtgggaaagttgaaaatggagaaggactccacaactgggggttcctctgttatgatagacggtgtcaaggctaaaagagcagatttggttggtgaagccaccaagttggtgtacaactccgtgtcgaaagtggtccaggcgaacagattccccttgaccttgggtggtgatcattcaatagccattggtactgtatccgcggttttggacaaataccccgatgctggtcttttatggatagacgcccacgctgatataaacaccatagaaagcaccccctctggaaacttgcacggctgtcccgtgtcattcctaatgggtttgaacaaggatgtcccacattgtcccgagtcgctcaaatgggttccaggcaacttgagcccaaaaaagatcgcgtatattgggttgagagatgttgatgccggagaaaagaaaatcttgaaagatctgggtatcgccgccttttccatgtaccacgttgacaaatacggcatcaacgctgtcattgaaatggcaatgaaagccgtgcacccagaaacaaacggtgaaggtcccattatgtgctcctatgacgtcgatggtgtagacccattatacattcctgctacaggtactccagtgagaggtgggttgaccttgagagaaggtcttttcttggtggaaagattggccgaatccggtaatttaattgcgctagacgttgttgaatgtaaccctgatctggctattcatgatatccatgtttcaaacaccatctctgcaggttgcgccattgcaaggtgtgcattgggtgaaaccttattgtag

SEQ ID NO: 2240 - DNA, 1002 bp, Saccharomyces cerevisiae
atggctaaccaggtaagtagtaaactgtttcgttccaagacgctaatgctattttattaacgctctcttttttctcgtttgcagaactctgacctttacaagcaaatcactgccggcagtgtagctgctgtgtttcaaacgacaatgacatacccatttgagtacttaaagactggtttacaattgcaaccgaagggtaccgctttcgaaatcattttacctcagattaagtcgtactttgttggctgctctgccctaaacgtggccgcatttggtaagactattttaaggttcgttacgttcgacaagttatgccactccctgaataataacattgataataatgataattttcaaagactgactggttataaccttttgatcgctggtacgttgacaggaatagtagaaagtttgtttattatcccttttgaaaacataaaaaccacccttatccaatcggcgatgatcgatcataaaaaattagagaagaatcaacctgtagttaacgcaaaggcaacctttcacaaggtggcgactaaatctactcctgtggctcgtatcgagaaactacttccagcggtaaaacacatgtatcaaacaagaggccctgctgcgttcgtccagggaacaacagccaccatatttaggcagatagctaacacctctattcaatttactgcatacacagcatttaaacggttgttacaagcaagaaacgacaaggcatcctcagtaataacggggttagccacatcttttacactcgtggcaatgactcagcccattgacgtcgtaaaaacaaggatgatgagtcaaaatgccaaaactgaatataaaaataccttaaattgcatgtatagaatatttgttcaagaaggcatggccacattctggaagggctccatctttaggtttatgaaagtcggtatttcaggaggcttaacgttcactgtttatgaacaggttagtttgttactaggcttctcttccaggtcttga

SEQ ID NO: 2241 - DNA, 1002 bp, Saccharomyces cerevisiae
atggctccgtcaatgattccgttcactgtatgtttatattttatagtaatttttaaaaagctttagtatgcaaaagatctaggatgtactaactgaagaagggtaaaactatcatccaaattattgttatagatcaagcttaaaacatgcctgaaaatgtgtattcaaaggttaagatatgctcaagaaaagcaacaggcgattgcaaagcagtctcgaagacaggttgcacaactgttactgacaaataaagaacagaaggcgcattatcgtgtggagacgctaattcatgacgatattcatattgagctactagagatattggaactatattgtgaattactactggctagagtgcaggtaataaacgatatctccaccgaggaacagcttgtcaaagagcatatggatgatggtattaacgaagctatcagatccctaatctatgcgattcttttcgttgatgaagtcaaagaacttagccaattgaaagatttgatggcctggaaaataaacgttgagtttgttaatggagtaatagcagatcatatcgatgtccctgaaaagattataaaaaaatgctctccctcagttccaaaagaagaactagttgatctttatttgaaggaaatcgcgaaaacatacgatgtgccatatagtaagctggagaattccttatcttcgtcgtcttctaacatttcttcagactttagtgacccctcgggagatatcgaggataatgacgaagaaaagcctattttagccttagataatgacgataatgacaatgcagatgctaaacaccctatcactgttaaaaagcctaggcagaatagtgaaaatatcaagaacgagctcaagattccgaaagatatcaaaaaggaagtgatcgaaaagaaacaatcagaaaagaaaactacaaaaagaaagactaagaaggagcaagaaaatgatgaactagatgagttgaagaaacggtttgacgctttacgcagaaaataa

SEQ ID NO: 2242 - DNA, 1002 bp, Saccharomyces cerevisiae
atgggtatgttgaactgaagcaataagagctatgattgaaacgaacacggaacgactgaactaatgcctaaactagctgtgtagaaacaagcattggataacactgtaaattaacagtaggaaccgtggaataattagatcccgctgtctttgaaacgttgcaaaaatcaagatcaaaagaatcattctttgagataattggcactttgaccagtttataaataggcgggttgcactaaaaggatgccttgagatatttagaggaatcagcatggcgaggcaatgtaaattgtgcattaataatgaggttaaatgattattaccctgagattcgtttatcagaaactagaaataaaggtttactcaaaggaagcaaatttactaactgatttttttatgattatagctatctccaagaatttaccaattttgaagaaccacttcagaaagcactggcaagaacgtgtcaaggttcactttgaccaagctggtaaaaaggtttctagacgtaatgctagagctgccagagccgccaagattgctccaagaccattggatttgttgagacctgttgtcagagctccaactgttaagtacaacagaaaggttagagctggtagaggtttcaccttggctgaagttaaggccgctggtttgactgctgcttacgccagaaccattggtattgctgttgaccacagacgtcaaaacagaaaccaagaaatctttgacgctaacgttcaaagattgaaggagtaccaatccaagattatcgttttcccaagagacggtaaggctccagaagctgaacaagttttgtctgctgctgccactttcccaattgctcaaccagctaccgatgttgaagctagagctgttcaagacaatggtgaatctgctttcagaaccttgagattagccagatccgaaaagaaattcagaggtatcagagaaaagagggctagagagaaggctgaagctgaagctgaaaagaagaaataa

SEQ ID NO: 2243 - DNA, 1002 bp, Saccharomyces cerevisiae
atgggtattacagtaataggttctctaaactatgatttggacacatttacggatagattacctaacgctggagaaactttcagggctaaccacttcgaaacacatgctggtggtaagggattgaaccaagctgcggccattggtaaattaaaaaaccccagcagcagatatagtgttcgaatgattggtaatgttggaaatgatacatttggtaaacaattgaaggacactttatccgattgcggagtcgatatcactcacgtcggtacttacgaaggcattaatacgggtaccgctaccatactaattgaagagaaagctggtggccaaaataggatattgattgtagaaggtgctaacagcaagactatttatgacccgaaacagttgtgtgaaatttttccagagggcaaggaggaagaagagtatgttgtttttcaacacgaaattcctgatcctctttccattattaaatggatacatgcgaacaggccgaattttcagatcgtatataacccctcacctttcaaggccatgcctaagaaagattgggagttggtagaccttttggtcgttaatgaaattgagggtcttcaaatcgtggaaagtgtatttgataatgaacttgttgaagaaataagggagaagataaaggacgactttttaggagaatatcgtaaaatttgtgagcttttgtatgaaaaactcatgaatcgaaagaaaagaggaattgtggttatgactttgggttcgagaggggtgcttttctgttcgcacgaaagccctgaagtacaattccttccggctattcaaaatgtttcggttgttgatactacaggagctggagatactttcctgggcggtttggttactcaattgtatcaaggagagaccttgtctacggctataaagttctctacattagctagttcattgaccattcaaagaaaaggtgctgctgaaagcatgccactgtataaagatgttcagaaagatgcataa

SEQ ID NO: 2244 - DNA, 1002 bp, Saccharomyces cerevisiae
atgtcagaaccttcagagaaaaaacaaaaagttgctacctcatctttagaacaattaaaaaaggccgggacccatgtggttgctgattcgggtgattttgaggctatttcgaagtatgaaccacaggattcaacaactaacccttctctgatattggctgcttcaaagttggagaaatatgcgaggtttatcgacgctgccgttgaatatggtagaaagcatggcaaaactgatcatgagaaaatcgagaacgccatggataagattttggtggaattcggcacccagattttgaaggtagtcccaggaagggtttccactgaagtagacgcaaggttatcttttgataagaaggcgacggtgaagaaggctctccacatcatcaaactatataaagatgcgggagtacctaaagaaagagtcttgatcaagatagcttctacgtgggagggtatccaagctgctagagaattggaagtaaagcatggtattcattgtaatatgacattactgttttcctttacgcaagcagtagcctgtgcggaggcaaatgtcacattgatctccccatttgttggaaggattatggacttttacaaggccctttcaggcaaagactatactgcagaaactgatcccggtgttctttctgttaagaagatatacagttactataagaggcatggttatgcaactgaggtaatggcggcttctttcaggaatttagatgaattgaaggcgttagccggtattgataatatgactctcccactgaaccttctagaacagttatatgaatcaacagatcctattgaaaacaaattgaattctgagagtgctaaggaagaaggcgtcgaaaaagtctcttttatcaacgacgagcctcatttcagatatgttttaaacgaagatcaaatggctacagaaaaactatcagatggtatcagaaaattctccgcagacattgaagcactgtacaaactggttgaagaaaaaatgtga

SEQ ID NO: 2245 - DNA, 1005 bp, Saccharomyces cerevisiae
atgaaatgtactataccagaacagcaaaaagtcattttgattgatgaaattggtggatacgatgtaatcaagtatgaggattatcctgtaccatcgatttcggaggaagagttactaatcaaaaataagtacacgggtgttaattacatcgaaagttactttcggaagggtatttatccctgtgaaaaaccatacgtattgggcagggaagcgtcggggaccgttgtagcaaaaggtaaaggggtaactaattttgaagttggagaccaagttgcttatatatctaactcaacttttgcacagtattcaaaaatttcgtcccaaggcccagtcatgaagctgccaaagggaacgagtgacgaagagttgaaactttatgcggctggtttattacaagttctcactgctttatcatttacaaacgaagcgtatcacgtcaaaaagggcgactatgtattactttttgccgcagcgggtggtgtgggattgattttaaatcagctactcaagatgaaaggtgcacatacgattgcagttgcctcaactgatgaaaagcttaaaatagcgaaggaatacggcgccgaatacttgatcaacgcttcgaaagaggatattttaagacaagttttaaaattcactaatggtaagggcgttgatgctagttttgactcggtcggaaaggatacctttgaaatcagcttagccgcactaaaaagaaaaggtgtattcgtttcctttggtaatgcatctggtcttatcccgccattctctattaccagactttccccaaaaaatattactttggtgagacctcaactttacggctatatcgccgatcctgaagaatggaaatattactctgacgagttttttggtctggttaattcaaagaagttgaacatcaaaatatacaaaacttatccattacgggattatagaactgcagctgctgacatagaaagtagaaaaactgttggtaagctagttcttgaaataccacaatag

SEQ ID NO: 2246 - DNA, 1005 bp, Saccharomyces cerevisiae
atgacaaaatcaagaaagcagaagcaaaaaaagcaggattttttgagaaaaaagttaaaagttggtaagccaaaggaaaaagcaaggaatgctaccgatacatctttcgtttccaagactatttctattagaaatcaacatttagaccaaaatccacatgatttaacaaaacggctaacgctcttaaagcatcataacatcaatgtgagaaaggaaacattaacaacattccaaaagtcaataccgtctataataaaatctcgacttatgacaccattacttactcaaagtataccgttgatttgcgatgaatcgcagcaagtacgtcagggacttattgatctcgtagatgaaataggtagtcacgatgcggagattttaaaattgcactgcaacatttttgtcttatacattaacatggcaatgacacatattgttacacaaattcaagcagattctactaaatttctctctcatctgttgaagtattgcggagatgaagtggttaggaaatcttgggtaaaacttttgaacggtgtctttggagtgctcggttggggacaggtagggaaaaatgatagcgctagcatagtgcaaacgaagaagcgaaacgccaaatatgtcactattcatctcaatgctctgtacactcttgttgaatacggatgtcaggatgaacgcgctagaagcgacggagacacggcagagactacagaggacagcggtacgctacgaaacccatatttaatcccagattatccgcagccgtttgagcacttgaaactatttaccagagaattgaaagttcaggatgctacctccagtggagtaaatgccacactactgtcattggcaacacaggatatcgatactcgaaaagcggtatttatcgaacaattcctgcctatagtacgtaagaaaatcgaagtaattatcaaggaaggtggtgaatgtggtaaaagtgcaaacaagcttaaaacgctgcttgcaaaaatctttgattga

SEQ ID NO: 2247 - DNA, 1005 bp, Saccharomyces cerevisiae
atgagagcgttgagattcctgattgagaacagaaacactgtcttttttacgctcttagtagccttggtgctttcactgtatttattggtctatttattttcgcatacaccaaggccgccatatccagaggagctcaaatacatagctattgatgaaaaaggtcatgaagttagtcgtgccttacctaacttgaatgaacaccaagatgacgaagaaatatttttatctgttgttatcccaagctataatgagacaggtagaattttactaatgttgacagacgcaatcagctttttaaaggaaaaatatggttccagatgggagattgtcatagtggatgatggttccacagataataccacacaatactgtttgaaaatttgtaaagaacagttcaaattgaactacgaacaattcagaatcatcaagttttctcaaaacagaggcaaaggtggcgcagtgagacaaggttttttacatattagaggtaagtatggtctttttgccgatgctgatggtgctagtaagttcagtgatgtagaaaaactaatagatgctattagcaaaattgaaacgtctagtacagatctaaaaacgactaaaccagcagtagcaattggttccagagcacatatggtaaataccgaagccgtcataaagagatcaatgataagaaactgcttgatgtacggtttccataccttagttttcatcttcggcatcaggtctatcaaagacacacaatgtggattcaaattgttcaacagagccgctatattgaaaatttttccgtatttgcatacagagggttggatctttgacgttgaaattttgatcttagccatcagaaaaagaatccaaattgaggagataccaatttcctggcatgaggttgatggctctaagatggctttagctattgatagtatcaaaatggcgaaagacttggttattataagaatggcctatttattagggatatatagagataataagaaatgttag

SEQ ID NO: 2248 - DNA, 1005 bp, Saccharomyces cerevisiae
atggaaaaggacgcattggaggttagactgaagtctattagacattcgctggacaagaataccaaacttttaccgggaaaatataggaatactctaggagagcgacttattaccaaatggaggtacaagaagaaatcccataatggcagttcaatgttgcctgaaaaatgtaagagccacgtgcaattgtatgatgatttggtacaagaaagctctaaacattttgttggtttccgattacacgatcttcgggccttgttgaaaagaatatgctccattcaaaactacacaaggcatgtgctcattgaatgggacgttcgatgggtcaatccactgactctagcatccaagggctgggagccgtaccaaagtgcatcccagtcgcaagtgccatttaagtgctgttgttgccatgccattatgacaattcctttattaaaaaatggcgatgatgtcgccgattacaccatgaaattgaatgaaaaaatctggaattccaatataattggaaatcatctccaaaagtgtccgtggagggaaaatcaggttgatttaaacaaagagtattatttaagctcacaaaaccttataagggaaattgaaagaattcatacagaaattgacagaattgtttccggatcaaatgaatttagccttaaaagaaactcttcccgtatatttcattacttgtctgagaaagaaatacaaaaattggcattttttttcgattgtaaagactattctctcgtaggtctgttgcttctcggctacacgaaattccagaaggatgatctggttcaatgcacggcttgctttcatcgagcatccctgaagaagttagaatatacagaatttaacggacacgctctatggtgtcggtattacaacaaagagttgttgcccacaatgttgctggagttaatcggcaaggaggacaaactaataacgaaattgggcgtgggagaaagactaaataaattagaggctgttctacaaactttataa

SEQ ID NO: 2249 - DNA, 1005 bp, Saccharomyces cerevisiae
atggccagcaagactttgagggttctttttctgggtcccaaaggtacgtattcccatcaagctgcattacaacaatttcaatcaacatctgatgttgagtacctcccagcagcctctatcccccaatgttttaaccaattggagaacgacactagtatagattattcagtggtaccgttggaaaattccaccaatggacaagtagttttttcctatgatctcttgcgtgataggatgatcaaaaaagccctatccttacctgctccagcagatactaatagaattacaccagatatagaagttatagcggagcaatatgtacccattacccattgtctaatcagcccaatccaactaccaaatggtattgcatcccttggaaattttgaagaagtcataatacactcacatccgcaagtatggggccaggttgaatgttacttaaggtccatggcagaaaaatttccgcaggtcacctttataagattggattgttcttccacatctgaatcagtgaaccaatgcattcggtcatcaacggccgattgcgacaacattctgcatttagccattgctagtgaaacagctgcccaattgcataaggcgtacatcattgaacattcgataaatgataagctaggaaatacaacaagatttttagtattgaagagaagggagaacgcaggcgacaatgaagtagaagacactggattactacgggttaacctactcacctttactactcgtcaagatgaccctggttctttggtagatgttttgaacatactaaaaatccattcactcaacatgtgttctataaactctagaccattccatttggacgaacatgatagaaactggcgatatttatttttcattgaatattacaccgagaagaataccccaaagaataaagaaaaattctatgaagatatcagcgacaaaagtaaacagtggtgcctgtggggtacattccccagaaatgagagatattatcacaaataa

SEQ ID NO: 2250 - DNA, 1005 bp, Saccharomyces cerevisiae
atgtgtgaagagaatgttcatgttagtgaagatgttgctggcagtcacggttcttttacgaatgccagacctaggttaattgtactaataaggcatggggaaagcgaatcaaataaaaacaaggaggtcaatggttatattcctaaccatctgatttctttaacgaaaacaggtcaaatccaagctagacaagctggtattgacttattacgtgttttaaacgtagacgatcacaacttggtggaggatttggctaagaagtatattaaagatgaaagtagcaggagaactttaccgctgaaggactataccaggctgagtagagaaaaagacacaaacatagttttttatacatcaccctatagaagagcaagggaaacattgaaaggtattttggacgtcatcgatgaatataatgaattaaacagtggtgttcgtatatgtgaagatatgagatatgatccacatggtaaacagaaacatgcattttggccgagaggacttaataatactggtggtgtttacgaaaataatgaagataatatttgtgaagggaagcctggaaaatgttatctgcaatatcgggttaaggatgagccaagaataagggaacaagattttggtaatttccaaaaaatcaatagcatgcaggacgttatgaagaagagatctacgtatggtcatttcttcttcagattccctcatggagaaagtgcggcagatgtatatgacagagtcgccagtttccaagagactttattcaggcacttccatgataggcaagagagaagacccagagatgttgttgtcctagttacacatggtatttattccagagtattcctgatgaaatggtttagatggacatacgaagagtttgaatcgtttaccaatgttcctaacgggagcgtaatggtgatggaactggacgaatccatcaatagatacgtcctgaggaccgtgctacccaaatggactgattgtgagggagacctaactacatag

SEQ ID NO: 2251 - DNA, 1005 bp, Saccharomyces cerevisiae
atgttgtcaagagtagctaaacgtgcgttttcctctacagttgccaacccttataaagtgactgttttgggtgcaggcggtggtattggacaaccattgtctttgcttctaaagcttaaccataaagtcacggacttaagactgtacgacctaaagggcgcaaaaggtgttgccaccgatttgtctcatattccaacaaactccgtggtcaaggggtttactccagaagagccagacggattgaacaacgctttaaaggacacagacatggttttaattcctgctggtgtgcccagaaagcctggtatgacacgtgatgacttgttcgccatcaacgcaagcatcgttcgcgatttggcagcagcaaccgccgaatccgctcccaatgctgccattctggtcatttccaacccagtcaattctaccgttccaattgtcgcccaagtcttgaaaaacaagggtgtttacaacccaaagaaattgttcggtgtgactaccttggactctattagagccgccagattcatctcagaagtcgagaacaccgatccaactcaggaaagggttaacgtcatcggtggacattctggtattaccatcatcccattgatttcgcaaacaaaccataagttgatgtctgatgacaagagacacgaattgattcacagaatacagtttggtggtgacgaagtcgtcaaagcaaagaatggtgctggctctgctacgttgtcaatggcccatgctggtgctaaattcgctaacgctgttttgtccggtttcaaaggcgaaagagacgtcatcgagccttccttcgtggactctcccttgttcaaatccgaaggcatcgaattctttgcatctccggtcactttgggcccagatggtattgaaaagatccatccaataggtgagttatcttcagaagaagaagaaatgctacaaaaatgtaaagaaaccttgaagaagaatatcgaaaagggtgtcaactttgttgctagtaaatag

SEQ ID NO: 2252 - DNA, 1008 bp, Saccharomyces cerevisiae
atgaataatggagacaataaaacgacattagaaaactcaaaaaatgcgtcactagctaatggaaattatgcgattcccacaaaactaaataggctgaaaaagaatgctgaccctagagttgctgcaatttcaggtgctttatctggtgcactatccgcaatgctggtctgtccttttgacgttgcgaaaacaagattacaagcacaaggtctccaaaacatgacacaccaaagtcaacattataaggggttttttggtacatttgctactattttcaaggatgaaggtgctgctgggctttataaaggtctacagccgacggttttaggttatattcctactttgatgatttacttttccgtctatgatttctgtagaaaatattcggtcgatattttcccacatagtccgtttctctcaaacgcttcttctgcaattactgcaggtgccatctctacagttgcgacaaatccgatttgggtagtaaaaacaagacttatgctgcaaacaggtatcggtaaatattccacccattataagggtaccatagacacatttagaaagatcattcaacaagagggtgctaaggctctttatgccggcttagtaccagccctgctggggatgctgaacgttgctatacagtttcctttatatgaaaatttaaaaataaggttcggatattcagaatcgactgacgtatcgacagatgtgacgagctcaaactttcaaaaattaatattggcctctatgctatctaaaatggtagcatctaccgtgacttatcctcacgaaatacttcgaactcgaatgcaactgaaatccgatcttccaaatactgttcaacgccatctccttccattgattaaaattacgtataggcaagagggcttcgccggcttttactctgggtttgcaactaatttggtaaggacagtacctgctgctgtggtaacactagtatcgtttgaatattctaaaaagtatttaactactttttttcaataa

SEQ ID NO: 2253 - DNA, 1008 bp, Saccharomyces cerevisiae
atgatgtcagtcaatagatttacttcaggtcgactccctgttttccttagaaagtcccctttttactactcgagagcttatttgcatcaaacatgtgttttcaagcaaaataaagaaactgcacaagattcgccagagcttttagcaaaaagctcacatctgaattcgaaaccactagatgtaagcaataaagcaccagtgaaaactgctcagaataaaattcctctagctcatagtaaatatgaatcgtcaaagtacgaacttcccaaatggaaagaagccttgggtgaactagtaattcgagcatttcatttagatatggatagagtgagggcagggcccgttgcaggatcttactattataaaatttgtaaagagcaaggtttacaatacgaggacgagccattatcagaaactgctaaatacttttacgaggatttgaagctaccacgtactttttcacaatggtttcaaatcactgtattgcacgagtggatactttttgtacgtatgagagccatgcctttcaaatacggcagaaactatcagcagaaattggtagatagaacattttctgacattgagctgagattattcgaggaaatgaaagttaattctggtagaatcgcagatcaatatttgaaagatttcaatacgcaattaagaggagcgatatttgcatatgatgaaggatttgctacagatgatggtacacttgcgacagctgtctggagaaatctttttggtggaagaaagaacattgatatggttcatttagagtctgttgtgagatacatttattctcaactatatgttctaagcaggttatcagacagagagtttgccacaggtaaattcaagtttgttcctcctggggtgaaggtcgaaaaactgacaccaaagcaagaggaagagttgaaggccaagaccattgcaaaatatgaagctctagacaaggatcctaaaaccttaccaagcgagagaagtaggctgtcatatacaaactaa

SEQ ID NO: 2254 - DNA, 1008 bp, Saccharomyces cerevisiae
atgcactcacaccattcacactccggtgactatagtgcccacggtacggaccctttggattccgtggtcgatcaagtggtcaacctcaactttcacacgtactgtttgacagagcacataccaagaattgaggccaagtttatataccccgaagagcagtcattgggcaagaatcctgaggaagtcataaccaagctagaaacatcgttcaagaatttcatgagtcatgcgcaagaaatcaagactcgttatgctgatagacccgatgtgcggactaaattcattataggaatggagatcgaaagttgtgacatggctcatatcgaatatgcaaagcgactcatgaaggagaataatgatattttgaagttttgtgtgggttcggtccatcacgtcaacgggatccctattgatttcgaccaacaacaatggtacaattcattgcattccttcaatgataatttgaaacattttctcctgtcttacttccaatcacagtacgaaatgctgatcaatattaaaccgttggtcgtgggtcacttcgacctttacaaattatttttgcccaatgacatgctagtaaaccagaaatcgggcaactgcaacgaagaaaccggagttcctgtagcttcactggacgtcatcagtgaatggccagaaatatacgatgcagttgtaagaaatttacaatttatagactcctatggcggcgcaattgaaatcaatacgtccgcattaagaaagcgcctcgaggagccgtaccccagcaaaaccttatgtaatctggtcaagaagcactgtggatccagatttgttctaagtgatgacgcacacggcgtggcgcaagtgggtgtgtgctatgacaaggtaaagaaatacatagtagacgtgctacaattagagtatatttgctaccttgaggaaagccaatcaccagagaatctgttaactgtaaagagattacccatttcgcaattcgttaatgatcccttttgggccaatatataa

SEQ ID NO: 2255 - DNA, 1008 bp, Saccharomyces cerevisiae
atggaggccaagatagatgagctgatcaataatgatcctgtttggtccagccaaaatgaaagcttgatttcaaaaccttataatcacatccttttgaaacctggcaagaactttagactaaatttaatagttcaaattaacagagttatgaatttgcccaaagaccagctggccatagtttcgcaaattgttgagctcttgcataattccagccttttaatcgacgatatagaagataatgctcccttgagaaggggacagaccacttctcacttaatcttcggtgtaccctccactataaacaccgcaaattatatgtatttcagagccatgcaacttgtatcgcagctaaccacaaaagagcctttgtatcataatttgattacgattttcaacgaagaattgatcaatctacataggggacaaggcttggatatatactggagagactttctgcctgaaatcatacctactcaggagatgtatttgaatatggttatgaataaaacaggcggccttttcagattaacgttgagactcatggaagcgctgtctccttcctcacaccacggccattcgttggttcctttcataaatcttctgggtattatttatcagattagagatgattacttgaatttgaaagatttccaaatgtccagcgaaaaaggctttgctgaggacattacagaggggaagttatcttttcccatcgtccacgcccttaacttcactaaaacgaaaggtcaaactgagcaacacaatgaaattctaagaattctcctgttgaggacaagtgataaagatataaaactaaagctgattcaaatactggaattcgacaccaattcattggcctacaccaaaaattttattaatcaattagtgaatatgataaaaaatgataatgaaaataagtatttacctgatttggcttcgcattccgacaccgccaccaatttacatgacgaattgttatatataatagaccacttatccgaattgtga

SEQ ID NO: 2256 - DNA, 1008 bp, Saccharomyces cerevisiae
atggcagctgcaccatggtatattagacagcgtgacacggatttattgggtaaattcaagttcatacagaatcaagaagacggcagattaagggaagctacaaacggaacggtgaattcacgatggtcgttgggggtcagcatagaacctcgtaacgatgctagaaacagatacgttaacattatgccgtatgagaggaaccgcgttcatttgaagactctatccgggaatgattacattaatgcctcgtatgtcaaagtgaacgtgccagggcagagcatcgaaccgggctactatattgctactcaaggtcccacgcgtaaaacttgggatcagttttggcaaatgtgctatcacaattgtcctttagacaatattgtcattgtgatggtcacgcctctggtagaatacaatagggagaagtgctaccagtactggcctcgcggtggtgtagacgatacggttagaatagcatcaaaatgggaaagtccgggcggcgccaatgatatgactcaatttccctctgatttgaaaatagagtttgttaacgtacataaggtgaaggactattatacggtcaccgatatcaaactcacacccacggaccctcttgtaggacctgtcaaaactgttcaccacttttacttcgacctttggaaagatatgaacaagccagaggaagtagtacccataatggaattatgcgctcactcccacagcttgaattcccgcgggaaccccattatcgtacactgttccgcaggcgtgggcagaacggggacgttcattgccctagatcatctcatgcatgataccttggattttaaaaatattacagaacggtcaaggcattcagacagggctacagaggagtacacacgggacttgatcgaacagatcgtgttacagttgcgctcgcaaagaatgaaaatggttcagacaaaggatcagttcctatttatctaccatgctgccaagtatcttaacagtctttccgtgaaccaatag

SEQ ID NO: 2257 - DNA, 1008 bp, Saccharomyces cerevisiae
atggcattccaagatccaacttacgaccagaataaaagcagacacatcaacaacagtcacttgcaagggccaaaccaggaaacaatagaaatgaaatctaaacacgtatcattcaaaccctctagagacttccatacaaacgattactcgaataactacattcatgggaagtcgctaccgcaacagcatgttactaatattgagaatagggttgatggctatccaaaacttcagaaattatttcaggcgaaagctaaacaaataaatcaatttgccactacgccatttgggtgtaaaatcggaatagattccattgttccaacgttgaatcactggatacagaacgaaaatttgactttcgacgtggtgatgattggctgcttaacagaaaatcagtttatttacccaattttaacccaattgccattggatagattgatctccaaaccaggtttcctgttcatctgggccaattctcaaaaaatcaatgaacttactaaacttttgaataatgaaatatgggctaaaaagtttagaagaagtgaagaattggtttttgttcctattgacaagaaatcaccgttttatccaggtttagatcaggacgatgaaacgttgatggaaaaaatgcaatggcactgttggatgtgtatcacaggtacagtaaggaggtctacagatggacatcttattcattgtaacgtagacactgacttgagtatcgaaacgaaggacaccactaatggtgctgtaccatcccatttgtatcgtattgcagaaaacttctctaccgcgactagacgattacatattattcctgcaaggactggttacgagacacccgtcaaagtaagacctggctgggttatagtgagcccagatgttatgttggataacttctcacccaagagatataaagaagagatagctaatttaggttcgaatatcccattaaaaaatgagattgagctgttaagaccaagaagtccagtacaaaaagcacaataa

SEQ ID NO: 2258 - DNA, 1008 bp, Saccharomyces cerevisiae
atgggtatcgatcacacttccaagcaacacaagagatctggtcacagaactgctccaaagtctgacaatgtctacttgaaattgttagtcaaattatacactttcttagctcgtatgttcaagaataatatcaagggttttaaccaacgccaattatggttagaaggattctgttacattgaatataatagattatcctgaactttggtaagttcattggttttctataaatattcgttatggtttgctgaaaaatattggttaatgtttttcgcgatcatctagctttgcttctgatgtgacaaattattggtcaatttattgaactgaatctggctaaaatagtcataccagaagaagctagacgtattaaaattctgcgagtgcaaacgggtatatttgaggaacgatatgtttcttttacatcacgttttgtgcggtattgcaaaccagtgagcagaatctttttctaatttaatgaaatatttgtacggaaaactattgttttccggtccttcgatccattagttactaacattttttcattttttttttttaggtcgtactgatgctccattcaacaaggttgtcttgaaggctttgttcttgtctaagatcaacagaccacctgtttctgtctctagaattgctagagctttgaagcaagaaggtgctgctaacaagactgttgtcgttgttggtactgttactgacgatgccagaatctttgaattcccaaagaccactgttgctgctttgagattcactgctggtgccagagccaagattgttaaggctggtggtgaatgtatcactttggatcaattagctgtcagagctccaaagggtcaaaacactttgatcttgagaggtccaagaaactccagagaagctgtcagacacttcggtatgggtccacacaagggtaaggctccaagaatcttgtccaccggtagaaagttcgaaagagctagaggtagaagaagatctaagggtttcaaggtgtaa

SEQ ID NO: 2259 - DNA, 1008 bp, Saccharomyces cerevisiae
atggttaatgaaaaagtgaatccattcgacttagcttcggtttctcctttagtcttaggaggtgcaatactgaaccagcaatatacagatgagccagaatccattccactggaagacataatcaaatacgcattttcgcatggtatcaatgcaattgacacttctccctactatggccctagtgaggttctttatggtagggcactgtccaatttaaggaatgaatttcccagagacacttattttatatgcacaaaggttgggcgtattggtgcggaagagtttaactattctagagatttcgtgagatttagtgttcacagatcgtgcgaaagattacacactacatatctcgatttggtgtacttgcacgatgtcgagtttgtcaaatttccagacatcttagaggcattaaaggaattgaggaccttgaagaacaaaggagttatcaaaaattttggcatatcaggctacccaatcgactttatcacctggcttgctgagtactgctctaccgaggaaagtgatattgggtcattggatgcagtattgtcctattgtaacttgaacttacaaaacaataagctattgaactttcgagaaagactgctacgcaatgctaaactgaaaatggtttgcaacgcatcaatcttgagcatgtcgctactaaggtcacaggagacaagacagtttcacccgtgttctcatgaattgagagaatgcgcatctcaggctgccaaatactgtcaagaacaaaatgtcgacttagccgatttggccacaagatacgcgatttcggaatgggtaggaaagggacccgttgttcttggagtcagtagcatggaagaattgaaacttgctctggataattacgaaattgtgaaatcgaatggcaacagattatcttctaaggacggacaactagtagaatatatccaaaagaatatttttaaagaacattttaatgaagagtggtcttcaggtattcctcatccagaaatgatataa

SEQ ID NO: 2260 - DNA, 1008 bp, Saccharomyces cerevisiae
atgtcaaatattgtgggtattgaatataaccgtgtaacgaatacaacctccacggattttcctggtttctcgaaggatgcagaaaacgagtggaatgtggaaaaattcaaaaaggacttcgaagtcaatatttcgtcattagacgcaagagaggcaaatttcgacttgataaacattgacacatcgattgcgaatgcctttcgtcgtataatgatttccgaggttccatccgtggctgctgaatacgtctatttttttaacaatacatccgttatccaagatgaggttttggctcatagaataggcttggttccattaaaagttgaccctgatatgctcacatgggttgatagtaatttgccggacgatgaaaagtttacggatgaaaatactatcgttttgagtttgaacgtgaagtgcacaagaaatccagatgctccaaagggatctactgatccaaaggaactatataacaatgcccatgtctacgcccgtgatttgaagtttgaaccacagggcagacaatctaccacttttgctgattgtccggttgttccagctgatcctgatattttattagctaagctaaggcctggtcaagaaatttcgttgaaggcacattgcattttaggtatcggtggtgatcatgctaaattttcaccagtttccaccgcttcttatagattattacctcaaatcaatatcttacagccaatcaaaggtgaaagtgccagaagatttcaaaaatgttttcccccaggtgttattggtattgatgaaggttcagatgaagcgtatgtcaaagatgctaggaaggatacggtttccagggaggttttaagatacgaagagtttgctgataaagttaaattaggaagagtgaggaaccactttattttcaacgtagaaagcgctggtgccatgacaccagaagaaatttttttcaaatccgtcaggattttaaagaataaggctgagtatttgaaaaactgtccaattacccaatga

SEQ ID NO: 2261 - DNA, 1008 bp, Saccharomyces cerevisiae
atgtctgaaccagctcaaaagaaacaaaaggttgctaacaactctctagaacaattgaaagcctccggcactgtcgttgttgccgacactggtgatttcggctctattgccaagtttcaacctcaagactccacaactaacccatcattgatcttggctgctgccaagcaaccaacttacgccaagttgatcgatgttgccgtggaatacggtaagaagcatggtaagaccaccgaagaacaagtcgaaaatgctgtggacagattgttagtcgaattcggtaaggagatcttaaagattgttccaggcagagtctccaccgaagttgatgctagattgtcttttgacactcaagctaccattgaaaaggctagacatatcattaaattgtttgaacaagaaggtgtctccaaggaaagagtccttattaaaattgcttccacttgggaaggtattcaagctgccaaagaattggaagaaaaggacggtatccactgtaatttgactctattattctccttcgttcaagcagttgcctgtgccgaggcccaagttactttgatttccccatttgttggtagaattctagactggtacaaatccagcactggtaaagattacaagggtgaagccgacccaggtgttatttccgtcaagaaaatctacaactactacaagaagtacggttacaagactattgttatgggtgcttctttcagaagcactgacgaaatcaaaaacttggctggtgttgactatctaacaatttctccagctttattggacaagttgatgaacagtactgaacctttcccaagagttttggaccctgtctccgctaagaaggaagccggcgacaagatttcttacatcagcgacgaatctaaattcagattcgacttgaatgaagacgctatggccactgaaaaattgtccgaaggtatcagaaaattctctgccgatattgttactctattcgacttgattgaaaagaaagttaccgcttaa

SEQ ID NO: 2262 - DNA, 1008 bp, Saccharomyces cerevisiae
atgtgtgcaaagaagctcaaatacgctgctggcgatgactttgtacgctatgctacacctaaagaggccatggaggaaactagacgtgaattcgagaaagagaaacaacgacagcaacaaataaaggttactcaagcacaaactcccaacactagagtccactcagctccaattcccttacaaactcaatataacaaaaacagagcagaaaacggtcaccactcctatggttctccccaaagttattctccaagacatacgaaaacacctgtggatcctagatataatgttatcgcacagaaaccagcaggcaggcctatacctccagcgccaacccattataacaacttgaacacttccgctcaacggatagcttcctctcctcctcccctaattcacaatcaagcagtgcctgcacaactcttgaagaaagttgcacctgcttcgttcgatagcagagaagatgtacgagacatgcaagtggccacacagctatttcataaccatgatgtaaagggcaaaaaccgactgacagctgaggaactacagaacttactacaaaacgacgacaactcccatttttgtatatcatcagtagatgcgctgataaatttatttggtgcttccaggtttggcactgtcaaccaggcagaattcatcgccctatacaaaagagtgaaaagttggagaaaagtttatgtggacaatgatatcaacggatcgctcaccatttctgtaagcgaatttcataactcacttcaagaactaggatatctaataccttttgaagttagcgagaaaacatttgaccaatatgctgagtttataaacagaaatggaacaggaaaagaactaaagtttgataaattcgttgaggcgttagtttggctaatgagattaacaaaattattcaggaaattcgatactaatcaagaaggcattgcaaccatacagtacaaagattttatcgatgctacattatatttaggtcgtttcctacctcattga

SEQ ID NO: 2263 - DNA, 1008 bp, Saccharomyces cerevisiae
atgttgaggttatctttactgagatcaacagctactttgccagtgaaatgccaacgtcgtgggctaatattacctgcggcggcaatgtacaccttaggctcattaatatttggtaaggaagcaaggttggcggatgccatggaacgtggtgagttacataacaagaacgttgattatgcgaaagaagctgaagagcgtaccgagttacgtattagggccctggctaatactcggccaatggaacctcggtacaacggccatgttccccttcatcggtacgagaaattgctgctgtttgcaatttccggttggaattcatttttccatcctgaagatggttataatattgtacaattgggtgaggcaactgcattgccggtcttcttggagaatttgaagcaaacaatgttaagtgattcctctgggaggcgcattttgaaggaacaacccaatatcacaacagagattttgcatatggacaaactagctaaattgccacataacacgtttgggtatgtatattaccaatggttgaaaagagaaaacgtttctccggacactagagcacctgtcaaatttatcgacgatcctatgcatgcatatatctttaagaggtatagacaatgccacgatttctatcacgctataaccaacatgcctattatcattgagggggagatcaccataaaggctcttgaaggtgccaacctgggcgtcccaatggccattctcggtggtatccttgcacctttacgtttgaaaaaggtgcaaagaaaaagattatataatatatatctcccttgggctgtcagaacaggtttaagctgcaagccattgatcaacgtgtattgggaggaaatgctggagaaggatgttactgctttgaggaaagagctaaagataacactccctccggatctaaggacaatgaggaaggagcgtgcagcccttaggaaggagattgacgcaaaatacaactcacagaaacgagccacgactccagcatga

SEQ ID NO: 2264 - DNA, 1011 bp, Saccharomyces cerevisiae
atgaatgacaggctttcgttgacaagtctgtttcccaggtgtttgaccacatgtttgtatatttggactgcatacataacattgacaaggattcatcaaatacctaggtggtttctcgcgctaacaatagttccgacattggcagtggctctatacacttattataaggttattgctagaggtcccggttctcctctagatttccctgatttgttagtccacgatttaaaggcagcggaaaatggacttgaacttcctccggagtatatgtcaaaaaggtgtttgaccttaaaacatgatggaagatttcgggtgtgccaagtatgccatgtttggaagcccgatcgctgtcatcattgttcatcatgcgatgtttgcatattgaaaatggatcatcattgcccttggttcgctgaatgcactggttttaggaatcaaaaattttttattcaattcttaatgtacacaacattatacgcgttcttagtcctaatttatacttgctatgagcttgggacgtggtttaactccggtagtttcaaccgtgaattgatagattttcatctattaggggtggccctattggcggttgctgttttcatttctgttttagcatttacctgtttcagcatttatcaggtttgtaaaaaccaaactactatcgaggtacacggaatgagaaggtatcgaagggatcttgaaatcctcaatgacagctatggaacaaatgagcatttagagaatatatttgacttgggttcttcaatggccaactggcaagatataatgggtacatcttggttagagtggatacttcctattgagaccttcaagtacaaaaagtctaaacacacaaaggatgaaaaaggtttatattttaatgtaagacctcaagtacaagaccgactgctaagtagtagatgtttagaagatcaattactgagaagagtaacaccaagaccctcattagaagccgatagggcgtctgtagaaattatcgatgcaaattag

SEQ ID NO: 2265 - DNA, 1011 bp, Saccharomyces cerevisiae
atggaggtacatgaagagcaggtctctgcacctgtaacaggggatgctacagcaaaatatctgctgcaatatatcttgtcagcaagaggcatttgccatgaaaatgctctcattctagccctaatgagattggaaaccgatgcttcaacgcttaacactgaatggtcgatccagcagtgggtcgacaagctaaatgattatataaacgctataaacgtaaaactgaaccttttgggttacaagatcattcggatcaaccacgggattggtagaaacgcagtgactttaaaggccaagcagaattttgagtccttcgaagataatacagcaataagggctcacaataatgattatgcagttttgcaatcgatagtacttccggagagtaacaggtttttcgtatatgttaacttagcatcaacagaagagactaagttagccacaaggtttaaccaaaacgagatcgagtttatgaaatgggccatagaacaattcatgatcagtggagagactatcgttgaagggcctgcactggaaacctcgataattgtgaaggaagtcaaccgtattctagtagcagctacaggagactcaaacctcgcgaaatggcgtaagttcagtacgtttactgtagggtccaccaatcttttccaatttcaagaattaacagcaacggacatcgaagacttactactccgattatgcgaactgaaatggttttacaggactcaggaagggaaattcggtattgatcttcgctgtatagcagaactagaagagtatctaacatccatgtacaatttgaacacttgccaaaattgccacaagctggcaattcaaggtgtcaggtgcggcaacgaatcatgccgagaagagaatgaggaaactggagagaatagtctgtctcaaatttggcatgttgattgtttcaagcattatattacccatgtaagcaagaattgtgatcgttgcggttcatcgctaatcacagagggcgtatacgttatttaa

SEQ ID NO: 2266 - DNA, 1011 bp, Saccharomyces cerevisiae
atggccaggaaattgaagggtaagattgggagtaaaggcctaaaaggtgcattattaaggcacaaggccaaagtgaaattagtgaggaatattgaaagtaagcaaaaacatgaactaagaaagaaaaattcgagcgctaataacaaaaccgtgaagagaaaccaagaattccaaaaacttaatcaagggaaggttatgccctttgagaaggatgaaactttgatgctatgtggtgaaggagatttttcttttgccagatccattgttgaacaaaactatattgaaagtgacaatttaatcataacaagttacgataattctgtgaatgagctgaaattgaaatatccgcatacttttgaggaaaattaccagtacttaaaagatctaaatattccgatatttttccagattgacgttacgaagctcgtaaagagctttaaaatttccaaaaataatacttggtttaaaataatcaacaggcttagcgatcatcgttggggtaacaaacctttacaaaatatagttttcaattttccccataatggaaaaggtattaaggatcaagaaagaaatattagagagcatcaggacttaatttttaactttttccaaaattccttacaattatttaatcttataaacacgaaaattcaaaatgatactcttcgttatacgcaaggctatgatcttaatgaggatactccccaggctaaaaaattgaccgccgaaggttatggtaacatcatactgtcccttttcgatggagagccctatgattcatggcaaatcaaacttttagccaaaaaaaatggactaactctgagcagatcgagcaaattccaatgggaaaattttccaggatatcatcaccggagaacgaatagcgaacaagatactacaaaacctgcgaaagaacgtgatgctaggttctacatctttagtaaatatgtctcgaatagttcaaaacataaccgtaaaagcaaaaaagacacagattctgattcagactaa

SEQ ID NO: 2267 - DNA, 1011 bp, Saccharomyces cerevisiae
atgggttcaataagtagataccttcttaagaaagcagcagatgggcttaaagatgagcagagattgaagattgaaatgtccgatagcaaaagtgtcccagagtgctttcattttaatagggaaagaagaatgcccatagccgagataaacggcgaggatgggtttttcatgtttccgtctcagcaatcgcttgaaaattttgaaaacactaaaaagtattcgaatgagctgagtccagatgcaattggtattccattattccaaattatcaattgcactctaccgtttggtaaaagaggtcatagcaatactgtggtcggcaatgtcccatattataaaattttcaaatttattttaagaacggcagacgaacctccgccttatactgtggcaaaaatcgtttgctcaaacaacggattaatattgtataaagtgcctctttacgacatatataaaaatgtcagccaagcaaacgtaacttacagcttcgtagggactacgtctacggagcccaacttactagcaatggctcaccgagaaggacacagggatttggacactaaagtgaataatttaaatctcaggtggcatgtcacttattcgcccgtagttaccaacgatcattataaattaattctgttagcagattatgaagtgaatcgtttggatgaagatgtcattagagccgctaaaaataagatgtccatcgaccaaaaggatcaaaaagttcagaggttcgtggcagctcattatactagagaatttgaaacatctctttttaggtgggtcgctcaagagggccacttaattcttggcgagtattccacagatcaaggatcatttggattgaataatatcccaccattgacggaagaactcgggtgtcagagcctgctcatacattacatagagtacatgaagagacaacgtaaaaaaattgcgaaagaggcaaggagacaaaataaaagaaacgttgcaaacacgactaacatgaacatgaacctcatgtaa

SEQ ID NO: 2268 - DNA, 1011 bp, Saccharomyces cerevisiae
atgtcatggaatctactatttgtgctgctaataggattcgtagttttgatattactttcgcccgtcttcaagtcaacatggccattttcgactttctatcgtaatgtgtttcagcccttcctagtggatgaccaaaaatatcgttggaagttgcatttagtacctcttttctacacctctatttacctgtacctagtatatacataccacatgagagtggagtctacgattaagaatgagctattccttttagaacgaatactgatcgtgcctataattatactaccgccggtagcattaggaattctagccatggtaagcagagctgaggattcaaaggatcataaatcaggctcgacagaggaatatccatatgattacctattgtattatcctgccataaagtgttcgacatgccggatcgtcaagcctgctagatccaaacattgtagcatttgcaaccgatgcgttctcgtcgccgaccatcattgcatctggataaataactgcatcggaaagggaaactaccttcaattctaccttttcctaatttccaacatattctcgatgtgctacgcctttctaaggctgtggtacatttctttaaatagcacaagtacgctccctagagctgttctgactcttaccatattatgtggatgcttcactatcatctgcgctattttcacgtatcttcaattggccattgtaaaggagggaatgactacaaatgagcaagataaatggtataccattcaagagtatatgagagaaggaaaactggtgagatcattggatgatgattgcccatcttggtttttcaaatgcacagaacaaaaagatgacgctgctgaaccactccaagatcaacatgttacgttttatagcacgaatgcctacgaccataagcactacaaccttacacactacatcacgattaaagacgcgtccgaaattcccaatatatatgacaaaggtaccttcctggccaatctcacagatttaatatag

SEQ ID NO: 2269 - DNA, 1014 bp, Saccharomyces cerevisiae
atgaaaatttccgcagctttaatattgtcttccctttcttctgtcgcattttctgcccctgcacctgctccagcggacagtcaccatgaagatcatcacaaagatgaaaaaccagcggttgtcactgtcactcaatacatagattccaatgccgctactagtactgtagaatctgctgctactaccactacattgtcctcatctgagaaggatacctctgaacagaagcgtgatggcggattccaagatggtactgtcaaatgttcggacttcccttctgtaaacggtatagtttccttggactggctaggatttggtggatgggcctctgtcatggacatggatgccaacacttcgtccgaatgtaaggatggctactactgttcttatgcatgtgaacctggaatgtcaaagactcaatggccttctgaccaaccaagcgatggtaaatctgttggtggtctttactgtaaaaatggttacttgtaccgtaccaacactgataccagcgatttatgttctacggatgaaacatctgctaaggccattaacaaaaagtctgactccattgctctatgtaggacggattacccaggatcagaaaacatggtgattcccacagtggttgatggtggagattcacaaccaatttcagtcgttgatgaagacacttattatcaatggcagggtaaaaagacttctgctcagtactatattaacaacgccggtgtatctgcagaagatgggtgcatttggggtacttctggttcggatgtcggcaactgggctccactagtgttaggtgctggttccactaatggagaaacatacttgtcgttgattccaaaccccaacagtaaccaagctgccaactttaacgttaaaatagttgcatccgatggcgctaacgttcagggcagctgtgcgtatgaagatggctctttcaccggagatggttccgatggttgcacagtttctgttttatctggatctgctgaatttgttttctattaa

SEQ ID NO: 2270 - DNA, 1014 bp, Saccharomyces cerevisiae
atgaacaggattaagaatacattttctgttgctaagagattaaaactaagcaaagttatgacgaactcagaattaccgagcatattcgaaggaactgttgatttagggattattggtggtacaggtttatataaccttgactgtctggagcccatcgctttgcttccacccatggtaacaccatggggtaccacatcgtctcctgtcacaatctctcagttcgtaggaactaacagccactttcacgttgcgttcatagccagacacggtattaaccacgaatacccacccactaaagtcccatttagagcaaacatggcggccttaaagaacttaaattgtaaagccgttctttcttttagtgccgtggggtctttacaaccccatataaagcctagagattttgtgttaccacagcaaataatcgacagaactaaaggcataagacattcttcatatttcaacgatgaaggcttggtaggtcacgttggtttcggacagccgttctctcaaaaattcgcagagtatatctatcaattcaagaacgagataacaaatcctgaatccgaagaaccgtgccatttgcattacgacaaggatatgaccgttgtgtgtatggaaggcccacaattctccacgcgcgctgaatccaagatgtacagaatgtttggtggccatgttattaacatgagtgttattccagaagccaaattggcgcgtgagtgtgagctgccttaccagatgatttgtatgtctaccgattacgacgcatggagagatgaggcagaacctgttaccgtagaaaccgttattggtaatttgacgaataatgggcgcaatgcaaatattttagcttctaagatcatcgtctcaatggccaaggaaatcccagagttcatgcatactggcgatgggctgcgcggttccatcaagaaatctatctctaccaaaccagaggctatgtccaaggaaaccttagaaagactaagatacttatttccaaactattggtaa

SEQ ID NO: 2271 - DNA, 1014 bp, Saccharomyces cerevisiae
atgaagaatgataataagttgcaaaaggaagcacttatgcgactatcgcagctaagatttccatttgccgatgctccaagtatagtacaagcgcatcaaaaagatgaacaaatccagggccttttgattatgaaagtgactgaattgtgcaaattgataaagagtcaattgtttgttaactcttaccctaaggaactgtccatatttgccaagctcctgtatttgctctttactacaggaagacgtggtagaacgttaggtgaggaatatgttgacttgacatacactaataggaagggtaccagacttgcaggacggctcaaaatgattgtattcgctttcgcttatcctttatgtccatatttcatcaccaaactatacaagaaaataatgaagaacaacaaggaaagtaaaattgaagatactgaaagtgttgccgcgttttgtaagggccttttagatttcattttagacgtacacatgaccctcttttatttcaaaggagctttttacagtatttccaaaaggatttttggtatgagatatgtttttaaacatatattgtcaaaaaatgaggccaattttagagaagagggctcacaaaagtacaaagtattaggttatatcctattagctcaaaatgttatgaaatggtaccctgtcctaacctctacgctcgggtcctggatttatgggagaaaaaggaccaatgattcaattactaggtcgtctgttggtctacaggagcgttcagaacatgaatctatagaaggcataccgaaggaatcgcagctgactcatataaatttgtcagataaaaaccaattgccatttattccagaagcctcgagaaaatgcatcctatgtctcatgaacatgagtgatcctagctgcgcgccatgtggacatctattttgttggagttgtcttatgagctggtgtaaagagaggccagaatgccccttgtgcagacaacactgtcaaccacaggaaattctggtcctgcggcaatag

SEQ ID NO: 2272 - DNA, 1014 bp, Saccharomyces cerevisiae
atgagtcagtcttacgaagcaggaaatgccaatatgggccaaggggaggatgatgaatttgatggctatttcgaagactttgacaacgatatcatgccaaatagtaataatggacaaagggttggtactaatgctggattgtcattcaatgacgaagtaaatgttaatgatgatgattttttagacatttataatatgtcccctagagagagattgatgcataatatcaggaagaatgttcaaaaattacagttttatttttattcactacgcttatggcaacagattatcattgtcctcctcggcataatgctaatgataatgggtatattgttgctcgtcttccataatgcgattttacataaagttgttgttacttcgaacgatttgagagaaaagatgtcaacacattttatattaatggttctgatattctttgtcgcatttcctcctatgattggctactccttattatccaccactactgggttgatctatggtgtcagttttgagggatgggttacgctagctttgggatctgtaacaggttccattgcctctttcgttgtgttcaagacgatcttgcattcaagagcagaaaagcttgtgcatttgaatagaagatttgaagcattggcttcaattttacaagaaaacaatagctattggattctagctctactgagattatgtcccttcccatattctttgactaatggtgccatagctggtgtttacggtatctcggtacgcaacttttccattgccaacataataaccacaccaaagctgttcatctatctatttataggttctcgtgtaaagagtctcgcagaatctgaatctacaggatctagggtatttgacttggtaagcattattatcacattattaatcctaagtcttacagcatggctcttatacttcaagactaagaagagatatttagaactacaaaaccgcgaccgtcaagtgtccactgatcaactacctgaattgtcttttgaggtctaa

SEQ ID NO: 2273 - DNA, 1014 bp, Saccharomyces cerevisiae
atgatggacaagcataagtatcgtgtggagattcaacagatgatgtttgtctctggtgaaattaacgacccacccgtagaaaccacatcactgatagaagatatagtgaggggtcaagtgatagaaattcttttacagtcaaacaaaacggcgcatcttaggggaagtaggagcattctccctgaagacgtcattttcttgatcagacacgacaaggccaaagtcaatcgtttgagaacatatctgtcatggaaggatttgcgtaaaaacgccaaggaccaagatgctagtgccggtgtagcgagtggcactggaaatcctggggcaggtggtgaagatgatttgaaaaaagcaggtggtggcgagaaagacgaaaaagatggtggaaacatgatgaaggtcaagaaatcccaaattaagctgccatgggaattgcagtttatgttcaatgaacatcctttagaaaataatgacgacaatgatgatatggatgaggatgaacgagaagctaatatagtcactttgaaaaggctgaaaatggctgacgatagaacacgaaacatgactaaagaggagtacgtgcattggtccgattgtcgacaggcaagttttacatttaggaagaataaaaggttcaaggactggtctggaatttcgcaattaactgaggggaaaccccatgatgatgtgattgatatactggggtttctaacttttgagattgtctgttctttgacggaaacagctctgaaaatcaaacaaagagaacaggtattacagactcaaaaggacaaatcccagcaatctagccaagataatactaactttgaatttgcatcatccacattacatagaaagaaaagattatttgatggacctgaaaatgttataaacccgctcaaaccaaggcatatagaggaagcctggagagtactacaaacaattgacatgaggcatagggctttgaccaactttaaaggtggtagactcagttctaaaccaattatcatgtaa

SEQ ID NO: 2274 - DNA, 1014 bp, Saccharomyces cerevisiae
atgcattcaagaaagtcgaagagtattacgggcaagaggaagcaagtaggaagtaacgtgacgagagtaatcaagccacagaagacaagaaggataataagaagattccaccatttaattaataagcgtcaatcgatatgcaagtttttatgccttaaggaaaacctagatgattccaacgaggagaagaatgacaaaattatcaggttaagtattaaaggtaatgtaagactgggcaagtactatgaagacggcaaatcgcagtccttcaatgatgctatggaatcacaactactgaggctgcactcattaattaaaaatgaatccaaatcaaaggatacttctgacttggctgtgatgtacacattacttggttacataatgaatcagattaataaattgggaggactagaaacttaccaaattgccagtcaaaacgggcaattgaaggaacgaggaggagacacgtccaagttgctcgagaaatggatcaggtcctcatttgaaaattgtcctggagcagtggcattagaaattggttcattgagctccggaaatcgcatatcccgttgtgcactttttagaaatgtggttcgtatagatttagaggaacatgaaggcgttattaagcaggattttatggaaagaccgctaccgagaaatgaaaacgacaaattcgacctgatatcatgctctctagtgctaaattttgtcaaaaatcacagggatcgcggtgcaatgtgccatcgcatggtcaaatttctcaagccgcaaggctacatctttattgttctgccacaagcctgtgtgacgcactcaagatactgcgacaaaacactgttacaaaacctcctcggctctatcgggctcataatgcttaatagccatcaaagtaataagttgtactattgtttgtatcaattgcaggtagttccaccgcagccgagtagcttttccaaaagaatcaaggttaacgacggccctgggttgaacaattttggtattaccctctaa

SEQ ID NO: 2275 - DNA, 1014 bp, Saccharomyces cerevisiae
atgccgaccaagtcaacttttagtcgctggaagaaggcggacctaattgacctggccaacaagctggaaattgacggcttccccaattatgccaagaagagtgatatgatcgattacctcgaatcgcacttgaatcatcttgagaaacctgtggattttaaagacgactacccggaactaaggtccttttatgagtcgatgacagtggaccagtcaaaggatgaacggaacgaatacggatccggatctggaaacgggtctgggtctggatcctgtgacaccgccacaaatgattccgatctggagaaagcgtacatcaaggaggatgatgatgagaaaccgcaatcaggcgatgaaacaagcgcgacaaagccgctttccagcaggaatgcaaattcaaacgccaaaacgaacttcaatttgttggattttagcacagataacgactcgtccacctctgcgtttactaagttcaagtttaactttcaggaatacctctccgatattagataccaaacgcagaaattgaatgaaaatgttcaggactatctttccactatttccgccgtcgatacgattttttccttgttggaattctcttttctggtgagaaacatattagccgccgggcagccaacttcttcttcttcgctcgcatcgtcgctggaagccgccgttgccgcccataataaatatcaatacacgctcgatttctgtttaccaatactcacgtggctgctcttctttaggggtattccaacgttagtgtcatactacatcaacttcatccgctacgacctgaacatcgagttggacccgatgactttcaatctcacgaaattcttgatttctttggcaatcttcaaaacttgtaataataaaaacatagatttccattcttttcgatgtgttaaccaactatggacacaactctgtacagtgaaccgttcccttggtatggtacctctagtattctccatggttagttgtctcctcactctatacgtattatag

SEQ ID NO: 2276 - DNA, 1014 bp, Saccharomyces cerevisiae
atgtctgaattgaaaacaggtcatgcaggccataacccttgggcttcagttgccaattccggtccgatctctattttatcctactgtggttcctctattttaatgacggtgactaacaagttcgtcgtcaatttgaaggatttcaacatgaactttgtcatgcttttcgtgcaatctttggtttgtactataaccttgattatcctacgtatactgggctatgcgaagttccgttcattaaacaaaacagacgccaagaactggttccctatttcctttttactggtcttgatgatctacacctcttcgaaggctttacaatacttggctgttccaatttacaccattttcaagaatttgactattatcttgattgcttatggtgaggttctcttttttggtggctctgtcacctccatggaattgtcatcatttttgttgatggtcctttcttctgtcgttgcaacttggggtgaccagcaagctgtggctgccaaggctgcttcattggctgaaggagcagccggtgctgttgcctcctttaacccaggttatttctggatgttcaccaactgtatcacttctgcattattcgttcttataatgagaaagagaattaagttaactaacttcaaggatttcgacactatgttttacaacaatgttttggctctacctattctattgctgttttctttctgtgtggaagattggtcttcagttaatttgaccaataacttttctaacgattcgctaactgctatgatcatcagtggtgttgcatccgtcggtatttcttactgttccggttggtgtgttcgtgttacttcgtctactacatattcgatggtaggggctttgaacaagctgccaattgccttgtctggtttgattttctttgatgctccaagaaacttcttatctattctctccatttttattggtttcctatcaggtattatttatgctgttgccaaacaaaagaagcaacaagcccaacctttacgtaaatga

SEQ ID NO: 2277 - DNA, 1014 bp, Saccharomyces cerevisiae
atgttagcagaattgtctcatagagaattgataaagttggcgcagaaaagatgtataccacctttattgccaaagtttcataagggacagtctggtgggagagtttgcattattggaggatgcgaagattatacaggggcaccgtatttcagcgccaatgctacagccttgatgggctgtgatttgacacatgtcatctgcgaatacaacgctggtacggtcattaaatcgtacaccccaaacctaatggttcatccataccttcgtatgagtaacaccaaattagacgttgatatggacgaacaaaggaagaaaatcaattccttattggatagaatccacgttgtggtaattggacccggcttgggtagggaccccctaatgttaaaatccattaaggatatcataagatatatacttgaaaaacatgagggcaagatcccgttagtaattgatgctgatggactgttcttagtaactcaagatagcgaagtcaaagaaatgctgaaaagctaccccaaaggtagagtgatcttgacgcccaatgtggtagaattcaaaagactatgtgatgccataggcaagaagggagactctcactccgagatgggcagcttgatcgcccaggaattgaattgtattgtggtggagaaaggtcagtcagataagatattctcacccgatagtgaaaaagacatgttgacgaacagcgaagagggcagcaacaagagggtaggaggccaaggtgatactttgacaggagctatatcatgcatgcttgcatttagtcgtgcaatgtatgactttaagatttgtgagcaggaagaaaagggagaatcttctaacgataaacccttgaaaaactgggtagactacgctatgttgagttgctacgcaggctgcacaattacacgagaatgctcccgcctaggatttaaggctaagggacgtgcaatgcagacgacagatctaaatgaccgtgtcggtgaagtgttcgccaaacttttcggttaa

SEQ ID NO: 2278 - DNA, 1017 bp, Saccharomyces cerevisiae
atgaaattatcaactgtcctattatctgccggtttagcctcgactactttggcccaattttccaacagtacatctgcttcttccaccgatgtcacttcctcctcttccatctccacttcctctggctcagtaactatcacatcttctgaagctccagaatccgacaacggtaccagcacagctgcaccaactgaaacctcaacagaggctccaaccactgctatcccaactaacggtacctctactgaagctccaaccactgctatcccaactaacggtacctctactgaagctccaactgatactactactgaagctccaaccaccgctcttccaactaacggtacttctactgaagctccaactgatactactactgaagctccaaccaccggtcttccaaccaacggtaccacttcagctttcccaccaactacatctttgccaccaagcaacactaccaccactcctccttacaacccatctactgactacaccactgactacactgtagtcactgaatatactacttactgtccagaaccaaccactttcaccacaaacggtaagacttacaccgtcactgaaccaaccacattgactatcactgactgtccatgcaccattgaaaagccaacaaccacatcaaccaccgaatacactgtagtcactgagtacactacttactgtccagaaccaaccactttcaccacaaacggtaagacttacaccgtcactgaaccaaccactttgactatcactgactgtccatgtactattgaaaagagcgaagcccctgagtcttctgtcccagttaccgaatctaagggcactaccaccaaagaaacaggtgttactaccaaacaaaccacagccaacccaagtctaaccgtctccacagtcgtcccagtttcatcctctgcttcttctcattccgttgtcatcaacagtaacggtgctaacgtcgtcgttccaggtgctttaggtttggctggtgttgctatgttattcttataa

SEQ ID NO: 2279 - DNA, 1017 bp, Saccharomyces cerevisiae
atgaatagcgtaaaaagagtaaagctaaattcaaaaatgtccaaacaaatatgcacgcattccggatcttttcacgcggacgagtcgttggcggtatacatgttaaggctactacccgaatttaaagatgctaagttggttagatcaagaaatcccaaggactgggaggctagtgacattctagtggatgtaggagctcagtatgacggcgtgaaattttttgaccaccaccagcgtggatttttcgaaactttcaacgagaaatacaagactaagctctcaagtgctggtctgatcttcaaacactacggtcgtgacattatcaaaacaattttgaacaacaaggttagcagctctgatttagatctgctctatgacaaggtatacaaacaatttgtcgaggcactggatgcaaacgacaacggtattagcaagtacacgattcctaaggattccaacttggaaccgaatttcagggataacgccatcagcattcccgggattatttcaggtatgaatcctaactggaacgaagacacttccgatgagtcttttgacagatgctttgctcgcgcaagtgagtttatcggtggggtctttgtcacattggtaagaggctacggtcaatcgtggttgccagccaaggcccttgtggcgcaagccattgatgaaagaatggatgttgataagagtggcaaaatcattgtcttgccccaattctgtccatggaaggagcatctatacgagctggaaagagagaagaacattgaaaagcaaatcgagtttgttctcttcacagactcttctggtgcctggagggtatctactgtaccaatcaactccacctccttccagtttaggagaggtttgccggagccattaagaggcctcagagacgaagagctgagcaccaagagcggtgtgccaggatgtatcttcattcatgcagcaggtttcattggaggtgccaagtccaaagaggctgtatatgagctggctaagatgtctttggcctag

SEQ ID NO: 2280 - DNA, 1017 bp, Saccharomyces cerevisiae
atgaatgataaactccaagaagagcataacgaaaaagacaccacttcacaaattaatggtttcacgccgccgcatatgagtatagactttcattcaaataacaatagcaatatcatcgagactattggcgtttccaaaagattaggaaattctgtattaagtgaactggattctagagctagctcaaaatttgaatttttaaaagatcaatccgaacaacaatacaacggcgacaagaacaatgaaccaaaatcgggctcgtataatattaatgagttcttccaagcaaagcacgactctcaatttggccagatggagtcgctagacacacattatacccttttacatacgcccaagagaaagtcacaacatgcaatcccacaggatcgatcggattcgatgaaaaggtcgagaccgtcccgctcaattccatacactacaccagtggtaaacgatatcacaagaagaatacgaagattgaaattacggaactcattggttaatggtaatgacatagtggctagagcgagatctatgcaagcaaattctaacattaattcaataaagaacacaccattgtcaaagcccaagccatttatgcacaaaccaaactttctaatgcccactacgaattctttgaacaagatcaattccgctcaccgtaatacatcctcctcttcgacagcttcatcgataccaagatctaaagtacacagatcgatatcaataagagatttacacgccaaaaccaaaccggtagaacgcacgccagttgcgcaaggaacaaattcgcaattgaagaattcagtttccgtttttgatagactttacaagcaaacaacgttctctaggtcgacgtctatgaacaacttatcgtcaggaacctctgcaaaatccaaggaacacacaaatgtaaagactcggttggttaaaagtaagacaagtggttcattgtccagtaaccttaagcaaagtactgccaccggcacaaagagtgatagacctatttggcggtga

SEQ ID NO: 2281 - DNA, 1017 bp, Saccharomyces cerevisiae
atgactttgagtaattgcgactctttggataacttattccaggaccctccagaggaagaagaaagtagtaaattcgttgaggcggtcagaactttgatgaatagaaacgatatgggatatcctcccgccgctgcaaatggtacgtattgcttaaaaaaaatcaagtctttgaatgccaaacagtggaaaataaacaagaaaagaatgtgcatgttgccagcagtaaagaagaaaaatttcgactttcacgagcaaagaagtttaatcttgaatttaaatttatggaaattcatcaagtttatcaattgtagtagtaaaaacaattacaataaaaataataagcatgtgagaagctcgaacaacactgtaaaaaatgaaaatgttttaccgttacaaaaacacaagaaagtggacaatgatcaaagattggagaaccttttttggagaagctggtttaaggcacgcaaaaggagagatataatgggcaagccacgagagaggcatatcaaatttaacgataacgttgaacagtgtattataactgatgagcatttcatacaaaggcttccttctacacggttgaattcgactgatgaacagcgcccttgttcaaagtctgaactagatccctgtattggcaacgcagcaagtaagcgaagtttctatgattataacagcgtttacgtcgcgagtgacgcaattattacgactgccgctgccactgccattatcagtagtaatagtggagactatcagcgtgggcacgatgttcgcgatgttccaagaaatgttttgttacaggcaggagaaacagatttcagtagtgtgcttcgggttgactccgatctcaagttatccaacataagtcatcattcccccgtaaaaccttcgtcaacttcaagtcattcgaccttcattttcgagtcggaaactgacactgatactgatactgacgctgaaacagaaaatgacattgacgcttacatagacaccagtatacccaacctgctcctataa

SEQ ID NO: 2282 - DNA, 1017 bp, Saccharomyces cerevisiae
atgattgcttcagaaatttttgaaagaggtgtacaagatccattttgtcaagattgtgattatgaagatgaaacagacgtacaaagttttttaggttcaaatgatttgaatgattttgtaaattccaaattagcgtcctttagttttcaaaattcctcgaaatcaaataattctcaccacagcagcagtaccaatgccggtaatacaagcagacacataggcaatcatactattggccaccatttgagaaaaatcaagacagctccgcatcacttgtatggcttcgtcccagcaaattcaacgaacaattccaatgaaccaattcgcccttctccaagaagaataagagcaaatagtagcaccctcattcaccagttgtccagacaatccacaagacagtcttccttgggcgacgcggcggattcctgttttgaccacaaatgcataaagccaagatccaggcattcttcctgttacggtataccaacacatctatacggccttgaaaaatacgtttcatccgagctagactctctagcagtagctaacgaccagtcaaatgatctcacttccccattaacatctgtttcaacacccgcctcgaattccaactcgtatttgaatctgaattcaagttcggctgcatatccgtcgtcttatctctccaacgaaaagaataatcgactaaaattgatttcccatgggaaaatatcatcaaataacgtcccaggtcacagtggaaaccttaaccactatcacagagaacgaacgccatcaaatctaagaagagaatccttttcgcttctttccaatggttcctcttcctctcccttgcagactagaaacaactcgtattccaactctttggtgaaatctccttccaatagttcattgaatactagtgtggcttcttctaacgaagaatctagtcctcacacttctaattgcctggaggaaaggaatcccaggagaaaatcattcataaaattgtcactagcgagttcattctccaattga

SEQ ID NO: 2283 - DNA, 1017 bp, Saccharomyces cerevisiae
atgccatcaaatttgaatatagtgaaggttacaaaaccacaagaagaaaataagaattttttacacaaaaacacgaatgaacccaatgaaatggaacaatcgcagacacaagaagcagttacagaaaattttaccgaaaacagtaatctcagtgcaaatgaacatgcagctaggaggggtagattaaatttgaaaacagttgatcacatagaaacttatccaatagtgcaagaaacagaagagattgcaaagaagattgctctaacgagaattattttagcacaaacaaagcctagaatcgataaagtggtagtgtcacgtcccgttcaagccgtagcaccagtggtcaatttttttgacaagatggccaattcgactttaagtacagtagagcgcgttgtcccttctttgaaaacaaaaacttataaaagattaggtgaggaaattgcacttccgtatactttgtcgaaaaagtatggaaagcagctcagggatacgacagcaagaaatggagacaactatgtttaccaacctgtccatggaaggttgatgaaatttaggaagtactataatgaaaaattcatagacacaaagggcaagcctttgataagggggcaacttgaccctgttttgttaccagtcaataatacattcgaaaaggtaacggtaaagtatttgcccaaaggtaagaaagttccaaatgattccttttcttgtgagtttaatagggggctagctttagaatacaattttatgacaagagcagtttctgcagttagtcatcaagttgttggtattgcaaagcttcccattgcctatggatatcatacaaactctgtttataataaaaacttagacaaacaggccgatttaaaaatgaaaaatgtattgagaggtacttgggataccataactgatttagaacgcgaaatttgggcctctgtcaccgatagaagtttgtttagattttttggcaacaaatctgagggaggagatttaccacatctagtacaataa

SEQ ID NO: 2284 - DNA, 1017 bp, Saccharomyces cerevisiae
atggataagaattcagttaacaaagatagtgaagaaaaagacgaaagacacaagattgaggttgtagacgatacaaatcctgacttcatcactgcagattcggaactgacacaagatctgcctgatgatgtagaggttattgacttggtccatctaaaaatcaaatcgttagaagatttgaacctttataggttcaagaatttgaaacaattatgtctcagacagaacctgatcgaaagcataagcgaagtggaagttttaccccatgacaagattgttgaccttgatttttacgataacaaaattaaacatatctcctctaatgttaataagctcaccaaattaacgtctctagacctgtcgtttaacaagatcaagcacatcaaaaatctagaaaatttgactgatctggagaatttatacttcgtgcagaacagcatttccaaaattgaaaatctgtccactttgaaatcactgaaaaacttagaattaggtggtaataaggttcattctattgaacccgattccttcgaaggtctgtcaaacttggaagaaatttggttgggtaaaaattccataccaagacttattaacttacatcctttaaagaatttgaagatattgtccatccaatctaataaattaaaaaaaattgaaaatctagaagagttgaccaatcttgaagagctctatctgtcacataatttcatcaccaagattgaaggtctagagaaaaacctaaaactaactactttggacgtgacctccaacaaaattacctccctggaaaacttgaaccacctgtcaaatttaactgacatatgggcctcctttaacaagatagatcaatcctttgagagcttgggtgaaaacctgtccgccctatcacgcttggagaccatttatctggagggaaaccctattcaactggaaaataagacttcgtatagaagaaaactgactatgaacttacctccatccctacagaagattgatgcgacatatataagaggctga

SEQ ID NO: 2285 - DNA, 1017 bp, Saccharomyces cerevisiae
atggatgcaatatctgatccaacgtttaagcatgctagatcaagaaaacaggttactgaagaatcaccatctttgcttaccgttattatagaaattgcaccaaagttatggacaacttttgatgaggaaggaaatgagaaaggaagtataataaaggttttagaggcattgatagtatttctcaatgctcacttagcgttcaatagcgccaacaaagtagcagtcattgctgcatactctcagggaatcaaatatttatacccagagagcacatctgctctaaaagcctctgaatctgaaaataaaacccgtagtgatcttaagattattaactcagatatgtatagacgttttagaaacgttgatgagacgctagtggaagaaatatataaactatttgagttagaaaagaaacaaatcgaacaaaatagtcaaaggagcacgctagcaggtgccatgtcagctgggctgacttatgtaaacagaatatcaaaagagtcagtaactacctcattaaaatcaaggctacttgttcttacgtgcgggagtggcagtagtaaagatgaaattttccaatacatccctataatgaactgtattttttccgcaacaaaaatgaaatgtcccattgatgtcgtaaagattggtggttctaaggaaagcacgtttttacagcaaacgacggatgccacaaatggcgtttatttacatgttgaatctacagaagggctaattcaatatttagcaactgcaatgtttattgatccgtcgttaagacctataattgttaagccaaaccatggatctgtagattttaggacatcatgctatttaacagggagagttgttgccgttggattcatctgttcagtttgcctatgtgtcttatcaatcataccgcccggaaataaatgtcctgcttgtgattctcaatttgatgagcacgtaattgccaagttgaagaggaaaccagttgttccaaggttgaaagccaaaaagaaggtgacgaaaccatga

SEQ ID NO: 2286 - DNA, 1017 bp, Saccharomyces cerevisiae
atggcaagatctttaagtcaatcactcacagcgactacccagaagctaaaaggaaagaagaatggtggaaaaggcaagaataagccctcagcaaaaattaaaaaaactcaaaaagagatgctatatggaatactgaacgaaaggaacataagacagattcagtttggactgaataaaaaattctctacttggtatgggagcgccgtttatttcgatcctgaaacaaaaaggctagggtgctccgagaccaagggtcagctttcctctgtttctaacagccaatactggctagacactcttttcgtttgtgaatactgcttcaaatacacggatgatcagacgcggtttgtaggacatgttgcaagttgtccatttcaatatcgtgttccaggcaaaataaaatacaagagtcctgaatatacaataagaagagtaaaaggatccaagtatcaactcttttgccaatgtctttgtcttttcactaagctatatctggacaataaatccatgtatttcaaagtagatcattatgaattttacatagtttatgaaactggatcaacaaagccgatgggattcttttcgaaagatttagtgtcatatcagcaaaataatctagcgtgcatcttgatatttcccccatatcaacgacgtggattaggccttttacttatcgagttttcatacaaactatcccaattagaaggtgtaatatcagggccagaagtaccgttatcaccttttggactaatcgggtacttgaaatattggtcacagatactctgttggcaccttattgaaggtgacctcgcccattatgataaagtgaccctggaggatctttccatcgtgactggaatgagagtcaatgatgttattttgaccttgaagcacttgaactgtattggggagaataaccaaatttacttgcagtcattgaatagctggttgaaactacatggaacaaaacggaattggttcaaattaaaagatgaatatttgctgatagatgactag

SEQ ID NO: 2287 - DNA, 1017 bp, Saccharomyces cerevisiae
atgtcaaccacagcatccacgccttcatctttacgtcatttgatttctataaaagatctttctgatgaagaattcagaatcttagtacaaagagctcaacatttcaagaatgtttttaaagcaaataaaacgaatgatttccaatccaaccatctgaaactattgggtagaactatagccttaatatttactaaaagatcaactagaacgagaatttcgaccgaaggtgcagccaccttctttggtgcccaaccgatgtttttaggtaaagaggatattcagcttggtgtcaatgaatcattttacgataccaccaaggttgtatcatctatggtttcatgtatttttgcccgtgtgaacaaacatgaagacatacttgctttttgcaaggattcctctgtaccgatcatcaactctctatgtgacaaattccaccctttgcaagcaatttgtgatcttttaacaataatcgaaaacttcaatatatctctagatgaagtaaataagggaatcaattcaaaattgaagatggcatggattggtgatgccaataatgtcataaatgatatgtgcatcgcatgtctgaaattcggtataagtgtcagtatttccactccccccggtattgaaatggattccgatattgtcgatgaagcaaagaaagttgctgagagaaacggtgcgacatttgaattaacacacgactctttaaaggcctccaccaatgccaatatattagtaaccgatactttcgtttccatgggtgaagaatttgcgaaacaggccaagctgaaacaattcaaaggttttcaaatcaatcaagaacttgtctctgtggctgatccaaactacaaatttatgcattgtctgccaagacatcaagaagaagttagtgatgatgtcttttatggagagcattccatagtctttgaagaagcagaaaacagattatatgcagctatgtctgccattgatatctttgttaataataaaggtaatttcaaggacttgaaataa

SEQ ID NO: 2288 - DNA, 1017 bp, Saccharomyces cerevisiae
atgtcaatacgtccagcaacacatgcaggctcatggtattccaatagagcccaagaattatctcaacaactgcatacatacttgatcaaaagtacccttaaaggcccaattcacaacgccagaattatcatatgtcctcatgccggttacaggtattgtggacccactatggcctactcgtacgcatcgttggatttgaaccgtaatgttaagagaatatttatcttggggccgtcgcatcacatctatttcaaaaaccaaatattagttagtgcattcagtgagctagagacgcccttgggtaatctgaaagtggatacagacttgtgtaaaacattaatacagaaggagtatcctgagaacggaaagaagctgtttaagccaatggatcatgacactgatatggctgaacattccttagagatgcagctccccatgttggtggaaactttgaaatggagagaaatttctttagatacggtgaaggtatttcctatgatggtttctcataacagcgttgatgttgatcgttgcattggtaatatcttgtcggagtacattaaggatccgaacaatttattcattgtaagcagtgatttctgtcattggggccgcagattccaatatactgggtacgtcggaagcaaggaagagttgaatgatgccattcaagaggaaacagaagtggaaatgttaactgctaggagtaaactttcacatcatcaagttcccatttggcaatccattgaaataatggacagatatgcgatgaaaacgctaagtgatactccaaatggtgaaaggtacgatgcttggaaacaatacttggaaatcaccggaaacaccatatgcggcgaaaagccaattagtgtgatactaagtgctttatcgaaaatccgtgatgccggtccttcaggcatcaaatttcagtggcctaattattcacagagttctcatgtgacaagtattgatgatagtagtgtcagttatgcttcaggttatgttactataggataa

SEQ ID NO: 2289 - DNA, 1017 bp, Saccharomyces cerevisiae
atgtctctacaacacgagaaagttaccattgcaccactagttttgctatctgctttggatcattatgagcgtacgcagacaaaagaaaacaaaagatgcgttggtgtcatcttaggtgatgctaacagttccactatcagagtcactaattcctttgccttaccgtttgaagaagatgagaaaaactctgacgtgtggtttttagaccataattatattgaaaacatgaatgaaatgtgtaaaaagattaatgccaaggaaaaactcattggatggtatcatagtggtcctaaattaagggcttctgacctcaagattaatgagctgtttaaaaaatatactcagaataatccgctattattaattgttgatgtcaaacaacaaggtgttggtttaccaacagatgcatatgtcgcgattgagcaagttaaggatgatggtacgtctacagaaaagacgtttcttcatttgccttgtactattgaggccgaagaagctgaagaaattggtgtagaacacttattgagagacgtacgtgatcaagcagcaggtggcttatctatccggttgaccaaccaattaaaatctttgaaaggattacaaagcaaactaaaagacgttgtcgagtacttagacaaagtcattaataaggaattaccgataaaccacactatattgggcaagctacaagatgttttcaaccttttaccaaatctgggaacacctgatgatgacgaaatagatgtggagaatcatgacagaattaatatttcaaataacttacaaaaggctttaactgtgaaaactaatgatgaattaatggttatatatataagcaatttggttaggtcaattatcgcgtttgatgatttgattgaaaacaaaattcaaaataaaaaaattcaagaacaaagagtaaaggacaaacaatcaaaagtctctgatgacagtgagagtgagagtggtgacaaagaagcaactgcgccattgatccaacgaaagaacaagaaaaattaa

SEQ ID NO: 2290 - DNA, 1020 bp, Saccharomyces cerevisiae
atgcacagaacttactctttaagaaattccagggcacctaccgcctctcaattacagaacccaccgccaccaccatctacaaccaaaggtagattctttgggaagggtggtctagcttacagctttaggagaagtgctgctggagcttttggcccagaattatccagaaagttgtctcaattggttaagattgaaaagaatgttttgaggtccatggaattgacagccaacgaaagacgtgacgctgctaagcaattgtctatttgggggttggaaaacgatgacgatgtttccgacatcactgataaattaggtgtcttgatctatgaagttagtgaattagacgaccaatttatcgatcgttatgaccaatacagattgactctaaagtccatcagagatatcgaaggttctgttcaaccatctagagaccgtaaggacaagatcaccgacaaaatcgcctacttgaaatacaaagatcctcaatcacctaagattgaggtcttggaacaagaattggtgcgtgctgaggctgaatctttggtcgctgaagctcaattatctaatatcacaaggtcaaagttgagagctgctttcaactaccaatttgactccatcatcgaacattcagagaaaattgctttaatcgctggttacggtaaggctctcttggaactattggacgactctcctgtcactccaggtgaaaccaggcctgcttacgatgggtatgaagcctctaaacaaatcattattgatgctgaaagcgcactgaatgaatggacactagactctgcccaagtcaagcctactttaagtttcaagcaggattacgaagacttcgaacctgaagaaggcgaagaagaggaagaggaagacggtcaaggcaggtggtccgaagacgaacaagaagatggacaaattgaagaacctgaacaagaagaagaaggtgctgttgaagaacatgaacaagtcggacaccagcaaagtgagtctcttccccaacaaacaacagcttaa

SEQ ID NO: 2291 - DNA, 1020 bp, Saccharomyces cerevisiae
atgaatgaagatctattctacgatagattacatcagcggtgccctggaaaatacttgctagaagagttggaaacaagcaaatctaacgatgtcctgcatgcatcgagatttgtttgtgagatggaacttgtgcaaaagacgaatgcatattattgcaaaaccatagtcaagatgctcttagaccacgaatggattttcgcgaaggcattcacaattgtcaacgatggcgaagacgagatagagatatatgattatctctatgagaagtacataaaactattaagcacaggcaagccagacccgatgatgaaagacgtcgtgaggtacaggtttgacgaggacgtaaagatcaaaattgaggaaacaccgaatttgatcagtgcggccagtactacaggtttcaggacatgggaagctgccttatacatgggtgatttccttattcataagcccttacaagagttggcaccggtacaaggacaagacgatggcaagaaaaaattaaatgttcttgaggtcggcgctggcacaggcatagtgagtctcgtcattttacaaaagtatcacgagttcgtaaataagatgtacgtcacggatggtgattcgaatctcgttgagacgcagctgaaaagaaattttgaattgaacaatgaagtgcgtgagaacgaaccagacatcaagttgcaaagattatggtggggcagcgatagagttcctgaggatatagatttagtagtgggggcagatgttacgtatgacccaactatccttcctgatctatgcgagtgtctggccgaatgtcttgctttagaccgatgcaaactgtgtctcctatccgcgacaattagaagcgaatccactgtccaactgttttctcaagagtgcaataaactcgggctaaaatgtaccatagtcaccagcacagagtacgacgcaaacaacgagatccgcgcgatgaaagccctgcaattcaaacctttgattgcacccatacggatctacaagatcacgaaacaataa

SEQ ID NO: 2292 - DNA, 1020 bp, Saccharomyces cerevisiae
atgacatcttggagggataaatccgcgaaagtgcaagtgaaggagtcagaactgccctcctctataccggcgcagactggattgacgtttaatatatggtataataaatggtcccaagggtttgcggggaatacacgatttgttagtccatttgctttgcagccgcaacttcattctgggaagactaggggcgataatgatggccagttgttcttctgtctattttttgcaaagggtatgtgttgccttggccctaaatgtgaatatctgcatcatataccagacgaagaagatataggtaaactggccctgaggacagaggtattggactgttttggtagagaaaaatttgctgactatagagaggatatgggcgggatcggttcatttaggaagaaaaacaagacattgtatgtaggtggtattgatggagcattgaatagcaagcatttgaagccagctcagatagaaagcagaattcgatttgtattttctcgattgggtgatattgatagaatacgatacgttgagagcaaaaactgtggatttgtgaagtttaaatatcaagctaatgcagaatttgccaaagaagccatgagcaatcagacattgctgctacccagcgataaagaatgggatgatagaagggagggtactggactattggtgaaatgggcaaatgaagatccagaccccgctgcacagaaaagactgcaagaagaactgaagttagagtctttaaacatgatggtgcatctaatcaataacaataccaatagtgctggcactgaggttaataataagaataatgaaaggttagacaggacatttccagaagcaagtgttgataatgtcaagaaaagactattgccattagataatggaatggagagtgatgattttatagaaaaattgaagaaagtgaaaaaaaatatcagtagagaaaatatttcatcaaagccatctgttggtaagcttggtggtcccttgctcgattacctctcctctgatgaggattag

SEQ ID NO: 2293 - DNA, 1020 bp, Saccharomyces cerevisiae
atgaggatggaaaaaacaacagacaaaccactttctgcaggagatatgaacgatgaatattctcggggtccaatcgacgatatagactgtttgaactttttcgaaagggctgttcaggacccatgttgtgaggcctgtgacacagaagatgcagatgaagaactgagagcaaagcttagtagcttcaattttcagcctgattcatctccgtgtaatgctaaatgtcaacagacactgaatccactgtgtaaaatagatgaagcactcccagcggagtcagaattagctccatcgagaaacggctcagtatctgaggcaaattctgatacaaattccatagcttctactgtccatgaccctgtcgactccaaatatggaggcatgcctagcttgagaaaggccaaaacaacgtcgtactttacttcatcttcatcgaacaataccacaatgaggaacccgctaaaaaaatgtaataccaatataaatggccttttagtgaacggaaggagctcaagctcctccagacagtctataccagagctctttagcggtgcgtgtactaaaaagaaaaacaacgtattactgaaaagtgaaacacccaattcagaattctctagtaactcacttcaacattgcaactcaaggtcgttttctctacccaggtcaagatcaaggtcttctgccattgccataccaacacatttgtatggcttggaaaagtacgtttcacctgggttggatactttgactgctgacccagaagaaagtattgaaaggttttcaaataatcggccccgtgaaatatcatcgtgttgtccgaacgatacaggggacacctcctcatcattatcacattcgaacacttcctcatcactaaatttccctttaggtacaaatacaaatcaattccaccaaccaaggcagccagtacaacagcaacagtcttcgaaaccaaactttggtgctgggaggaaaaaatctttcattgagatgtcactagcaagttcctttgcaggctaa

SEQ ID NO: 2294 - DNA, 1020 bp, Saccharomyces cerevisiae
atgccattacctccgtcaacattgaaccagaaatctaatagagtctactctgtagctagggtgtacaagaatgcctgcgaggagagaccacaagaatactgggactacgaacaaggggtgaccatcgattggggaaagatttccaattacgaaattatcaacaaaattggaagagggaaatattccgaagtgttcagcggtagatgtattgtaaacaaccagaagtgtgttattaaagttttaaaaccagttaaaatgaaaaaaatttatagagagttgaaaattctgaccaatctaacaggcggccccaatgttgttggcctttatgatatagtacaagacgctgactccaaaatacctgctttgatctttgaggaaatcaaaaatgttgatttcagaactttatatcctacattcaaacttcctgacatccagtattatttcacgcaattattgattgcgttagactactgtcactccatgggcataatgcacagagacgtaaagcctcagaatgtcatgattgatcctacggaacgtaaactaaggctgatcgattggggcctggcggagttctaccatccaggtgtagattacaacgttcgtgtcgcttcgcgttaccacaagggaccagaacttttagtaaacttgaaccaatatgactactccctagacttatggtcagtaggatgcatgctagcagctattgtcttcaaaaaagaaccttttttcaaagggtcgtctaatccagatcaactggtaaagattgccacagtactaggaaccaaggaactgttaggctatttgggtaagtacgggttgcacttaccatctgaatacgacaacattatgagagactttacaaaaaaatcgtggacacactttataacctccgagaccaaattagctgttcctgaagtggttgatttaatcgacaatttattaaggtatgaccatcaagaaagattaacagcaaaggaggctatggatcataagtttttcaaaacgaagtttgaataa

SEQ ID NO: 2295 - DNA, 1020 bp, Saccharomyces cerevisiae
atggcgggaagtacatccagtttggtgatctgtgcgattggtatatatgctacttttttgacgtgggcattagtacaggagcctttggctacaagaacctggccaaactccatgggaaagtttcaattccctaatgtaatatccctcatacaagcttctgtggcaatgatgatgggctacctgtacttaaactggaagaaggtggaatatccgcccagaaaaatgattaaagatcattggaaacaattgatgttgatatcatttacacagagtagttcaggcccgctggctacaacttctttaaagcacgtggattatctcacttacatgttagcaaagtcatgcaagatgatccccgtgttgttggtgcatttgcttttgtataggacgcccatagcaagccaaaaaaaagttgtagctctcttggtaagtctcggtgtcactattttcactataggtggcaacgatggtaaaaagttgaagagatcctttaatgagagcggaaatgataacaaattacaagggtttggactacttttctctagtttattccttgatggattgaccaacgccacccaagataagctactaaaggccaataaggccaaagaaaagggaaaacaaactttgataacaggtgcacacttgatgtttacactgaacctcttcgtgatattgtggaatattttgtattttattgtgatcgactgcaaacaatgggataatgccgtttctgtattgacgatggacccacaagtgtggggctatttaatgctttattcgttctgtggcgctatgggacaatgctttattttctatactctagaacaatttggctctttagttttgatcatgataacagtcaccaggaaaatggtctcgatgattttgagtattattgtcttcggtaagagtgtacgtttccagcaatgggtggggatgtttatagtatttggtggaatcacttgggaagcactcaacaagaagaaggctaatataccgaaggcaaaatctgcgtag

SEQ ID NO: 2296 - DNA, 1020 bp, Saccharomyces cerevisiae
atgggaaccataacagtggtgattaatgagggaccaatactgttgataagggcattgcaccgagcaacgaccaacaagaaaatgttcagaagtacagtttggagacgttttgcatctaccggcgaaattgcgaaagcaaagctggatgaattcttgatataccacaagacagatgcgaaactaaaaccattcatttaccgtcccaagaatgctcagatattgttaactaaagatattagggatccaaaaacaagggaaccattacaaccgagacctcccgtaaagccactgtcgaagcaaacgttaaatgattttatttattcggttgaacccaactcgacagaactactagattggttcaaagaatggacagggacctccataagaaagcgcgctatttggacgtacatctcaccaattcatgttcaaaagatgttgactgcgtcatttttcaaaatcggtaaatatgcgcacatggtaggactcttatatggtattgagcacaagtttctcaaagcgcaaaatccatccgtatttgatatcgagcatttttttaatactaatatcatgtgtgctttgcatcgaaataggttgaaagactataaagatgcagaaattgctcagaggaaactgcaggttgcttggaaaaaggtattaaatagaaaaaataatactggactagcaaatattcttgttgcaacattaggtagacagattggatttaccccagagctgacgggcttgcaacctgtagatattagtttaccagatatccccaattcatcaagtggcgcggaactaaaggacttgctaagcaaatacgaggggatataccttattgcaagaacattattggacatcgatcaacacaatgctcaatatctagaattgcaagaatttatacgccaatatcaaaatgcattaagtgaatccagcgatccatacgacacgcatttgaaagcgttgggactgttggaaacaccacctcctcaggaatccaccgaaaaagaggaaaaatag

SEQ ID NO: 2297 - DNA, 1020 bp, Saccharomyces cerevisiae
atgtcttcttcttcacagtatgtagttttctagtcaagtatcattggaaagtaaagaactagaaatgatgaatactaacatatatacgagaaaaaatcaacctcgagctctatgaacagatttaagcagttagaaaagcttggcaatggtacgtatgccacagtgtacaagggactgaacaaaaccacaggggtatatgttgccctgaaagaggtaaaactggattcagaggaaggtacaccctctacggccatccgtgagatctccctaatgaaagaattgaaacatgagaacattgttagactttatgacgttattcacacagagaacaagttgactttggtttttgaattcatggacaacgatttaaagaaatacatggattcccgcaccgtgggcaacacaccaagagggctagaactaaacttggttaaatacttccagtggcaactactgcaagggctggccttttgccatgaaaacaagattctccaccgtgatttaaaacctcaaaacctattaatcaacaagagaggccagttgaaattgggtgatttcggtctggcccgtgctttcggtattccggtcaacacattttcaagcgaagtcgtaacgttgtggtaccgtgctcctgatgtgctaatgggttctaggacgtactccacatccattgatatatggtcgtgtgggtgcattcttgcggaaatgataacgggtaagcctttgtttcctggcaccaacgacgaagaacaactgaaattgatcttcgacatcatgggcactcctaatgagtccctatggcccagtgtaacaaagttacccaaatacaacccaaatatccagcaacgaccaccaagagacctacgtcaagtattgcaaccacacaccaaagaaccgctagacgggaatctcatggatttcttacacggactcttgcaacttaatccggatatgaggctgagcgccaagcaggctctgcatcacccttggtttgcagagtactaccaccacgcttcataa

SEQ ID NO: 2298 - DNA, 1023 bp, Saccharomyces cerevisiae
atgtctacagacaagatcacatttttgttgaactggcaaccaaccccataccatattccaattttcttggctcaaaccaaaggttacttcaaggagcaaggtctagacatggccatcctagaaccaaccaatccttccgatgtcactgagttaattggatctggtaaggtcgacatgggtttgaaagccatgatccacaccttggctgccaaggcccgtggtttcccagtgacctctgttgcctctttgttggacgaaccatttaccggtgtcttgtacttaaagggcagtggtatcactgaagacttccagtccctaaagggtaagaagatcggttacgttggtgaattcggtaagatccaaatcgatgaattgaccaagcactacggtatgaagccagaagactacaccgccgtcagatgtggtatgaatgtcgccaagtacatcatcgaaggtaagattgatgccggtattggtatcgaatgtatgcaacaagtcgaattggaagagtacttggccaagcaaggcagaccagcttctgatgctaaaatgttgagaattgacaagttggcttgcttgggttgctgttgcttctgtaccgttctttacatctgcaacgatgaatttttgaagaagaaccctgaaaaggtcagaaagttcttgaaagccatcaagaaggcaaccgactacgttctagccgaccctgtgaaggcttggaaagaatacatcgacttcaagcctcaattgaacaacgatctatcctacaagcaataccaaagatgttacgcttacttctcttcatctttgtacaatgttcaccgtgactggaagaaggttaccggttacggtaagagattagccatcttgccaccagactatgtctcgaactacactaatgaatacttgtcctggccagaaccagaagaggtttctgatcctttggaagctcaaagattgatggctattcatcaagaaaaatgcagacaggaaggtactttcaagagattggctcttccagcttaa

SEQ ID NO: 2299 - DNA, 1023 bp, Saccharomyces cerevisiae
atgaaatatacgcaatacccgaacagctcaaaactgaaaagaaatagtgatcgacgtgaacacgacgaaaagcttagcgatgagttacataatcaaagtacgatatatgaagatgaagagctaagcagggcagaatatgattctgattctgattctagcgttgaagattctacagataatgaaaatagtgggaaagaaatggatgaaaaatcctatgaaaaaaatgaagatcacgtcgaagaccatagaaagcgaaagaaatcgaaaattcagcttttggatattgcagagttcaagaaagaaaacttagccgacttagattatcagatcggtaattcagagagcaaggtagaaaaaggtgtgaatatagagccatttaatatagatgacgaaataaaacatggggtattcgataaagatgggaattatattaagacagaaaacgccacagaaaatgatcaacaagataatgaggaatggatgaatgatgtcataaatacagaggaggtaaatcgcttagaaaaggaacaaagtgtcaaaacgcagaattcgagacattatatggtccacgaagcattaaatcttttgaaattttttcttgttgatgagaatgaaacagtactggaatccttgggcaggttaaacaagctgcgaaaaattgccatttcaaaaaagaacaaatcattgaaatatgttattcacggaatcgagctattatctgatttgatcaatatactagaaaaaaagggattcagtgaagtatatgaatataaccgcttaaaagttcaggatgctatagaagaggaaattttcgatgactcctccagaatagttaaccataaaacaaagttatggggcttcaagtggttgaacaaattagatgaatatcacggcctgtacacgaactatgaaatgtcttattggcaaaaatcctacttcaaaaacagtgttatagtaaaatttcacagcgaaccagatcgagatgaaaactggatacatgtatcgtgtttaagtttcatgtaa

SEQ ID NO: 2300 - DNA, 1023 bp, Saccharomyces cerevisiae
atgaacataaaggatagaacttcagaatttcaacaaagtgtgttgagttacaagaaaagaaacaaaaactttagagaacagcagagggaacgtctacaagagaaagaaagtgaaaactttgccaacaacacaaccggcaatgggaaaagtgtctctgagtttcaaaaaaaggcttctggcatagctcacgaaatttcatccaccgcacaattattatcgaaattagcagtgctggccaaaaggaaaccgatgttcaatgacaaccctgtagagattgccgagctatcatttttgatcaaaaggaagatttatgccatcgaacaaagtttagtgcaattaagtcagctcaagaaaaccgacgtgaatggcaacacatcaaatcaatcttctaagcaacctagtgccgtacagcactccaaaaatgtcgtaaatcttttaaacacgcaaatgaaaaacatatcaggaagttttaaagacgtattggaggaaaggcaacgactagaaatggctaacaaagacagatggcaaaaactaaccaccgacactggacatgcaccagctgatgaccaaacgcaaagcaatcacgccgcggacttgaccacgtataacaactccaacccattcatgacctcactactagatgaatcctcagaaaagaataacaactcgtccaaccaaggagaactgtctttccctcaaaacgactctcaactaatgttaatggaagagggacagttatccaataacgtctacttacaagaaagaaatagggcggtggagacaatagaatccacaatccaggaagtgggaaatctcttccaacaactggcctccatggttcaagaacagggcgaagtaatccaaaggattgatgcaaacgtagacgacatcgatttaaacattagtggtgctcaaagggaacttttgaaatacttcgacaggataaagagtaatagatggttagccgcaaaggttttttttataatctttgtatttttcgttatttgggttttagtcaattaa

SEQ ID NO: 2301 - DNA, 1023 bp, Saccharomyces cerevisiae
atgaccgcaccattggtagtattgggtaacccacttttagatttccaagccgacgtcacggctgaatacctggccaagtattctctaaaggaaaacgacgcaattttggtcgatgccaaatcaggcgatgctaagatggctatttttgacgagctcttacagatgccagaaacaaagcttgttgcaggtggtgctgctcaaaacactgctagaggggcagcatacgttttgggcgccggccaggtggtgtacttcggttccgtcggtaaggacaagttcagcgagagattgcttaacgaaaacgaaaaagctggtgtcaagtctatgtaccaagttcaaaatgatattggtaccggtaagtgtgccgcattaatcactggccataaccggtccttggtcactgacttgggtgctgccaatttctttactccagaccacttggacaagcattgggacttggtcgaagcagctaagctcttctacatcggtggtttccacttgaccgtgtctccagacgctatcgttaagttgggccaacatgctaaagagaacagcaaacctttcgtgttgaactttagtgctcctttcattcctcatgtcttcaaagacgcattggccagagttttgccttatgctaccgtcatcatcgctaacgaatcggaggccgaagccttttgcgacgccttccaattagactgtgccaacactgatttggaagctattgctcaaagaattgtcaaggactctccagttgaaaagactgtcatcttcacccacggtgtcgaaccaacagtggtcgtgtcctccaagggtaccagcacatatccagtcaaacctttggactcttctaagatcgtcgacaccaacggtgctggtgacgccttcgctggtggctttatggctgggttgactaaaggtgaagatttggaaacctctattgacatgggtcaatggctagctgctttgtctattcaagaagttggtccctcttacccttccgaaaaaatatcttactctaaatag

SEQ ID NO: 2302 - DNA, 1023 bp, Saccharomyces cerevisiae
atgactgttagtaaaatacccatatggctagattgtgatcctggtcatgatgatgccatagccattttattaggctgtttccatccagctttcaatcttctaggaatcagcacgtgttttggtaacgcaccgccagagaatactgactacaacgcccgttctcttttgactgcgatgggcaaagcacaagcgattccagtttataaaggcgcacagagaccttggaaaagggaacctcattatgctcctgacattcatggtatatcaggtttagacggcacttctttgctacctaagccaacatttgaggcaagaactgataaaacgtatattgaggccattgaagaggcgattctagctaacaatggagagatatcctttgtgtctactggtgcacttaccacattagcaacagtttttaggtgtaaaccatacctaaaaaaatctgtcaaatatattagcattatggggggtggactccatggtctaggaaactgtaacccaaatctttctgctgaattcaacgtttggattgatcctgacgcagcgaattacatattccgtgatcccgatgtaaaggacaaatgtatagtagttcctctaaatttaactcacaaggccatagctacttacaaggttaacgaaatgatatacaacgaaaagaataacagcaagttacgagaattgtttttggagctttttcaattttttgctcatacctacaaggatatgcaaggatttgaatcgggcccacctatacatgatccggtagctttgatgccgcttttggaattttatgggtgggatccatcgtctgcggttggatttcgctacaagagaatggacatatcctgcattgatgatgttttcaacgaaaactcagggaaaattatcattgaaaaagaatatccaaatgacagtgatgttggtacaataattggtctcgatttgaatatccagtacttttgggatcagatttttgaagcattaaatagagcagacaaaatgtcaacgattggataa

SEQ ID NO: 2303 - DNA, 1023 bp, Saccharomyces cerevisiae
atgatattaagtcagaggaggatgctgagttcaaagcaactaatagagaacttgataagatacaaatttcataaaacaccatatactcggagctcaatatggcctttcaaaagaaattcggcggtaataatactattattcattggaatgaaaggcgaactacgagtgcttttaactaaacgttcaagaacattgagaagcttctcaggtgatgtttcatttcctggaggtaaagctgattattttcaagaaacctttgaaagcgtagccagaagagaagctgaagaggagattgggttaccgcatgatcctgaggtcttgcataaggagttcggaatgaaattagacaatttggtcatggatatgccatgctatttatcaagaacatttttaagtgttaagccaatggtctgttttctttacaaagataaattagaaaaacatgaggataaatacaaagttcccttagatatccgtaagttttttggtaagctgaaccctggagaaacatcttctttgttttctgtaccactcaatgacttagttatacatcttcttcctgaagccgatgaggatgttaagagttatcaagcagaatattttgagcggaaggagtataagcttaattggggtggaataaaatggttgattatgcattatcattttcacgtagcaaataataacgaaatgccatggttgcaaaccatagaggatttatcaagttcagacgaagacggtgttgatggaggtattttcagattcagggatttgtggggactcacatgtaaaatattattcgacgtttcatgtatagctaatggactaatggacgaaaagttaaaaggagaactagggcacgaagatttgatagttggactacatgactatggtaatcagatgcaaccgaacggaagaagtgaatgggagataggaatgatcaacggcgacagaaacttaaaatatagcgatgtgatacctgaatactacatgaagcacctgctggagtgccgctcgctttggtaa

SEQ ID NO: 2304 - DNA, 1023 bp, Saccharomyces cerevisiae
atgattgatcgtaccgagttatcgaagtttggtattactacgcaactgtctgttattggacgtaatccagatgaacaaagtggctttgttaatccacctttgtataaggggtcaaccatcattcttaaaaaacttagtgatttagaacaaaggaaaggaagattttacgggacagcaggttctccaactattgacaatttagaaaatgcctggacgcatttaaccggcggtgctgggacagtgctatcagcttctgggcttggttctatctctttggcgctattggccctttcgaaagctggtgatcatatcttgatgactgatagtgtctacgtgccaacacgtatgctatgtgatggtttattggccaagttcggtgttgaaacggattattatgacccatcaatagggaaggatatagaaaaactagttaagccaaatacaaccgtcattttcctcgaaagcccgggttctgggaccatggaagtacaggatattccagctttggtctctgttgccaaaaagcatgggataaagacaattctagacaacacatgggcaacgccactcttttttgatgctcatgcgcatggtatcgatatttcggtagaagctgggacaaaatatttgggtggtcattcagatcttcttattggtctggcctccgcaaatgaagaatgttggccgctattacggtcaacttatgatgcaatggcaatgttaccaggtgccgaggactgtcaattagcattgcgaggaatgcgtacattgcacttaagattgaaagaggtagaaagaaaagccctggatttggctgcttggctcggaaatcgagatgaggttgaaaaagtgcttcaccccgcctttgaagattgtcccggacatgaatactgggttcgtgactacaaaggttcttcaggcttattttccattgtccttaaaaatgggttcacaagagctggtctggagaaaatggtagaagggatgaaagttttgcaattgggattttcatggggtggctag

SEQ ID NO: 2305 - DNA, 1023 bp, Saccharomyces cerevisiae
atggacgaaaacaaaataatcgaccagttgttcagtaaggaatacacaccgcaagatgactccgagcaagccaaaaatggagatgtgtcgttatatgggttattagatgaagtagcgaacggtaggcggttgatgaactgtttgtttcattcacctatgcaaatggggaataaattgagtaccgacaaacttgatgggaaatgtcggcaaatacaaagagattggattgatgaggaaaaaaccataactatgaattctggcgctttacagctggatgggccagttctattttcctggagtcataatgtagcacctacttctcatcaagaaactataaatacaaccttcaagcagggctctccgagcagaggaagcaacaagcccaaaattactactaccagtcagttatttgatagagcttctgctgagattgataagtgtataaagcccaatagcaaaagttggatggtggaagaaagatttgagagaaatgaggcacatacagctgatggcaagaaaccttctacgtgggctaattccgatttcaaagtggacccgctacagaaattcgttgttaaggaattgcccaaagaaaagaagaaatcagacggtgataagacaaagaaaaataagtcgaaaaggaagagtttttttggattttggggccattctggttctaaatcaggttcaaaaaagaaatccgaaaagcctatagaggccaaaaatgaaattcaggatgaggtaagccaaaaatctggcctatcacctgacgatgatacaactttcagtgataaaaataccatccaatcaaagcaagagagtatgagtgatcaacaagctgaacccaaagtacacgagcccgcagttactaacactggatgcagtgaacatgatgatggtgatggatttgaacaggtacctgcacaatctagttatcatccatccagcgagcccagcattgccagcactccttcattaactctagattcattcatcccattacaaccaaagaagaaaatataa

SEQ ID NO: 2306 - DNA, 1023 bp, Saccharomyces cerevisiae
atgtcgacaagtacagagaagaggagcaaagaaaaccttccatgggttgaaaaatacagacccgaaacgttggacgaagtgtacggacaaaatgaggtgatcaccacagttcgtaaatttgtagatgaaggtaaattgccacatcttctattctatgggcctccaggtaccggtaaaacttctacaattgttgctttggcacgtgagatatatggtaagaattactcgaacatggttttggagctgaatgcatccgatgacagaggtattgatgtggtgaggaatcaaattaaagactttgcctctacaagacaaatcttctctaaagggttcaagttaattatactggatgaagcagatgccatgaccaatgccgcacaaaatgcgttgagaagagttatagaacggtacaccaagaatacgcggttctgtgtattggccaattatgcgcataaacttacacctgcgttattgagtaggtgcacgagattcagatttcagcccttgccccaagaggccattgagcgtcggatagccaacgtcttggtgcatgagaagctgaagttgtctcctaatgcggagaaggccttaatagaactttctaatggggatatgagacgtgtgttaaacgttttgcagtcttgcaaagctactttagacaatcccgacgaggatgagatcagtgacgacgttatctatgaatgctgtggggcacccagaccaagtgacttaaaggcagtattgaagtcgatactggaggacgattggggtaccgcccactacacacttaataaggtacgcagtgccaagggtctcgcgttgatcgacctaatcgagggcatagtgaagatactggaagactacgaacttcaaaatgaggaaacaagagtgcatttgcttaccaaactggccgatatagagtactcgatatccaagggtggcaacgaccagattcagggcagcgcggtcattggcgccatcaaggccagcttcgagaacgaaactgttaaagccaacgtataa

SEQ ID NO: 2307 - DNA, 1025 bp, Saccharomyces cerevisiae
atggtcgctagaggtagaacagacgagatatctacagatgtttcagaggctaattctgaacactcgttgatgattacagaaacatcatcaccgttcagatctatattctcccacagtgggaaagtagcgaatgcaggcgctttagaggaatcggacaagcagatactggaatgggcaggtaaactggaattggagagtatggagctgagggaaaactctgacaagctaattaaagttttaaatgaaaattctaagacattatgtaaatcgctaaacaagtttaaccagctactggaacaagatgctgctacgaacggttcgtaccaacacagtgcataccctcaagttttttattcattttcttccaaaacacatttactaacaactgtagtataggaaacgtgaaaaccttaataaaggatttggcttcccagattgaaaaccaactggacaaagtgtcaacagcaatgttatcgaaaggcgacgagaagaagacaaagtcggattccagctacaggcaggtattagtcgaagaaataagcaggtataattccaagataacgcgacacgtaactaacaagcagcatgagacggaaaagtcgatgaggtgcacccaggagatgctcttcaacgtcggcagccaactggaggacgtgcataaagtgctcctgtctctatccaaagacatgcacagtctacaaacccgccagactgctctagagatggcgtttcgagaaaaggcagatcacgcctacgatcgcccggatgtgtctctgaatggcaccacactcctgcacgatatggacgaagcccacgataagcagcgtaagaagtccgtgccgccaccaagaatgatggtcacaaggtccatgaaacgcagaagatccagctccccaaccctatccaccagccaaaaccacaatagcgaagacaatgatgacgctagccatcggctgaagcgtgcggccaggaccattattccctgggaggaactaagacccgacactctggaatctgagctgtga

SEQ ID NO: 2308 - DNA, 1026 bp, Saccharomyces cerevisiae
atgcacagaacttactctttaagaaatcaaagagctccaacggctgctgagctacaagctcctccaccaccaccatcctcaacgaagtccaagttcttcggaaaggcctctattgcgtctagttttagaaaaaatgcggctggtaactttgggccagagttggctcgtaaattatctcaattggttaagactgaaaaaggtgtccttagagctatggaagttgttgccagcgaacgccgtgaagctgcaaagcaactgtctctatggggtgctgacaatgatgatgatgtttccgacgtaaccgacaaattaggcgtcttaatatatgagttgggtgaactacaggaccagttcatcgataaatatgatcaatacagagtcacattaaaatcaattaggaacattgaagcctctgttcaaccttcgagagatcgtaaggaaaagatcacagatgaaattgcccatttgaaatataaagatcctcaatcaacaaaaatcccagttttagagcaagaactagttcgtgccgaagctgaatctttggttgcggaggctcaattatcgaatatcacacgtgaaaaattaaaggctgcttatagttatatgtttgattcattaagagagctttctgaaaaatttgccctgattgctggatacggaaaggccttattggagctgctagatgactctcctgtcactccaggtgaagctagaccagcgtacgatggctatgaagcttctcgccaaattattatggatgctgaatcggccttggaatcttggaccctagacatggctgcagtcaaaccaactctttcatttcatcagaccgttgatgacgtctatgaagacgaagatggtgaagaagaagaagaacctgaaatccaaaatggagatatccccggtcaagtagtcgaagaagaggaagttgaatggactactgaagttcctgtagatgatgaagcccatgaggccgatcatcatgttagtcaaaacggtcatacctccggttctgaaaacatctga

SEQ ID NO: 2309 - DNA, 1026 bp, Saccharomyces cerevisiae
atgaaaagaggagaaagccaggcgcctgatgccatctttggtcaatctcgtgcatttgcactatctgattcttcagtgaatcctgatgtcattgaatatcttaaaagtgttaggcaagaagcactaagaaccaacgccatatcgattaagaatcatatgaatctgcaaaagaggacgcgtcacaaatcaagcatgtacgatgatgaggatgagggggcccttaaaaggcacgccatctcgccatccttgattaggcttcaaaggaatgtagaaatatgggtaaggtggtttaactctgtgaaggcgacggtgttgactaatgcctacgagtttaccggttatgaggacgaaacactggatcttttattgcttttcttaaagaattatctcgaagatatgcccagcaaatgtactacagttgaaaaaattataagtgtcctaaatcagcattcctttcctgagaaggcagaagagaaggaagaaaatcttcagattgatgaggaatgggcgaagaatattttggtacggctggaaaaaaccaagattgacagtgttgaggatgtaaaaaaagtaatcactgaaggagataaacatgaactagttggatacaaccagtggttccaataccttataaacaatgaaccgcagcatactacttttcatgaaaagattacctctaagcaactttgggttctgatcaagtatatgtcgaatacatggataaaagaaatacacaagaaaggaaggcattatcgtcggctgcaagattggctattctacatactggtacatacacccgaaagagtcacggcagaatatacaagcatcttgagagatcttggaaagaaatgccttgaactgattcaaaagaagccagttgaagcacatgagaataaaataacactcccgaaggagatggcggaattgaatgttgagataccagccgcggtggagaatatgacgataactgagctgacagtgtctgttatagcagtgaactatggtcaaaaagacttgatagaataa

SEQ ID NO: 2310 - DNA, 1026 bp, Saccharomyces cerevisiae
atgagactgccagaaatctccatttggaaagtgatactactacttcatttgtttgctctacaagaatttcaacttgtctccgctgcaaatttgccctctttatcaagtagtacaaaggcagcagatagttctagtaaaggcagctcttcagccaagacaaccacgtccttaggcaaaagctcagtaaccagtaaggatgtttcgtcaagtcataatgtcacttcaagcactaaaatgcccaaaatcaccacgagcgctagtacaagcttatacaccaactctagtttatggagcaacaacagtgtaatatcaacttcatctattacaccttccagcgtttatatcccggttacggacggaaataaattcttatatcaggctcatcatcctaacggtactgtgttcattgcatttgctggctgtttaggtgcaattctactatcactgacgggtgcatggattgcattgaatataaagtcatggcgaagtgctagaaaggaaaataagctgagaaatctagaaaatcaataccaacacgatcctttctacttccaaacaaacattaatgacgacgaaagtgaaacatcttcccattctgacgacagtgacatatcagaaaaagttctgaaaaataactcatctcgtatgagtttgtatactctaggatccacttctgttttgaatcttttgaacaataaaacagatgccaacgataacttcagatcatctatgtttatttcacccaccgaaattctgcaatctgatgccaacaactctaatacatggtctcaaagcaatgagagtgctatatatgattccttgtccagtactccaagggaacctggtgctacccaaatactgggaaagtttacagacagcactaatccattcaattatacatcatacaatttaagtcccgactctgaagaccgctctactccaaaatcaaatgttagtcagggtaaagtaaagaagtaccgtcctcccagtgttcatctggatcaactgctcgacggtaaggaataa

SEQ ID NO: 2311 - DNA, 1026 bp, Saccharomyces cerevisiae
atgagtgacgtggtcagtaaagatcgtaaggcattgttcgactcagcagtatcctttttaaaggatgagtccattaaagatgctccacttttaaagaaaatcgaatttttaaaatccaaagggttaacagaaaaggagattgaaatagccatgaaagagcccaagaaagacggtatcgtaggcgatgaagtatcgaaaaaaattggtagtactgagaatagagcctcacaggatatgtatctctatgaagcgatgccaccaacgctgccccacagggattggaaggactattttgtgatggctactgccacagctgggctgttgtatggtgcatatgaagtaactagaaggtatgtgataccaaatattttaccagaagcaaaaagcaagttggaaggggacaaaaaagaaattgatgatcagttctccaaaatcgatacagtcctcaatgccatcgaagcggagcaagctgagtttaggaaaaaggaaagcgaaacattaaaggaacttagtgacacgattgctgaactgaaacaggcgcttgtgcagacaacaagaagcagggaaaagatcgaagacgagtttagaatagttaaactcgaggtggtcaatatgcaaaatacgatcgacaaatttgtttcagataatgacggcatgcaagagttaaataatatccaaaaagaaatggaatctctgaaaagcttaatgaataaccgtatggaatccggtaatgcgcaggacaacagattattttccatatctcctaatggtatacctggcatagatacgattccatctgcgtctgagattcttgccaaaatgggcatgcaagaagaaagtgataaagaaaaggaaaacggcagcgatgctaataaagatgacaatgctgttccagcgtggaaaaaagcaagagaacaaactattgatagcaacgcctccattccagaatggcaaaaaaataccgccgccaatgagatcagtgtccctgactggcaaaatggacaggtcgaagactccatcccatag

SEQ ID NO: 2312 - DNA, 1026 bp, Saccharomyces cerevisiae
atgagtttagaggctacagattccaaggccatggttttgttgatgggcgtaagaagatgtggaaaatcatccatttgtaaagttgtttttcataatatgcagcctttagatacattatatctagaatcaacctcaaatccttctcttgagcatttctctactctcattgacctggcggtgatggagcttcccgggcagctaaattactttgaaccgagttatgattctgaaagattattcaaaagcgttggggcactagtttatgtcattgattctcaagatgaatatatcaatgcgatcacaaatctggcgatgattattgagtatgcctataaggttaatccctccatcaatatagaggtcttgattcacaaggttgatggcctaagtgaagatttcaaagttgatgctcaacgtgatataatgcaacggacaggtgaagagttgcttgaactggggctggatggtgttcaggtttccttctatttaacttcaatttttgatcactcaatatatgaggcattttcgaggattgtgcagaaactgataccggagctgtcttttctggagaatatgctagataatttaattcaacattcaaaaattgagaaggccttcttatttgatgttaattccaaaatttatgtttccacagattctaaccctgttgatatacaaatgtatgaggtatgctccgagttcatagatgtgacgattgatttgtttgatttatataaagcgcctgttctaagaaatagccaaaagagctcggacaaagataatgtgataaatcctcgtaatgagctacagaatgtatcacaattagctaatggcgtcattatttatttgaggcagatgattagaggcttggcattggtggcgattataagacctaatggtacagacatggaaagctgcttaacggtcgcagattacaatattgacattttcaagaaggggttggaagatatttgggcaaacgcaagagccagtcaagctaaaaatagtattgaggacgatgtgtga

SEQ ID NO: 2313 - DNA, 1026 bp, Saccharomyces cerevisiae
atgcaatacaaaaaatcattagttgcctccgccttagttgctacatctttagctgcctatgctccaaaggacccgtggtccactttaactccatcagctacttacaagggtggtataactgattactcttctactttcggtattgctgttgaaccaattgccactactgcttcctccaaggctaagagagccgctgctatctctcaaattggtgacggtcaaatccaagccactaccaaaaccactgctgctgctgtttctcaaattggtgacggtcaaatccaagccactactaaaaccaaagctgctgctgtctctcaaattggtgacggccaaatccaagccaccaccaagactacctcagctaagactaccgctgcagccgtctcccaaattggtgacggtcaaattcaagccactactaaaaccaaagctgctgctgtctctcaaattggtgacggtcaaatccaagccactaccaaaacaactgctgcagctgtctctcaaattggtgacggtcaaatccaagccactactaaaaccactgctgctgctgtttctcaaattggtgacggtcaaatccaagccaccaccaatactactgttgctccagtctcccaaatcactgatggccaaatccaagccacaactttaacttctgcaaccattataccatctccagctccagctccaattactaatggcactgacccagtaactgctgaaacatgtaaaagcagtggcactttagaaatgaacttaaagggtggtatcctgactgacggtaaaggtagaattggttctatcgttgccaacagacaattccaattcgatggtcctccaccacaagctggtgctatctatgctgctggttggtccatcaccccagaaggtaacttggccatcggtgaccaggatactttttaccaatgtttgtcaggaaacttctacaacttatacgatgagcacattggaactcaatgtaatgcagtccacctacaagctatcgatttgctcaactgttaa

SEQ ID NO: 2314 - DNA, 1026 bp, Saccharomyces cerevisiae
atgcagatagtacaaattgagcaggccccaaaagactacataagcgacatcaaaataatcccttccaagtcactgcttttgattacgtcttgggatggctctttaacagtctacaaattcgacattcaagcaaagaatgttgaccttttacaatcgctacgatataaacatccgttattgtgctgcaatttcatcgacaataccgatctgcaaatatacgtgggaactgtacagggtgaaattctaaaagttgatttgataggtagtcccagcttccaagctttgacgaacaatgaagccaatttgggtatttgccgaatatgcaaatatggagacgataaactcattgccgcgtcatgggatggcctgatagaggttatcgaccctcgcaattatggtgatggagttattgctgttaaaaatttgaactctaataacacaaaggtgaagaataagatatttactatggatacaaactcctctcgattgatcgttggtatgaacaatagtcaggttcaatggtttcgcctgccactctgtgaggatgataacggaacaattgaagaatcaggactgaagtaccaaataagagatgtcgctcttttaccgaaagaacaagaaggttatgcatgtagcagcattgacgggcgagttgctgtggagtttttcgatgatcagggcgatgattacaactcaagcaaaagatttgcatttagatgccaccgtttgaatttaaaagatacaaacttagcgtatccagtaaattctattgaattttccccccgtcataagttcctatacacggctggctctgatggcataatttcatgctggaacctacaaacccgcaagaaaataaaaaatttcgccaaatttaacgaagacagcgtggttaaaattgcttgttcggacaatattctatgtctggcaacttctgatgatactttcaagacaaacgccgcaattgaccaaactattgaactaaacgcaagttcaatatacataatatttgactatgagaactga

SEQ ID NO: 2315 - DNA, 1026 bp, Saccharomyces cerevisiae
atggcaggcccaaggaatgtgcgtacattacatggaaatggaggccgtaataatgatgtgatgggcccaaaagaattctggttaaatatccccccaataacaagaactttatttactctagcgatcgttatgacgatcgtcggccggttgaatctaatcaatccgtggtactttatttatgtttggaatttgacgttcaagaaggttcagatatggagacttcttacttcttgtgtaatgctttcgtctcgtgccatgcctgcgctaatggaactatatagtatttatgacaggtcctcacagttggagcgagggcattttggtcccggtttgtccaatagacgaggaccgatggtaacagtagactatgcctactacctgtgcttttgtatactagccatcactacggccactacaatcatttatgggtcctactaccctgttgtgctcacctctgggttcatatcatgcattacatatacttggtcgatcgacaatgccaacgtgcagatcatgttttatggtttgattcctgtttgggggaagtacttccccttaattcaattgtttatctctttcgtttttaatgagggtgatttcgtaatctcattgatcggttttactacagggtacctttatacatgcttagatacccatacactggggccaatatgggggatgatatccagaaaagctgatccaacctacggaatctcgcccaatgggaaattctcaacgccatggtggtttactagtctatatgctcgcataacgggtgcccacaatgaaactgcaacattcaacaacaactttgccaatgtgccatcttcgcaaagagaaacgagaacttttagtggaagaggtcaacgattgggtacggcccctgcaacattgtctcaaaccagtggcacagattcaggcagagcttctggaagtcaattaagaagtggcccatcgaatttgaaccaatttcaaggccgcggccaacgagtaggacaaacaaacagcccctccgactcacaataa

SEQ ID NO: 2316 - DNA, 1026 bp, Saccharomyces cerevisiae
atggcagtaaaacataaatccgagagccttaagcacgaagagggggctgccaaaaaggcaaagacaggcctattgaagctaaaaaaaatcatggatatagaatctaatgtggtcaaatattccatatgcataccgacaactgttatcgacaattgtaataatttggagcaagttacatttactgcatatcaaatagctcggacagctgtattgttcaatgttcaagaaatcatagttctagaccagtcaaaagataaaaagcatgaaaaaaaatcaagatcaaaggagactatctctgattgtttattacttgccacactattacaatattttgtaacgcctccaaacttactggatactacattcaaaaaaaaaaacaagttatatttaaagtgtgcatctacctttccgccattgaaccagctaccttttatgaacgcatctgccgaacaacactacaaggaaggcttatcaatcgcacgagatagctcaaaaggtaaatctgatgatgctctaacaaatttggtgtatataggaaagaatcaaattattacgttatctaaccaaaatattcccaatactgcgcgtgtaacagttgatacagagcgcaaagaagtagtgtcacccatagatgcttacaaaggaaaaccactcggctatcatgttcgaatggcaagcactttgaatgaggtgtccgaaggttacacaaagatcgtttgggtcaacagtggtgacttccactacgacgaagagttgtcaaagtaccacaaggtagaaacaaagctaccatacatcgcaaaactgaaaaaaagttcaacatcagaaaaaccctgtaatatcctgcttatcttcgggaaatggggccatttaaaacgttgtttcaggagatctgacttagaatcctcttctttgcatcattacttttctggtcaactgcaattccctgcttccgtaccccagggaaatatacccattcaagatagcctacccatagctcttaccatgtttcagcgttgggcaagttga

SEQ ID NO: 2317 - DNA, 1026 bp, Saccharomyces cerevisiae
atgtcaaataataaggctggcggtgaatatgaagtcatcactattggtgatgcaaaaaagcttcaagcaacaatttcagagcttggcgctactttgcttgacttgaaagtgaacaacgaatcgattgttctaggataccctgatattcatggctatatatcagatggctacaactacattggtgctactgttggccgttatgcaaatcgtatttacaagggcatgttcagtatggaagatggacctcatcagttgacagtgaacaattgtggaaacaccaaccacagtagcatcagctccttccatctcaagaagtataaggcatccaaagtccaaaatcctcttgatgacctttacattgttgaatttacgttattggatgaccgcacactgcccaatgaatttccgggagatctagctgtaaacttaaagtacacattgaacgttgctgacatgaccttggacttggaatacgaggcaaaactggtcagcggtgaggctactcccatcaacatgacgaatcacacgtacttcaatttaaacaaaactatggataaaaaatccattagcggtacggaggttaggctctgctcagataaatcattggaagtaagcgaaggagcactaattccaaccggtaaaatcgttcaaagaaaaattgctacttttgactcctccaaacctaccattctgcaggatgatggcccgatttatgactacgctttcattgttgatgaaaataagaatttgaaaacgacagactcagtaagtgtaaacaagctcgtccctgccttcaaggcttatcatccggcatcacgactttcattggaggtttcaacaacagaaccaactgtcctattttacacaggtgacaacttgtgtgatggatttacgccgagatctggctttgccgttgaacaaggcagatatgttgacgcaatcaaccgtgatggatggagagactgcgttcttttgagacgtggtgaggtatatacttctaagactcgatatcgttttgcggtgtag

SEQ ID NO: 2318 - DNA, 1026 bp, Saccharomyces cerevisiae
atgtctgaacaggagtctgatgaagttaagcgtatgaaacaattggaagaggctagaaagagagtagaagaattgaagaaaaagaaaaataaaaagaataaaggtaagaagaataaaaatagcagtgccacaggctctataggatctgaaactcctgatttagagggcacaccaggcgaagagtccacacaggaggagactgtgaaagcaaattccaccaaaagtgaaaacaacgatcaaaatgacgtggatgaggagagtgaagaaaaagaaatagaacaggttaaatcagatccttcgggcacaacagaaaaagatattgaggaaataaatagtacttcatcaaatgtgggaaaggatgatgcagaaaacacaaaaaaagaggaagttcaagaagttataaaaaataacaacgatgagcaaacagcagatgccggaaagaccatagaaccacaagaggaaaagaaaattgtacaaactcaagaaggaaacgaaccttcaaatacatcagaagcagcagacgatttatttgccaatgacggcaatgaagaatctgactttctcaccacgattaaaaagcaaaaagaagaagatgagttgaccaaactaagggcggaaaatgagaaactcacacaggaaaataaacaactgaaatttttgaatatggaaaatgaaactactgtcgatgacctacaggatcaattgcaggaaaaagaagacatcattaatggtttacaaaacgatttgcaaaccgcaagggatgaattaattgccgcagtagaaaaattaaaattagcagaagctaaggcagcaagaaataccacagcaactcctattcaatttgcggatttcaacacttcaagcaataatctaactccctcacaatctgtaaccaattctggtacgcaggtggcccacgggaataatatggaagtggatcgcgttatgctgaacaaatggcgccagtggaacgtagacatgaccacttggagaagtattggttctggcccaataatggaattttga

SEQ ID NO: 2319 - DNA, 1026 bp, Saccharomyces cerevisiae
atgtctgttccaatccctggtattaaagatatctccaaacttaagttcttttatggtttcaaatatttatggaatccaacagtatacaataaaatctttgataagctggatttaactaaaacgtataaacatccagaagaattgaaagtacttgacctctaccctggtgttggtatacaatcagctattttttataataaatattgccccaggcaatattctttattagaaaaacgctcaagtctctacaagtttctgaatgcaaaattcgaagggtctccattgcaaattctaaaaagagatccatatgactggtcaacctactcgaatctaattgacgaagagcgaatatttgttcctgaagttcaatcctcagatcatattaatgataaatttctaaccgttgctaatgtgacgggggagggttctgaaggtcttataatgcagtggctgtcctgtattggaaacaagaactggttgtataggtttggtaaagtaaagatgttattatggatgccaagcacaacagctagaaaacttctagctaggccaggcatgcattctagatccaaatgttcagtagtaagggaggcatttacagatactaaactcattgccatatcagacgcaaatgaattgaagggatttgatagtcaatgcatagaagaatgggatcccattttatttagtgctgcggaaatatggcctacaaagggaaagccaattgcgttagtagaaatggacccaattgacttcgattttgacgtagataattgggattatgtcacgaggcacttaatgattttgaaaagaacacccttgaatactgtcatggactcgctgggacatggtggccaacaatattttaatagtagaatcactgacaaagatctgctaaaaaagtgtccgattgatttgacaaatgacgagtttatatatctaacgaaattattcatggagtggcctttcaaaccagatattttaatggattttgttgatatgtatcaaacagagcactctggttga

SEQ ID NO: 2320 - DNA, 1029 bp, Saccharomyces cerevisiae
atgaaggtcgagaaatcatctaaaggcttggaagttttagtgaggacacaggaggatgatctagaggggttctctttcctggagattatggaccgcgtagaccctttaccattagacttcgagaattacaaaaatttcaaagagggcatttactatatgtgtacacacgatggcacaaagatcggtttcgtgttgaaatttgcgataaatgaaatggagactgtttgctcggaaatcttcgaagaaaccttccaattagatgaatctagacatgagttaaggtttaaaagtgaagattttgatcatagaaacaatctaattgaccaattggctcgtaaaatgtatttagaatcatccttgagtggtgtgaagggctggagaaacgagaaatatgccgtttgggttaataaaaaaccctatgtactggttgagcgtgcagtagcaggtgttcttggtataattacctacgggattcatattaatggttatgtgctagatccaaagtcaaaaaaagttcagttttgggttccaagaagatctaaaacgaaacaaacatggccgctaatgcttgacaacattatcgccgggggattaggttatccttatggtatctatgaaacagttttgaaagaaagcatggaggaagccaatctagaaaagagtgttattgaggataacattaaagcaactggttcagtttcctacctttactttacgggtgatatttctgtaacgaagttcaataaggaatcagattttatcgtaggggaagtacaatatgtatacgatctaaaactcagcgaagacatcattccaaaaccaaacgatggtgaagtcgagagtttcaatttattcagcctgcaagagacgattaatgctttaagaaaaaaagagttcaaaccaaattgtgcattggtaatggtagatttcttgattagacatggctacatcactccagaaaatgagcccaattatcttgaactagtaactagaatgcacagaaggttaccattccccaccttgaattaa

SEQ ID NO: 2321 - DNA, 1029 bp, Saccharomyces cerevisiae
atgaatgaaaacgagtacgataattttgatgatttggatgaccttttagatgaagatcccactaaactggatgaagcagagcccgatgatgtgcaagcgaagggttctgtgtacaacgatagtgaaaacaaagagaagaatgccgaaagtaaggacagtgatggcgtacaggtagctaatgaatctgaagaggacccagaattgaaagaaatgatggtagatttgcaaaatgagttcgcaaatttgatgaaaaataacggtaacgagaataatgtgaagacagaagattttaataaactgattagtgctctagaagaggcagctaaagtacctcatcaacagatggagcaaggatgtagtagtttgaaaagtaacagcactgataaagggaccgtgaatggtagcaatccgggatttaaaaacattgtttccaatacgctagacaggttaaaggaaaatggtaataaagttgatacatccctagccgaagaaaccaaggaatctcaacgcagtggccaaaataataatattgatgatatattgtcacaattattagatcaaatggtagcatctggtggaaaagaaagtgcagaaaatcaatttgatctaaaagatggggagatggacgacgcaataacaaaaatacttgatcaaatgacgtcaaaagaagtattatatgagcctatgaaagaaatgcgtagtgagttcggtgtttggtttcaagaaaacggtgaaaatgaagagcataaggaaaagataggcacctacaagaggcaatttaatatcgtagacgaaattgtaaatatttatgaattgaaagattatgacgagctaaagcataaagatcgtgttactgaacttttggacgaattagaacagcttggtgatagccctattagaagtgcgaacagccccctaaaacacggtaatgaagaagaagaactcatgaaaatgttggaaattgatggtaatgatccgaacttggggaaccttgataaggaattaaccgacggttgcaaacaacaataa

SEQ ID NO: 2322 - DNA, 1029 bp, Saccharomyces cerevisiae
atgataaaacatatagtttcgccattcaggacgaattttgttggcatcagcaagtccgtgctgtcaaggatgattcatcacaaggttacaatcataggttctggccccgctgcccacaccgctgctatatacttggcaagagcagagatgaagcccacattatatgagggaatgatggccaacggaattgctgctggtggccaattgacaacaaccaccgatatcgaaaatttcccagggtttcctgaatcgttgagtggcagtgaactgatggagaggatgaggaaacaatctgccaagtttggcactaacataattaccgagactgtctctaaagtcgatttatcttcaaaaccattcagattatggaccgaatttaatgaggatgcagagcctgtgaccactgatgctataatcttggccacgggtgcttccgctaagagaatgcatttaccaggggaggaaacctactggcagcagggaatatctgcctgtgctgtatgtgatggtgcagtccctatctttagaaacaagccattggccgttattggtggtggtgactctgcgtgtgaggaagcggaatttcttacgaagtatgcgtcgaaagtatatatattagtaagaaaggatcattttcgtgcatctgtaataatgcagagacgaattgagaaaaatccaaacatcattgttttgttcaacacagttgcattagaagctaagggtgatggtaagttattgaatatgttgagaattaagaatactaaaagtaatgtggagaacgatttagaagtaaatggactattttacgcaataggtcacagccctgccacagatatagttaaaggacaagtagatgaagaagagacggggtatataaaaactgtgcctggatcgtctctgacttctgtgccaggtttttttgctgcaggtgacgttcaggactctaggtatagacaagcagttacttctgctggttccggatgcattgctgctttggatgcagaacggtacctaagtgcccaagagtaa

SEQ ID NO: 2323 - DNA, 1029 bp, Saccharomyces cerevisiae
atgatgatactgggtaaagccgggatcctggcacagtatgggacaatatatgtgagacaaaataccattcggaataatttaagttcctgcatttttaagcagtcactatgtgcctttcattcattagcaaaggtgctgcaacaaaagcaagtcccactggacctttcatatgacataatcaagagagatgcagtaaaaactggggatgaagggaagccaagaccacctattatcatacttcacggcttattcggtaacaagctcaacaaccgaagcattggccgtaaccttaacaagaaattgggaagagacgtgtatctgctggacctaagaaatcatggatcctcaccacacagttcagtccataactacgaagtcatgtcggaagacgtgaaacactttatcacaaagcacgaattaaacaccaatggaggccctattataataggacactcaatgggtggtaaagttgccatgatgctggtcctgaaaaacccgcaactttgttcgatgttagtctgtatagagaacgctccggtgagtttgcgccctaacgctgagtttgtcgaatacatcaaagcgctgatggaaatcgtcaacgacaagggcaaaactatccgcacgctgaaacaggctgatgaacaccttgcagagaggatcggcggcaatgagctagtaaggcggtttctcctaacggcgctgaaaaaggtcaagatggacaattcatcgtctgtgtcgtcatatacattcgaagaacgaattcccctcgcaacactgaaagatgccattgtcaaaggtgaaattgccgcgtggcccctagatcctgctcgtgaacgatggacgcggcctgcgctattcatcagggctactcaatcgcattatgtggtagacgagtatcttccgatcatcggcgcgttctttccacgctttgaaacacgtgacatcgatgcgggtcactgggtaaatgcggagaagcctggggaatgtgccgaaagcatcgtcgattttgtggagcggcacgaggattaa

SEQ ID NO: 2324 - DNA, 1029 bp, Saccharomyces cerevisiae
atgcaatatagttcgaggttcctagaattgaatatcccggattcatttttaaatatcaataagattcctgatgctactaaatttattacagtcacttatatatgcttaactgcaacccttttctgtataaggagatccttgtacaacaagctagttcttgaagaccctaacttggactacaacttgattacttcgccgcttttgcaaatggtaccttcgcagatttggaggtaccccacctcattagttctatccaacttcatcgacactaaagcttggaaggtggtagtgaacttattgaatttgatcattggtggatccttcattgaacgcaattggaactcttccaaagaaatgttcaaatttatcatagttttaggttctcttacaaacgttctgatcatcatgctgactttgttagtatcttttttctctaataaggtaaggctggatattcccttagacgggaactacacaattttaatcggtttccctatcatttatagacagttattgcctgaaacaactataatccatctgaagacacctcaatttttggccaaaaactttaggttcaaattactacccatttttgtaatgtttacaatgacggtaacccaaataatatggtttcatcattttgctcaattgttctccatttgggttaccttttttgccagttggtcgtacttgaggtttttccagaaacttgcacccttgaattgtccctctttgccaacaactaattctcaaggtggtcaggaaatattggtcggcgatgcatctgatacttttcaattgatttacttctttcctgatctaattaagccgattttgaggccgattttcaatttcatttataatgtagttgttgtaaaatttaaagtcattaaaccttttcatgatattgatatagatattgggaacaccatcgcagaaagtagaggcgccaaaaaaattatgactgtagaagaaagacgaagacagttagctttacaagttttggaagagcgtatggtaaacccttga

SEQ ID NO: 2325 - DNA, 1029 bp, Saccharomyces cerevisiae
atgcatacagctgaatttttggaaacagaaccaacagaaatctcatctgttctagcaggtggttataatcacccactgctgagacagtggcaaagtgagcgtcaactgactaagaacatgttgatttttccgctattcatctccgataatccagatgactttactgaaattgactctctacctaatatcaatagaatcggtgtaaataggctaaaagactacttaaagccattagtggccaagggtttgcgttctgtgatcttgtttggtgtgcctctcatccctggtaccaaggatccagtgggtacagcggctgacgatcctgcagggccagtcattcaaggtattaaattcattcgtgagtatttccctgaactgtatattatttgcgatgtctgtctctgtgaatacacttctcatggccattgcggggttctatacgatgatggtactattaatagagaacgtagtgtctctagattagcagctgtggcagttaactacgctaaagctggtgcgcactgtgtggctcccagtgatatgatcgatggtaggatcagagatattaaacgaggcttaataaatgcaaacttggctcacaagaccttcgtgttatcctatgcagctaagtttagcggtaatctatatgggccattccgtgatgctgcttgttcagctccttcgaatggtgataggaaatgttaccaattacctcctgccggtcgtggcctggcacgtagggcgttggaaagggatatgagtgaaggtgccgacggtattattgttaagccttccactttctacttagatataatgagggatgcaagtgaaatttgtaaagacttaccaatctgcgcatatcacgtgtcgggcgaatacgcaatgttacatgctgcagctgaaaaaggtgttgttgatttgaagacaattgcctttgaatctcatcaaggtttcttgagggcgggtgccagattaatcatcacttatttggctcctgagttcctagactggttagatgaagaaaactaa

SEQ ID NO: 2326 - DNA, 1029 bp, Saccharomyces cerevisiae
atgctacacttacaaccacaaaaccttctcatccaaaagacactgaatgaagcgatagaggcacttcgcaagggttcgccgttgaccatggacagaattgtttccgatttcgactataccacctaccacatttcaaacacagcagaagataagtccattctgttgttgagtgttaagaccaaagcttgggtaagtgtctctgagtgccaattggacggttctttgacgttactgaagtttctggccgaccactactcctctttgggtggggtgactatcccaagtgaagtggagcccggctatgactacactcttcagattacgttggccgaattggttcaagaatcgattttacaactgtctgttttgaagaccattatattgagttttcccttcgaattggccatttcgaagtttattgaactaagccagcagcaaccggcacctgtcgaagcagaaattactggcggtgaggttgctgccaatggagacaacactttgttcacaatcaagtatcgtgacgaggagaacatcttcatcaaaccttccaatgacagagttaccataatcttcgagactatttttcaagacgaaacagataaaatttttggcaaggtctttttacaagaattcgtggatgcacgtaagagaaaccgtcaaatccaatccgctccacaagttttatactcacatgaaccaccattggagttgaagagactatatcaaccacctaaagttgcagagcaaagtagaagatttatcacgtttgttcttttcccacgtcatttccagacaaaagagttgcaattccattcaatttgccagttaacattgtttagaaactacttccattatcacataaagtgctctaaagcctacatgcactccagaatgagattcagagtggactcgttcatcaaagtcttaaatagagccaaggtggacgaagatgatgaaaatgatgaattgagtgcagaaggcagacaacaggcaagaagaaccttcaccggtagaaagattgtctactag

SEQ ID NO: 2327 - DNA, 1029 bp, Saccharomyces cerevisiae
atggaagaaaataaacttagtggaaataaaccgattcaacttgctacctggtcgaaccagatggggtcaccagaaaacaatggaaataatgcaaataatggtagtgatgtacagaatgttattcagaaagctttaggcttgattcgacagttgaacaataatgggctaatgagtccgatggaagaagagcattcgcaaccttcatcttcacaagagacacttagtgtcgatagagagattaatgaacagggccgtttgcgtcttcttatgcaagcaaaagatgataatacgcggaaggaagtaggcacatattctagtccgatggattctgcgtacgccagggaaaatatgttaaacgttttgcaatcattagttacgcatctgaaccaagctgtcagccaaatacaacaattaaaattcaagaacatgattcttacttcaaatgaaaataatattcagtcgaggcatgaagtggaagataatctccagaaacagcaatttgaaaggatgaagtgtcagtttctattggaacgtcaaagtttgaaggatcaattgcgaaagcgagagaataaaattgttaaatataagcagaaaattattgaaaagaacaagaaattaaacaatctagcaaaagtacttaatcaacatgcaatatctgatacctctcaaatagatagtttcagtagctcggtaaagaaaacgccttcgtcgactacaacgccccaagaaatgaagtcggacatgttgaacaccttgggaatattggccacacatgtcttgaaagatgaaattgacgatgattctggaaatcaaacgattctgcaactggctgcagggagtataagcaacgattgtaacactacggagttggaaattacgtgcagtcctgaaatgggaaggactattacacacaatcgaccaaatactaaagatgagtcaattcaggattcacatgggaataggaccctccaattgcccaaaatgaaaagtttcagtaccatagacggaagcattaaggatattaagtga

SEQ ID NO: 2328 - DNA, 1029 bp, Saccharomyces cerevisiae
atggattctgagttgaaagggcagcagctaagtgatgcagaatggtgtgttaaaaaaattaatggtgagggaaattgtctcctattatttctaccgatgtcatctccaaccacaattgtaatgattgttttagtttccttggagcgcttagttccctacgttttcaaactttcacaaactcaattatcacagcaatgccagagccaaggttttacggatagtatatcattaaatctaattaaactaaaactaatggacattctacaagctcctcaagaaattaaccaaattggattggtagattcaaatttggtttttagtttcgatgtatctgcggatattacagtttccataaatagcgtaccttcacatgttactaaggatatgttctatatgattttgcaaagtttatgcatgcttttattaaaattggtaaacctttccacccaataccactatgtacaacgggatattttgaatgaaaagcaaaaatgcttagattttcttttaatttctcttcgtgatttagacggtgggagtaaagttatcagtcaatgggctcctgaaaattctaagaattatgaatctctgcagcaatgcacagacgatgacataatcaaaaaattactacataaaggaaaattccagcatcaagaatttctggcggactcattaaaaacattattatctttaagaaacaaatttcaagatgtgtcgcggtttgaagaatctggagaacttaacaaaaaagagcgcgtcagatttcctgcggtgaatcatttttataatgatgattttgaattgcaagcagaccctacaaatgaggctcgaccaaatagccgcggtaaaattaaaccaaagacagatttcaagccaaaatctagagaaagtagtaccagttcgcaacttcgcctggagaatttttctgaatctgaggctacaccagaaaaaacaaaatcaagttcttctttggtcgaagaatacccacagaaaaaaagaaaatttggaaaggtgagaataaaaaactaa

SEQ ID NO: 2329 - DNA, 1029 bp, Saccharomyces cerevisiae
atggttttagttaagcaggtaagactcggtaactcaggtcttaagatatcaccgatagtgataggatgtatgtcatacgggtccaagaaatgggcggactgggtcatagaggacaagacccaaattttcaagattatgaagcattgttacgataaaggtcttcgtacttttgacacagcagatttttattctaatggtttgagtgaaagaataattaaggagtttctggagtactacagtataaagagagaaacggtggtgattatgaccaaaatttacttcccagttgatgaaacgcttgatttgcatcataacttcactttaaatgaatttgaagaattggacttgtccaaccagcggggtttatccagaaagcatataattgctggtgtcgagaactctgtgaaaagactgggcacatatatagaccttttacaaattcacagattagatcatgaaacgccaatgaaagagatcatgaaggcattgaatgatgttgttgaagcgggccacgttagatacattggggcttcgagtatgttggcaactgaatttgcagaactgcagttcacagccgataaatatggctggtttcagttcatttcttcgcagtcttactacaatttgctctatcgtgaagatgaacgcgaattgattccttttgccaaaagacacaatattggtttacttccatggtctcctaacgcacgaggcatgttgactcgtcctctgaaccaaagcacggacaggattaagagtgatccaactttcaagtcgttacatttggataatctcgaagaagaacaaaaggaaattataaatcgtgtggaaaaggtgtcgaaggacaaaaaagtctcgatggctatgctctccattgcatgggttttgcataaaggatgtcaccctattgtgggattgaacactacagcaagagtagacgaagcgattgccgcactacaagtaactctaacagaagaagagataaagtacctcgaggagccctacaaaccccagaggcaaagatgttaa

SEQ ID NO: 2330 - DNA, 1029 bp, Saccharomyces cerevisiae
atgtcaaatagtaacggtgataataagtatggtgtcattacaattggtgatgagaaaaagttccaagctaccattgcgccacttggtgcaactttggtagacctgaaggtaaacggccaatcagtcgttcaaggttattcaaacgtacaagactatttaacagatggtaacatgatgggcgctacagttggtcgttatgccaaccgtatcgccaagggtgttttcagcctggatgatggtcctcacaagttaactgttaacaattgtggtaacacaaatcacagcagtatcagttccttaaatcttaagcagtacaaggcgtcccctgttgagaatccttccaagggcgtttacgttgttgaatttaaattgttggatgatcacacacagcccaaccctaacgagtttccaggtgacttggaagtcacagtgaagtacactttgaatgttgcagaaatgactttagacatggaataccaagcacagttagttcgtggtgatgctactccaattaatatgaccaaccactcgtattttaacttgaacaaagtcaagagtgagaagtccattcgtggtacagaagttaaggtctgctcgaacaaatcgcttgaagttacagagggggcattgcttccaactggtaagatcattgaaaggaacattgctacttttgattcaactaagcccaccgttttgcatgaagatactccggtctttgattgcactttcattattgacgctaacaaggatttgaagactacagattctgtgagtgtcaacaaattggttcctgtttttaaggcctatcatcccgaatctcacatcaaatttgaggtttcgacgacagaaccaaccgttcatttgtacaccggtgataatttatgtggcaaatttgtgccaaggtctggatttgccgttcagcaaggtagatacgttgatgctatcaaccgtgatgagtggagaggttgtgttcttctgaagcgcggcgaggtatacacttcaaagactcagtacaaattcgatatttag

SEQ ID NO: 2331 - DNA, 1029 bp, Saccharomyces cerevisiae
atgtcagttttcgtttcaggtgctaacgggttcattgcccaacacattgtcgatctcctgttgaaggaagactataaggtcatcggttctgccagaagtcaagaaaaggccgagaatttaacggaggcctttggtaacaacccaaaattctccatggaagttgtcccagacatatctaagctggacgcatttgaccatgttttccaaaagcacggcaaggatatcaagatagttctacatacggcctctccattctgctttgatatcactgacagtgaacgcgatttattaattcctgctgtgaacggtgttaagggaattctccactcaattaaaaaatacgccgctgattctgtagaacgtgtagttctcacctcttcttatgcagctgtgttcgatatggcaaaagaaaacgataagtctttaacatttaacgaagaatcctggaacccagctacctgggagagttgccaaagtgacccagttaacgcctactgtggttctaagaagtttgctgaaaaagcagcttgggaatttctagaggagaatagagactctgtaaaattcgaattaactgccgttaacccagtttacgtttttggtccgcaaatgtttgacaaagatgtgaaaaaacacttgaacacatcttgcgaactcgtcaacagcttgatgcatttatcaccagaggacaagataccggaactatttggtggatacattgatgttcgtgatgttgcaaaggctcatttagttgccttccaaaagagggaaacaattggtcaaagactaatcgtatcggaggccagatttactatgcaggatgttctcgatatccttaacgaagacttccctgttctaaaaggcaatattccagtggggaaaccaggttctggtgctacccataacacccttggtgctactcttgataataaaaagagtaagaaattgttaggtttcaagttcaggaacttgaaagagaccattgacgacactgcctcccaaattttaaaatttgagggcagaatataa

SEQ ID NO: 2332 - DNA, 1029 bp, Saccharomyces cerevisiae
atgtccggattcgcaaaactcaagtcgtggttatacaaagcttcccttttcgtttctttgatacttttgattgggttttcagttgttttacccatagattccattgcacaagcttctaaatcagaaaacaatgcctttaatacgttcattgttgtaggcgctttagttgtctttggcgttttttgtatctttattattattggaagaatgctatttcataagagttgtttaaaagatataccaagaagatatattccgatcacacctgctgatctcccgcatcgttctagtagggaagcagtactgcagaacatggaaagatctaaagaattaacaattcttctcaaaaaacctaaagaccctgttattcacgacggacttgagcccccgaggagatgtgactacccattagatgaaaagttatttccagaatacctaaactatgctgattgtataaaaagtttaacagatagactgaaataccatggattgtttctgaacaatttagatgttagaatgaatctagaagatacgtttgccgacgtggtgaactcacaatttgttaatcacaacgccaataaaattcagttagaaaaggcgaaggagtttatcgatttatatgaaacaattagattttcagggaaggacgttactagagaccagttcataaagtttgttaagttttgtctctatttcggtgaagtgtcattaacaagagacacttcatttgcaaatttacataattttagattaaatggcagttcaaataacattggaagaactgaatcaaaatattcaataaacccatttgatgaaaacgaatacgcgcaggatgatatgcattactttcccgaaccgcctacacatttggttagagaaagtagcataagtactgtcgcaaggcatgtttcatcaggtgtagatctgactaattctgaagaacatcctttggatacggattctgattgtaacgcccttcgtctcaaactttccaaagcggatagttatagaagtgtaattcgtcattag

SEQ ID NO: 2333 - DNA, 1029 bp, Saccharomyces cerevisiae
atgtggaactcactaaaagcattcgctctagtgttcggaggttgttgctccaatgttattacatttgaaaccttaatgagcaacgaaacaggcagcattaataatctcattactttttgtcaatttttatttgttacatgtcagggactccccgaatttctggatgttcatcaacctttcccttacttcaagcctctgaaaactccacttcacgtttatgtcattactgtcgttttattttatatttcatctacgacgaataataacgtatttaaatacaacatatccattccgattcatatcgttttcagatgcttcggaaccgtaataaccatgtttacatgctggttattaaatggtaggaaatatacaaagattcagattttatcaacactatttttaaccattggagctataattgcctcattattcaaagatgctgattttcggtaccaagatttgaaactgcaagcgtggaaaattggaagtgaccaatctgtagatctcacttttatttttggcatttgtatactagtactttcatcattcacatcatctttactttcagcatacaatgaacgtacgtatcaaaaatatggaaagcattggaaggagaatatcttttacagtcattttttatcattacctctctttctatttagtcgaaagcagttaattcacgaatatcgagtgatgagaaagtctgaaagaatattgtgttcaaattttggagggaagattctagtcccgcgagaagaaactctccttcttttcaatgtgttaacacaatatttttgcgtcaagggtgttaatatcctcgccagtaaaacaaacgctctgacactttccataacattacttgtaagaaaatttataagtcttttactgagcgtccgacttttcgataataacttgtcatatactggctacatcggggtctacctagtcttttttggtgcctttatatactcgctgggatcaattcaccccaggcaaaatgacaagggggcgataaagaaaagtaaatga

SEQ ID NO: 2334 - DNA, 1030 bp, Saccharomyces cerevisiae
atgtcttttctacaaaatttgtatgttgctattttcttttctacttcaagtattattgttcatcttttattaacaaactgggtatgagttaccttttgaaagcagtcatataagtcccggccaaacaataagatctactagaggtttcaagtggaatactgccaatgcagctaataatgcaggctctgtatcgcctactaaggcaactccccataacaatactattaacggcaataataataatgccaatactattaacaatagagcagattttacaaacaatccagtaaacggatataatgaaagcgaccatggaaggatgtctcccgtcctcactacgccaaagaggcacgcccctccgcctgaacaattacaaaatgtaacggactttaactatacaccatcgcatcagaagccgtttctacaaccgcaagcaggtacgacagttacaacacatcaagacatcaagcaaattgtggagatgacactggggtctgagggagtccttaaccaagctgtgaagttaccgcgtggtgaggatgagaatgaatggctagcggttcattgcgtggatttttacaatcagattaatatgttatacgggtccatcacagaattttgctccccacaaacatgcccgaggatgatagcgacgaacgaatatgaatatctttgggcatttcaaaagggtcagccccccgtttcggtaagtgcccctaagtatgtggaatgtttgatgaggtggtgtcaagaccaatttgatgacgaatctctttttccttccaaagtcaccggtaccttcccggagggattcatccaacgagtaattcaaccaattctaaggcgattattcagagtttatgcgcatatttactgtcatcattttaatgaaattcttgaactaaatttacaaaccgtactaaacacaagttttagacatttttgtctttttgcacaagagttcgaactactaagaccggctgattttggtccgctgttagaattagtgatggagttgagggataggtag

SEQ ID NO: 2335 - DNA, 1032 bp, Saccharomyces cerevisiae
atgaaaatgcccagtattattcagattcagtttgtagccctaaaaaggcttttggtagaaaccaaagaacagatgtgcttcgcagtgaaaagtatatttcagagagtatttgcgtgggttatgtcattaagcttgttttcatggttttatgtaaatcttcagaatattttgataaaagcattaagggtagggccagtgcctgaacatgtctcctttatcatggatggtaaccggagatatgccaagtcaagaaggctaccagtaaaaaaaggccatgaagctggtgggttaacgttactaacactactgtatatctgcaaaagattgggtgtaaaatgtgtttccgcctatgcattttctattgaaaattttaatagaccaaaagaagaagtagatacgctaatgaatttgtttacggtaaagcttgatgaattcgcaaaaagagccaaggactataaggatcccttatacggatctaaaataagaatagtaggtgatcaatctttactatctccagaaatgagaaaaaaaattaaaaaagtggaagaaatcacacaggatggagacgatttcactttatttatatgttttccttacacttcaagaaatgatatgttacatactattcgtgattcagttgaagaccatttggaaaataaatcaccaaggattaatataagaaaatttactaataaaatgtacatgggtttccattccaataaatgtgaattattaatcagaacaagtgggcataggaggctctcagactatatgctatggcaagtacatgaaaatgccaccattgaatttagtgatacgttgtggccaaattttagcttctttgctatgtacctgatgattctcaaatggtccttcttttccaccattcaaaaatataatgagaagaatcactcattgtttgaaaaaatacatgaaagcgttccttcaatatttaaaaaaaagaaaacagctatgtctttgtacaactttccaaacccccccatttcagtttcggttacaggagatgaataa

SEQ ID NO: 2336 - DNA, 1032 bp, Saccharomyces cerevisiae
atgaagttttttagtttggcagatgaggcagaatttaagtcaataatcatttcaaaaaacaaagcagtagatgttataggatctaagttaggtggtcaagtggtttctttttcagatgaatggtttgcttctgctgaaaatttaattcagccaactgctcctataagggatcctaccagatttgttcattcaggcgcatggtacgacggctgggaaacacgaagacataatgagatggaatacgattgggttatcatcaagatgggagtcgctgctgcccatattattggtggtgaaattgacactgcgtttttcaatggtaatcatgcaccatttgtatcaatagaggcgctctatgacgagggcgaagaaggtaatatagtggaagatgactcgcgttgggttgagattgttgagaaatttgagtgtggtccttcgcaaaggcatcttttcgttagaggcaacggccttactaaagaaaggtttactcacatcaagctgaagatgtaccccgatggaggaatcgccagatttagattatacggaagagttgttcctccagaactcaaaacgaaggatcatataattgacttggcttatgtttgcaatggtgctgtcgctttaaagtattctgaccaacacttcggttcagttgataatttgctactgccaggtcgaggtcatgatatgtcggacggctgggaaaccaaaagatcgagacaaccaggtcatactgattgggcggtaattcaactgggcagggagtcttctttcattgagaagattattgttgatacggcacacttcagggggaacttccctcagttcattaccgtggaaggttgcttgaaggagtcagaatcaagtgagaacactggtgaaggaacatgggtagagctagttggtaagtcaaagacggggcctgacaaagaacatgtgtatgaaatacgtaagagtataagagtctcccatgtcaaattaacgattattccagatggaggagtgaaaagaataagagtttgggggtactga

SEQ ID NO: 2337 - DNA, 1032 bp, Saccharomyces cerevisiae
atgagcgaagataaagctaaattagggaccacaaggtctgccacggaatatcgtttatccattggtagcgctccgacttcaagaaggtcgtctatgggtgaatcctcatccctgatgaaatttgctgatcaagagggattaacgagttccgttggcgaatataacgagaataccatacaacagcttctgttgcctaaaataagagaactgagcgattcaatcattactttagattccaatttcacgcgcttaaattttatccacgagagtttagctgatcttaatgaatccctaggttcgttgttgtacggtattatgagcaattcatggtgcgtagaattctcacaggcgcctcatgatattcaagacgatttgatcgctattaaacaattgaaatcgttggaagatgagaaaaataacttagtaatggaactctccaatatggaacgcgggattaaaagaaaaaaagacgaacaaggtgaaaatgatttggccaaggcatctcagaacaaacagtttaaccagccgctatttccctcctcacaagtaagaaaatacaggtcatatgacaacagagacaagaggaagccctccaagataggcaacaacttacaagtagagaatgaggaggactatgaagacgatactagtagtgaagcttcttttgttctaaatccaacaaatatcggtatgtccaaatcatctcaaggtcacgtgactaaaaccacgcgtttgaataataataccaacagtaaactgagaagaaagtccatcttacatacaatcagaaatagcattgcttccggcgctgatttacccatcgaaaacgacaatgttgttaatttgggagatctgcatccaaataatcgaatatcactcggaagtggtgctgcaagagtggtcaatgggcccgttacgaagaacagaaattcaatgttctcaggacgtgctgaaaggaaacccacagaaagcagacattctgttgcaaagaaaactgaaaaaaaaataaatacaaggccccccttcagatga

SEQ ID NO: 2338 - DNA, 1032 bp, Saccharomyces cerevisiae
atgagtaatgcaaacaatagtgctatgaaccacatcacgttgcctcccatctcgtcatttgacaaccttatcaaggcagccgagagacaatataatggcgaggcttcgtccgcctcgacacatccgacactgcctaatatgaacattagtaacggcagtggcagtgcgggcgcatcatcgtcgatgctgagctatcagttgcttccgcactccaatgatgtgtcccggtcgaactccagctcgagcttccttccctccgtgcagcagcctacggaaggttccgcttctgcatcggaaacttcttcatctgcatcaccttcacgttccatttcaccaattttaaaagtggctggtccttcatctgttggcggtgccggggtgagtaccccccatagcaccaaaatcaataagccaaggaaaaagaagcaatgtccaatttgtcgtaatttttatgccaatctgaccacgcacaaggcaacgcacttgacgccagaggatcggcctcacaagtgtcccatctgccaccgcgggttcgccaggaacaatgacttattgaggcataagaaaagacattggaaggatgagatactgtcccaatcgggagtactttcgaaccataatgatggtaagggaggatccgtttctcccaatgatgatgatacccatgaaaaaatgacaccgatgaattctgtcacagattatgcacaattgaaatcgttgcatcaaatcaagggcacattcaagtgcccattcaactccaccttaatacaattggacatggatatgtacccgtataaactgaaacctttaaattttgagacttccaattgtcaccagacgggggtgttctcacgttgcgacaccttcaaaaaccatttaaaggctttgcattttgaatacccgccaggcacgaagaaaaaggatagaaatgttgttcctggtagatgtaagcattgcggcctgaagttcgagaacgttgacgtttggctcaacgaacacgtaggtaaacaatgcggctataaataccattga

SEQ ID NO: 2339 - DNA, 1032 bp, Saccharomyces cerevisiae
atggtcaaagtcgcaattcttggcgcttctggtggcgtgggacaaccgctatcattactgctaaaattaagcccttacgtttccgagctggcgttgtacgatatccgagctgcggaaggcattggtaaggatttatctcacatcaacaccaactcaagttgtgtcggttatgataaggatagtattgagaacaccttgtcaaatgctcaggtggtgctaataccggctggtgttcccagaaagcccggtttaactagagatgatttgttcaagatgaacgccggtattgtcaaaagcctggtaaccgctgttggaaagttcgcaccaaatgcgaggattttagtcatttcaaaccctgtaaacagtttggtccctattgctgtggaaactttgaagaaaatgggtaagttcaaacctggaaacgttatgggtgtgacgaaccttgacctggtacgtgcagaaacctttttggtagattatttgatgctaaaaaaccccaaaattggacaagaacaagacaaaactacaatgcacagaaaggtcactgttattgggggtcattcaggggaaaccattatcccaataatcaccgacaaatcgctggtatttcaacttgataagcagtacgagcacttcattcatagggtccagttcggaggtgatgaaattgtcaaagctaaacagggcgccggttccgccacgttgtccatggcgttcgcgggggccaagtttgctgaagaagttttgaggagcttccataatgagaaaccagaaacggagtcactttccgcattcgtttatttaccaggcttaaaaaacggtaagaaagcgcagcaattagttggcgacaactctattgagtatttttccttgccaattgttttgagaaatggtagcgtagtatccatcgataccagtgttctggaaaaactgtctccgagagaggaacaactcgttaatactgcggtcaaagagctacgcaagaatattgaaaaaggcaagagtttcatcctagactcttccaagctatga

SEQ ID NO: 2340 - DNA, 1032 bp, Saccharomyces cerevisiae
atgtctgagccaaacacaccattacatgctcaaccgaatgagcaactggacttgaacaacttaaatgatctagatgaaaaagacattgatgatttaaacttggatccaaactcagatgtagaaattagtgcagactcaggtgatgtcgtaaattctaacatagacaacgttatatggcagcgtaattgtaataagaaaagaagatatcatacaccagaattcaatgatgtttacaatgaaactaacaacacaatcaacgacgtaactatgctcgatgatgttgacgatttccagcctagaataaacgtgtcttctcccttttcgtctgccacaaagctgagtgaattattgccaaatgatcacaatggaacgtcacacccgagaagattgtcaatgtctcaacaatccaaattcatctcttacgttgatgatcagcttttacaaattcaaagaaaatttgttcaatccaggggcctgaatatcaaaaacggctatgccagtcttactccgctgctgcaggatttaaaaactttagttgacttcgtttggtattctattgcccatgttccaaactcagactatttacttcaatcagaagaaaagagacattgcccagattcccgaaacccaaaagatacatgcggatattctagttattttggtcaagggtcctatttaataaaaattgcggacgatctcatcgattacgttgaaaaatttacattcaaaaatatggaagactcagagattaatgacactttatccaaattattcaaactcttcttcatccttgacaggatatttgtaattctaactgatgataatgataattgcaaagaagtccctaaaacgtcttcagccagcaagaacatagcaggattgaatgggactgatattgtgaggttaaaaggtatcgcggaacgaacaagagttcgcctacccatatttttggaatcccagggtatccatggttaccattatgaattaagcaagatttacgagggatttttagaccatgccaattcattttaa

SEQ ID NO: 2341 - DNA, 1035 bp, Saccharomyces cerevisiae
atgaagataaaaattgacattatacattttattaacgcccccccttttttttttttttttgttgatgcagaagcctcgcaacttaaagcttttcagttgtttcttcttggtcatattttttatacatatatacatacatatatgcatgtgctgtgtactacatgctgcctttcttcaatttttatgtatagacaaggaggccagaaagatattataaacaatgttttttatgtgaacttcgaagtactttgaaaatcaaccctcccatcttgcgagacggtcgcaataaacagtgagggtctgttggcaagctcaatgatctttgaatttacatcgttagccacttgtttctctaaattgacaccgttatcattcacgttgctcttcttaacgtggcccttggacgttagtttagttagaatattatctttggatgttgtcatttcatgcgtttgaatcaatattgttcttggacctttaatcttcataaagtacgagtcgacaccataaatgtatcttttttcgtactggttacggatccaactgcgcattcttttgaaaaattgaacagtatgtccgtaagcagattttagcgtttggttcttaatgaatttaggtgccaccgtatcattacttgaatctccgacgtacgcgccttccacgtgtaactcttgtctctccactgaatttgcaatatccaattgactttggccgttgatggccaaaatgtttctggaattaaccagaattttgtcgctttcatcaattaactcaattgaatataccaacccacctccacatactaacacatttcctctcccattcagaatttgaaatttccgtggtagttgtgattttgatgagttcgagactaaagaccttgcagagggaaagataggcgatttgatttccagactggagttctgttcaaatgcgataattgaatccttgccaaatacattccaatcctttgtcccggtcaaattcagtacggacaagcttcttgaagaatcgaaaggtcttctcgatgtttga

SEQ ID NO: 2342 - DNA, 1035 bp, Saccharomyces cerevisiae
atgacattggcagagttgcttggacggtcgagaatagctcaagtagctaacaatcataaaccattgacatacactggcaaaaaatttcatccaacacatcaaatcatcgaaactaagccatcgacactatacagacaagaatgggggttgaaatccgctattccttcgaaaattaaatctcgatatttggtgtacaacgatttggatacgttggaaagaattaccacattcgaacctagaggcggtacgcaatggaataggctaagatttcaagaaatgggagtaccaattgtgtctaatataggcagacaaaatccatttttcaagtacatatctcgtcctgaggatgagtctcatgctaaattgtccttattcaaagaaatgaaaggagatacagatatttcgcctgctgctatgaagaagcgtttgaagaagataacagcactaattagatcgtttcaagatgaatttaaagagtggctggtggaaaatcatccggatgaattgaaattgaattctaataagctggaagactatgtagtgaagtttctaaacaaaaagttggaaacaaaaacgaataaaaaatttaacactgaaatcattggtacaggtggattatcatacagcttgccaggaaagctaaaaaactcaccaaatggtgtcattcaaaggactgtagtacccggtagaatcttgaacgttgttaaggagaacaacgacaataaatggctggcagctattggtgggtttgtggccgatgtggtatttttccaatcaccacctagttcctttaactccatgggagatttcatcagaatgaaaacgttcttgttcgagatcttggaggcatctatggagaaaaatggttctgtttcgatgcacgctagattactcgaaccacaaaatgacaagaccagagaatttttcaataagagaccaatttataaaccattgacctctagaagggcacgtcgaccatcagtgggaaacattcaagaggccaataaccttttgaatataatcaagggaaattga

SEQ ID NO: 2343 - DNA, 1035 bp, Saccharomyces cerevisiae
atgagtgcgggtatcggagaatcacgtacagagttgcttacatggttgaatggcctccttaacttgaattacaaaaaaattgaggaatgtgggacgggagcagcatattgtcaaataatggattcaatttatggagacttgccgatgaacagggtaaaattcaatgccacggccgaatatgagtttcaaaccaactataaaattttacagagttgctttagcagacatggaattgagaaaacagtgtacgttgataagttaatcagatgtaaatttcaagataatttagagttcttgcagtggttaaagaaacattggattcgacataaagatgaaagcgtgtatgatccagatgcaaggcgcaagtatcgtcccattataacgaataatagtgcaaccaaaccccgtacagtatccaaccctaccactgcaaagaggtcatcaagcacaggcactgggagtgccatgtcaggaggattagcaacaagacattcttcgctgggaataaacggtagcagaaaaaccagtgttacccaaggtcagttggtagcgatacaagcggaattaactaaatcgcaggaaacgatcggttcattgaatgaagagatagaacaatacaaaggaacagtaagtactttagagattgaaagagaattttacttcaacaaactacgcgacatagaaatcctggtccataccactcaagatttaataaatgaaggtgtttataaatttaatgatgagaccatcaccggccatggtaatggaaatgggggagcattattacggttcgtcaagaaggtggaaagtattttatatgctactgcagaaggatttgaaatgaatgatggtgaggatgaattgaatgataaaaatctgggtgaacatggaactgtgccgaatcagggcggctatgcgaacagcaatggcgaggtcaatggtaacgaaggtagtaaccatgatgtgataatgcagaacgacgaaggtgaggttggcgtgagcaacaacttgatcatcgacgaggaaactttttaa

SEQ ID NO: 2344 - DNA, 1035 bp, Saccharomyces cerevisiae
atgatagtagattatgaaaaggaccctagggctaaagaggctattgctatttgggaaaaaggtgtactgaaagagaaggatgggtcaatgtcagatgctataaacttctatcgaagtgcattgaaaatccatgataatgtggaatcactgtacagaaaaaaaatacttgatgagtggatgctgcacaaaaaactatcgggattatcaatgactactgatgctccagatgaacaaaatgaaaccggtaaagatgacttatctgttgaagaaaatgctgaacttcaaccctgctggattctggaaatcttgcctgacgacattttactgagaattattaaaaaagttatattaatgtctggtgaatcttgggtgaatttgtcgatgacttgttccacctttagcaagctttgcttccacgattctgtgccatttaaaactttcgcgaagtacatatattctaagcaaatatacgacaaaatggcaatggatcttaacggaatcaccgatataaatacctttgaaaaggaaatatggcggggtgatgattatcgtatgttaagggaaaggccatatattaaattcgaaggtgtttacatcagtgtagtaaattatgtaagatacggttccaatgcagaaagttcgttatctcttttaaagccagttcacatgatcacctattacaggtatttcagattttatgagaacggccaatgtttgagattactttctacagatgaacctagcgctgtcgtgaagcacttctccaaagagaacaaacccaggcatagtcatatgtgttattggagcctcggatttgattatgattttggtcatttaaagataacaaggtcagatgaaaagtatacgtttatcgaagaattccaaatcaagaatcaaggcaataagagatatcaacggttgaaatggctaagttcaattgtagtggataaggaagggaatgcatctaactgttcgttgagaaatgagaaatcttttttcttctccagagtgaaatctttcaaggatcctggatga

SEQ ID NO: 2345 - DNA, 1035 bp, Saccharomyces cerevisiae
atgattagaaccgtaaaacccaagaatgcaagagccaagagagctttggtaaagagggaagctaagttggtagagaatgtcaagcaagcgctattcattccagggcaaagctgtaacaagaatctgcacgatattatggtagatttgagtgccttgaagaagccagatatgaagaggttcaatcgtaagaatgatattcatcctttcgaagacatgtcgccactagagttctttagtgaaaagaatgactgttcattgatggtgctgatgacaagttccaaaaagcgtaaaaacaacatgacctttatacgtacatttggctacaaaatatatgatatgattgaactaatggttgcagataatttcaagttgttatctgattttaagaaattaacatttactgtagggttgaagcctatgtttacattccaaggtgctgcatttgatacacatcccgtatacaagcaaattaaatctttgtttttagatttctttagaggcgaatctactgatttacaggatgttgcgggattacaacatgtcatttccatgaccattcaaggtgacttccaagatggtgagccattgccgaacgttctattccgtgtttacaaattaaaaagttataaaagcgaccaaggtggtaagagattaccacgtattgaattggtggagattgggccacgtctagatttcaaaatcggcagaattcatactccaagtccagatatggtcactgaagctcacaagaagccaaaacaattagaaatgaagacaaagaagaatgtagaattagatatcatgggtgataaattgggtagaatccatatgggcaaacaagatttgggtaaactacaaacaagaaagatgaagggtttgaaatccaaattcgaccaaggaactgaagaaggtgatggagaggtagatgaagactacgaagatgaagcgtcgtattcggatgatggacaagaatacgaagaagagttcgtcagtgccactgatattgagccctctgctaaaagacagaagaaataa

SEQ ID NO: 2346 - DNA, 1035 bp, Saccharomyces cerevisiae
atgcattgcccaatttgccaccatagagcgcatgtagtgtactgtgcacattgtatcaatacgagcccaagtctgctactgaagctaaaactagatttaattttattaaaggatgagaataaagaacttaacgggaaagtcgaacaaatattaaacgaggccatgaactatgaccagttagatatcaagaggatggagaaaaagaaagatcccctgatgaatagtctcatgaagttagatgttttacgaatgaaaaagaataataacctgattaggcacaggatagaacagctaaatgagcggatttatagtaaaaggaatcacatcagcgaattgaaagtagaaattgacaattataaatgttataaggtgggtactggtacggacaaattaagagagcaagtggaaattagtgatgcaaaaaataagctggcacaagtatcgaagatttgtgaatcggctagagattacaagctcaatctactaaataattggtttgtgatccagaagctgcaagataatttccaaatacctttcgctatagcttttcagccactaatatctttgaaaaacttccgtattttacctcttgctataacaaacgattccatcaacatcatgtggaagtatattagcttcttctcagacattcttatgattaaacttccctacacaaataaaatctgtgaacaacccatgtttgagttttccgatagcatacagacagtagtacaaaggttgatcaagcttatcataaatattttacagatatgtagacatttgaaactcgtaccttcaacacccatggatatcccatggctactggaccagtacgatgtggatgggctgttctataatatggtgaaacggaacaagatgaagtgtaggtccgtctcgctatattggacttttgggatgttgtactcgatggttttggataacatgaataatccacaaagaggacatcctgcaaggcggaccgcaccacctccaacagtcacaggacctcatgaccgatggtacgtggtaggctag

SEQ ID NO: 2347 - DNA, 1035 bp, Saccharomyces cerevisiae
atggaaaaaaatacggcaccatttgtcgtcgatacggcacccacaactcctccagataaacttgtagcaccttctatagaggaagtaaatagtaatcccaacgaattaagagctcttagagggcagggtagatattttggcgtaagcgatgatgacaaggatgccattaaagaggcagcacctaaatgtaataattgctctcaaagaggtcatttgaagaaggattgtccccatataatatgttcgtactgtggggcgacggatgatcattattctcgacattgtccgaaggctatccagtgttcaaagtgtgatgaggtgggtcattacaggtcacaatgtccacataaatggaaaaaagttcagtgcactctttgtaagagtaagaaacactcaaaagaaagatgtcctagtatatggagagcatatattttagtagatgataatgaaaaggctaagcccaaggtccttccctttcatactatatactgttataactgcggtggaaaggggcactttggtgatgattgcaaggaaaaacgatcatctagagtacctaacgaggatggaagtgcgttcactggttctaatttgtcagttgagctaaaacaggaatattaccgtcacatgaacagaaattcggacgaaaatgaagactatcaatttagtgagtccatatacgatgaggatccactaccgagaccttcccataaaagacattcccaaaacgatcactctcatagtggcagaaataaacgtagagcatcgaacttccatcctcctccttatcaaaagtctaatgtcattcaaccaactataaggggcgagacgctgtcactcaataataatattagtaaaaattcacggtatcaaaatacaaaagtaaacgtctcgtcgatatcggagaatatgtatggctccagatataacccttctacttatgttgataataacagcatttccaactcttccaattacagaaactacaattcttatcaaccatataggagtggtaccttggggaaaagaagataa

SEQ ID NO: 2348 - DNA, 1035 bp, Saccharomyces cerevisiae
atggccgatttcttattgagaccaattaagcaacgtcatagaaacgaggacaagtacgtgtcggtggacgctgcagacggatcggtgtctaaaattgagcccatcgcagattttgtaattaagacaaaactattatccgctaatgggccggaaaaactgcaagatggcaggaaggtgttcatcaatgtttgtcactctccgttagtgcccaaacctgaggtcgattttaatgcaaggatagtgttcccgctcatcatccaaaacgaatgggagattcctattattacatcctgctaccgcatggaccatgacaagaaggggcaggagtgctatgtgtgggattgctgcataaatagcgattgctcgcgctggatatgcgatgatatccaactgcgagagatactggtcgaatggtgcttggagtcatgtgagatccgagattcggtggtattgtgcagagatcgcattgcattccccaagatgaagaagaagggcgctgagcttcctgcactagaggtattgaatgatgagttacatcaagattacaaggcaaaaatgcataaaatcatagaagaggaggccggagacccgatgagtatattgagaggaaggaatgacgatggcgatgataataatgatcccgacgatggaacactaccaccattgttccctatcgagaacaaaatctccggagccaagatagaggagattgataagaacgagattgctcacagaaacctgaaacaggcacctgcacctgcacctgcaccgcacgagcagcaggaggacgtgccggaatacgaggtaaagatgaagaggttcaaaggggccgcctacaagctgcgaattcttattgagaacaaagctccgaactcgaagccggaccggttctctccgagctacaacttcgcagagaatattttatacattaacggtaagctgagcatacctttgccgcgcgacatagtcgtgaatgcagcagatatcaagattttccatatccgcaaagaacgcacactatatatatatatataa

SEQ ID NO: 2349 - DNA, 1035 bp, Saccharomyces cerevisiae
atgtctaatacagttctagtttctggcgcttcaggttttattgccttgcatatcctgtcacaattgttaaaacaagattataaggttattggaactgtgagatcccatgaaaaagaagcaaaattgctaagacaatttcaacataaccctaatttaactttagaaattgttccggacatttctcatccaaatgctttcgataaggttctgcagaaacgtggacgtgagattaggtatgttctacacacggcctctccttttcattatgatactaccgaatatgaaaaagacttattgattcccgcgttagaaggtacaaaaaacatcctaaattctatcaagaaatatgcagcagacactgtagagcgtgttgttgtgacttcttcttgtactgctattataacccttgcaaagatggacgatcccagtgtggtttttacagaagagagttggaacgaagcaacctgggaaagctgtcaaattgatgggataaatgcttactttgcatccaagaagtttgctgaaaaggctgcctgggagttcacaaaagagaatgaagatcacatcaaattcaaactaacaacagtcaacccttctcttctttttggtcctcaacttttcgatgaagatgtgcatggccatttgaatacttcttgcgaaatgatcaatggcctaattcataccccagtaaatgccagtgttcctgattttcattccatttttattgatgtaagggatgtggccctagctcatctgtatgctttccagaaggaaaataccgcgggtaaaagattagtggtaactaacggtaaatttggaaaccaagatatcctggatattttgaacgaagattttccacaattaagaggtctcattcctttgggtaagcctggcacaggtgatcaagtcattgaccgcggttcaactacagataatagtgcaacgaggaaaatacttggctttgagttcagaagtttacacgaaagtgtccatgatactgctgcccaaattttgaagaagcagaacagattatga

SEQ ID NO: 2350 - DNA, 1035 bp, Saccharomyces cerevisiae
atgtctgattatgttgaactattgaaaagaggtggtaacgaagccatcaaaattaatccaccaaccggtgctgatttccacattacatctcgtggttcagactggcttttcaccgttttttgtgttaacctactattcggtgtgattttagtcccactaatgtttagaaaaccagttaaggacagattcgtatattatacggccattgctccaaatttgttcatgtcaattgcttatttcaccatggcttctaacttgggttggatcccagtcagagcaaagtacaaccatgtacaaacttctacccaaaaggagcacccaggttacagacaaattttttacgctagatacgttggctggtttttggctttcccatggccaattattcaaatgtctctacttggtggtactccattatggcaaattgctttcaatgttggtatgactgaaatatttactgtctgctggttgattgctgcctgtgtccactctacttacaaatggggttactacaccattggtattggtgctgccattgttgtttgtattagtttgatgacaactacattcaacctggtcaaggccagaggtaaggatgtctctaacgttttcattactttcatgagtgtcatcatgtttttgtggctgattgcttacccaacctgttttggtatcacagatggtggtaacgttttgcaaccagattctgctaccattttctatggtattattgatttgttgatcctatctatcttgccagttcttttcatgccattggctaactatttggggattgaaagattaggtttaatcttcgacgaagaacccgctgaacatgttggtccagttgctgaaaagaagatgccatctccagcttctttcaagtcatctgattctgactctagtatcaaggagaagttaaagctaaagaagaagcacaagaaggacaagaagaaggctaagaaggctaagaaggccaagaaggccaagaaagcccaagaagaggaggaggatgtagccaccgactctgagtaa

SEQ ID NO: 2351 - DNA, 1035 bp, Saccharomyces cerevisiae
atgtcttcttcagtagcctcaaccgaaaacatagtcgaaaatatgttgcatccaaagactacagaaatatacttttcactcaacaatggtgttcgtatcccagcactgggtttggggacagcaaatcctcacgaaaagttagctgaaacaaaacaagccgtaaaagctgcaatcaaagctggatacaggcacattgatactgcttgggcctacgagacagagccattcgtaggtgaagccatcaaggagttattagaagatggatctatcaaaagggaggatcttttcataaccacaaaagtgtggccggttctatgggacgaagtggacagatcattgaatgaatctttgaaagctttaggcttggaatacgtcgacttgctcttgcaacattggccgctatgttttgaaaagattaaggaccctaaggggatcagcggactggtgaagactccggttgatgattctggaaaaacaatgtatgctgccgacggtgactatttagaaacttacaagcaattggaaaaaatttaccttgatcctaacgatcatcgtgtgagagccattggtgtctcaaatttttccattgagtatttggaacgtctcattaaggaatgcagagttaagccaacggtgaaccaagtggaaactcaccctcacttaccacaaatggaactaagaaagttctgctttatgcacgacattctgttaacagcatactcaccattaggttcccatggcgcaccaaacttgaaaatcccactagtgaaaaagcttgccgaaaagtacaatgtcacaggaaatgacttgctaatttcttaccatattagacaaggcactatcgtaattccgagatccttgaatccagttaggatttcctcgagtattgaattcgcatctttgacaaaggatgaattacaagagttgaacgacttcggtgaaaaatacccagtgagattcatcgatgagccatttgcagccatccttccagagtttactggtaacggaccaaacttggacaatttaaagtattaa

SEQ ID NO: 2352 - DNA, 1035 bp, Saccharomyces cerevisiae
atgtttaaatcattggctgctgtcttgcctagagctagcaaggcaaagttcctccagaaaaattacgcctccactttagctttcattgaaagctcaaaagatggctctgtttcaaggtcatcattgagtttattggctgctgcacaaaagttgtctaaccctatcacagctgtaatcacaggtagcaaagctgaaaaaactgctgaggcgctaaaatcttcatattcatgcagcaatttagaaaagcttgtcatatttgaagattcaaaattagatacctgtcttcccgaacaactaactccgttattagtgaaactattaaaaggcggcgactattcacattttgttgtctcaaactcctctgttggaaaaagtgttttacctcgggtgggtgcgctcttggacgtccaacctgtttgtgaggttactgtaatcaaagatcctaagacctttataaggccaatttatgcaggtaacattatttctacaatagaatgccaggcagaaaaaaaactgttgattattagggcatcagcttttccaccaattgcagagggtagtatggattctgttaccattgagaagagaactgatattcctccttgtgacttaaatgttacctgggttaaaactattcttaccaagagtgaaaggcctgaacttacttctgcacagaacgtggtaactggtggaagggcactcaaggataaggagacatttgagaagctattatcgccgctagcagatgttttgcacgctgctataggtgccacaagagcttctgttgataatggactatgtgataattctctacaaatcggtcagactggtaaggtagtcgcaccaaatttgtatatagccattggcgtttctggtgcagttcagcatttagcgggaatgaaggattcgaaagttatcgttgccattaacaatgatcctgatgcccctatatttaatgtcgctgactatgggttgcaaggggatctttacaaaatagtccctgaactaactgaaaaacttggtaaatataaataa

SEQ ID NO: 2353 - DNA, 1038 bp, Saccharomyces cerevisiae
atgaacactaccacatctactgttatagcagcagttgccgaccagttccagtctttgaactcttcttcttcatgtttcttgaaggttcatgttccttccattgagaacccattcggtattgaattatggccaattttctccaaagtgtttgaatactttagtggctatccagctgagcaattcgagtttattcacaataagactttcttggctaacgggtatcatgctgttagtattattatcgtttattacattattatctttggtggccaagctatcttacgcgccttgaacgcctctccattaaagtttaaattgcttttcgagatacacaacttgtttttgacttctatttctctagttttatggttgctgatgttagaacagttggttcctatggtttatcacaacggtctattctggtctatctgctctaaggaagccttcgcaccaaaattagttactctttactatttgaactatttgaccaaattcgtagaattgattgacactgtgtttttagttttgagaagaaagaagttattgtttttgcacacttaccatcacggtgccaccgctttgttgtgctacactcaattaattggtcgtacttctgttgaatgggtagttatcctactaaacttgggtgttcacgttatcatgtactggtactacttcttgagttcatgtggtattagagtttggtggaagcaatgggtcactagattccaaattattcaatttttgattgacttggtatttgtttactttgctacctatacattctatgctcacaaatacttggacggtattttaccaaacaagggtacttgttatggtactcaggctgctgctgcttatgggtatttgattctaacatcttatttgcttttgtttatttccttctacatccaatcttacaagaaaggtggtaaaaagacagtcaagaaggaatctgaagtttccggctccgttgcatccggttcttctactggtgtcaagacctctaacaccaaggtctcttccaggaaagcttaa

SEQ ID NO: 2354 - DNA, 1038 bp, Saccharomyces cerevisiae
atgaccatagataactacgacaacagtaaacaggatagcagcaaatacgaggttagtggtacgggtgatggcaggaacggcgatggcggcttgcctctagtacaatgtgtcgcaagagctcgtatcccaaccacacagggtccggatatctttttacatctttacagtaacaacagggacaacaaggaacatctagccattgtgtttggtgaagacatacggtcgcgctcgctattccgtagaagacagtgcgagacgcaacaagatagaatgatcaggggcgcttatattggcaaactgtatcccggcagaactgtggcagacgaagacgatagactcggattagctctggagtttgatgatagtacaggtgagttattagcttccaaagccactacatgggacgcccataacgacacgctggtacggatccattctgaatgttacaccggtgaaaacgcatggagcgcccgttgtgattgtggtgaacaattcgatagggccggtaggcttatcgcttgcgaccacgaacccacaagcaacatcaaaggtggaaacggccatggtgttatcgtgtatctaagacaagagggtcgtggcatcgggttaggtgagaaactcaaggcctacaacctgcaagacttaggtgctgacacagtgcaggccaacttaatgctgaaacatcccgtggatgctagggacttctcgctgggtaaggctattttgctggatcttggcatcggtaatgtcaggctgctgacaaataacccggaaaagataaaacaggtagatcatgcgccttaccttaagtgcgttgaacgagtgcctatggtacccatacactggacaaactccagtgaaggcatagactccaaggagatagaaggttatctcaggaccaagatagaaagaatgggtcatttactaacggagcctctgaaacttcatacaaaccctcaacctactgagacaagtgaagcccaaaaccaaaaccgtatgaactctgcgttgtcatcaacatcgacgctggcaatataa

SEQ ID NO: 2355 - DNA, 1038 bp, Saccharomyces cerevisiae
atgagttacggcttaacaggtacctcttctaagctaagaggaactagttcaatattttcatggactcaggtgaggcacttttctcgtagaagaatagcctatccattttatccattcaagaaattgggaagacaacacccgaagaagcatgatacaaacttaaagactgctatgagacagtttttaggtccaaaaaattacaaaggagaatatgtcatgaacaagtattttacggttccgacgaatcatgtacctaactacattaagccagatttggaaaggggacaaagtttagaacacccggtaaccaagaagccattgcaactaaggtatgatgggacattaggtcctcctcctgtagaaaataaaaggttacaaaacattttcaaggatagattgttgcaacctttcccttcaaatccacattgtaagacgaattacgtattaagcccgcaattgaagcaaagcattttcgaagagattactgtggaaggactttctgcccaacaagtttctcaaaagtatggattaaaaattcctcgtgtagaggctattgttaaactggttagcgtggaaaacagctggaacagacggaatagagtatcttctgatttgaaaactatggacgagactttatatagaatgtttcccgtcttcgactcagatgcctcttttaaacgggagaatttaagcgaaattcctgttccgcaaaagactttggcgtcaagattcctcaccattgcagagtcagaaccttttgggcctgttgatgcagcccatgttttagaattagagcctgctgtagagaccttaaggaatttgtctactgtgggggaacattctagtggccatcaacaatccactaataagaatacgaaggttatatatggtgagcttgtcgaaggtgaaagatcacaatataaatttactaacgcaaaggttggaaaagtgggataccgttacggtagcggaaatagggataacaagaaagacagaagaattggctttaataaactgggccaaatggtatatatataa

SEQ ID NO: 2356 - DNA, 1038 bp, Saccharomyces cerevisiae
atgatgactagggagagcatagataaaagagcaggaagaaggggtcctaatctgaatattgtgctgacgtgtccggagtgcaaagtctacccaccaaaaatcgttgaaagatttagtgaaggggatgttgtatgtgctctatgtggtctagtactatcagataaactggttgacaccaggtcggagtggagaacgttttcaaatgatgatcacaacggtgatgacccaagtcgtgttggtgaggcttcaaatcctcttttagatgggaataacctatctacaaggatcggaaagggtgaaaccacggatatgagattcaccaaagaactgaataaggcacaaggaaaaaatgtgatggataaaaaggataatgaagtacaagctgcatttgctaagattaccatgctatgtgatgctgctgaattaccgaagattgtgaaagattgtgccaaggaagcatataaactttgccacgatgaaaaaactttgaaggggaaatcaatggagagtataatggctgcatccatactgattggttgcagacgtgctgaagtggcaaggacttttaaagaaatccagtcattaatccatgtcaaaactaaagagtttggtaaaactttaaacataatgaagaacattttaagaggcaagagcgaagatggtttcttgaagattgataccgataatatgagtggtgcacaaaacctaacttatatacccaggttttgttcgcatctgggcttaccgatgcaagtcactacttctgctgaatataccgcaaagaaatgtaaagagatcaaagaaattgcaggtaaatcccctattactatcgctgttgtttccatctatctaaacatcctgctctttcagatccctattaccgcagcgaaagtgggccaaaccttgcaagttactgaaggtaccatcaaatctggttacaagatactttatgagcatagagacaagcttgtggatccgcagcttattgctaatggtgtagtgtctttggataacttaccgggcgttgaaaagaaataa

SEQ ID NO: 2357 - DNA, 1038 bp, Saccharomyces cerevisiae
atgccaccaaaaaagggaaaacaggcccaagcggctggtaagaagaaggataatgtcgacaagacgttcggtatgaagaacaagaaccgttctaccaaagtccaaaaatacatcaaacaagtgcaatcacaatccgaccccaagaaagaagagatgaggttaaagaaactcgaagaaaaaaagcgcagagaagccgaagaagctgaacgaagagcactattcaaccctgtagcagaccaaagggttcgtgcgggtgtagatcccaagtccatggtttgtgctctgttcaaactggggaattgtaacaaaggtgccaaatgtaagttctcacatgacttgaacgtcggtagaagaatggaaaagaaagatttataccaagatacaagaagtgaaaaggaaaatgacacaatggacaactgggatgaagaaaagctgagaaaagttatcctgtcgaagcacggtaacccaaagaccaccaccgacaaagtatgcaaatacttcatcgaggccgtggaaaacggtaaatacggttggttttggatttgtcctaacggaggtgacaaatgtatgtacagacactccctaccagagggctttgtgctgaaaaccaacgagcaaaagaggctcgagagggagtcgctcgagaaacagccaaaaattacgctggaggagtttatcgaaacagaaagagggaaactagacaaatccaagctaacaccaataacaattgccaacttcgcccaatggaagaaggaccacgtcatcgcaaagattaacgctgaaaagaagttatctagtaagaggaaacctactggtagagaaatcattcttaagatgagcgccgaaaacaagtcatttgagacggacaacgccgacatgccagacgacgtcacccagggatccgcatgggatcttactgaattcacagatgccttgaagaaggctgaccaccaagacgacggcggcatcaaggactacggtgacggtagcaaccccaccttcgacatcaaaaaagccaactccgccacgctcgcatag

SEQ ID NO: 2358 - DNA, 1038 bp, Saccharomyces cerevisiae
atggaagcacataaccaatttttgaagactttccaaaaagaacgtcatgatatgaaagaagctgaaaaggatgaaatccttttgatggaaaacagccgtagattcgtgatgttccctatcaaataccacgaaatctgggctgcttacaagaaggttgaagcctctttctggactgcggaagaaatcgaattggctaaggacactgaagatttccaaaaattgactgatgaccagaagacctacatcggtaacttgttagccttgtccatttcttctgacaaccttgtcaacaagtacttgatcgaaaacttttctgcccaattgcaaaaccctgaaggtaagagtttctacgggttccagattatgatggaaaacatctactctgaagtttactccatgatggttgatgccttcttcaaggaccctaagaacatccctctattcaaggaaattgccaatttgcctgaagtcaagcataaggctgctttcatcgagagatggatttccaacgatgacagcttgtatgctgaaagactagtagcatttgctgcaaaggaaggtattttccaagctggtaactatgcttctatgttctggttgactgacaaaaagattatgccaggtttagcaatggccaacagaaacatctgtagagacagaggtgcctacactgacttttcatgcttgctatttgcccatttgagaaccaagccaaaccccaagatcattgaaaaaatcattaccgaagccgtggaaattgaaaaggaatactactcaaactctttgccagtagaaaaatttggtatggatttgaagagcattcacacctacatagaatttgtcgctgacggtctattacaaggtttcggtaacgaaaaatactacaacgccgtcaacccattcgaattcatggaggatgtcgctaccgctggtaagaccaccttctttgaaaagaaggtttccgactaccaaaaggccagtgacatgtctaagtccgctaccccatccaaggaaattaactttgatgatgacttctaa

SEQ ID NO: 2359 - DNA, 1038 bp, Saccharomyces cerevisiae
atggaaggcgtgtatttcaatattgacaatgggtttattgaaggtgtagtgagaggctacagaaatgggttgttatctaataaccaatacatcaacttaacacaatgtgacacgttggaagatctaaaattacaattatcatcaactgattatggtaattttctttcctctgtttcctcagagtctttgaccacgtcattgattcaagaatatgcttctagcaagttgtaccacgaattcaactacataagagaccaatccagtggatccacgagaaagttcatggactatatcacttatggttacatgatcgacaatgtagcattgatgattacaggtactattcatgatcgtgataagggtgaaattttacaacgttgtcatccgctaggttggtttgatactttgcctacgttgagtgttgctactgatcttgaatccctatacgaaaccgtattggtggataccccactggcaccttacttcaaaaactgttttgacacggcagaggagctagacgatatgaacattgaaattattagaaataagctgtacaaggcttatttagaagacttttacaattttgtcactgaagaaattccggaacctgctaaagaatgtatgcaaacattactagggtttgaagctgacagaagaagtatcaatattgcactcaactctttgcaaagttcagatattgacccagatttgaaaagtgacttgttacctaacataggtaagttgtaccctcttgcaacgtttcacttggcgcaagcccaagatttcgaaggagttagagctgctttagctaacgtctatgagtataggggatttttggagactggtaacttagaagatcacttttaccaattggaaatggaactatgtagagatgctttcacgcaacaatttgccatcagcactgtttgggcctggatgaaatccaaggaacaagaagttaggaatattacctggattgcagaatgtatcgcacaaaaccaaagagaaagaatcaacaattatatttccgtttattga

SEQ ID NO: 2360 - DNA, 1038 bp, Saccharomyces cerevisiae
atggtgactggtgaagaaaatgtgtatctaaagtcaagcttatccattctcaaggagctcagtctcgatgaactactaaatgtgcagtatgacgtgactaccttaatcgcgaaacgtgttcaagcactgcaaaatcggaataaatgtgttctcgaagaacctaacagtaaactggctgaaattctatgtcacgaaaaaaatgctcctcaacaatcctctcagacgtctgcggggccaggtgagcaagattctgaagatttcatccttactcagtttgatgaggacataaagaaagaatcagcagaggttcactatcgtaatgaaaataaacacactgtgcagttaccgctggttactatgccacctaataggcataaacggaaaatttcggagtttagttcgcctttaaatggcctcaacaacttaagcgatttggaagattgctctgatactgtaatccacgaaaaagataatgataaagagaacaaaacaagaaaactattgggaatagagctcgagaaccctgaatctacatcgccaaatttatacaaaaatgttaaggataatttcctgtttgacttcaatacgaaccctttaacaaagcgagcctggattctcgaagactttagaccaaatgaagatatcgccccggttaagagaggaagaagaaaattggagcgattttatgcccaagttggaaagccagaggattctaaacacagatcattgtcagtagttatagaatcgcaaaattcggactacgaatttgcgtttgataacttgaggaatagatcaaaatcccccccaggttttggaagactggattttccctccactcaggaagggaacgaggacaaaaagaaatcccaggaaatcatcagaagaaagacaaaatataggtttttaatggcaagcaataacaagatcccaccgtacgagagagaatatgtattcaaaagagaacaattaaatcaaattgttgacgatggatgtttcttctggagtgataaattattgcagatatatgctagatgttaa

SEQ ID NO: 2361 - DNA, 1038 bp, Saccharomyces cerevisiae
atgtacaactttttagaatttttcttcttttttataacgtacaccttatttaagagcactttcgttcaaggaaaaagttcatttcctggacatgatgtgtgtaagttcgaagaccaaaatttccagacagagttcttcttaaatgttcttaaaggtgacaagttacagaacttgaagcaggagtacgaacaatacaaaaaacaaagtactttgtacacaggctttgtaattgaaaaacaatatgaataccaggtagcgcccttgcaaatcaataattttcttcaagtgaccttttgtaaaggaggaaagccaatttggaatcatattctaccctttcaaaaggatttagattgggcagaaccactatgcattccagcccaggaggatgatactatctcccaaaacagctcagtatgtttcaagtttgcaagggtgcagaaatatacacagcgtaatgtaaccctttactttcctaataaatttgttggattcgtatttgtttgcaattcttcaaagacgcatccccccactcagaacaattttgaaactattccattaacgcctattatttctgatgatattagagattacaaaatatcttggtcaattaaaggaagaatcaccaaggtggtaccttatctacattcgttaagtattcctatgtccaaatatgagatgctcatccattcagataagaacatatcaaacgaattggaatataaatccttaacttcggagttttggaagagctataaaaacttaagaaagtttaaaaacaaagaaatgtcttggataaacgaaataaatcctatggagcaatatgatagctctgggaatgaaaatgtcccgaattttcatgaaaaactagaccgtacaataaatcggattgcgcaaaacatagaaaggcctcatgatgcactaataagagcgatagccgcacataatagaaactctaatagtggaaatattacaagaaggaaatatttgaggaggaagatctcaaagatgttaaaaaataagatacctcttaagaactga

SEQ ID NO: 2362 - DNA, 1038 bp, Saccharomyces cerevisiae
atgtctactttacaacgtcgtagagtcaatagggcggattctggagatacttcctccattcattcttctgctaacaataccaaaggagacaaaatcgcaaatattgctgttgacggggatgatgacaatggaacaaacaaaaagattgcatatgacccagaagaatcgaaattgagagacaacatcaatatccctacgttaacgttgatggaagaagtcttattgatgggcttaagagatagagaaggatatttgtcgttttggaatgatagtatttcatatgctttgcgtggttgtataattatagaattagcgttaagaggtaaaatcagaatcttagatgattccgccaggaaaaggttcgatctttccgaaaggttgattgaagttattgacagttccaaaactggggaagttttactggatgaaactttgcaattgatgaaaaacgacgaacctttgtcaatttctaactggattgatcttttaagtggtgaaacatggaaccttttaaagatcaactatcaattgaaacaagtaagggaaagattggcaaaaggtttggtcgataaaggtgtattgagaacagaaatgaaaaatttctttttgtttgacatggcgacacaccccattgcagacgccagctgcaaagaagccattaagcgcagagtactttctgtactcgtatcgaggaacatggaattaagttacaatgaatattttccggagacaacatctttcaaaatcattagaactttagctttaatatgtggatcatatggggcaaacgtattggagaatgtcctgactacgttggaatatgagaagagagataaggcaattagtagagctgaagaaataatggcacaattttcgcaatacccatttgatttagaaaaggaaactgagttaggtgtctccgttaatttaaacaaggaagttaaagaagagatagaaaacaatcctggtcatgatttacaattggaagttattgctggtgtatttgaagtcttttcaagaatggatatgctattatga

SEQ ID NO: 2363 - DNA, 1038 bp, Saccharomyces cerevisiae
atgtctgtcgccgatttgaaaaacaacatccacaagttagatactggctatggtttaatgagtttgacttggagagccgagcctatccctcagtcgcaggctttcgaggccatgcacagagtggttgagttatccagagaacgtgggcacaaggcctttttcaacgttggtgaattctatggtcccgattttattaatttgtcgtatgttcacgacttctttgcgaaatacccagatttgagaaaggatgtggttatcagttgtaaaggtggtgcagacaatgctaccttaacccccagaggcagtcacgatgatgttgtacaaagcgtaaagaattcagttagtgctattggtggctacatcgacatcttcgaagtcgcaagaatcgacacttccctatgcacgaaaggagaggtctacccctacgaatcgttcgaagcgcttgctgagatgatctccgaaggcgttattggcggtatttcattaagtgaagttaatgaagagcaaattagagctattcacaaggattggggaaagtttttgacctgcgttgaagtggaactttctttgttcagtaatgacattttacacaacggaattgctaaaacatgtgctgaattggggttgtccatcatctgctactccccactgggcagaggattgttgacaggtcaattgaagtcaaacgctgatatccctgagggtgactttagaaagtcgttaaagagatttagcgacgagtctttgaaaaaaaacctgaccttggtcaggtttctacaggaagaaatagtcgacaagcgcccacaaaacaactccattactcttgcacaactggctttgggatgggttaagcactggaacaaagttccggaatacagtggcgccaaatttatcccaattccaagtggctcttctatttccaaggttaatgaaaactttgatgaacagaaaaccaaacttaccgatcaagagttcaatgccattaacaaatatttgactactttccatactgttggtgacagatacgaaatggcgtaa

SEQ ID NO: 2364 - DNA, 1038 bp, Saccharomyces cerevisiae
atgttacgcaacatcatcaggttcaaaggatttggaaaagggaccagtggaggatttttaaaacctgtatcatttcgtgttcagttaacgcgatgttaccgctatgacaatggtccttcatatcgtcgatttaataatggagagtattcccaaaaatcatcgtttaaaagcattcttctcgataagtcatcaagaaaatacttagctttattatttggtggatgctctctcttttattatacacatttggataaagcaccggtaagcgataggtccaggttcatctgggtatcgcgtccattagagttaactatcggaaattacacatacaaatcaatttggagacaaacgcagcaggaaatattacctccacagcatccgctgtccatcaaaattgagaatattttcatgaaaattgtcgaagctgcttataaggaccctagtgtagacaactcactactggacggaatcaagtgggaaattcatgtggtcaatgatccaactgcttcaccaaatgcattcgttttaccagggggtaaggtctttatattcagctctattttacctatttgtgctaatgatgatgggattgccactgttttagcacacgaatttgctcatcagctagcaagacacacagccgaaaatttgtcgaaggctcctatatattctcttttgggtttggtgttatatactgttactggagctcatgctatcaacaatatactattggatgggtttttgcgaatgccagcatcaagacagatggaaaccgaagctgattacattggcctgatgataatgtcaagggcatgttttcaaccacaggagtcaataaaagtgtgggaaagaatggcaaattttgaaaagcaaatgaatagagggggtgttgtgaatatggagtttctaagtacacatccagcaagcactcgtagaatagagaatatgtcgaaatggttgccaaaagctaatgaaatttatgaacaatctgattgtagcagtatgggtaactattataaaagttttttctcaatgtaa

SEQ ID NO: 2365 - DNA, 1041 bp, Saccharomyces cerevisiae
atgaacacagattcacacaaccttagtgagccatacaatataggtggccaaaaatacattaatatgaaaaaaaaggaagatcttggcgtatgccagcctggcttaacgcaaaaggcattcacagtcgaagacaagttcgattacaaagcaattattgaaaaaatggaagtatacggactttgcgtggtcaagaattttatagagacctccagatgtgatgaaatattgaaagaaatcgaaccgcatttttatagatacgaatcatggcaaggctcaccgtttcctaaggaaactactgtggcaacgagatcggttttacactcatctacagtcttaaaggatgtggtatgcgaccgtatgttttgtgatatctcaaaacattttttgaatgaagaaaactactttgcggcgggaaaggtgattaataaatgcactagtgatattcaactgaactccggtatagtctacaaggttggcgctggtgcaagtgaccagggctaccaccgagaagatattgttcatcatacgacccatcaagcatgtgaacgtttccagtatggaaccgaaaccatggtagggttaggtgtagcttttacagatatgaataaagaaaatggctctacgcgaatgatagtcggttcacatttgtggggtccgcacgattcctgtgggaactttgacaagaggatggaatttcacgttaatgttgcaaagggagacgcagttctattcttagggagcctctaccatgcagccagtgcaaatcgtacgtcacaagacagagttgctggatatttttttatgacaaagagctacttgaaaccagaggaaaatcttcacttagggactgatttgcgagtgtttaagggtttaccattggaagccttgcaactgttggggctcggaattagtgagccattttgtggtcacatagattataagagtccaggacatcttatcagttctagtttgtttgaaaatgatatcgaaaaggggtactatggagagacaataagggtgaattatgggtccacgcaataa

SEQ ID NO: 2366 - DNA, 1041 bp, Saccharomyces cerevisiae
atgaaggcgtcgcacatttgctcttatttgctaagcattgcacccctagtggtgtcccatggagtacatcataatcgagatcatggccacgaggcaaaccatgagtccaagcaaagtttcttgattttgaagcaagaatccattttttactctctagtttgctttctgcagaaccacctctttgtcctgggaccccgttacaatgcgattgtggctatcctaatcatacaacttatgccgtgtcttttcgtactgtttgttcctggactgcgcaagaacgatcgtgccagcttgacactgtccttactagtttccttttctctaggaacactcctgggtgatattttattacacgtgatacctgaaagtctcagcggcgtaactgatgtcacaatggttggaggagccatatttctggggtttataagcttcttgactctggataaaacgatgcgtattctgtcagggacgtccaacgatgacggcagcatacattctcattctcatagtcatactccacaacaaactgcagagaagaaagcgggctttaacatgtctgcgtatctgaatgtcatatccggcattgctcatcacatcacggatggcatagcgctggctacgtcattctatagttccacacaagttggcataatgaccagcatagctgtcactttccatgagatccctcatgagctaggtgacttcgccattctgctttccagtgggtttacgttcccacaagcgataagagcccaagcggtgacagctttcggcgccgtcgttggaacgtccattggctgctggatgaacgaaatcgggaacaacagccataaagcaacgtcttcatccgcgaacgcatctgaacttatgctgccgttcacggcgggcggcctcatatacatagccactactagcgttgtaccgcagatcttacatagctccgcacccgatagcaagcttcgagagtttaagaagtgggccttgcagctagtcttcatttttgtaggatttgccgttatggcgctcatggatgagcattga

SEQ ID NO: 2367 - DNA, 1041 bp, Saccharomyces cerevisiae
atgacccttgatgatgacgactatataaaacaaatggagcttcaaagaaaagcttttgaaagtcagttcggatctttagagtccatggggttcgaagataaaacaaaaaatatacgaactgaagtagataccagagacagttcaggtgatgaaattgacaattccgatcatggtagtgatttcaaggatggtactatagaaagttctaattcttctgatgaagatagcggtaacgaaaccgcggaagaaaataatcaagattccaaaccgaaaactcaaccaaaggtcattagattcaacgggcctagtgacgtttatgttcctccaagtaagaagacacagaaacttttgagaagcggcaaaactttaactcaaataaacaaaaaattggagagtactgaagccaaggaagaaaaagaagatgagactttggaggcggaaaatttacaaaacgacctggagttgcagcaatttctgagagagtctcacttattgagcgctttcaataacggtggaagtggttctacaaacagtggtgtatcgttgactctacagagtatgggtggtggaaatgatgatggcatagtataccaggatgatcaagttattgggaaggccagatcgcgtacactcgaaatgagactgaatagactctcaagggtgaatggtcatcaggacaaaataaataagctggaaaaagtacccatgcatattagaagaggaatgatcgacaagcacgtcaagagaatcaaaaaatacgaacaagaagctgcagaaggtggaattgttctatccaaagtgaaaaagggacaattcagaaaaattgaatctacatacaagaaagatatcgagaggcgtatcgggggaagcattaaggccagggataaagaaaaagctaccaaaagggaacgtggtttgaagatcagtagtgtaggcagatcgacgaggaatggactgattgtatccaaaagagatattgctcgtatcagtggaggcgagaggagtggtaaatttaatggcaaaaagaaatcccgtcgctag

SEQ ID NO: 2368 - DNA, 1041 bp, Saccharomyces cerevisiae
atgaccgaacctcaaggtcctttggacaccatcccgaaagtgaactatccgccaatactgacaatagcaaactatttttccacaaaacaaatgattgaccaagtcatcagtgaggaccaggactacgttacgtggaaattgcaaaacctgcgaacgggtggtacatcaatcaacaaccaattaaataaatatccaaaatacaaataccagaaaaccaggataaatcagcaagacccggactctatcaacaaagtcccagaaaacctgatctttccacaagacattttacaacagcaaacacaaaatagcaattacgaagacaccaataccaacgaagatgaaaatgaaaaacttgcgcaggacgaacaattcaagctcttggtaaccaacttggataaagatcaaactaatcggtttgaagttttccatagaacatccctaaacaaaacccaggtcaaaaaactggctagcacagtagctaatcaaactataagtgaaaatattcgtgtttttctgcaagcggtgggaaaaatatacgctggtgagataatcgaattggccatgattgtgaagaataagtggttgacaagtcaaatgtgcatagagtttgataagaggaccaaaataggctataaattgaaaaaatatctaaaaaaattgactttctccatcatagaaaaccagcaatacaagcaagattatcaatccgatagcgttcccgaagacgaacctgatttctacttcgacgatgaagaagtagacaagcgcgaaactacgctgggcaactcgttgctacagtccaaatccttacagcaatcagaccataattcacaggacttgaagctacaactcatcgagcagtacaataagctcgtcctccaattcaacaaactagatgtaagcatcgagaaatataacaacagtcccttattgcccgaacacatccgtgaggcgtggagactctaccgtctgcagtcggacactttgcctaacgcttactggagaactcaaggagaagggcagggatccatgttcagatag

SEQ ID NO: 2369 - DNA, 1041 bp, Saccharomyces cerevisiae
atgatgtctgatttaacaccaatattccgtaagtatgttgctgttatcgatgatgctagaaatgagcaaaatggtatagatgatcatgttgaaaggaaacaagaggacttcgggaattctaatgaaacgtgtgaaatgtttagggattcgtttattaaggaatgtgcaagactattgaagttcctagtcgaattaaacaaggtaataaaacagattgaaaaaaactatttagatgactttaatatgagtgatgcggaaaaggacgagtttgacatggaatgcaggctgcaaattcaacaatatttcaaaaagtttgaattcctagagaattacgaaatggaaaggcataatttgtcgctgaaaagatttcagtcaaagtctcacagatggtcaaaaatactttccaataaaaacgacaacactaagcatgtgatacatccgcaagacattgaaaatggagtttatgaatttagattaggtgtcctacggtgtttgaatttgtggataaaatatgtttcatccaaattcactaccatacaacaggaaagattgatattagaaaataaaatgaatttcaattcaacgcctatgcctactttatccaacaatgcggatgatttctctgcagatgcaatagacatctcagtgtcacaatctgctcccgtagaaactgtacaagacgaagtaaaacattatgaagagacgatatccaaattaacccaggagcaactacaagtgttggagacagaacattcggaactgctaaatcaaaaaaatgagcaattgaaaaaagtggagactataaacaaaacaattttagacattgtcaatatacagaacgaattgtccaatcatttaacggtgcaatctcaaaatataaacctaatgctgaacaatcaagatgacattgaattgaatattaagaagggaaataaagaattacgtaaagcgaaacgagctgctggaagaactgctaaaatgaccacttatggtgccattatcatgggtgtttttatattgttcctagattatgtaggttaa

SEQ ID NO: 2370 - DNA, 1041 bp, Saccharomyces cerevisiae
atgcagaagagcatattgctgactaaacctgacggaacacaatcgaatctacacagcatcaaaacggaaacgcccaccacggtggagttcgactcggagcagatggaaaggggccacagggaaagaggtcgtagcaagaagaaaagaggcgaacgagactcaaacgtgagcagtctgtcgcggtcgagaagcagggccagtagccgcagcagagtaagggaggaagagttcctcaagtggaccgtgttgaggcaggacccctcgatgcggttgagggtcgtggatgtggattctgaagaggaaggtgagggcaacgacgaagatgacgacgacggcgacggcgacgatatggacgaggaagagtccgatgaagagcaagtgagcgatatagagaacgatttagagattgacgaggagttccactacgatctgggcatgaaagtgttacccaacttttgtaccagcataaacgaagtgctagactccagcaagccctggatagccaagtacgagatcagcatccgtggccacgaaaacgaagacgtgtctctggagcaactcgacggaggctacgtcagagccatgcaactactcaccaagggtgccggcgcagaggccgggaaccaaaggtccttcatcctctacacggacctgagcagcgagtccacctacgccctgacctatctcatgggcgcagctgtcaaccagggagacaccgtctacattgtccactgggagccctcgaagcccacggacgactcccagatgttcgccaacgttgccagaatcagaaagcacgtcatgcacctgtttgactgcgtcgcgggcgtgctcgacgacctcgacgtcgtcgtcctctccttgacccatccgtacccaaaacacctcctcaacgagatgatccacggcctcaagccagtcgccctgtgctgctccctctcggtcatcctgtccactctgcagaacttcgtctgctctgtgcccatcctcgcggttagaaagaagctgaaacgtgccaagcgcaagggcatcagcgagtga

SEQ ID NO: 2371 - DNA, 1041 bp, Saccharomyces cerevisiae
atggaggacggtaaacaggccatcaatgagggatcaaacgatgcttcgccggatctggacgtgaatggcacaatattgatgaataatgaagacttttcccagtggtcggttgatgatgtgataacttggtgtatatccacgctggaggtggaagaaaccgatccattatgtcagagactgcgagaaaatgatattgtaggagatcttttgccggaattgtgcttgcaagattgccaggacttgtgtgacggtgatttgaataaggccataaaattcaagatactgatcaataagatgagagacagcaagttggagtggaaggacgacaagactcaagaggacatgataacggtactgaaaaacttgtacactactacatctgcgaaattgcaagaatttcaatcgcagtacacaaggctgaggatggatgtcttggacgtaatgaagaccagctcaagctcttctccgattaacacacatggagtgtccactacggtaccttcttcaaacaacacaattatacccagtagtgacggtgtgtctctttcacaaacagactatttcgacacagttcataaccgacaatcaccgtcaaggagagaatccccggtaacggtatttaggcaacccagtctttcccactcaaaatctttgcacaaggatagcaaaaacaaagtaccccaaatatctacaaaccaatctcacccatctgccgtttcaacagcgaacacaccggggccatcacctaacgaggcgttaaaacagttgcgtgcatctaaagaagactcctgcgaacggatcttgaaaaacgcaatgaaaagacataacttagcagatcaggattggagacaatatgtcttggtcatttgctatggggatcaagagaggctgttagaattgaacgaaaagcctgtgatcatattcaagaacttaaagcaacagggtttgcaccccgccattatgttaagaagaagaggtgatttcgaagaagtagcaatgatgaacggaagtgacaatgtcacccccggtggaagactctaa

SEQ ID NO: 2372 - DNA, 1041 bp, Saccharomyces cerevisiae
atggatgaaatgcattcttcagacacacttttgttgcgaacaccgaaatcaaaaaaaaaaattgggcttgtaatacccagtacaccaagtaaaaaatgtaaatattcatcaggctttatagcagaagacactacgccctccaaacggtttcgtttataccaagccaaatttaagacaagttcaaagaatgtcaaagcccaaactcttagcgtatcaataaaaaaaaatcaaggtgaaatcaccaatccatttatgaccgaaggatataatgattaccggaatattgtcagtcctggattgagttttgataacgactgcttttcagaacatgaattagttagtccattgagtgatatatcttcgataaactcgacatcgcctgatgttgaaaagattgattctttagatccttttggcgttgattcttttgtctggaactgtaagccgcttgttaataaagaagcactggagctccaccgaatgattcattcttcgtttccgatgagcccactggaatccaacagtgatgtgccacttttattgcctaaactcaaaaaaaggttatctccagtaaacagatcgaccttcaagccaacaaggtacgaaccctctcaccgtctattgaagcccaaaaaatcaattctaacagtaccagccaaatctctgaatctcatagtcagttcgtcgcgaggctcattaaatgacgctaccatctttgccaccgaaataaattctactttgagcaatgaagaaaacaaattaccagcaatttctagtatttgggagaagctcacaattccagtaaactcttcaattaaggagaaatacaagaagcttaaagaccaaatatatgggcaagctagtaattttggcgaagatgaagataatgaagaagacaatgaagacgaccttcccgacgcggcagtaataagaggttacgaatttcagtcaggaaggcgcgatgagctgacgcaatgtaatgaactacagagtacgaaggactacaaaaaagttcagtgggcaaaggttttagaacaataa

SEQ ID NO: 2373 - DNA, 1041 bp, Saccharomyces cerevisiae
atgtcagcatcaaaagaagaaattgctgcccttattgtaaactacttttcttccattgtggaaaagaaagaaatttcagaagatggcgccgattctttaaatgttgctatggactgtatctctgaagcctttggctttgaaagagaagctgtttcaggcattttaggcaagtctgaattcaagggtcaacatcttgctgatatattaaattctgcgtcaagagttccagaatcgaataagaaagacgatgctgagaatgtcgagattaatattccagaagatgatgcggaaactaaagccaaagctgaggacttgaaaatgcaaggtaataaagcaatggccaacaaggattacgaactggcaatcaataaatatactgaagccattaaagttttaccaacgaatgctatttattacgccaatagagcggctgctcattcatccctgaaagaatatgatcaagcggtcaaagacgctgaatctgcaatttctattgacccatcttatttcagaggctactctagattgggttttgctaaatatgcgcaaggtaaacccgaagaagcccttgaagcatacaaaaaggttcttgatatagagggcgataatgcaacagaagctatgaaaagggattatgaaagtgccaagaagaaggttgagcaatctttgaatctggagaaaaccgttccagaacagtcaagggatgctgatgtcgatgcaagtcagggtgctagtgcgggtggattgccagatcttggttctttattaggaggtggtcttggaggtttaatgaacaacccacaattgatgcaggctgcgcaaaaaatgatgagcaatccaggtgcaatgcagaatattcaaaaaatgatgcaagatccaagtatcagacagatggctgaaggctttgcttcaggcggaggaactccaaatttgtctgacttgatgaataacccagcactcagaaacatggcaggcaatctttttggtggagcaggtgcccaatctacagatgaaacaccagacaatgagaacaagcaatag

SEQ ID NO: 2374 - DNA, 1041 bp, Saccharomyces cerevisiae
atgtcaggtgtaagctctgttatgctcggtcttcgacctgctacaagaatttttttccgcagtaatatttcggtttcaccttcgaggacttttgtatcatatattggaagatcccagagcacgtcgatactcaaaaatgctcccaacttagaggacaatgtcacaaatcttcagaaaattataccgaaacggttcttttctcaaacatcaattttgaaatcaaggtggaagcctatattcaatgaagaaactactaatcgatacgtacgtttgaacaggtttcagcagtaccagcagcagagaagcggcggcaatcctctgggctctatgactattttggggctctctttaatggcaggaatatattttggctccccttatttgttcgagcacgttccaccctttacgtattttaagacgcatccaaagaatctggtatacgcgttattaggcatcaatgttgccgtatttggactatggcagctacccaaatgctggaggtttctacagaagtacatgttgctgcaaaaggattacgtaactagcaaaatttcgataatcggaagtgcgttttcacatcaagaattctggcacttaggtatgaacatgctagcgttgtggtcctttggtacttcactcgcaacaatgttgggagcatccaattttttctccttatatatgaatagtgccattgcaggttctttgttttcgttatggtatccaaaactggcacgcctagccattgtcggacctagcttgggtgccagtggagcgctatttggggttttaggatgtttttcatatctattcccacacgctaaaattttgctgtttgttttcccagtcccaggtggggcttgggtagcattcttggcttcagtggcatggaatgcagctggttgtgctttaagatgggggtcatttgattacgctgcgcatttaggtggctctatgatgggggtcttgtacggatggtatataagtaaagctgtagagaaacaaaggcagcgtcgccttcaggctgctggtaggtggttttaa

SEQ ID NO: 2375 - DNA, 1042 bp, Saccharomyces cerevisiae
atggctagaggaccgtatgtttgactatagactttgattataattacgcaaggatgagaagaatgatagacaagaaacaagtggagtcttaaccaaacgaataggaacaacaatgaaccagtttatgtccatttaattttagatcatcctgggattgtacaaatattttacgagtaatgatttactaacgagcacaatgaaaaaaataaaatgtctgtatcttcattatacattcatttttgcccttttttctcatttttttccgtacagaaagaagcatctaaaaagattagcagctccacaccactggttattggacaagttgtccggttgttacgccccaagaccatctgctggtccacacaaattgcgtgaatccttgccattgattgtctttctaagaaacagattaaagtatgctttgaacggccgtgaagtcaaggctatcttgatgcaacgtcacgttaaagtggacggtaaggttagaaccgacactacctacccagctggtttcatggatgtcatcactctagatgccaccaatgaaaacttcagattggtctacgatgtcaagggtagattcgctgtccaccgtatcaccgatgaagaagcttcttacaagttgggtaaggtcaagaaggttcaattaggtaagaagggtgttccatacgttgttacccacgatggtagaactatcagatacccagacccaaacatcaaggtcaatgacactgttaagatcgacttggcctctggtaagattactgatttcatcaagttcgatgccggtaagttggtttacgttactggtggtcgtaacttgggtcgtatcggtactatcgttcacaaggaaagacacgatggtggtttcgatttagttcacatcaaggactccttggacaacactttcgtcactagattgaacaatgtcttcgtcatcggtgaacaaggtaagccttacatttctttgccaaagggtaagggtatcaagttgtctattgctgaagaacgtgacagaagaagagctcaacaaggtttataa

SEQ ID NO: 2376 - DNA, 1044 bp, Saccharomyces cerevisiae
atgaacaggaaagtagctatcgtaacgggtactaatagtaatcttggtctgaacattgtgttccgtctgattgaaactgaggacaccaatgtcagattgaccattgtggtgacttctagaacgcttcctcgagtgcaggaggtgattaaccagattaaagatttttacaacaaatcaggccgtgtagaggatttggaaatagactttgattatctgttggtggacttcaccaacatggtgagtgtcttgaacgcatattacgacatcaacaaaaagtacagggcgataaactaccttttcgtgaatgctgcgcaaggtatctttgacggtatagattggatcggagcggtcaaggaggttttcaccaatccattggaggcagtgacaaatccgacatacaagatacaactggtgggcgtcaagtctaaagatgacatggggcttattttccaggccaatgtgtttggtccgtactactttatcagtaaaattctgcctcaattgaccaggggaaaggcttatattgtttggatttcgagtattatgtccgatcctaagtatctttcgttgaacgatattgaactactaaagacaaatgcctcttatgagggctccaagcgtttagttgatttactgcatttggccacctacaaagacttgaaaaagctgggcataaatcagtatgtagttcaaccgggcatatttacaagccattccttctccgaatatttgaattttttcacctatttcggcatgctatgcttgttctatttggccaggctgttggggtctccatggcacaatattgatggttataaagctgccaatgccccagtatacgtaactagattggccaatccaaactttgagaaacaagacgtaaaatacggttctgctacctctagggatggtatgccatatatcaagacgcaggaaatagaccctactggaatgtctgatgtcttcgcttatatacagaagaagaaactggaatgggacgagaaactgaaagatcaaattgttgaaactagaacccccatttaa

SEQ ID NO: 2377 - DNA, 1044 bp, Saccharomyces cerevisiae
atgaagatattctccacactcttatcgcaaaaacctaaaggcaaactggtaattcgaccatcaaccactatacatagtagtgatcccttttcaaaatttatagtgacgaagaataccgagcctctttctcttggtgaccttcgaaaaagcgattcaggaaattcagctgtgtgcttaaatgctgaaaatactatattaagtacgctaactgatttacaaaaagaagaagaaagaaactgggatccagtgaaatttgttgctggtaaacttcgaggtgtaatttcacccatccaagcctatgtgacgattggaaaaaaattttcccctaactcattggtatacactagtagattctttcaacttcattacttccctgaagaccattttatgtcttgttttagaaaaagtaaaccagcaataacggtaaaatccaataagaagttttatttaaatgggaaggttttcaacaaggacaaagaatatttcaatgaaactaggatatcaaaagctaatgaagtcgaactaagcaaaattcaaacagcgatgacacggcttacaaatagacatagaaacagtattccctctgaatttgcgtacttgagacgagatttaaaattaaaggtgaaaacaacgtttatcaaggagtggtgtaaactaaatggtgataaggccattcgagagtacgttaatcttaacagatctccaaatattaatcctgctagcatgaagggcaagccaaagaaaagttttttagataaccttggtagaagtactgtgggaaccgcaaaggacggctattatttatacattgttagcatatttcctgataaagatatgttaggagaatttaatgacgaggtcaatagaagcgttcaaaaggttgccaatttggattgggatgggttcttgaccccaaaaaaaggcacgaaaggcaaaaattgggtagaatcgttcaatgacagtataaacgttcaaacaattaacaagatactcgagatcaacaagtttccatttgaattaagaagagaacaaacagaaggctga

SEQ ID NO: 2378 - DNA, 1044 bp, Saccharomyces cerevisiae
atgaaggctatcaaattaacaggtcatgaacgtccattaactcaagtgaagtacaacaaagaaggtgatttactattttcatgttcgaaagatagctcggccagtgtttggtattcgttgaacggtgaaagattaggtactttggatggtcacaccggtaccatttggtctatcgacgtcgactgtttcaccaagtactgtgttacaggaagtgctgattacagtatcaaattatgggatgtgtcaaacgggcaatgtgttgctacatggaaatcgcctgtccccgttaaaagagttgaattttccccatgcggtaactactttctagctatcttggacaacgtcatgaaaaatccaggttccattaacatatacgaaattgaaagagattccgccactcacgaattaacaaaggtctccgaagagccaatccataaaattatcactcatgaaggtttagacgctgccaccgtggctggatggtcgactaagggcaaatacatcattgcaggccataaagacggtaagatcagcaaatacgatgtgtccaacaactacgaatacgtggattccatcgatttgcacgaaaagtccatcagtgacatgcaattttctcctgatttaacatactttattacatcatccagagatactaactcgttcttggtcgatgtatcgactctacaagttcttaagaaatacgaaacagactgtcctctaaacaccgccgtaatcaccccattgaaggaattcattattcttggtggtggtcaagaggccaaggatgtcaccaccaccagtgccaacgaaggtaagtttgaagctaggttctaccacaagatcttcgaagaagaaatcggcagagtacaaggccattttggtcccttgaacacagttgccattagcccacagggcacaagttatgcctccggtggtgaagatgggttcatacgtctacaccatttcgaaaaatcttactttgatttcaaatacgacgtggagaaggccgccgaagctaaagagcacatgcaagaagctaattaa

SEQ ID NO: 2379 - DNA, 1044 bp, Saccharomyces cerevisiae
atgaattcactcgttactcaatatgctgctccgttgttcgagcgttatccccaacttcatgactatttaccaactttggagcgaccattttttaatatttcgttgtgggaacatttcgatgatgtcgtcactcgtgtaactaacggtagatttgttccaagcgaattccaattcattgcaggtgaattaccattaagcactttgccccctgtgctatacgccatcactgcctattacgttattatttttggtggcaggtttttgttaagtaagtcgaaaccatttaaattaaatggccttttccaattgcataatttggttttaacttcactttcattgacgcttttattgcttatggttgaacaattagtgccaattattgttcagcacgggttatacttcgctatctgtaatattggtgcttggactcaaccgctcgttacattatattacatgaattacattgtcaagtttattgaatttatagacacctttttcttggtgctaaaacataaaaaattgacatttttgcatacttatcaccatggcgctactgccttattatgttacacccaattgatgggcaccacatctatttcttgggtccctatttcattgaaccttggtgttcacgtggttatgtattggtactatttcttggctgccagaggcatcagggtctggtggaaggaatgggttaccagatttcaaattatccaatttgttttggatatcggtttcatatattttgctgtctaccaaaaagcagttcacttgtatttcccaattttgccacattgtggtgactgtgtgggttcaacaactgccacctttgcaggttgtgccattatttcttcatatttggtactatttatttcattttacattaacgtttataaacgtaaaggcaccaaaaccagtagagtggtaaagcgtgcccacggcggtgttgccgcaaaggttaatgagtatgttaacgttgacttgaaaaacgttcctactccatctccatcaccaaaacctcaacacagaagaaaaaggtaa

SEQ ID NO: 2380 - DNA, 1044 bp, Saccharomyces cerevisiae
atgacaactttattacagctcttgtcaaattattataaggctaaattagattcagaacgaatatacaatgaatatgttcagtcgcagtatgagtttgcatctttagacaagttgaacaacaataaaggtgacccaaagaaagtagttgatgagacattatttttgcagaggcaaattgcccagctgaataaacagttacaactttcatttcaagagaatgaaaaactattaagcgtacagaagaatcaaaaagctctttatcaaagtaagttatccagcaaggatgcattcattgatgatttgaaactcaaactgaaagtcgagcagatatctgtagacaaacataataaggaacggacaccttcaacaggccgtgatgaacaacagcgtaattcaaaagcggcacatacatcaaagcccacaattcatcttctttcgccaattgtaaatcgtgataagcctaataatcaaacgaacgacaggggtggcaacgatcctgactcgcctacatcacaaagaagatcaagaggactgagatctttattgagttcaggtaaaaatacaatatttgattcaatatccaaaaatctcgacgatgagataaatgaaaatgcgcatatcagaaatgataccacatcttccaagatagctggcaaatcgccatcaagattatctgcgctgcaaaaatctccagaactgcgtaaagaaaggaacaatatgatattaaaggaacacatactgcgttcaaaagatgaccaaaatatcacgtcatctagaaaactggataatatcgagctatctagtattggtgactctactgcaatgacatcaaggagttctaccgttaatgcaaatgacatcttgggaaatgaagagaacgacgggattacaaagctgaaaagagttaacaagttaaccagctctccagttaaaagggattgcagtacaaacaagaaaagaaaactcacaaagcagcgaattgccacgttacccaactcagatgaagaattgagtaataatttaaatgttgacgagtttgtatga

SEQ ID NO: 2381 - DNA, 1044 bp, Saccharomyces cerevisiae
atgactactgataccactgttttcgtttctggcgcaaccggtttcattgctctacacattatgaacgatctgttgaaagctggctatacagtcatcggctcaggtagatctcaagaaaaaaatgatggcttgctcaaaaaatttaataacaatcccaaactatcgatggaaattgtggaagatattgctgctccaaacgcctttgatgaagttttcaaaaaacatggtaaggaaattaagattgtgctacacactgcctccccattccattttgaaactaccaattttgaaaaggatttactaacccctgcagtgaacggtacaaaatctatcttggaagcgattaaaaaatatgctgcagacactgttgaaaaagttattgttacttcgtctactgctgctctggtgacacctacagacatgaacaaaggagatttggtgatcacggaggagagttggaataaggatacatgggacagttgtcaagccaacgccgttgccgcatattgtggctcgaaaaagtttgctgaaaaaactgcttgggaatttcttaaagaaaacaagtctagtgtcaaattcacactatccactatcaatccgggattcgtttttggtcctcaaatgtttgcagattcgctaaaacatggcataaatacctcctcagggatcgtatctgagttaattcattccaaggtaggtggagaattttataattactgtggcccatttattgacgtgcgtgacgtttctaaagcccacctagttgcaattgaaaaaccagaatgtaccggccaaagattagtattgagtgaaggtttattctgctgtcaagaaatcgttgacatcttgaacgaggaattccctcaattaaagggcaagatagctacaggtgaacctgcgaccggtccaagctttttagaaaaaaactcttgcaagtttgacaattctaagacaaaaaaactactgggattccagttttacaatttaaaggattgcatagttgacaccgcggcgcaaatgttagaagttcaaaatgaagcctaa

SEQ ID NO: 2382 - DNA, 1044 bp, Saccharomyces cerevisiae
atgacttttatgcaacagcttcaagaggctggggaaagatttaggtgtatcaatggtcttttatgggttgtttttgggcttggtgtcttaaaatgtacaacgttatcacttagatttttagctcttatttttgatctttttttactaccagcagtcaatttcgacaagtatggtgctaaaactggtaaatactgtgctatcactggtgcaagtgacggtattggtaaagaatttgctagacaaatggcgaaacgtggcttcaacttggtattgatctcgagaacgcaatctaaattggaggctttacaaaaagaactagaagatcaacatcatgtcgttgtaaagattctagccattgacattgcggaggataaagaatccaactatgaatccattaaggaattgtgtgcgcagttaccaatcaccgttttggtcaataatgttggtcaatcacactccattcctgttccatttttggaaacagaagagaaggagcttagaaatattatcactatcaataacactgctacattattaattacacaaatcattgcaccaaagattgtggaaactgtgaaagctgaaaacaagaagtcgggtactcgtggtttgatcttaaccatgggctcatttggtggtctgattcccaccccacttttggctacatacagtggttcgaaatcattcttacaaggttggtctaactctttggctggggaattatctaaagatgctatcgatgttgaattaatcatttcatatttggtcactagctcgatgtctaaaatcagaagatcatctttaatgatcccaaatccacaacagtttgtaaaatccactttaagaagcgttggcagacgctgcggctctcaagaaagatacgctactatgaccccttactgggcgcacgcagtgtatcaatttgtaattacagagacctttggcgtttactctaagattgttaactccattaattattccttccataaatctatcagaattagagccttaaaaaaagccgcaagacaggttaaaaaggaatag

SEQ ID NO: 2383 - DNA, 1044 bp, Saccharomyces cerevisiae
atgcccttcgctcagattgttattggtccaccaggttcagggaagtcaacctattgcaacggctgctcacagttcttcaatgccatcggaagacattcccaggtagtgaatatggatcctgctaatgatgccttaccttacccatgcgctgtggatattcgtgattttataacattagaggagatcatgcaagagcaacagttaggccctaatggaggtttgatgtatgctgttgaatcattggataattctattgatttgttcattttacagatcaagtcacttgtagaagaagaaaaagcatatcttgtattcgactgtccgggccaagtggagctatttactcatcactcatctttgttcaacatctttaaaaaaatggaaaaggaattggacattaggttttgtgttgtaaatttgattgactgtttttacatgacatccccttcacaatatatctcgattttgttacttgcattgaggtctatgttaatgatggatctccctcacatcaacgttttttctaaaatagatatgctgaaatcatacggagaattaccctttagattagactattatacagaggtccaggatctggattatttggagccatatattgaaaaggaaggctctagtgtactgggaaagaaatatagcaagttaactgaaacaatcaaagagctagtctcagatttcaacttagtatcatttgaggttttgtccgtggatgacaaagaaagtatgataaatcttcaaggtgttatagataaagcaaatggctacatattcggcgcatccgaagttggtggtgataccgtgtgggctgaggcttcgcgagaaggtgcattaatagcgaattacgacattcaagacaggtggatagacaataaagagaagtatgataaagaagaagaagaaaaacgtacggcgttgttaaaagaacaagaattgcaaaataaagctgttgatgtgaatgaagaagatgagtgggaaaatgcgctgaaggagtgggaagagaaacaaggaatggattttgttaggtag

SEQ ID NO: 2384 - DNA, 1044 bp, Saccharomyces cerevisiae
atggatatgaaagtagaaaaattaagtgaagatgaaattgcactgtatgatagacagattcgtctatggggaatgacagcacaggccaatatgagatcagcaaaagtattgctgatcaatcttggagcaattggttctgaaattaccaaaagtatcgtccttagtggtatagggcatttaaccatattggatggacacatggtgactgaagaagatttaggatcccagttcttcataggctctgaagatgttggccaatggaagattgatgcaacaaaagagagaattcaagacttgaacccccgtatagagttgaactttgataagcaggatttgcaagaaaaggacgaagagttctttcagcagtttgatttagtcgtggctacagaaatgcagattgatgaagcaatcaaaattaacacattaactcgaaaactaaacattccattatatgttgctggttctaatggattgttcgcttatgtttttattgatttgattgaattcatttcagaggatgaaaaattgcaaagtgtaagacctaccaccgttggtcccatttcaagcaataggagcattatagaagttactactagaaaagatgaagaagatgaaaaaaaaacatatgaacgaatcaagaccaagaactgctataggccactgaacgaagttttaagcacagcaacattaaaggaaaaaatgacgcaaagacagttaaaaagagtcactagtatcttgccgttaaccctgtccttattgcaatatggtctcaaccaaaagggcaaggccataagctttgaacaaatgaaaagagatgcggccgtatggtgtgaaaatctgggtgtaccagcaacagtggtaaaggacgattacatacaacagtttatcaaacagaaaggtatcgagtttgctcctgtcgcggccattatagggggtgctgtagcgcaggatgtcattaacattctaggtaaaaggctatctccattaaataatttcattgtttttgatggtattacattagacatgccactttttgagttttag

SEQ ID NO: 2385 - DNA, 1044 bp, Saccharomyces cerevisiae
atggttcaatatgtggtagaatggttaccaaggatacagagcatttcagtggtagtagaaggttggaagcaggtggagataaagaacttgaaggacacactcatgagcatatctggtgatgaagaacaagttgaagatattttacttccagtagaagttgaagaaaaagtagacgcttcttacaagttcaaaaacagaggtaaagacttagaatggatgacgaagttaagaagcaaatcctctaagatatatgacagttctatcatgtcgcttccagatggaagatggactaaagaagagcttcgctcagattctgatttctcgatagaatgtcttaactgtaagcaaaaaattataagcaaagataactgtcaagttttgaatgatatgccttcagagttttggttcgagttaatggattattggcattgccacaaacccgatgttaaggaagacaagtcttcctacacaagatttgaaacgctaaaaccatctaaaaacgaaattttaattggaagctcttattttcaaggcactcctgcgacttttgaaaatgtagcgactacaaaggaaaatgataatgttttatgcataaagtgctcagcagtgttaggccaagtaactgctggttcgctttataaactacacaaatggaaactgcagttaatacgcagtggaaacacatacaaatttcctccagaatgtgacattacaatttctttaataaacgtagttaaggcaaactcttgtcgttacgtactagtaaaatgtaaaacggaatcattgctagtttggatattttccgttgacattggagtcacattgacgggaaacaaaagcttcaagagagcgatgaagttgctttacacaaacagcgttaccacaataaatcgatgtctcaatcgacaagtcgtcgaggaattagatttccaagaaacatcgtttaatgctttttacagcgcccttcaacatactaatgcacttttaccctcaagcatgaaaaaaattggtgaatggaccattagctatacatcactaatctaa

SEQ ID NO: 2386 - DNA, 1044 bp, Saccharomyces cerevisiae
atggtttctgtggagtttttacaggagttaccaaaatgtgagcatcacttgcatttggaaggtactctagaacctgacctattgttcccattagctaaaagaaacgatataattctacctgaaggttttcctaaatcggtcgaggaattaaacgaaaagtataagaagtttcgtgatctgcaggatttcttagattactattatattggtactaatgtcttgattagtgaacaagatttctttgatttggcgtgggcctattttaaaaaagttcacaaacaaggcttggtccatgctgaagtgttttacgaccctcagtcacatacatctaggggcatctccatagaaacagtcactaaaggtttccaaagagcttgtgacaaagccttctctgaatttggtattacatccaagctaattatgtgtctgttaagacacattgaaccagaggaatgtttgaaaactatcgaagaagctaccccatttattaaagatggtactatctctgccttaggattagattctgctgagaaaccatttcccccacatttatttgttgaatgttacggaaaggccgcctcattgaataaagatttaaaactaactgcacacgcaggtgaagaaggccccgctcaattcgtctcggatgctttagacttgttgcaagtaacaagaatcgatcacggtatcaacagtcaatacgacgaggagttattggataggttgtcgcgcgaccagaccatgctaactatttgtcctctctccaacgtgaagctacaagtagtccaatccgtttcagagttaccactacaaaagtttcttgacagagatgttccattttctttaaattctgatgaccccgcctattttggtggttatatcttagatgtctacactcaagtttcgaaagatttcccacactgggaccatgaaacatggggtcgtatcgctaagaacgccattaaaggttcatggtgtgacgataaaagaaagaacggtttgttaagtagagtggacgaagtagtcactaaatattcgcattag

SEQ ID NO: 2387 - DNA, 1046 bp, Saccharomyces cerevisiae
atgtctcaaccagtcgttgttattgatggtacgtaaaaaatttctaattctaacaggagtgattgagtatgcaggtggaggacgttgcaaagaccatttcagaatatagtaattgaaataaaaaataatcctgcgaaatgtgttgcaaaatgcttactataaagaatagtattagctaattaggatgctcattgattcatagaagaaacggaacacgcaatacttgaaactccaaatacttaattgaatgcgttatatttgaaaacatgaatttgcaataccgtgcatcacgcctaaaaagtggcggtttgaaagcatcatgccaatgttacccctgagatgcatcgatatgccccatcacaccaaaaagtaatggtaacttctaatcaatattttgactccaactatattcaatccactcagtaaaaaataccaagattagcatttactaactttatttttctccttttattatagctaaggatcatttgttgggtcgtttggcctccactattgccaagcaagtattgaacggtcaaaagattgtcgttgtcagagctgaagctttgaacatttctggtgaattcttcagaaacaagttgaagtaccacgactttttgagaaaggctactgctttcaacaagacccgtggtccattccatttcagagctccatctagaattctttacaaggctattcgtggtatggtttcccacaagaccgcccgtggtaaggctgccttggaacgtttaaagatcttcgaaggtattccacctccatacgacaaaaagaagagagttgtcgttcctcaagctttgagagttttgagattgaaaccaggtagaaagtacaccactttgggtaagttgtctacttctgttggttggaaatacgaagatgttgttgctaaattagaagacaagagaaaggtcagatccgccgaatattacgccaagaagagagctttcaccaaaaaggtctcctctgcttctgctgctgcttctgaatccgatgttgctaagcaattggcttctttcggttactaa

SEQ ID NO: 2388 - DNA, 1047 bp, Saccharomyces cerevisiae
atgactactgaaaaaaccgttgtttttgtttctggtgctactggtttcattgctctacacgtagtggacgatttattaaaaactggttacaaggtcatcggttcgggtaggtcccaagaaaagaatgatggattgctgaaaaaatttaagagcaatcccaacctttcaatggagattgtcgaagacattgctgctccaaacgcttttgacaaagtttttcaaaagcacggcaaagagatcaaggttgtcttgcacatagcttctccggttcacttcaacaccactgatttcgaaaaggatctgctaattcctgctgtgaatggtaccaagtccattctagaagcaatcaaaaattatgccgcagacacagtcgaaaaagtcgttattacttcttctgttgctgcccttgcatctcccggagatatgaaggacactagtttcgttgtcaatgaggaaagttggaacaaagatacttgggaaagttgtcaagctaacgcggtttccgcatactgtggttccaagaaatttgctgaaaaaactgcttgggattttctcgaggaaaaccaatcaagcatcaaatttacgctatcaaccatcaacccaggatttgtttttggccctcagctatttgccgactctcttagaaatggaataaatagctcttcagccattattgccaatttggttagttataaattaggcgacaatttttataattacagtggtccttttattgacgttcgcgatgtttcaaaagctcatttacttgcatttgagaaacccgaatgcgctggccaaagactattcttatgtgaagatatgttttgctctcaagaagcgctggatatcttgaatgaggaatttccacagttaaaaggcaagatagcaactggcgaacctggtagcggctcaacctttttgacaaaaaactgctgcaagtgcgacaaccgcaaaaccaaaaatttattaggattccaatttaataagttcagagattgcattgtcgatactgcctcgcaattactagaagttcaaagtaaaagctaa

SEQ ID NO: 2389 - DNA, 1047 bp, Saccharomyces cerevisiae
atgagcaagacagccgtgaaagattctgctacagaaaaaaccaagctaagtgaaagcgaacagcactacttcaattcgtacgatcactatggtattcacgaagagatgcttcaagatactgttcgtaccttatcttacagaaacgcaattatccaaaataaggatctttttaaggacaagattgttttagacgtcggttgcggtaccggtattttatccatgtttgccgctaaacacggtgcgaagcatgttatcggtgttgatatgtcaagcattattgagatggcgaaggaattggtagagttgaacggattcagcgacaagatcaccttgctaagaggcaagttggaggacgttcatttaccctttcctaaagttgacatcataatttctgaatggatgggttactttctactatacgagtccatgatggacaccgttctttacgctagagaccactatttggtagaaggcggtctgatctttcccgacaagtgctccattcatttggccggtttggaagactctcagtataaagacgagaagttgaactactggcaagacgtttacgggtttgattattcgccatttgttccgttggtcttacacgagcccatcgtcgacaccgtggaaagaaacaatgtcaacaccacctcagacaaattgatcgaatttgatttaaatacagtaaaaatatcagatctagcgtttaagagtaactttaaattgacggccaagagacaagatatgattaatggtatagtcacctggttcgacattgttttccctgcaccaaagggtaagagacctgttgagttctccactggtcctcatgctccatacactcactggaagcaaacaatattttatttccctgatgatctagatgctgaaactggtgacaccattgaaggtgaattggtttgctctccaaacgagaagaataacagagatctaaatatcaaaatttcttacaagttcgaatcgaatggcatcgacggtaattcaagaagcagaaaaaacgaaggttcttatttaatgcattaa

SEQ ID NO: 2390 - DNA, 1047 bp, Saccharomyces cerevisiae
atgccaactctagtaaatggaccaagaagagactctaccgaagggtttgataccgatatcatcactcttcctagattcataatcgagcaccagaagcaatttaagaacgctactggtgatttcacattagtactgaatgccttgcaattcgcgttcaaatttgtatctcacaccatcagacgtgctgaattggttaacttggttgggttagcaggcgcttccaacttcactggtgaccagcaaaagaagttggacgttctaggtgatgaaatatttatcaatgccatgagggctagtgggatcatcaaggtccttgtatctgaagaacaggaagacttgatcgtttttcccacaaacacgggctcatacgcagtgtgttgtgatcctattgatggctcctcaaatttggacgccggtgtctccgttggaactatcgcgtctatattcagactgctaccagactcatcaggtactataaacgacgtactgagatgtggtaaagaaatggtagccgcttgctatgccatgtacggatcctctacgcatctagtattgacattgggtgatggagttgatgggtttaccttagacacaaacttgggcgaattcatcttgactcatcctaacttaagaattccgcctcaaaaggccatctactcaattaatgaaggtaacaccctctactggaacgagactataagaacatttattgagaaagtcaaacaaccccaagcagacaacaacaacaagcctttctcggctaggtatgttggatccatggttgctgatgttcacaggacgtttctttacggtggccttttcgcatacccttgcgacaagaagagccccaacggaaaactgaggttgctttatgaggccttcccaatggctttcttaatggaacaagcagggggaaaagcggtcaacgatcgcggagagagaatcttggatttggtgccaagtcatatccatgacaaatcttctatttggttgggttcttcaggtgaaattgacaaatttttagaccatattggcaagtcacagtag

SEQ ID NO: 2391 - DNA, 1047 bp, Saccharomyces cerevisiae
atggcaaggcaagggaacttctacgcggttagaaagggcagggaaactgggatctataatacatggaatgaatgtaaaaaccaagttgatggttatggtggtgcaatttataaaaaatttaacagctacgagcaagcgaaatctttcctaggtcaaccaaatactacatcaaactatggaagttcaacgcatgctggagggcaagttagtaaacctcataccactcaaaagcgagttcatcgaaggaatcggccacttcattattcctccttgacatcgtcatcagcatgttcatctttaagctctgctaatacaaataccttttattcagtaaagagtaatgttccaaatatcgagagtaaaatctttaacaattggaaagactgtcaagcctatgtcaagcataaaaggggtataaccttcaagaagtttgaagaccaattagctgcggaaaacttcattagtggtatgagtgcgcatgattacaagctcatgaatatatccaaagaaagttttgaatctaagtataagctttctagcaataccatgtacaacaagtctatgaacgtttactgtgatggttcaagttttggaaacggcacgtcatcttcaagggcaggttatggtgcatattttgaaggagcgccagaggaaaatatttcagaacccttattatcgggagctcaaactaataatagagctgaaatcgaagcagtatcagaagctttgaagaaaatctgggaaaagttaactaatgaaaaggaaaaagtaaattatcaaatcaaaactgattcagagtacgtaaccaaattattaaatgacaggtatatgacgtatgataataaaaaacttgaagggctacctaattctgatttaattgttcctttggtgcagaggttcgttaaagttaaaaagtactatgagttgaataaagagtgcttcaaaaataatggtaaatttcagattgaatgggtaaaaggacacgatggtgatccaggaaatgaaatggcagattttctggcgaagaaaggagcatctagacgataa

SEQ ID NO: 2392 - DNA, 1047 bp, Saccharomyces cerevisiae
atgtcacaatacaaaactggtttacttttaatacatccggcggtgactacaacgccagagctagtagagaacactaaggctcaagctgcatcaaagaaagtcaagttcgtggaccagtttttaatcaataaactaaatgatgggtccataactttggaaaacgcaaaatatgaaacagtacactatttgacgccagaagcccagactgatattaagtttccgaaaaagttaatttctgtcttagctgactcattgaaaccaaacggctcactaattggtttaagtgatatttataaagtagatgcattaatcaatgggtttgaaataattaacgaaccagattattgctggattaaaatggattcctctaaactaaaccaaactgtttctataccactgaaaaaaaagaaaacgaacaatactaagctacagagtggtagtaagctaccaacttttaaaaaagctagttcttcaacctctaatttaccctcattcaaaaaagcagatcacagtaggcaacctatagttaaggaaacagacagcttcaaaccacctagtttcaaaatgaccactgaaccaaaagtctaccgagtcgtagacgacctgattgaggatagcgatgatgatgatttctctagtgactcttccaaagcccaatattttgatcaagtggataccagcgatgattccattgaagaagaagaattaatcgacgaggatggttctggtaagtcaatgattactatgattacatgcggtaaatccaaaactaagaagaagaaggcttgtaaagattgcacctgtggtatgaaagaacaggaagaaaatgaaataaacgatataagatctcaacaagataaagttgtcaaatttacagaagacgagttgaccgagattgatttcactatcgatgggaagaaagttggcggctgtggttcttgttctctaggggatgcctttagatgtagtggttgtccctacttgggtcttcctgctttcaagcctggtcaacctatcaatttggacagcatttcagatgacttgtaa

SEQ ID NO: 2393 - DNA, 1047 bp, Saccharomyces cerevisiae
atgtctatcccagaaactcaaaaaggtgttatcttctacgaatcccacggtaagttggaatacaaagatattccagttccaaagccaaaggccaacgaattgttgatcaacgttaaatactctggtgtctgtcacactgacttgcacgcttggcacggtgactggccattgccagttaagctaccattagtcggtggtcacgaaggtgccggtgtcgttgtcggcatgggtgaaaacgttaagggctggaagatcggtgactacgccggtatcaaatggttgaacggttcttgtatggcctgtgaatactgtgaattgggtaacgaatccaactgtcctcacgctgacttgtctggttacacccacgacggttctttccaacaatacgctaccgctgacgctgttcaagccgctcacattcctcaaggtaccgacttggcccaagtcgcccccatcttgtgtgctggtatcaccgtctacaaggctttgaagtctgctaacttgatggccggtcactgggttgctatctccggtgctgctggtggtctaggttctttggctgttcaatacgccaaggctatgggttacagagtcttgggtattgacggtggtgaaggtaaggaagaattattcagatccatcggtggtgaagtcttcattgacttcactaaggaaaaggacattgtcggtgctgttctaaaggccactgacggtggtgctcacggtgtcatcaacgtttccgtttccgaagccgctattgaagcttctaccagatacgttagagctaacggtaccaccgttttggtcggtatgccagctggtgccaagtgttgttctgatgtcttcaaccaagtcgtcaagtccatctctattgttggttcttacgtcggtaacagagctgacaccagagaagctttggacttcttcgccagaggtttggtcaagtctccaatcaaggttgtcggcttgtctaccttgccagaaatttacgaaaagatggaaaagggtcaaatcgttggtagatacgttgttgacacttctaaataa

SEQ ID NO: 2394 - DNA, 1047 bp, Saccharomyces cerevisiae
atgtctattccagaaactcaaaaagccattatcttctacgaatccaacggcaagttggagcataaggatatcccagttccaaagccaaagcccaacgaattgttaatcaacgtcaagtactctggtgtctgccacaccgatttgcacgcttggcatggtgactggccattgccaactaagttaccattagttggtggtcacgaaggtgccggtgtcgttgtcggcatgggtgaaaacgttaagggctggaagatcggtgactacgccggtatcaaatggttgaacggttcttgtatggcctgtgaatactgtgaattgggtaacgaatccaactgtcctcacgctgacttgtctggttacacccacgacggttctttccaagaatacgctaccgctgacgctgttcaagccgctcacattcctcaaggtactgacttggctgaagtcgcgccaatcttgtgtgctggtatcaccgtatacaaggctttgaagtctgccaacttgagagcaggccactgggcggccatttctggtgctgctggtggtctaggttctttggctgttcaatatgctaaggcgatgggttacagagtcttaggtattgatggtggtccaggaaaggaagaattgtttacctcgctcggtggtgaagtattcatcgacttcaccaaagagaaggacattgttagcgcagtcgttaaggctaccaacggcggtgcccacggtatcatcaatgtttccgtttccgaagccgctatcgaagcttctaccagatactgtagggcgaacggtactgttgtcttggttggtttgccagccggtgcaaagtgctcctctgatgtcttcaaccacgttgtcaagtctatctccattgtcggctcttacgtggggaacagagctgataccagagaagccttagatttctttgccagaggtctagtcaagtctccaataaaggtagttggcttatccagtttaccagaaatttacgaaaagatggagaagggccaaattgctggtagatacgttgttgacacttctaaataa

SEQ ID NO: 2395 - DNA, 1050 bp, Saccharomyces cerevisiae
atgaacgtaacatcgaatgcaactgcagccggttcctttccactagcatttggtctcaagacctcatttgggtttatgcactatgccaaggcccctgccattaatttacgccccaaggaatccttgctgccggaaatgagtgatggtgtgctggccttggttgcgccggttgttgcctactgggcgttgtctggtatattccatgtaatagacactttccatctggctgagaagtacagaattcatccgagcgaagaggttgccaagaggaacaaggcgtcgagaatgcatgttttccttgaagtgattctacaacatatcatacagaccattgttggccttatctttatgcacttcgagccgatctacatgactgggtttgaagaaaatgccatgtggaagcttcgtgcagaccttcctcggattattccagatgccgctatttattacggctatatgtacggaatgtccgctttgaagatctttgcaggctttttattcgttgatacatggcaatactttttgcatagattgatgcatatgaataagaccttatacaaatggttccactctgttcatcatgaactatacgtgccatatgcttacggtgctcttttcaacaatcctgttgagggcttcttgttagatactttgggaaccggtattgccatgacgttaactcatttgactcacagagagcaaatcattctttttacctttgccaccatgaagactgtcgatgaccactgtgggtatgctttgccacttgacccattccaatggcttttccctaataacgctgtctatcacgatatccaccaccagcaatttggtatcaagacgaactttgctcaaccatttttcactttctgggacaatttgttccaaactaactttaaagggtttgaagaatatcaaaagaagcaaagacgtgtcaccatcgacaagtacaaagagtttttgcaagagagagaattggaaaagaaggagaaactcaaaaacttcaaagctatgaatgctgctgaaaatgaagtaaagaaagagaaataa

SEQ ID NO: 2396 - DNA, 1050 bp, Saccharomyces cerevisiae
atgagtgcttccaaaatggccatgtccaacctagagaaaatattggaactggttcctctttcgcctaccagttttgtcacaaagtatctgcctgccgcgcccgtagggtctaagggcacttttggtggaacgctggtatcacaatcgctgctggcgtcattgcatactgtgccattgaacttcttccccacatcgctacattcgtatttcatcaagggtggtgatccgcggaccaagatcacgtaccatgtgcagaatctgagaaacggtagaaatttcatccataagcaggttagtgcttatcagcacgacaagttgatatttacgtcgatgatcttatttgccgtgcaacggtccaaggagcacgactccttgcagcactgggagacgattccaggcctgcaaggtaagcagccagaccctcatcgttatgaagaggccacttcgcttttccagaaagaagttctggacccacagaaattgagcaggtatgcctcattgtccgacaggttccaagacgcaacctcgatgagcaagtatgtggatgcgtttcaatacggagtcatggagtaccaattccccaaggacatgttctactcggcaagacacaccgacgagctggattatttcgtcaaagtgagacctcccatcactaccgtggagcacgcgggcgacgagtcttctttacacaagcatcatccgtacaggatcccgaagagcattactcctgagaacgacgctcgctacaactacgtggcctttgcgtatctgtccgattcctacctcctactcacgatcccgtacttccacaacctgcctttgtactgccacagtttcagtgtctcgctcgaccacacgatttactttcaccagttgcctcatgtgaacaattggatctatcttaagatttcgaatcccaggtcccactgggacaagcacctcgtacagggcaagtatttcgacacacagtcgggacgcatcatggcaagcgtctctcaggagggctacgttgtctacgggtcagaacgagacattcgagccaagttctga

SEQ ID NO: 2397 - DNA, 1050 bp, Saccharomyces cerevisiae
atgcaaccatttgatagtgggcatgatgatttagttcatgatgtcgtttatgacttttacggaagacatgtggcaacatgctcttctgatcaacatattaaagtttttaaattagacaaggacacgagtaattgggaactcagtgactcatggagagctcacgacagtagtatcgtggccattgattgggccagtccagaatatgggcgcatcattgcttcagcctcttacgataagacggtaaaattatgggaagaagatcccgaccaagaagaatgctctggccgtcgttggaacaagctgtgtaccctgaatgattccaaaggatcactttatagtgtaaaatttgcgccagcgcatttgggcttaaaattagcttgtttgggtaacgatggaatcctcagactttatgatgccttagaaccttctgacctaaggtcatggacactgacttctgagatgaaagtgctatctataccaccagcaaatcatttacagtctgatttttgtctctcttggtgtccttcgagattttctcctgaaaagctcgcagtctctgcattggaacaagcgattatataccaaaggggtaaagacggtaaacttcacgttgcagcaaaacttcccggtcataaaagtttaataagaagtatcagctgggctccttccattggtagatggtatcaactcattgcaacaggttgcaaagatggtagaattagaattttcaaaatcacagaaaaactaagtcccctggcctcagaggagtctttaactaactcaaatatgtttgataatagtgctgatgttgacatggatgcacagggcagatcagactcaaataccgaagagaaagctgagctacaatcaaacttgcaagttgaacttctaagcgagcatgatgaccataatggcgaagtttggtccgtgtcttggaatttaacgggtacaatcttaagcagtgctggggatgatgggaaggtacgtttatggaaagccacttattcaaatgaatttaagtgtatgtcagtaattactgcccaacaataa

SEQ ID NO: 2398 - DNA, 1050 bp, Saccharomyces cerevisiae
atgcccaagttggaacaatttgaaataaaaaaatactggcaaatcttctcgggtttgaaaccaatagagaataaggtaaaccatgaccaggttttaccaattctttataattccaaattagattcatcggttctaaacaagatttggtttttagctgatattgatgacgacgacaatttagactttgaggaatttgtaatttgcatgagattaatatttgatatggttaataaaaacattagctctgttccagatgaattgcctgattggttgattccagggagtaaggtgaatctaatcaaagaaagaaagaagcgcaagcaaatagaaaacgcagacttgcctccaaagaaggaaatcaaagtagattggtacatgtctccagatgatttgaatcaatatgaaaaaatttataatagctgtgcaaaactaaccgatggtactattacattcaacgaactgtcaacaaaactttccacaaaattttttaacatcagtaagacagatttaaataaggtttggagtttaattaacccacaaaatttgccatcaattgatagagatcctactttttattttattcactgtttaagacaaagaaatgatttgggtgctgaaattccagcaagtttaccaaattctctggcggaggtgtgcaataaaaaacaactgagctatgatttacggtcctctcaacctcctacaaagagaaaagaagaagctaacgaagtggacaatctgcgtgacaatgggcagaactcgagttccgatagcagtggcagtaacgtgctttcaaatgaagacagtataaagcaaaaatatgcttctctgacagatgatcaagttgcgaacatgagagaacaattagaaggccttttgaactacaaaaagagtgaaaaaactcaaggaggctcaaaactttctaagcggattaacatcaggtcgataactgatgacttggataacattgaacagcaggttgaagtattggagaattacttgaacaataagagacacgaattgcaagcattacaagcagaaatcaattga

SEQ ID NO: 2399 - DNA, 1050 bp, Saccharomyces cerevisiae
atgtcaaagatagattcagttttaattatcggtggttctggttttcttggattgcacttaattcagcaattttttgatattaatcctaagccagacatccacatttttgatgttagagatctccctgaaaaactttcaaaacagtttacttttaatgtagacgacataaaatttcataagggtgatttaacatcacctgatgatatggaaaacgcaattaacgaaagtaaagcaaatgttgttgttcattgtgcttctccaatgcatggtcaaaatccagatatttatgacatagtgaatgttaagggaacccgtaacgtgatagatatgtgcaagaaatgtggcgttaatatacttgtatatacttcctctgctggtgttatttttaatgggcaagatgtgcacaatgcagacgaaacctggccaatcccagaagttcctatggatgcgtacaatgagactaaagctatcgccgaagatatggtcttgaaggcgaatgatccaagcagtgatttctatactgttgctcttcgtccagctggtatttttggcccaggtgataggcaattagtacctggtctaagacaggttgcgaaattggggcagtcgaagttccaaattggtgataataacaatctatttgattggacttatgctggaaatgttgctgacgcgcatgtgttagctgcacagaaacttctcgatccaaaaacaagaactgctgtctcgggtgaaacttttttcattaccaatgatacccccacctatttttgggccttggcccgtactgtgtggaaggcagatggtcatattgataaacatgttattgttttgaaaaggccagttgcaatttgtgcaggttatctttcagaatgggtatccaagatgctgggtaaagagccaggtttgactccattcagagtcaagattgtgtgtgcataccgttatcacaacattgctaaggccaaaaagttgctaggctacacaccaagagttggtattgaagaaggaattaacaaaacgttggcctggatggacgaaggtttgtaa

SEQ ID NO: 2400 - DNA, 1050 bp, Saccharomyces cerevisiae
atgtccccattgaacgtcggtatagttggtacaggtatttttgccagagatagacatctcccatcctaccaggaatttcctgacaaattcaaagtcattgccgccttcaacagacataaggcaaaagctttggattttgcaaaggttgctgacatacctgaaaataaggtttacgacaatctagatgaaattttgaatgaccctcatgtcgactacattgacgctttgctacctgctcaatttaatgctgatattgtcgagaaggcagttaaagcaggtaagccagttattttggaaaaaccaattgcggccaacttagaccaagcaaaggagattgtcaagatagcagaatccaccccattgcccgttggtgtggctgaaaattggttatatttaccatgtattaaaatcgcaaaggagcagatcgagaaaattggtcctgtagtagcattcacccacaattctaccggtccatttgttactcaaaataaatatttgaccacaacctggagacaaaaaccagagcacattggcggatttctatctgatggtggtgtccaccaattagctctcgttatttccctactcggtgaatttggatctgtttctgcattaacgagacaggtgcgtgaacgttccggtgcagatgatattgtctttgctactgtccagttgaaaaataaagaggttatcggaagttttacttatgggtctgcctttggtgctaccgaaaagtcggttttcttgaaagtctatggtaagaatggtaccgttaccgttgacttatcagacaaaaaagaccccgttgtaaaagtcaaattagggggttcagctgaagataacggtgacgaacaaatttttaaagtcgataatgatgaaagtttcggcgtcaacgctgaatttttgaattttcacgaagctgtcagcaagaaggacaaatccttatacctaggcacacccagaactgcatttcaccatttggcttgtgtggacgcgtttttaaaatcttctgccaagaatggtgactacgttaaaattgagcagccatga

SEQ ID NO: 2401 - DNA, 1050 bp, Saccharomyces cerevisiae
atgtcgcagtacatcggtaaaactatttctttaatctctgtgactgacaacagatatgtggggctgttagaagatattgactctgaaaagggtaccgtgactttgaaagaagttcgctgttttggtacagaaggtcgcaagaactggggtcctgaagaaatttatccgaatcctacggtatacaattctgtaaagttcaacggcagtgaagtcaaggatttaagcattttagatgctaacatcaatgacatacagccggttgttcctcaaatgatgccacccgcttcacaattccctcctcaacaagctcaatctccaccccaggctcaagctcaagcacacgtgcaaacaaacccccaagttccaaagcccgaatccaatgtgccagcagctgtcgctggatatggtgtttacaccccaacttcgacagaaaccgctactgctagtatgaatgataagagcactcctcaagacaccaatgtaaactcgcaaagtagggaaagaggtaaaaatggtgaaaatgagccaaaatatcaaagaaacaagaatagatcaagtaatcgccctcctcaatccaaccgcaatttcaaagtcgatattccgaatgaagattttgactttcaatcaaataatgcaaaattcacgaaaggtgattccactgatgtggaaaaagaaaaagaattagaatcagctgttcacaagcaggatgaatctgatgagcagttttataataaaaaatcgtcttttttcgacaccatctccacttctactgaaactaataccaatatgagatggcaagaagaaaaaatgttgaacgttgacacctttggacaagcttctgccagaccaagatttcactctagaggcctcggtcgtgggcgtggaaattataggggaaacagaggaaacagaggaagaggcggccaacgtggaaactaccaaaacagaaataactaccaaaatgatagtggcgcctatcagaaccaaaacgactcgtacagcagaccagccaaccagttttcgcaacctccttccaacgttgaattttaa

SEQ ID NO: 2402 - DNA, 1052 bp, Saccharomyces cerevisiae
atgaatatagactgtttgtgtcgttgggtagttctgccactgctgcgctatccacttctggtagctcttgtattgagatggtatgtaaagtagaaaataggcatgaggttagaaacagcgttttttatactaacatgacgaactaacctaggtctctaagcgactcgataagcatttgtctaacaatctatacactactgataaatgcattcctcattgctaattcctatataaagcggtcgggacaggtcgcctggaagagccttcgtgaatttaagaatggcatagttcttattactggaggaagtaaaggacttggacgggccatagtatctcaactcctacaagactacagcaacctgaccatcttgaatgtcgacatatgcccatcatcagtgaggaatactcgcgtgaaggatctcatctgcgacctgagtgatgatgaagaagttgcagcactactgaatttgttgaaaagaaagtataaaaatgaaatccgattgattgtgaacaatgctggagtaagggccaacttcaccggattcaacggcatggaacgggataatcttgataagatttttaagataaacacatttgcaccacttcagttcattcaagaactggcccctagtagacactcaactagacagtgttatattgtcaatatcgcaagcattttgggcatattgacgccggccaaagtagcagcttatgcggcgagcaaagcagcattgatagcctttcatcagtcgtacagttttgaattgcaaaacgaaggcgtaagaaatatcagaacactattagtgaccccagggcaactgaatacggaaatgtttgcaggattcaagcctcctcgccagttctttgcccctgtaatagacattactactctagctgccaagatagtccgttattgtgagctgggtcagaggggacagctaaatgaacccttttattgtagttttgctcatcttttgatgtgcgtaccttattcgctacaacgcattgtaagaagcttctctcgcatagattgctgcctcccggacgagtag

SEQ ID NO: 2403 - DNA, 1053 bp, Saccharomyces cerevisiae
atgaattggctgtttttggtctcgctggttttcttctgcggcgtgtcaacccatcctgccctggcaatgtccagcaacagactactaaagctggctaataaatctcccaagaaaattatacctctgaaggactcaagttttgaaaacatcttggcaccacctcacgaaaatgcctatatagttgctctgtttactgccacagcgcccgaaattggctgttctctgtgtctcgagctagaatccgaatacgacaccatagtggcctcctggtttgatgatcatccggatgcaaaatcgtccaattccgatacatctattttcttcacaaaggtcaatttggaggacccttctaagaccattcctaaagcgttccagtttttccaactaaacaatgttcctagattgttcatcttcaaaccaaactctccctctattctggaccacagcgtgatcagtatttccactgatactggctcagaaagaatgaagcaaatcatacaagccattaagcagttctcgcaagtaaacgacttctctttacacttacctatggactggactccaattattacctcgacaataattaccttcatcaccgtcttactcttcaaaaagcagtccaaactcatgttctccatcatatcttccaggatcatctgggcaaccttgtcaacttttttcatcatttgcatgatcagtgcctatatgttcaaccaaatcaggaatacccaattggcaggcgttggtcctaagggcgaggttatgtatttcttgcccaatgaattccaacaccaattcgccattgaaactcaagtcatggttcttatttacggaacattggccgcgttggttgtcgtattggtcaagggtatacaattcttgcggtctcatttgtatccagagaccaagaaagcgtacttcattgatgctattttggcctccttttgtgccttattcatttatgtcttctttgctgctttgacaaccgtgttcacgataaagagtcctgcttacccttttcctttactaaggttatcggcaccattcaaataa

SEQ ID NO: 2404 - DNA, 1053 bp, Saccharomyces cerevisiae
atgaccgtttccaacattgggggggaagaacgactaataattttaccagacgattatgaaacttcgaaaactataaacacttttacactgccgccaccttccaatattacatccaaacctcgtatcgagctcttcgaaaatattaatggaaaactttacgaaataagatcttttcaattcggcaaagggccctcgtattcacatgaggaagatttggcaaatgataaatatcactatactaaggaaaatcacccgatcaaatcaactttcattgtaaatacgtctgatcccaccgatggttatgtttttaactcaagcaaaatacacttttgttctttatacgatattgcttttagtttgattggattttactatagaaacagtgtttcagcagatgaacaagattactccaattcaagtgatactggtgaaaaccaaaaaagcaacagcaaaaccaatgagaaatttcttacggtgcgtgattaccatgatttcttaacggataaccatgacaagaattgggaaaacatttctttaagtcgtctcaagagtggcttagcaaaagttagtgaaaccattgaggaagctggtgacgtctattacaagatcacatctgcaatgataacacaatttttgttaggcaaggtatcaaaaattgtagaaaactttcctccaagtatccctacacttaaaaatgccccaacggaaataaaacagtgctacaaggtagttatggctacaaatcttttagtttccctgattccaagggcggcctaccataatttacttaccttttcacctacaatggatagtggttgcctaaatccggatataaaagctagcttcatagaactcgaaaactacgagactacgaacgaattacagaatgctgaaagagaattactgatgaaaagtgccatgaatgtaggcctaaattcgaatggcagggtttcattgccagtgaaaaaagttaccaaaaaaatagttcaaaataaaaaaccaaaagtagccataggaaaaggggccattgatggattttttaaacgtaagtag

SEQ ID NO: 2405 - DNA, 1053 bp, Saccharomyces cerevisiae
atgagtaagaaaccaattgttttgaaattaggaaaggatgcctttggtgaccaagcctggggggaattggaaaagattgcggatgtaattaccatccctgaatccaccactagagaacagtttttgcgggaggtaaaagacccacaaaataagctctcccaagtacaagtcattactagaacagcaaggagtgtgaaaaacaccggtagatttgatgaagagcttgctcttgctttgccctcctccgtagtggctgtatgtcatactggtgctggttatgaccaaattgatgttgagccattcaagaaaaggcacatccaggttgccaatgttcctgatttagttagcaatgctaccgctgatacgcatgtatttttgctattgggtgccctaagaaacttcggtattggtaacagaaggttgatcgagggaaactggccggaggcaggacccgcatgtggttctccctttggatacgaccctgaagggaaaacagttggtatactgggtctaggtaggattggtcgttgtattttagagagattgaagccgtttgggttcgagaatttcatatatcataacagacaccagcttccttccgaagaagagcatggttgtgaatatgtaggattcgaggagtttttgaagcgttctgatatagtatctgtaaacgtcccactgaaccacaatactcaccatctaatcaatgcagagactattgaaaaaatgaaagatggtgtagttattgttaacacagcgcgtggtgccgtgatagacgaacaagccatgactgatgctttgcgttctggaaagattagaagtgctggtttggacgttttcgaatatgagccaaaaatatccaaagagttattatcgatgtcccaagtcttaggactgcctcatatgggcacacatagtgtagaaacaagaaagaaaatggaagaactggtcgttgaaaatgcaaagaatgtgatattgaccgggaaagtcttgactattgttccggaattacaaaatgaagactggcccaatgaatctaagccattagtttga

SEQ ID NO: 2406 - DNA, 1053 bp, Saccharomyces cerevisiae
atggatcaaaaggcgtcatattttatcaatgagaagctcttcactgaggtaaagcccgtcctttttacggatctaattcaccacttgaagatcggcccatccatggccaagaaattaatgtttgactattacaaacagaccaccaatgccaaatacaactgcgtagtgatatgctgctacaaagatcaaactattaaaattattcatgatctttccaacattccacagcaagattcaataattgattgtttcatctatgccttcaatcccatggacagcttcataccatattacgacattatcgatcaaaaggattgtttaaccattaaaaattcatacgaacttaaagtttctgaatcatcgaaaattatagagaggactaagacgttagaagagaaatctaaacctttggtaaggcctacagcaagatcaaagaccacgccagaagaaacaaccggaaggaaatccaaatctaaagacatgggtctcaggtctactgcactgctggctaagatgaaaaaggatagagatgacaaggaaacctctagacaaaatgagttacgtaaaaggaaagaggagaacttgcaaaaaataaataaacagaaccctgaaagagaagctcaaatgaaagagttaaataatctttttgtcgaagatgacttagatacagaggaagtaaatggagggtccaagcccaactcacctaaagaaactgacagcaacgataaggacaaaaacaacgatgatttagaagacttgttggaaacgacagcagaagattcacttatggatgtacctaaaatacagcaaacaaagccttctgaaacagaacattcaaaggaacctaaatctgaagaagagccctcctcttttattgatgaggatggatatattgtgacaaagagacccgcaacttcaacaccaccacgcaagccatcacccgtggtaaaaagggcattgtcgtcttcaaaaaagcaagaaacgccgtcatcgaataaaaggttaaaaaagcaaggaacattggaaagctttttcaaaagaaaggcaaaataa

SEQ ID NO: 2407 - DNA, 1053 bp, Saccharomyces cerevisiae
atgggtcttttttcaagaaaacgggaccatacgcctgctgtgcctaaagagaaacttattccatgtgataagatattcttggaccctcctgccaagtatggtaacgcacctctactggaacccatctccgaagatcaaaacgaaaaatatagagctgtcttacgacattttcaagatgatgatctgaaattaccagaaaatctcaatgaccttgacaatgggacacatgccaatgacagacccttgagtgattgggagaagttttggctttctagggagtgttttctaagatacctaagagccaataaatggaacaccgcgaacgccataaaaggtctcaccaaaaccttggtatggaggagagaaattggacttacacatggtaaggaggacaaagaccctttaacagctgacaaagttgccgttgagaacgaaactggtaaacaggttattttgggctttgacaacgctaaaagacctctatactacatgaaaaatggtcgtcaaaacacagaatcttcctttagacaagtccaagaattagtctacatgatggaaactgcgacaactgtagctccccaaggtgtagaaaagatcacagtcttggtagatttcaaaagttataaagaacctggtattatcactgataaagctccacccatctctattgctaggatgtgtttgaacgtcatgcaagatcattaccctgaaaggttagctaagtgtgtcctgatcaatatcccatggtttgcgtgggcttttttgaagatgatgtatccgttccttgaccctgccactaaggcgaaggctatctttgacgaaccatttgaaaaccacatagagccatctcaactagatgctctatacaatggtctgttagacttcaagtataaacatgaagtctattggccagatatggttaagaaagttgacgatttacgattgaaacgttttgatagatttttaaagtttggaggcattgtcggattaagtgaatatgacaccaagggccaacatgacgaattaaaatatcctgttgatatggtcatttga

SEQ ID NO: 2408 - DNA, 1053 bp, Saccharomyces cerevisiae
atggtcgtgaataacccaaataactggcactgggtcgataagaactgcatcggatgggccaaggagtatttcaaacagaaactggttggagtggaggccggttcggtgaaggataaaaagtatgccaaaatcaagtctgtttcgtccattgaaggtgattgtgaagttaatcagcgtaaggggaaggttatatctttgtttgatttgaaaatcacggtgttaatagagggacacgtggactctaaggacggatcggcattgccattcgagggtagcattaacgttcctgaagttgccttcgatagcgaggcctcaagctatcaatttgacatatctatatttaaggagactagcgaattgagtgaagccaagccactaattagatccgagttattgcccaagttgagacaaattttccaacaatttggcaaggatttgctggccacccatggtaatgacattcaggtgcccgaatctcaggtgaaatctaactacacaagaggtaaccaaaaaagtagctttaccgaaatcaaggactccgcttcaaagccaaaaaagaatgcacttccctcttctacttcaacttcagcaccagtctccagcaccaacaaagtcccccaaaacggaagcggcaatagtacatctatttatttagaaccaacttttaatgtgccttcctccgagctctacgaaacgttccttgataagcaacgcatattggcctggaccagatcagcacaatttttcaacagcggaccgaagctggagaccaaagaaaaattcgagctctttggcggcaacgtgatcagcgagttggtttcatgcgaaaaggacaagaaacttgttttccactggaaactcaaggattggtctgcccctttcaactctactatcgaaatgactttccatgagtcgcaagaattccatgaaaccaaattacaggtgaagtggactggcatacccgttggcgaggaagatcgcgtgcgcgctaattttgaagaatactacgtgcgttctattaaattgacattcggctttggtgccgtattataa

SEQ ID NO: 2409 - DNA, 1053 bp, Saccharomyces cerevisiae
atgtctcaactgccaacagattttgcttcattgatcaagagattccaatttgttagtgtcctcgattccaaccctcaaaccaaagttatgtccttattgggaaccattgacaacaaggatgctattatcacggctgaaaagacgcactttctatttgacgaaaccgtgagaagaccctctcaagatggccgctccactccagttttatataattgtgaaaacgaatattcttgcatcaacggaattcaggaattaaaggagattacttccaatgatatttactactggggtttgtcagtgataaagcaggatatggagtcgaaccctaccgccaagttgaatttaatttggcctgctactccaattcatatcaagaaatatgaacaacaaaactttcatttagtcagagagactcctgagatgtacaagagaattgttcagccttacatcgaagaaatgtgtaataacggtagacttaaatgggtaaacaacattctttatgaaggcgctgagtcagaaagggtcgtttataaagatttttctgaggagaataaggacgacggcttcctaattttacctgatatgaaatgggatggcatgaacttagactctttatatctagttgcgatcgtctacaggaccgatatcaagacaataagggatttaagatattctgacagacagtggttaatcaacttgaacaacaagattagatccattgttcctggttgttacaactatgctgtccatccggatgagttgagaattttggttcactaccaaccttcttattatcatttccacattcacatcgttaacataaagcatcccggtttaggtaatagtattgccgcgggcaaggccatcttgttggaagacatcattgaaatgttaaattatctaggaccagaaggctacatgaacaagacaatcacctacgctattggtgaaaatcatgatttgtggaaaaggggtctggaagaagaactcactaaacaattggaaagagatggtatcccaaaaatacccaagattgtgaacggttttaaataa

SEQ ID NO: 2410 - DNA, 1055 bp, Saccharomyces cerevisiae
atggctagaggaccgtatgttgatttccacctaaaaaaatgaagagttggcaaaacaagataatagttttctttgaagatgggtaccctctcatgattggtacaagtgatttgcaccaaagtgacgatgcggactaaagaaagaatataagagttgtgtttatctatctggaagatagaattctgatgagaaactttatccttgttaagtaacagataagcattgcgggatatttttactaacaagagtacgtttaataatgttaatacgatttttcatatagaaagaagcatctaaagagattagcagctccacaccattggttattggacaagttgtccggttgttacgccccaagaccatctgctggtccacacaaattgcgtgaatccttgccattgattgtctttctaagaaacagattaaagtatgctttgaacggccgtgaagtcaaggctatcttgatgcaacgtcacgtcaaagttgacggtaaggttagaactgacaccacctacccagctggtttcatggacgtcatcactctagatgccaccaatgaaaacttcagattggtctacgatgtcaagggtagattcgctgtccaccgtatcaccgatgaagaagcctcttacaaattgggtaaggtcaagaaggtccaattaggtaagaagggtgttccatacgttgttacccacgatggtagaactatcagatacccagacccaaacatcaaggtcaatgacactgttaagattgatttggcctctggtaagattactgatttcatcaagttcgatgccggtaagttggtttacgttactggtggtcgtaacttgggtcgtatcggtactatcgttcacaaggaaagacacgatggtggtttcgatttggttcacatcaaggactccttggacaacactttcgtcactagattgaacaatgtcttcgtcattggtgaacaaggtaagccttacatttctttgccaaagggtaagggtatcaagttgtctattgctgaagaacgtgacagaagaagagctcaacaaggtttgtaa

SEQ ID NO: 2411 - DNA, 1056 bp, Saccharomyces cerevisiae
atgaactctctggcaaataataataagctttctactgaggatgaggaaatccattcggcaagaaaaagaggctataacgaggagcagaactacagcgaggccaggaaaaagcaaagagatcaaggcttgttgtcacaagagagcaatgacggaaatattgactctgctctgttgagcgaaggggctacgctaaaagggactcaaagtcagtatgaaagcggactgacgtctaacaaagatgagaaaggaagtgatgacgaagatgcgtcagtggctgaggctgctgttgccgctaccgtcaattatacagacttaatccagggccaggaagatagttctgatgcccacacatctaatcaaacgaacgcgaatggtgagcacaaggattcccttaatggggaaagagccataaccccatcaaatgaaggagtcaagccaaacacctccctggagggaatgacgtcttcaccaatggaatctacacagcaatctaaaaacgacatgctcataccattggcagaacacgatcgtgggccagaacaccaacaggatgatgaagacaatgatgacgctgacattgatctcaaaaaggatataagcatgcagccgggtcgtcgtggaagaaaacctactactttggccacaacagacgagtggaaaaagcaaagaaaagactcccataaagaagtcgaaaggcgtcgccgcgaaaacatcaacactgcaatcaacgttttaagcgacctcctgcccgtgagagaatcaagtaaggcagcaatattggcgtgtgccgctgaatacattcaaaaattgaaagaaaccgatgaagcaaacatcgaaaagtggacgttacaaaaattgcttagcgagcaaaacgcatcgcaattagccagtgcaaatgagaaactgcaggaagaactgggaaatgcttacaaagaaatcgagtacatgaaacgcgttttaaggaaggagggaatagaatacgaggatatgcacactcacaagaaacaagagaacgaaagaaaaagcactaggagcgataatccacatgaggcttga

SEQ ID NO: 2412 - DNA, 1056 bp, Saccharomyces cerevisiae
atgaagcaggagccacatagacaatccgaagaaaaagagaagccgaaaggaccaatggctgttgaacgagagcagcatacctcattatcttctggtacaaccgtgacagctagtacaggagacgagagtaccaacagtagaccagtggaatcatcgcaaacagaaaagtctctatcgcttcgaataagaatattaaaacaacttgggtttgacgatattcaagaactaaatgcatgcgacactggcctagtggagcaatttttaaacgtacgattgataaacgacacaaaagaactagaaaagatacgcgagtcaaatcttgcgaaactaaaccagattattgataaatgtatggaaagtgataaaataagtgattcgacattaaacaagattcttgatatgtccatgaatagagatacaaataatgataacaacaatcatcttacgataccgtctccgataacgacaaagaaacgcaagataaacgcctccgaacttgcaagtccacgaggccatagaagatatagatctgatatacctacagtgtcagaagttgagacaggggtcggataccctcaaatacaccagcaaccaggcgcatatactttacctatgcctgcaaatcagtggatgagcaacccgtatatgcaacctccgcaaccacaagtgcaacagataatgccgcagtatttatatccaccagggatgggaccacaagctcagcttcctacaatgagctcaaactcggagtcccagacaccagtgatgagctcacagtttctttccttgaaccagcatggcctttaccaacaaaatataggtgctcatccggtaatgagtatgggcccacaggcaaatatatacgggcagcagcaccagctgcaacctggtcaggaacgagaccagtcaagaaaaagttttagtcatagaaggtcacaaagtgccaatatttccatggcaaattttaggtcgcccatgcgaaatccccagccggcttcgtcccaaaggcccgtcaattttctcattcatacaccaaaacatcctcctcccacatga

SEQ ID NO: 2413 - DNA, 1056 bp, Saccharomyces cerevisiae
atgacacctacaaaccaatctagtggaacgactaatgcatctgtggaggtactttcagaggatggacctatgccaataaacgttatgatgcaagaaggtgtgaaagcgctgactaaaattctttccaatcagcttcaagacagacaagcttttcaaaacgctcctcatgcaatgcaattcgttataagaaatggaggaaaagctttatcaaatgcacggttagaagagctcaaagatgctcttcctaagatggactcgttgagtttggaagatgaacttgcgaaaatagatggccaaagtgcataccacattgattccgcagaggaaaaggaaacctttgaaagtaaaataggccaaatagcttctagaaatagtgcagacttcataatagaggaggacttgcaaaatattttagatgatgatcttaaagactcagaacttaacttggatggcgaagaagccgaaataattttcgattatgagagccaagaactggatacaccggatggtataggggaaaagatttctcaaatgatagaatcggtgttaccgggagggtttggaagtgaagaacagggggggttgcgaactgtaacaaatgtagaggatttagatgttgcagaagaagtcacagatatcgatcatgataccgttgacgcagctcgtttgcatggagacggtcaacattccatatcttctagaaagcacagcaggtcaaagaactcgaaaaagaatgggcatgtaaggcgacatgacttttatgacgaatctagagaccataaaagttgttgcccgcatcatcattatgaaaacttatccaaactacgaaactactattatcatgattttgaatatatttccagaacggaaaaccgtgttccagatttctctgtcctagttaacgaatcaagtcccatgtgtttattttgcgagtactacatggtgtttggtgaaccaccacgtaacatgataaagtggtataatcgtacgtttggttacaatcgtatgccgaatccaccaagagatgaacaagatagtaggaaaaggaatagatag

SEQ ID NO: 2414 - DNA, 1056 bp, Saccharomyces cerevisiae
atgagtgttgatttgtttccaaatgatagatttggtgcagaagataaatacgacaactttaaggatgccgtaaaagaatgctcctggctcatcgaagaaatcgtcaaaccgcaattacccaacattattgacaacttttctaaatgcctagagatgctagagagtgaccaaatattcaaaatgcctgtatctaatggtattcccaacgaaagtaacaaacaaaacgactctccgacggtaaagggtgttatcacaagacaaggccaatacattgttgactttcacattgttgtcagattcccacaatttcaaaggggtaaacaagttatgttccgaatgaatacgggactgaatttcttacttattcaattcagtaagataatgacgcacttgaaaaatattttggaaatactgaatcaacttcaagtagctacagatgtcagcgaattcgtatccaaatttggcgtggccatggaacttttgaaccattctctaatacttttacaaaatcctcctagagacctggtattcccagaagataacaactttgctatgaaggaaatgttccaggattgttactcagtctgcgaatccacagctcacatcctaggactggaacttacgctttgtaggaatgagctttgcatagaactacgaaatctaattaaggtgactaaaaaaccttggtgcgagattgatagtaaaactggcaggtcattttgcgaccaaataagaaatcaagtgacaaatgaaagaaacaaaactttatctaagatcctctcagaaaacggtgtacaagtccaggattccacattacttaaccacataatttcttcttttcaaagtgaagctataacacttccagaagctcaggaattattaagaaggggcgttactttcgataatagggtagtcatggaatgtgaaaagttaatagtatctacaagtgatccaactttgatcagtataagcgccaaattgaacagtctcaaagcttcgatggcgaaccatcaagcaaatttggtagctagcaaacagttaagtacatataagtaa

SEQ ID NO: 2415 - DNA, 1056 bp, Saccharomyces cerevisiae
atgcagaggtttgtcagtaagtttgtttccacaccaccagtacccaaaaagtttcaagagattttcccgaagaaacgtacggttaacaaaattttattccagttagatacaaggcttacataccatgaaatgtacccgatatttctgcaggtatcacaaaatactaatgaagagaatatcccatggaggaagaaatacccctatataaggagttcagacattatgcagatgcgaaacgtcttgataactctaaggacgcagaacaaattcgtccacaaagacttattagctatggaggataaattattgaatattgctgccgaacttggcaacaacgatgctatatccatcctaagcttcaacgtgatacatgaatataaaaaggaaaacgtcaaatccagttatgaaaaagacattgaaacggctaatgaattcataaagaagctgtatgcgcgtaaccatcatttaacggttaaattaataggggacctgtttttcgaaaacaaaacttacgataaggctgagaaatattaccaagagttcttgaaattggaaaatagtaccaaattggcaggcgaagttcacggaaaacttggggaaatccaaataaagcaagtcaatggttttttgaaggcagaaaagtcatggctgagttgtatagaactgctggaaattgaaagaagttcacgttggtactttctgttagcgaggttatatatgagttcagagcccatgaaagccaaagccttgctagaaaattgtgcatcaattggatttaaagaatgctttaaaacattaggatttcttgaattaaactatttcaataattatgaaagggcgaaagaatggttcaaaacgggtatggaaataatggacttggaatgtttctttggatttttcgattgctgtgtgaaagaagagaattttaaaggtgcacgagattgcctagaaagcgtaaaaaagctagggaatgataaagacaagaaaacaatgataaatgtctttcttgaaagtagaaaagattccataaagttgctggacaaagcacggctttaa

SEQ ID NO: 2416 - DNA, 1056 bp, Saccharomyces cerevisiae
atgccttcgcaagtcattcctgaaaaacaaaaggctattgtcttttatgagacagatggaaaattggaatataaagacgtcacagttccggaacctaagcctaacgaaattttagtccacgttaaatattctggtgtttgtcatagtgacttgcacgcgtggcacggtgattggccatttcaattgaaatttccattaatcggtggtcacgaaggtgctggtgttgttgttaagttgggatctaacgttaagggctggaaagtcggtgattttgcaggtataaaatggttgaatgggacttgcatgtcctgtgaatattgtgaagtaggtaatgaatctcaatgtccttatttggatggtactggcttcacacatgatggtacttttcaagaatacgcaactgccgatgccgttcaagctgcccatattccaccaaacgtcaatcttgctgaagttgccccaatcttgtgtgcaggtatcactgtttataaggcgttgaaaagagccaatgtgataccaggccaatgggtcactatatccggtgcatgcggtggcttgggttctctggcaatccaatacgcccttgctatgggttacagggtcattggtatcgatggtggtaatgccaagcgaaagttatttgaacaattaggcggagaaatattcatcgatttcacggaagaaaaagacattgttggtgctataataaaggccactaatggcggttctcatggagttattaatgtgtctgtttctgaagcagctatcgaggcttctacgaggtattgtaggcccaatggtactgtcgtcctggttggtatgccagctcatgcttactgcaattccgatgttttcaatcaagttgtaaaatcaatctccatcgttggatcttgtgttggaaatagagctgatacaagggaggctttagatttcttcgccagaggtttgatcaaatctccgatccacttagctggcctatcggatgttcctgaaatttttgcaaagatggagaagggtgaaattgttggtagatatgttgttgagacttctaaatga

SEQ ID NO: 2417 - DNA, 1056 bp, Saccharomyces cerevisiae
atgttcaagagatttagcaaaaagaaggaggctccagaagacccaaaaaatttgattaatattgataagcctatcaaagaacttcctgcttcgatagctattccaaaagaaaaaccacttacaggtgagcaacaaaaaatgtatgacgaagtgctaaaacatttcagtaaccctgacttgaaggtttatacaagtgaaaaaaataagtcggaggatgatcttaaacccttagaggaagaagaaaaggcatggttgacaagagaatgttttttacgttacctaagggctactaaatgggtgctaaaagactgtatcgatagaatcaccatgactctagcgtggagaagagaattcggtattagtcatttaggtgaagagcatggtgataaaataactgctgacttggtggccgtcgagaacgaatcaggtaagcaggtgattttgggttacgaaaacgatgctagacctatcttatatttgaaaccgggcagacaaaatacaaagacttctcacagacaggtacagcacttggtcttcatgttggaaagagttatcgattttatgccagctggtcaagactctctagctttgctaatagactttaaagattaccctgatgttcctaaagtacctggcaatagtaaaatcccacctattggtgtagggaaagaagtgctgcatattctacaaactcattatccagaaagactaggaaaagcacttttgacgaatattccttggttagcatggactttcttgaagttaattcacccttttattgacccactgacccgtgaaaagctagtttttgatgaaccatttgttaaatatgtccctaagaacgaactagattcgttgtatggtggtgatctgaaattcaagtacaatcatgatgtttattggccagctctggtggaaaccgcgcgtgaaaaaagagatcattattttaagaggtttcaaagcttcggtggtattgtaggtttaagtgaggttgatttaagaggtactcatgaaaaacttctttacccagtaaaatcggaaagcagtaccgtgtaa

SEQ ID NO: 2418 - DNA, 1059 bp, Saccharomyces cerevisiae
atgagtaaggataataggttagcaagtattttgctgcagcctgtagcatcatcctctggaaattgtactgaattccatgactcaaagttgcatactctgcaagaggaacttaatttcttgccactagaaggagttgcgtcgaatgtttgcccgccgatgtttagaggtcataagaactacgtgtttgtgttatattgtttgaatcaagtcgatctcgttacgaatttgcaggattctacaaaacgttactacccactgcaaatatttaaagattgtcaattgagttctttggttcagaaggatttttcacactatttccaactcagcaggcaaaaggaaggggaagatcggaacgatagtgataccaccttggttaatgtcgtcaattctggagtatcccgccatagaagtcaattactaaagatgtgtattatacctagaatttgttcctttgacaaatccaactccaaaacctacaagctaattcaggaatatgttaatcgctttgaaaccgttttaacaaaatttggcccagaaaaagatttcaccaaagtttacgctaactggtcaaaactcattgagtcgtttaatgagcttattttacatgacctgttggtgaaatggcaacaatggtctgaattaactcagccaaatgccacggtccatcagaacattccgaatgttctcagggaactcgtaataaaattaacacaaaggtactttacattccaaccttcatacagttgttcgattgatgaattcacaacaattttacttaataaaaatgctttgagtctcttggacgttttcagaaaacccagaaaatataaactgaattttggtttatggctagattgtcaaaacggtattttaatttttacaaatggtattgtgcagatggcagatgaaattacaagtgagagggtgaaatcctttgtcaggccagcacatctcttggtattggaagaccattcaaatgatgaagcagtcaagaaactaatgtttttcactttttcagcgatattacaatgctttacagatgagattctgaattgttaa

SEQ ID NO: 2419 - DNA, 1059 bp, Saccharomyces cerevisiae
atgattggcaaacggtttttccaaacaacaagtaaaaagattgcttttgcattcgatattgatggtgtgttgttcaggggcaaaaagccaattgctggtgccagcgacgcattgaagctgttgaaccgaaataaaattccatatattttactcactaatggtggagggttctctgaaagggcacggacagagtttatctcgagtaaattggacgttgatgtatcacccttgcaaattattcaaagtcatactccttacaagtcccttgttaacaaatattcaaggatcttggccgttggtacaccttccgtgagaggcgttgcagaaggctacggatttcaagatgttgttcaccaaacggatattgtaagatacaatagggacattgcaccatttagtgggctatctgatgaacaagtgatggagtactcaagggatattccagatttaaccactaagaaattcgatgccgtcttggtatttaacgatcctcatgattgggctgccgatatacaaatcatctcagatgcaatcaacagcgaaaatgggatgttaaataccttgagaaacgaaaagagtggcaaaccttccatccccatttacttttcgaaccaggatttactgtgggccaatccttataaattgaatagatttggacaaggtgccttccgcttactagttagaaggctttatctcgagttaaatggtgaacccttgcaagattatactttgggtaagcctacaaagttgacttatgatttcgctcatcatgttctcattgattgggaaaaaagactaagcgggaaaataggccaatctgtgaagcaaaaactgccactcttaggcacgaaaccttcaacttctccattccatgcggtttttatggtaggtgataatcctgcaagtgacatcattggagctcaaaattacggttggaacagttgtttggtgaagacaggtgtgtataacgaaggtgatgacttaaaggaatgtaagcctaccttgatcgtgaatgatgtatttgatgcggttactaaaacgttagaaaagtacgcatga

SEQ ID NO: 2420 - DNA, 1059 bp, Saccharomyces cerevisiae
atggaatcaagtttacaaaaattgaaattccaggatattgacataaatcttattcctactgcgaagtggaccacaaaattacagtatattctatacacctggtgtcagtcgatactacatgtggccatgtttttttctgatatatacacgtgtattaaattactggcatttaacacatggtcgaacaatatcatccaaccattcttggaattccgtatttcaaaatggttgtttagcggatgcatattatgctcctcattaatattaatttgggagttggtaattggattgagagtgtataggaagaaagagattacatcgaactacatgaatggcattagcagattaataaattgcttgttcaatttcaaaaagtatcaaattttcgaactaatagtgctgactgatgagaaaaaattcagtaagtggttattcttttcatattttgaaatcagtggatgtttgaggctattgttcggtgactctccaaggcaaataatcaacggattaactttgtggtcagttttactgacagtttcgaatgagaccagtagcggaacccatagtactcaaagcctaggtaatttagatgacctaaatggaataataaacaagataaaacatattgctaagacaaattacgaagaaagtgtgatcttgtccttcatgttgttctcgtttatcatatgggtaattttaataagcaaattaattctaagcataataatattcatcatttttatacgtccgagatttttgtctagtaaaaggaaggttaaggggtatgaattgaaactacgaaagtatgtgtctaaagtcattgacgagaatttaagtagaactgtctacgaattgggaatattgatagatgatgaggaagaagggaccatatgtggtgacaacaaaacgcaaaaaaaattcgattatgatagtcctgattatggcgacgaaagcacaataccgagttactactgctactcggatgtagaaacgtacgaaagagtatatacgcccataaaggcatatttcccccagaaatacaaacataaatacatataa

SEQ ID NO: 2421 - DNA, 1059 bp, Saccharomyces cerevisiae
atggcttcagaaaaagaaattaggagagagagattcttgaacgttttccctaaattagtagaggaattgaacgcatcgcttttggcttacggtatgcctaaggaagcatgtgactggtatgcccactcattgaactacaacactccaggcggtaagctaaatagaggtttgtccgttgtggacacgtatgctattctctccaacaagaccgttgaacaattggggcaagaagaatacgaaaaggttgccattctaggttggtgcattgagttgttgcaggcttacttcttggtcgccgatgatatgatggacaagtccattaccagaagaggccaaccatgttggtacaaggttcctgaagttggggaaattgccatcaatgacgcattcatgttagaggctgctatctacaagcttttgaaatctcacttcagaaacgaaaaatactacatagatatcaccgaattgttccatgaggtcaccttccaaaccgaattgggccaattgatggacttaatcactgcacctgaagacaaagtcgacttgagtaagttctccctaaagaagcactccttcatagttactttcaagactgcttactattctttctacttgcctgtcgcattggccatgtacgttgccggtatcacggatgaaaaggatttgaaacaagccagagatgtcttgattccattgggtgaatacttccaaattcaagatgactacttagactgcttcggtaccccagaacagatcggtaagatcggtacagatatccaagataacaaatgttcttgggtaatcaacaaggcattggaacttgcttccgcagaacaaagaaagactttagacgaaaattacggtaagaaggactcagtcgcagaagccaaatgcaaaaagattttcaatgacttgaaaattgaacagctataccacgaatatgaagagtctattgccaaggatttgaaggccaaaatttctcaggtcgatgagtctcgtggcttcaaagctgatgtcttaactgcgttcttgaacaaagtttacaagagaagcaaatag

SEQ ID NO: 2422 - DNA, 1059 bp, Saccharomyces cerevisiae
atggtcaaggagacaaaactttatgatttacttggagtatctccaagtgctaatgagcaagaactgaaaaagggttatagaaaagcagctctaaaatatcatccagataagccaacaggtgacacagaaaagtttaaggagatatcagaggcctttgaaattttaaatgatcctcaaaaaagggaaatatatgatcaatacggtctcgaggctgctagatctggtggtccaagctttggtcctggtggtcctggcggtgctggaggtgctggaggcttccctggcggtgcgggcggattctccggaggacatgcgttcagtaatgaggatgctttcaatattttttcacaattctttggcggcagttccccattcggtggtgctgatgacagtggcttcagtttctctagttatccatctggcggcggtgctggtatgggaggtatgcctggaggaatgggaggaatgcatggcggcatgggaggtatgcctggcggctttagatcagcatcaagctctcccacgtatccagaggaagaaacagttcaagttaatttaccagttagtctagaagatttgtttgttggtaaaaagaagtcatttaaaattggaagaaagggcccacatggggcctctgaaaagacacaaattgacattcaattaaaaccgggttggaaagctggtaccaaaataacatacaagaaccagggtgattacaatcctcaaacgggccgtagaaagactttgcagtttgtcatccaggaaaagagccatccaaactttaaaagagacggtgatgacctaatttacactctgccactatctttcaaggaatcattgttaggtttttcaaaaactatccaaacaattgatggcagaaccttacctttgtcgagagtacagcctgtccaaccctcacaaacttctacttatcctggtcaaggtatgccaactccaaagaacccatctcagagaggtaatttgattgtaaaatataaagtggactatccaatatcactaaacgacgctcaaaaacgtgctatagatgaaaatttttaa

SEQ ID NO: 2423 - DNA, 1059 bp, Saccharomyces cerevisiae
atgtcagattggaaagtggacccagatacccgcaggcgtcttttgcaattgcaaaagattggtgcaaataagaaatgtatggattgtggtgcgccaaatccacaatgggccacgcctaagtttggagctttcatttgccttgaatgtgccggtatccatagagggcttggtgtgcatatatcttttgtaagatctatcactatggatcagtttaaaccggaggaacttcttcgtatggaaaaaggtggtaacgaacctttgactgaatggttcaagtcgcataatattgacctgagtttaccacaaaaagtgaaatacgataaccccgtcgcagaggattataaagaaaagttaacatgtctttgcgaagatagagtatttgaagagcgtgagcatttggattttgatgcttccaagttatcagcaacctctcaaaccgctgcatccgctacgcctggtgttgctcaaagtcgagaagggacaccactggagaaccgtcgatctgcaacaccagcaaactctagtaatggtgccaattttcaaaaggagaagaacgaagcttattttgctgagctgggcaagaagaaccaatctagaccagatcatttgcccccttctcaaggtggtaaatatcagggctttggaagtacacccgcaaaacctccacaagaacggtctgcagggtccagcaatactttgagcctggaaaattttcaagctgatcctttgggaacattgagcagaggatggggcctcttctccagcgctgtaaccaaatcgttcgaggacgtaaacgaaacggttattaagcctcacgtccagcaatggcaatccggagagttgtcagaagaaacgaagagagcagctgcccagtttggccaaaagtttcaagaaacgagtagttatggattccaagcatttagtaacttcactaaaaatttcaatggtaatgcagaggatagctctacagcagggaatacaacccatacagaatatcaaaagattgataataacgataagaagaatgaacaggacgaggacaaatgggacgatttctaa

SEQ ID NO: 2424 - DNA, 1062 bp, Saccharomyces cerevisiae
atgacgctgcaaagaattagtaaagattatctaaagcctaattatggacttatcttacttatagtgtcttattttttcaattcttctatggtagtttctaccaaagtcctagaaaatgacccactggaaacttcgcaatcaagaattaatcctctgcaaatcctgctagtaaggatgtctatcacgtactgttgtacgctagtatacatgcattggaataaacaaagtgttccagatattccatggggcccagcaccatgcaggaaatggttgatactccgaggtataatgggtttttttggtgtttttggaatgtacttttctttaatgtatctaagtataagtgacgctgtcttaatcaccttcatgtcgccaaccctaaccattttcctttcatttttactgctgggtgagccatttagtaaacttgaagccttggggtccctaatttcattttctggagtggtgttaattattagacctacatttttgtttggtgagcagacccaaggccagcaatctccacaagacgatattgttgagactcaaaatcccaaattaagactcattgctatcggggtgagtttattgggggtttgcggattgagtagtgtttacattatcataagatatatcggtaacaaggcacatgccatcatgagtgtcagttatttctcgttggttactactgttgtggcagccctcggtgtgcttctaattccctcgatgtctttacaactgcctcattcgtggaagcagtgggggctatttctgaacttgggtatttctggattcattcaccaaattctgttaacaatgggaatccagagggagcgtgcaggaaggggttcgttaatgacttatactcaagttatatatgctgttttctgggatgtcgtgctctttcaccactggccaaacatatggacgtggtgcggtatggcagttatcgttagttctactatatgggtcattaatatgagagcctccaaacaaaacgttgtggctactgccgagctactctccacatcggactttgaattagatgatttggaggattaa

SEQ ID NO: 2425 - DNA, 1062 bp, Saccharomyces cerevisiae
atgactacaaataatgacttctattttgctctactacgcatatctattctccaattattgaaggcacaaggatttgacagggcaaggcccagtctggtggatgtcatgaccgatctctatgcaaaattcttgagtttgttagcatcagaggtcagttctatcgctcaggcaagatgtgatcaggacgatacaattgctttacaagatataactctggctctggaaaatctaggtattgttaagcctacgaacgttctggatgtctatgatgaaaactccgaattatcaagttcacgaggaatggaaaagttcaaggactggtgtatttatagtactcaattgaccgacgcgcgaataactgccttacccacagtagaattactacaaagtgaggaaaaagaatctgatcctttgtcagcaatacctgactatctcaatcaattactgcaaaacaagggtgcgaaacagaaattagaaacaaagaatagaaaaacagagttgatagaagatctaataaataataatggattagatgattggatcaaattagtcattgctagacaacgtataaacatgattgaaagagcttccaaaaaagaatctcaaaatgtaccggctttaccacatattgcaggctataaatcttccattctaagccgccatcaccacactaccataacaaacgaagataggatgccttcggcgatgaccccaagagatgaggatgccttaacagagatccaagaaaatccatttgtaactagcaaactgccgataatgagaaaagaaaataggttagaaaatataactctttcatttgaggatgaggagcttgaatcacttggcgaagtggaaggccctaaccaaaagtctcaagaaaataacaatgaggaaagttttaaagagaacaataaaagtttaacagagtctcctcatggtgatgaccgtgacatatcaatgtttcaattcgactcaaatgttgatactaaatgggcagagcaggaagatatggacagcacatttcaacgtcgaacctcactagattatgggggttacttttaa

SEQ ID NO: 2426 - DNA, 1062 bp, Saccharomyces cerevisiae
atgattcaatttaaaagtccaggtaactggctgttcatagtaccctggattgccttcattccatggtatggtatgctgatagccatgcttatttgctgggccagtcaaggccatcccatatattggttcatgcactcggagcaattccctgtgtacatttcagatataggtgccactaatttaaggccactgtttatatcgtgcgccggctggcagggtctaggctatgtaatcactgttgcccttgagttttttcaaagatccggctatctgcctttccaactgaaaaaaaaagacccttctatctctgattccacatcttatgctgagaaattgcacagcggtaaatacttaatgcctccatattacacaaaggatgaacggaacctgattttcgcagcttttgttctcggcagcattggtgaactagcccttttattcagttccatcttctcaaccgccctgtaccatcgcgttcacattgctatggtctctgttttcgtcgtcttcatgttcctatccacttgctgcttgattgcagagtatttcctcatgggaaggcactatgcctcagtccaccccctagccagccctcatttcaatcctcaatcatctgaaaaaagctttaaccaagattataacactgtggatgagctgccttggtataaatggaaaggccatgtatggaataaatttaccatcagtgcaactctaaaagttatatggttaactctcgcagttgtatgggccatttgttttggtgctatcaatgatagatctaagagtgcttgtttcgaatggttgctagcattttggtttggtatcatatttatgattctttccgccgacttttatttaggtggaagatacagacaatcccgctatttcaaccacgtggaatcattttcgggttattacaagtatgacaaggcgctaggcctctaccacagtgaagacgttttgccttcggacgataacgccggcgtgattgccacagaaacagcatcttcaaatatttacaataattcctcttccaacgaatctattcaagtagtcgtatga

SEQ ID NO: 2427 - DNA, 1062 bp, Saccharomyces cerevisiae
atgccaaagagaattgtatacaatatatccagtgacttccagttgaagtcgttactgggagagggtgcatacggtgtggtatgttctgcaacgcataagcccacgggagaaatcgtggcaataaaaaagatcgaaccattcgataagcctttgttcgcattacgtacgctgcgtgaaataaagatcctgaagcacttcaagcacgaaaatatcataacaatcttcaacattcaacgccctgactcgttcgaaaacttcaatgaggtctacataattcaagagctaatgcagacagatttacaccgtgtaatctccacccagatgctgagtgacgatcatatacaatattttatataccaaaccttgagagcagtgaaagtgctgcatggttcgaacgtcatccatcgtgatttaaagccctccaaccttctcataaactccaactgtgacttgaaagtatgtgatttcggtttagcaagaatcattgacgagtcagccgcggacaattcagagcccacaggtcagcaaagcggcatgaccgagtatgtggccacacgttggtacagggcgccagaggtgatgttaacctctgccaaatactcaagggccatggacgtgtggtcctgcggatgtattctcgctgaacttttcttaagacggccaatcttccctggcagagattatcgccatcaactactactgatattcggtatcatcggtacacctcactcagataatgatttgcggtgtatagagtcacccagggctagagagtacataaagtcgcttcccatgtaccctgccgcgccactggagaagatgttccctcgagtcaacccgaaaggcatagatcttttacagcgtatgcttgtttttgaccctgcgaagaggattactgctaaggaggcactggagcatccgtatttgcaaacataccacgatccaaacgacgaacctgaaggcgaacccatcccacccagcttcttcgagtttgatcactacaaggaggcactaacgacgaaagacctcaagaaactcatttggaacgaaatatttagttag

SEQ ID NO: 2428 - DNA, 1062 bp, Saccharomyces cerevisiae
atggaaagcagaaataccgtgcttccttctttaccaaacattattacaggtacttctaattcgcctttccaactgcatactttgccaaatacaaacttccctagtgatgaccaaggtgacatcaggttgccaccattagctgcatctgcgcacattgtgagaccagtggtaaatatttataaaagtccttgcgatgaggaaaggccaaaaaggaaaagtccacaggctgtggatttcttatcacaacgtgtaaccacttccatgacgcctttatccaagcccaagaagctgagctctcattcaccattcacgccaacggtcagagtctgttctaaagagcagccacctcagagtatgcactcttataaaaaagttaatattcttactcctctatctgctgcaaaggctgttctcacaccaaccacaagaaaagaaaagaaaaggtcatttgcctttattacacactcacaggaaacttttccaaagaaggagcctaagatagacaatgctcggttagctcgtcggaaaagaagaagaacttcatcatatgagcttgggatattgcaaacagcatttgacgaatgtcccacgcccaataaggctaaaaggatagagttatccgagcaatgtaatatgtccgaaaaatcggttcaaatatggtttcagaacaaaaggcaggctgctaaaaagcacaagaacagtggcaacaccagccattgcaaagttcactctaatgattcgatgtctatgatatcttactcagacgctgcgttggaaattacctctacgccaacgagtacgaaggaggctattactgcagagttgctgaaaacttcacctgccaatacgtcctcgatcttcgaagaccaccacataacgccttgcaagcccggcggacagctcaagttccacaggaaatctgtgcttgttaagagaacattatcaaataccggtcatagcgagattatcaaaagtcctaaaggcaaggaaaaccgcctaaagttcaatgcatacgaaagaaaaccccttggggaggtcgatctcaattctttcaaaaactaa

SEQ ID NO: 2429 - DNA, 1062 bp, Saccharomyces cerevisiae
atgggttcccaagatttagctagtttaattgggaggtttaaatacgtcagggtgttagattcgaaccctcatacaaaggtaatctcactactaggcagcatagatgggaaggatgccgtgttaactgctgaaaagacgcatttcatatttgatgaaacggtacgtagaccctctcaaagtggccgtagcactccgattttctttcatcgtgaaatagacgagtactcctttttaaacggtattactgatctgaaggaattaacttcgaatgacatctactactgggggttgtctgttttgaagcagcatattttgcataacccaactgcgaaggttaacttaatttggcccgcctcgcagttccacatcaagggatacgaccagcaggatttacatgtcgtcagagaaactcctgatatgtatagaaacatagttgtgccctttatccaagagatgtgtaccagcgaaagaatgaaatgggtaaacaacattctttacgagggcgccgaggatgatagagttgtttataaggaatacagtagcaggaataaagaggatggattcgtcatcttgcccgatatgaagtgggacggaatcaacattgattcgttatacctggtcgcgatcgtgtacagggacgacatcaaatctttgagagatttgaacccaaaccatagagattggttaattagactcaataagaagattaagaccatcatcccccagcactatgactataatgtaaacccggacgagctaagagttttcattcattatcaaccttcatattaccattttcatgtccatatagtgaatataaggcatccaggagtaggcgaggagagaggctccggaatgacaatactgttggaagatgttatagaagcgttgggtttcttaggtcctgaaggttatatgaagaagacgcttacttatgtcattggtgaaaatcatgatttatggaaaaagggctttaaggaagaagttgaaaagcaactgaagcatgatggtatcgcaaccagtcctgaaaaaggctctgggttcaataccaatttgggttga

SEQ ID NO: 2430 - DNA, 1062 bp, Saccharomyces cerevisiae
atggtcgatacgcataaactagcagacgacgttcttcagctattggataaccgtatcgaagataattatagggtttgtgttatcctagtcggttctccaggctccggtaagtctactattgcggaagaactttgtcaaattataaatgaaaaatatcacacatttttgtcagagcatccaaatgttattgaggttaatgataggttgaaacctatggttaacctagtagactctttaaagacgctccagcccaataaagtagctgaaatgattgaaaatcaggggctgtttaaagatcatgttgaggatgttaattttcaaccagtcaagtactcagcccttacatcaaataatgaagaatgtaccgcagtagttgccagaggtggtactgcgaatgccataagaatcgcagcagttgataatccagtcaatgttaacaagttggcccaggatagtatcaatatagcgcaaatagtcccaatggatggttttcacttatctcgcagatgtctagacctattcaaagacccacaaactgcccataaaagaagaggttcgccctcaacgtttgacagtaacaatttcttacaattgtgtaaaattctagccaagacgtccctatgtaaggtctcctcacatcataaattttactccacttcaagcgtttttgagaagttatccaaaacttttagccaaacaattcctgatatctttgttccaggatttaaccatgcactaaaagacccaactccagatcagtactgtatttccaaatttacaaggatagttatacttgaagggttatacctactgtatgaccaagaaaactggaagaaaatttacaaaacattagctgatacgggagcacttcttgtttataagattgacatagactatgaggccaccgaagaaagggtggccaaaaggcatttgcaatcagggttagtcacgactattgcagaaggacgagagaagtttcgcagcaatgatttgttgaatggcagggatatagataatcatttaattaaggtagataatatcgtccatatccgcaacgactag

SEQ ID NO: 2431 - DNA, 1062 bp, Saccharomyces cerevisiae
atgtcattaccacaatggtgtccaccgcattccaccttaaaaagaaatccaactacaggagaggacgtatactgcatatgtaaaaggccagactatggggagctgatggtgggatgtgatggttgtgatgactggtttcatttcacctgccttcatattcctgagcagtttaaggacctggtgttctctttttattgtccttactgtcaagcggggattactggtaagaataaggacgccataatcaatggtgaagggagcttgccaaaaaccttatggaaaagaaaatgtaggataagtgattgctacaaaccatgtttacaggatagtaaatactgttctgaggaacatggtagagaatttgtgaatgatatttggtcgcgattgaaaacagatgaggatagagcagtcgtcaagaaaatggtcgaacaaacaggacacatagataaattcaagaaatttggacaactggatttcattgataacaatatagttgtaaaaacagatgacgaaaaggaaatattcgatcaaattgttgtacgagacatgacgttaaaaactcttgaagatgatctgcaagaggttcaagagatatcgctaccattattcaaaaaaaagctagaacttttggaagtatatttgggatggttagacaacgtatataccgaaatgcgcaagctggacgatgatgctgcaagccatgtggaatgtggtaaagaagattccaaggggacaaaaaggaagaagaagaaaaatagcagcaggagtagggctaggaaaaatatatgtggctattgttctacatacgagcgaataccctgctctgtggaagaatttgtcagagattttggaagtaatgaggaagccaccaaaatacatgaggtatgcacgaagtggaagtgtaacagacatttggattgggtgtctactaatcaggaacaatacctccagcagattgactctttagaatctatgcaagaaaggttgcaacatctgatacaggccaggaaaaagcaactaaatatacaatactatgaggaaattttaagaagaggtttgtaa

SEQ ID NO: 2432 - DNA, 1062 bp, Saccharomyces cerevisiae
atgtccaagttagaaaccgtttacttatacgctggtgaagaacaaccacgtgttaaattgacctgtattaaggaaggtctcactttaactcaggttatcaagttcgtgcattctattcaagaattgtacgggattgagttgcaaacttctgagaccataacagaaaatttgaagatagattgtgcacccgcatatttgaagccgaattgtattccccatttctacattctcgaatatgaagaaataagtgacacctttttcatttggaaatctgatggtcgttggcaattaaataagttgtctgccttgttgtacgtggataacgacgctaacgtggttaagaacacttcctggaaggaggttttccagaatgatcaacgatttaaaaattatgataaacgggcctggttacaaaattgtctagaaaaaatgaatagagatctctcaaaactaaacgttgaacaattttggtctcaatatgataaaatatgtcaaagcattgccaaacaaaagaaaaaacaggaacagttcaacatggaggttttcgataacttcaaaaatattgtttctattgctatcataaagaccaaagttttatcgaataagcgacttttgacaacaactttaaaaaattatcataactcgatgaagaaaaagtataacatccaggaacaaaatcttaaggaaaatagtttggcatcgtgctcaaacaatgagccttccgcatctctggaaagcgaatcaagacatttttctccggtaaattcgctgtctccttcatctttgagtaccgatgatgaggctgtctcgacagactacatctataaaggtcctgagtctaaaccaaacgtgaatttcatgcattcaagtgctacaaacgatctgatcaagtcaaattttgaaagctattttaaattgatggccgaagactatgaaacttttgacttgagagcctggtcgagacaaagacctcgaaaatttcagcttgtggaaaaaaaaaaaatcactaaaaaccctcctaatagccatcatccgcataaaaatggcaaaatatcattttaa

SEQ ID NO: 2433 - DNA, 1062 bp, Saccharomyces cerevisiae
atgtcgacagcacagaaagctaagatattgcaactcatcgattcctgctgccaaaatgcaaaaagcacacaactgaaatctttatcatttgttattggagcagtaaatggcacgacgaaagaagctaaaagaacctacattcaagaacagtgtgaatttttggagaagttacgacaacaaaagataagagagggaagaattaacatattgtctatggatgctggtgtttctaactttgctttctctaagatgcaattgctcaataatgatccgctccctaaagtactagactggcaaaagataaatctagaggagaaattttttcaaaacctcaaaaagttaagcttgaatcctgctgaaacttctgagcttgtatttaaccttacggagtatttatttgaatctatgccgataccagatatgtttacaattgaaaggcaacgtaccagaactatgtcttcgaggcatattttagacccaattttaaaagtgaatattctcgaacagattcttttctctaacttggaaaataaaatgaagtatacgaataaaataccgaatacgtccaagttgaggtatatggtatgttcgtccgatccacatcggatgacttcatattggtgcattccaagagaagagacaccgaccagttcaaaaaagttaaaatctaacaaacatagcaaagattctcgaataaagctagtgaaaaaaatactttcaacctcaatactagaaggtaattcaactagttctacaaaactggtcgagttcataggagtttggaataataggataagaaatgcccttaccaaaaaaaaaagtttcaagctatgtgatatactagagatccaagataattcgggggtgagaaaagatgacgatttggcagattcattcctccattgtttgtcttggatggagtggttaaaaaattatgaaagtattactgaactcttgaattcaaaaacactggttaaaacacagttcggacaggtgtttgaattttgtgaaaataaggtacaaaagctgaaatttttgcagaacacttacaacaatgactaa

SEQ ID NO: 2434 - DNA, 1062 bp, Saccharomyces cerevisiae
atgtttgaagggtttggtccaaataaaaagcgtaagatatcaaagttagccgcagagcaatcattggcacaacaaccctgggttgagaaatacaggcccaaaaacctagatgaagtgacagctcaagatcatgccgttactgttttgaagaaaaccttaaagtcagctaatctaccacatatgttgttttatggtcccccaggaactggtaaaacgtctaccattttagcgctaacaaaagaattatatggacccgacttgatgaaatcaagaatattggagttgaacgcttctgacgaacgtggtatctctattgtaagagaaaaggtaaaaaattttgcaagattgactgtatccaagcctagcaaacatgacttggagaactatccgtgcccaccgtataagatcattattctcgatgaggccgattcaatgactgccgatgcacagagtgcattacgtagaacaatggaaacctattcaggagtaacaagattctgtttgatttgtaattatgtgacaagaattattgacccgctagcgtcccgttgttccaaatttagattcaaagccctagacgcaagtaatgccattgaccgtttgaggtttatcagcgaacaagaaaatgttaaatgtgatgatggagttttggaaaggatcttggacatttcggcaggtgacttgagaagaggcattacattattacaatccgcttccaagggggcgcaatacttgggtgatggtaaaaacataacttctacccaagtggaagaattagctggtgtggtacctcatgacattctaatagaaattgttgaaaaagtcaaaagtggtgattttgatgagattaagaaatacgtcaatacgtttatgaaaagcggttggtctgctgcgtcagtagttaaccaactacatgaatattacatcaccaacgataactttgatacgaacttcaaaaatcaaatatcttggttgctgtttactacggattccagattaaacaacggaacgaacgagcacatccaattattaaacttattggttaaaatatcccaactctaa

SEQ ID NO: 2435 - DNA, 1063 bp, Saccharomyces cerevisiae
atgaaggtatgtaatatcacccaaatccttagaattctaatgaatcagcacgcgctaaccggctgtttctgactgtttgataaacgtatacccacaaattagtgcactataataaaaattctcaagaacaacgttgtttaaacgagataattccctctaatatacacgtaccgacacttaggaaaatatctcgctaagttcaaattaaggaatgaaaaaggaatttacgaaaagggtttagaaatatcaatgaaaataagaaaaacctgtaacggaagaaaggacagcagggattcgttggaatttgtcgatattggcttcggacaactttactaacaaatggtattatttataacagttgaacatttcttacccagtcaacgggtctcaaaagaccttcgaaattgatgatgaacaccgtattcgtgttttcttcgacaagagaatcggtcaagaagtcgatggtgaagccgttggtgatgaattcaagggctacgtcttcaagatctctggtggtaacgacaaacaaggtttcccaatgaagcaaggtgttttgttgccaactagaatcaagttgttgttgaccaagaacgtttcttgttacagaccaagacgtgatggtgaaagaaagagaaagtccgtcagaggtgccattgttggtccagatttggctgtcttggctttggtcattgtcaagaagggtgaacaagaattggaaggtctaactgacactactgttccaaagagattgggtccaaagagagctaacaacatcagaaagttcttcggtttgtccaaggaagatgacgttcgtgatttcgtcatcagaagagaagtcaccaagggtgaaaagacttacaccaaggctccaaagatccaaagattggttactcctcaaagattgcaaagaaagagacaccaaagagctttgaaggtcagaaacgctcaagctcaaagagaagctgctgccgaatacgctcaattgttggctaagagattgtctgaaagaaaggctgaaaaggccgaaatcagaaagagaagagcttcttctttgaaggcttaa

SEQ ID NO: 2436 - DNA, 1065 bp, Saccharomyces cerevisiae
atgaagttccaagttgttttatctgcccttttggcatgttcatctgccgtcgtcgcaagcccaatcgaaaacctattcaaatacagggctgttaaggcatctcacagtaagaatatcaactccactttgccggcctggaatgggtctaactctagcaatgttacctacgctaatggaacaaacagtactaccaatactactactgccgaaagcagtcaattacaaatcattgtaacaggtggtcaagtaccaatcaccaacagttctttgacccacacaaactacaccagattattcaacagttcttctgctttgaacattaccgaattgtacaatgttgcccgtgttgttaacgaaacgatccaagataagtcatccgccggtgccgttgttgttgccaacgccaaatctttggaagctgtctcattcttcttctctatcatttttgacaccgaaaagcctattgttgtcactgaagattccgcttatgccattccagtcgctaacaataagaacgctaccaaacgtggtgtcttgtccgtcacttctgacaaattagtgtactccggtgtcttcactccacctactgcttgttcttacggtgctggtttgcctgttgctatcgttgatgaccaagacgaagttaaatggttcttcgatgcttctaagccaactttaatctcttctgactcgattatcagaaaggaatacagtaacttcactactccttatggtctattagaaaacggtgttccaattgttccaattgtctatgacggtggttactcttccagtttgattgactccttgagttctgccgttcaaggtttggttgttgtttcttctggttctaccaactcaacctcatctactattgaaagcactgaaatcccagtcgtatatgctcaagctaacactccattaaactttattgacaacaaagatgttccaaagaacgctgtgggtgctggttacctatccccaattaaggcccaaatcttgttgtccattgctgccgttaatggtgtcacctccaagtccgctctggaaagcattttcccatga

SEQ ID NO: 2437 - DNA, 1065 bp, Saccharomyces cerevisiae
atgatgaataacaacggcaaccaagtgtcgaatctctccaatgcgctccgtcaagtaaacataggaaacaggaacagtaatacaaccaccgatcaaagtaatataaattttgaattttcaacaggtgtaaataataataataataacaatagcagtagtaataacaataatgttcaaaacaataacagcggccgcaatggtagccaaaataatgataacgagaataatatcaagaataccttagaacaacatcgacaacaacaacaggcattttcggatatgagtcacgtggagtattccagaattacaaaattttttcaagaacaaccactggagggatatacccttttctctcacaggtctgcgcctaatggattcaaagttgctatagtactaagtgaacttggatttcattataacacaatcttcctagatttcaatcttggcgaacatagggcccccgaatttgtgtctgtgaaccctaatgcaagagttccagctttaatcgatcatggtatggacaacttgtctatttgggaatcaggggcgattttattacatttggtaaataaatattacaaagagactggtaatccattactctggtccgatgatttagctgaccaatcacaaatcaacgcatggttgttcttccaaacgtcagggcatgcgccaatgattggacaagctttacatttcagatacttccattcacaaaagatagcaagtgctgtagaaagatatacggatgaggttagaagagtttacggtgtagtggagatggccttggctgaacgtagagaagcgctggtgatggaattagacacggaaaatgcggctgcatactcagctggtacaacaccaatgtcacaaagtcgtttctttgattatcccgtatggcttgtaggagataaattaactatagcagatttggcctttgtcccatggaataatgtcgtggatagaattggcattaatatcaaaattgaatttccagaagtttacaaatggacgaagcatatgatgagaagacccgcggtcatcaaggcattgcgtggtgaatga

SEQ ID NO: 2438 - DNA, 1065 bp, Saccharomyces cerevisiae
atggactatggctacttttttcccgcacaacgtattgaagaaacaaatggtgtggatttttggatagacagtaatgctgaatttacacagtctaaaagacctgactcttcaacatccactctttcgagggttttaacggacaccacgaatgtatccaataatagtggatcactcaaaagaaaaaccatcaagaacaaaatattcccacaaaggaaaatattcaacgatagcgaaaattttgactttggtaaagccaacactgattgtaagcatgtgtttaaaagtatttctaagcaactgatttttcttccaaggtgtttccaacatcacagtatccgaggctggatgaaagacagatactccgaatttggttataaaataaaaagaaatcaaaattgtcccccctcagcatgtgtacaggcactatacaatactagtagatccaataccgaagagtcaaaccccaacagtctggattctctgataatgtataaatacatgcgatactctgaaaagaaaaaggaattgatgtgcagattttgccaggggaataattggattctagctgaaaactacctaaaacatttattctttgcgcacggcattttgtctgaatttaagcctcacactttataccatttcgagtctaagctgttaaaaatccagggaaaacttaatttcaaaattcaagtattaaaagagccagagtttagcaaaaaaattttgaactctcttactgtatccatcattccctctcctttggcctactacactcaaacgttgaacgggggatttaggagaatccatgtgaaatgcccccactgcgaaaattggatccgtttgggttggtgtgaatacgatgaaatcattagggattcctttcaggatttcgagtctctaagaaacctcaatgctgattataatgggatgtcgtatattcaaacacgcaatagagaagacattgaaggtatatacgagaattattttacacactacatccaatgcgacttagccacgttccgaacgaaatgtttatatgtccaagttataacaaaaagcaattga

SEQ ID NO: 2439 - DNA, 1065 bp, Saccharomyces cerevisiae
atggatttaaccgtggaacctaatttgcactctttaattacctctaccactcataagtggattttcgttggtggtaaaggtggtgttggtaagactacttcatcatgttccattgctatccaaatggctttgagtcaaccaaacaaacagttcctactgatctctactgatcctgcccataacttaagtgatgcattcggtgagaaatttggtaaagacgccagaaaggtgacaggcatgaataatctatcatgtatggaaatcgatccatccgctgctttgaaggatatgaacgacatggcagtttcacgcgctaacaataacggaagtgacggtcaaggtgacgatctaggaagcttgcttcaaggtggtgctcttgctgatttgaccggttccatccctggtatcgacgaagctttatccttcatggaagtcatgaagcacattaaaaggcaagaacagggcgaaggtgaaaccttcgatactgttatttttgacactgctccaactggccacacattaagatttctacaactaccaaatactttatccaagcttttggaaaagttcggtgaaattaccaacaaattgggcccaatgctaaactcttttatgggcgcaggtaatgtcgatatctctggaaaattgaacgagttaaaggctaatgtcgagaccatcagacaacaattcacggatcctgacctaacgacttttgtttgcgtttgtatcagtgaattcttatccttatatgaaactgaaagactaattcaggaattgatttcctacgatatggacgttaattccatcattgtcaaccaattattatttgctgaaaacgatcaagagcacaactgtaagagatgtcaggcaagatggaagatgcaaaagaagtacttggaccaaatcgacgaattgtacgaagatttccatgtcgttaaaatgccattatgtgctggagaaatcagaggcttaaataacttaacaaagttctcacagttcctaaacaaagaatataaccctattactgatggcaaagtcatttatgagttagaagataaggaatag

SEQ ID NO: 2440 - DNA, 1065 bp, Saccharomyces cerevisiae
atggggtttctttcggatcatccgcatacagctatcaccgagacgatctttcgaattgtctcttcaagggactatacgctagaagtggagttagctcccttgattcagcttatcaaagcagatcacaacgattataactataccgtgaaccaagaagaagctgcgcgagcacttagaaagaaaataaagtatgggaaccggctgcagcagtccaggactctggacctcttggatctgttcatctcacaaggcgtgaagtttacagtcatgtacaatgatgacaagctgctgcaaaggctgagagggatggctacgaactctgaaaacagcgggtccggtgaaaagtatgagcctaggattattaagaagtgcgcggcgtatgctatctcgtggctaaactatattacgcagaacaaccttgagaatgcgagggcgtattcaggtctttatcaattgggtcaaacagtcaaacagaggtactcgaagagcagccgttcccgccgtagcggcggaggctctggcggacggtctaacttcatggatgatagcgccgacgacactttgtaccagtccaactcgctgactagtgccgatagattgtataggattccacagatcaacatgaacaaagaggcacccaggattcggctcataatcagcgatgctctcgcgtctgctgtgtcgttacagaactcgctgatcgggctgcccaagggcaagttctccacagacgatgaagaggccacgtccaagttcatccaggcaagggcgatcagaaggaaagttcttagatatctgcaattggtcacggagggtgagtttctgggtagcttaattcatgccaatgatgaactggtggctgcgttgactgcatacgacgaccgaagcgctcaggacgatagcagcgatgaaagtgatcacggctcgtacgatgacggtatttatgatgaaaacgagcaggataacagcaggtatattgatagcgagtcctcagaggaagagagcttgtcttcttatcagccgtccacgatctcaaaccctttcggtgatcataacaaaatttga

SEQ ID NO: 2441 - DNA, 1065 bp, Saccharomyces cerevisiae
atggtacccgctgctgaaaacctatctccgatacctgcctctattgatacgaacgacattcctttaattgctaacgatttaaaattactggaaacgcaagcaaaattgataaatattctgcaaggtgttcctttctacttgccagtaaatttaaccaaaattgaaagtctgttagaaaccttgactatgggcgtgagtaatacagtagacttatattttcatgacaacgaagtcagaaaagaatggaaagacactttaaattttatcaataccattgtttatacaaattttttcctttttgttcaaaacgaatcctctttgtccatggcagttcaacattcttctaacaacaataagacctcgaactctgaaagatgtgcaaaggatctgatgaaaattatttctaatatgcacattttttactcaataacatttaattttatcttccccataaagtcgataaagtcattttcaagcggcaataatcgctttcattctaatggtaaagaatttttattcgcaaatcattttattgaaatcttacagaattttatagcaatcacatttgctattttccaacgttgtgaagtaatattatatgacgaattttacaaaaatctttcaaatgaggagattaatgttcaattgctattgattcatgacaagattttggaaattttaaaaaaaatagaaattatcgtatcctttttacgagatgaaatgaatagcaacggaagtttcaaatctattaaaggtttcaacaaggttttgaatctgattaaatatatgctgagatttagcaagaaaaaacaaaattttgcgagaaactctgataacaataatgttacagattatagtcagtcggcgaagaacaaaaatgttctcttgaaattccccgttagtgaactgaacagaatctatttaaaatttaaggagatttcagattttttaatggaaagagaagttgtccaaaggagtataattattgacaaggatttggaatctgataatctgggtattactacggcaaacttcaacgatttctatgatgcattttataattag

SEQ ID NO: 2442 - DNA, 1065 bp, Saccharomyces cerevisiae
atggtaccgaaccttcgttttaatatcacgatgattgtcatttggggtatactactgacaatacatgtcgtacagttactgatgcgccaatactggttttcaatcgcttttatatgcacaggtattttggaagttcttggatttatagggaggacgtggtcgcattctaatgtcgccgatatggacgcttttcttttgaacatgatttgtttgactattgcaccagttttcacaatgggtggtatttattatcaacttgcaaagcttatagaagtatacggccacaggttctctttattgccctctccaatggcgtattcttttattttcatatgttccgatatcgtatcgcttgtggtgcaagctgtaggcggtggcctgtgtggtgtggcggtcacagatggaacgtccacaacaaccggcaatcatgttttcattgctggtttggccattcaagttgcatcgatggccatctttcttatgttatggtttcacttccttttccgtatatatatatcggtaagatgggaacacataaattctagacctatctcattgagcctcttaaagatatcgcaaacagaagttgattatttatacagggaaaagttccattttttgagactcgaacctaaacgttgggtttttcattattttaatctggcaataaccgttgcggtactaaccatttttacccgttgttgttaccgtttggctgaattagttgtcggttgggatggctatctgatcacacacgagtggtattttattatcttagatgcattaatgatggccatcgctacggtcactttgaccatcttccaccctggatttgcgtttaaaggtagaagcacctcgattccaatcacaccgggccatgttgatcctgaaactttaccacatactgacgatgttgaagatatcttagatacttcggattcaaaacaatttgatattgaaaaggaggaattccaagcaagcatgaaatacccgattagcaccttcaaacaattcatgtccaaaatagctaacttgttttcctctaaaaagaaggctaaactttag

SEQ ID NO: 2443 - DNA, 1065 bp, Saccharomyces cerevisiae
atgtcattgtgggtagataaatacagacctaagtccttgaatgctctttcacataatgaagagttgacaaattttctaaaatcgttatctgatcagcctcgtgatttacctcatcttttactgtatggaccaaatggtacaggtaagaaaacgcgttgtatggcattattggagtccatatttggacctggagtctatagattgaaaattgatgtcagacaatttgtcactgcttcgaacagaaaactagaactgaatgtggtcagctcgccataccatttagagatcacgccaagtgatatgggtaacaatgatagaattgtcatccaagaactattgaaagaagtggctcaaatggaacaagtggactttcaagattctaaggatggacttgcccatagatataagtgtgttattatcaacgaggcgaactcgttaacaaaagatgctcaagctgctttaagacgtaccatggaaaaatactccaaaaacattaggttgataatggtctgcgattcgatgtcgcctataattgctcctatcaaatcccgttgtctgttgattcgttgtcctgcaccaagcgatagcgaaatttcaactatcttgtctgatgtggtgacaaatgaaagaatacaactagaaacaaaggatattttaaaaagaattgctcaggcatcgaatggaaacttgcgagtctccctattaatgcttgaatctatggcactgaacaacgaattagcattgaaaagcagtagccctataataaaaccagattggattatagtgatccataaattaacgaggaaaatcgttaaagagagatctgtcaattctttaatcgaatgcagagctgtcctatacgatttactagctcattgtatacctgccaatatcatcttaaaggaactaacgttttctttgttggatgtggaaaccctgaataccacgaataaatcgtccataattgaatactcaagtgtttttgacgaaagattatcacttggaaacaaagcaatattccatttggaagggttcatagcaaaagttatgtgctgtctagattaa

SEQ ID NO: 2444 - DNA, 1068 bp, Saccharomyces cerevisiae
atgaatactgtaccatttacatctgctccgattgaggtaactatagggatcgatcagtattcctttaatgtcaaggagaatcagccatttcacggaatcaaggacatccccattggacacgttcatgtcattcattttcagcatgcagataattccagcatgaggtatggctactggtttgactgtagaatgggaaacttttacattcagtatgatcctaaagatggcctttacaaaatgatggaagaaagggatggcgcaaaattcgagaatattgttcacaacttcaaggaacggcagatgatggtttcttatccgaaaattgacgaagatgatacctggtacaatcttaccgagtttgtgcagatggataaaatccgaaagatagtaaggaaagatgaaaaccagttctcttacgtagattcttcgatgaccacagttcaagaaaatgagctgctaaaatccagcttgcaaaaagcaggttctaaaatggaagccaagaatgaagatgatcctgcacattctttaaactatacagtaataaacttcaaatctagagaagccataaggcctggccatgaaatggaggattttttagacaagtcttactacttgaacactgtaatgctacaaggaatttttaaaaattcaagtaattattttggggagttgcagtttgcgttcttaaatgccatgttttttggtaactacgggtcgagtttgcaatggcatgctatgatcgaactgatatgttcaagcgctacggtgcctaaacatatgctcgataaattagacgaaatcttatattatcagataaagacattgcctgaacaatactcagacatcttgttgaatgaacgagtttggaatatttgtctgtattcgtcatttcaaaaaaactccctacacaacacagaaaagataatggaaaacaaatatccagaattgcttggtaaagacaatgaagacgacgctcttatttacggtatcagtgatgaagaaagggatgacgaggatgatgagcacaaccctaccattgttggcggtctctattaccaaaggccataa

SEQ ID NO: 2445 - DNA, 1068 bp, Saccharomyces cerevisiae
atgactgccagcacatcagttgcggtgggttgtgcggtgggtatacccgtcggtgtaggtattataatagcagtatgtttctggtttaacctacaaaaaagatacaagagggaggaacaagacgatagagaattggaaagggctatttatgatgaaagtggtttcgtgtcctttgacaattttggacccttaagagacagtaaagatgaagcagcactagccagctccgagctaaaaaatcctgatcacacttctggttcatcggaaggatctgctcatccagaagaaaaagatggaaaatcgcgagatcaagagaaaccgttagggaaaaagaatagtaaatactatgtgccagcataccgtaggaaaataaatttacttcaagtacgaaataataactacggcaataatgccaggcagaagtccgttgtggatttaccaagtataaataacagctccaatgtttccttatcatcttcccaacggcatataacaaagagacagatcagcgtttatgatcagatggtccctgttatttctgatgaaggaccaaactttttcgcagatccttccagtgatactaatactagcaatgaccaaaacaaagcttcgatgatagaacttaaacataatactcgccaatctagtaatgaaaatctgataagaaatttgcagaatcaggactttggttcgtattacccaaggagagcttcatcctcgtttttaaatggtaacatttcaaacgcgtccttccatacaaggaattcctctataacatcggtaaataagcgcgatgccctagaggatgtgtttgcaacacccaaaagtgcggctcaatcacagttaccaaacacttttgataaagataacgaaggaatggatgctgaccactcggtaaaggatagcaggtctgcaataacagataaagataaggatttatacaaattacagaataactatgatgtgggcaatatcggggaaattgctgaggaagatcaatacgaaaacgaatttaccaactactcacagagtaagagagagttcatagaaagtctaaggcctaaatag

SEQ ID NO: 2446 - DNA, 1068 bp, Saccharomyces cerevisiae
atggatacggtaaacaattatagggttttagagcataaagctgctggccacgacggtactctaacagacggtgatggattgctcatctttaaaccggcctttccgcaggaactggaattctacaaagccatacaagtgagagatgtgagtcgaagaaagtcttcggctgatggagatgctcccttgtgctcttggatgcccacgtatcttggagtcttgaatgaaggggcaaaaatcgagcaaagtggcgatgctgcgcttctgaagatagatgagcggttaagtgattccactgataatcttgattcaatacctgtaaagtctgagaagtccaagcaatacctcgttttagaaaatctactatatggatttagtaaacctaatatacttgatataaaattaggcaaaactttgtatgattcgaaggcatcattggaaaaaagagagagaatgaaaagagtcagtgagacgacgacttcaggatctttgggtttcaggatatgtggcatgaaaatacagaaaaatccctctgtgctgaatcagctttcgctcgaatattacgaagaagaagcagacagtgattatatctttataaacaaattgtatggtcgttcaagaaccgatcaaaatgtttcagatgcaattgaactttattttaacaatcctcatctgtcggatgcgagaaagcatcaactgaagaaaacatttttgaaaagattgcagttgttttataatactatgctagaagaagaagttagaatgatatcaagtagtcttttgtttatttacgaaggagacccggagcgatgggaattactaaatgatgttgacaaacttatgcgagatgattttatagacgatgatgacgacgatgatgataatgatgatgatgatgatgatgatgccgagggaagcagcgaaggaccaaaggacaaaaaaacaactggttctttgagttccatgtcactaatagattttgcacattctgaaataacgccggggaagggttatgatgaaaacgtgattgaaggagttgaaaccttgctagatatttttatgaaattctag

SEQ ID NO: 2447 - DNA, 1068 bp, Saccharomyces cerevisiae
atggtactttgcaaattactgacaccatatttcttactgtcaattttgagtgtcggcgtgttcacggcgaccgccgcgccatcgcccagtattcaaatgacggaaaatacaaatcaagatcatcatgagcatgccaagcgtggaggaacgtgtgcgttccctaactacgatgggatggtcgcagtacaaaaaggtggatctaatggaggatgggctatgagccctgaccaagaatgttcctacggttcatggtgcccttacgcttgcaaaccaggtcaactaatggggcaatgggacccttcggctaccacatactcttatcctaaatgtcaaaatggaggtttgtactgtgattctaacggtaacttgcaaaagccaaacagtgataaagactattgttatgatgggaagggaaccgtaatagcgaaaaacaacgctaacagcggtgacgttgcattttgccagaccgtgcttccgggcaacgaagctatgctgatcccaaccttagtcggctctgggtcaaagcaaacgctggctgtgcctggtacagactactgggcctccagcgcgtcgcattactacgtaaatgctcccggtgtaagcgtagaggatgcatgccagtggggtagtagtgcaaatccacaggggaactgggccccatttgtagctggttccaacatggacgacaaccagaacacttttgtaaagattggatggaaccccgtctacctggaatcgtcatgtccgttcaagaacgttaagccttcattcggtattagaattacttgtgatgacgaatcacaatgtgaaggcctaccatgctccattgacccaagttctaatggagtcaacgaagtgacaagttctggcggtggttcttccggggctggtggtggaaacttttgtgttgtcaccgccagaaacggcgccaaggccaacatcgaagtttttgatgttggtagcggctcatcttctaaaggcaagagagaactgaatccgctagacgttattaccacaacggtcaccgagaccaagtacaagacagtcaccgtcactgccaaaacttag

SEQ ID NO: 2448 - DNA, 1068 bp, Saccharomyces cerevisiae
atgtctactggaagcagtgatagaaaggatgacgtcaaattattggaactgctgaattctatagatgaacagtttttagtgccatacaaaaagccggaagacttgcgtaaaatctcctctactaccaaactacaaggttccaccccaactaaggaactagacaaattagcctctgtattgaaggcacattgcacaaaaataggtattgtttgcaagccaggaacttttgataacaatcataaagttgtgattaccgaaatccaaaattttagtaggccattattctacttactaagtttattccctttgttttacaataacaaggattgccccaaatactttacagaccaactggatgaaagtacgctacaattgctcgatggcttgagagatttcattgccgaattacaagaaagattgaaaaatgacgaaaatgcatctctagacaaagaaaggttaacctcagttggtaaaatattcaatgcgtgcgattctctctctaattgttccaaggctggaccttatgggatcctagcaaacatcttaaaagataatgtggccataatggacgatacaatgaatgaaataaaagagtggcttgaggaacccgatttttcagcaaactcggacgatatatttttggattttgaggattcagaatccgaatctgattcacagaaagaggaatttgaccaggaaaaggtctatgaaaatataaagttgtttttcgatgggtttacgaggaagataaagctaatcaaattacttgtatcaactttcaggaaaactctggtgtcaaaagattttactcctaagaggaatcaagcagaaactttagacagtatacatacatatctgaaggaaatacagttacttttggatgaagtggtatccactgtacaatttgagccgaagaactttaccaatgaggaggtaaaagaagaacaggctgcattagttgcagtaactaaaaaagttcttatccaaatgagtaaactatatgaaggtgatccaaaaagaaagaaatggattgacacatgggagataaaattcaatgaattgttttag

SEQ ID NO: 2449 - DNA, 1071 bp, Saccharomyces cerevisiae
atgactgacttaactacacaagaagctattgttctagagcgacctggtaaaatcaccctaactaatgtcagcatcccaaagatttcagatcctaacgaagtaatcatccagatcaaggcgacaggaatatgcgggtcagatatccattactatacccatggaagaatagccaattacgtggtagaatcaccaatggtgctgggacatgaatcatcaggaatagtggccctcataggtgagaacgtcaagacacttaaagtaggagatagggtggcacttgagcccggaatacctgacaggttttcaccggagatgaaagagggcagatacaacctggaccccaatttaaaatttgctgcgacacctccctttgatgggaccttgacaaagtattataagaccatgaaagatttcgtctataaacttcctgatgatgtgtcattcgaggaaggagcactaatagagccattatcagtggcaatccatgctaataaattagcaaagatcaagtttggagcccgttgcgtcgtctttggagctgggcccataggtttgctagccgggaaagtagccagtgtctttggtgctgcagatgttgtttttgtagatctattagaaaacaagctggaaacggctaggcagtttggtgccacccacatcgtcaactcaggtgatctcccacatggcgttactgtagatagtgttataaaaaaagcaatcggcaagaaaggtgctgacgttgtgtttgaatgttctggtgcagagccttgcgttcgagcaggcatcgaagtctgtaaggcaggtggaacgatcgttcaagttggaatgggacaagaggaaatacaatttcccatctcgatcattccaacaaaagaactgacattccaaggctgtttccgatactgtcaaggtgattatagtgactccatcgagctagtctctagcagaaaactctcgcttaaaccattcattacacatcgctatagctttaaggatgctgtcgaggcattcgaagaaacaagccaccacccgttaaataatatcaagacgatcattgagggcccggaatga

SEQ ID NO: 2450 - DNA, 1071 bp, Saccharomyces cerevisiae
atggtatgtgcacttcaaatgttcgttacattatgaattcttttttttactgactaccaagcaattttttatatttgccacattaaacagcatggcattaaaaggaaacagtggaccaaggaattactgagacaaaagagagttcaagacgaaaagaaaatatatgattatagaagcttgactgaaaatgttttgaatatgagagatgaaaaaatttactcaattgaagctctgaagaaaacatcagaacttcttgagaaaaatccggaatttaatgctatttggaattacagaagggatattatagcgagtttggcttctgagttggaaatacctttctgggataaagagttagtttttgtaatgatgctattgaaggattaccccaaagtctattggatatggaatcacagactttgggtcttgaaacattatcctacgagttcccctaaagtgtggcaaactgaacttgctgtcgtgaataagttattggaacaagatgcaagaaattaccacggatggcattaccgcagaatagttgttggtaacatagagagtatcactaataaaagtcttgacaaggaggagtttgaatacacaacaataaagattaacaataacatttcaaattattctgcatggcaccaaagagtacagatcataagcagaatgtttcagaaaggagaggttgggaatcaaaaggagtatattcggactgaaatatcttatatcatcaacgctatgtttaccgacgccgaagaccaatccgtatggttttatatcaagtggttcattaaaaacgacattgtttgtaaaactctggacgaacaagagtaccttaaaatgttgaaagacttgagagaaaacattctgttaataaataatgacgaaattgaattttccgggaagcaaaatatttggtgcttgaaaattttattagttctcgaagatattctggaagaaaaggaagctctaacggaaagaagctcggaacaatatttggtccaattaatagatgcggatccgttaagaaagaatagatacctacatctcctggagcagcataagtga

SEQ ID NO: 2451 - DNA, 1071 bp, Saccharomyces cerevisiae
atggttacagtatgttgttgcttttatttactttttctttttttgacattcattgtgacaatattcacattcttcagatagttctgtctatatgaagcaaaaatgatatatcaataagtttactaacaaacacaagtggtattactatgacttcactttaaatagcaacaagaaaaggaatttttagaatcctaccctcaaaactgtcctccagatgccttgcctggtactccaggaaatttagacagcgctcaagagaaggcattggcagaactaagaaaacttttggaagacgctggtttcattgaacgtttagacgattcaactttactacgttttttgagagccagaaaatttgatgttcaattggctaaagaaatgtttgaaaactgcgaaaaatggaggaaggattatggtaccgacactatcttgcaagattttcattatgatgaaaaaccattgattgccaaattctacccacaatattatcataaaaccgataaagatggccgcccagtatattttgaagaattaggtgctgttaacttacatgaaatgaacaaggttacctctgaagagaggatgttgaaaaacttggtttgggaatacgaatctgtcgttcaatacagattacctgcctgttcaagagctgctggtcacctagtggaaacttcatgtacaattatggatttgaaaggtatctccatatctagtgcatacagtgttatgtcatatgttagggaagcctcctacataagtcaaaactattaccccgaacgtatgggtaaattttacatcatcaacgcgccattcggtttctctaccgcatttaggctatttaaacctttcttggatccagtcactgtttcaaagatttttatcttgggttcttcttaccagaaggaattattaaagcaaattccagctgaaaacttaccagtcaaatttggcggtaagtctgaagttgatgaatccaagggtgggttatacctatccgatatcggtccatggagggatccaaagtatattggaccggaaggtgaagctccggaagccttttcgatgaaatga

SEQ ID NO: 2452 - DNA, 1071 bp, Saccharomyces cerevisiae
atgtcagtatcttacaagggaacaatttctaagacacattctgtttttaaaccagaaaaaggaaggtattatatttacggggcccttgggtgtccattcactcatagagccattcttgccaggtctttgaagaaattagaacctgttctagggcttgtgttatctcactggcaattagactccaagggtgcccgtttcttacctgctccacaccggccggaaaaatataaagagagattctttactgccactggtggcattgcttcagctaaattagacgaatctgaggagttaggtgatgtgaacaatgactctgcaaggttgttcgtggatggcgctttcgacccggtggaaaatatatcaaggttaagcgagttgtactacttaaatgatcctaagtaccccggtacaaagttcactgtgcctgttctgtgggattctaaaacaaggaaaattgttaacaatgagagtggcgatatcataagaattttgaacagtggcgtgtttgatgaatttatccaaagcgaagaaacgaacgtgattgatctagttccgcatgatttaatagacgagattgataagaacatcaaatgggttcatccgaagattaatcttggtgtctataaagtcggattagcagaaaacggaaagatttacgaaactgaagtaaaaacactgtttgaaaacttgcagaagatggaatgtgtactaaaagaaaattataagcgcttagaggagcaattcagtggtaacaaacagaaaatcttggctaaatattttgttttaggacagaggttaactgaagcggatatcagattgtatccatcaataattagatttgacgtcgtgtacgtgcagcacttcaaatgcaatttgaaaactataagggatggtttcccgtaccttcatttgtggttgattaatctatactggaattacgcagagtttagatttactacagattttaatcatattaagctcttttacatcaggatggaagtaagtaggaacaagatcaatcagtttggtatagtgccattaggcccaaagcctgacatttctagattatga

SEQ ID NO: 2453 - DNA, 1071 bp, Saccharomyces cerevisiae
atgtccaaaagaaacactccaccgctcagatcatcagggataaacactattcaaataaatgctgctagagaaatgcacgctcaaacggtgcgcgctcgaagaatgcccatgccaactagcggcatcactacaccctctgtgcaaccaactgcagccccagcaacaccacctcgacatatttgcaataacccaaacaatccgcagtgtctccactgtgggtctgttatcattccatctccaagggccacgttacccttggaggacaacccctccatctccatcaacgactggaccatctcctccagaaagaagcccattttgaactcgcaggaattagacatctgggaaaacgaaaaactcaaaggtttgactttgccagagatgatttttggtaacaactacatcaggatcgaaaattcaaaacagcattggtccatagagttcaatgccctggatgctttaaaggaggttcaactccaggattcaggtattcgtgttgcgtactcaaacgactggataaattctaaaaaaagacaaaattcaactaatggtgcgcaacggttcactaacgatgtgaacgacgattccttaaatatcatacacaagtacgactggacctacactacgcggtataagggcacagagagctcacctgagtcgaaattccgactggataacgatcaaaagctgccccttgacaaactggccgtacacgataaaatcctattctatgacgacatgattcttttcgaagacgaattggcagacaatggcatatcaatccttaacgtcaaaataagagttatgaacgaaaggttactgctgctgagccggttctttttaagggtggacgatgttctggtgagggtctacgacaccaggatttacgtggagtttgacgaaaacgtagtgatcagagaatccaaggaatttgaaggtaaatatcaggatgtacttgctaagcaccggctatcccaatctcacgacccaaaagctgccttgagagatagtaattgggtagcacagaacacgccgatgatcaaaagacaatgtgaaataattcagttctaa

SEQ ID NO: 2454 - DNA, 1071 bp, Saccharomyces cerevisiae
atgtctagaatactagttatcggggcaggtggcgttggggtcattactgcgctttcgttgtggcttaagaaggagagcgacgtttccttggtagtcagatctgactacgatagggtattgaagcatggctacacaatcgaatcatgtgactatggccggttagaaggttggagaccccaccatatttacagcagcgtcgaggacgctgcttctgccgcagacaaccaaggatacaactatattgtagtgactaccaagaacatcatagatgggcccgttaattcaagggtgtccaacatcatcagacctgtgcttgagaagaataaagagctacatgggccgcaattgacgacacacattttactggtacagaacggaatcgatattgagaaggagatatgggcggaatttcccagagagcagtatcgttacacggtgctttctggcatccagttaatcggatccactaagatcgggtcaggccatatcagtcaagtgggccaggaccacttatcgtgtggagcttttgatccacaggacgctgctgctatccaggctgccaacgacttcgtcaggatgtacagcaacgaggggcaaaactttgtcgaatttgaccctagggtccgttactctcggtggaagaagttgctctacaatgcagctatcaacacatccacggcacttgtggggctagacgttccgcgttgcctggagtttggggttaacaagaagagcacagaaattgaagtgttccaccctgccatgagggagatcatcgccattgcggcgagtgaaggcatcattatcgaagaggagttcataacgatgtttacagagattaccaggaaaaaggtgttcaagccatccatgtgcgtggactgcgagaagggccaattgatggagctagaagtcatcctaggcaaccccataagaatcgcgaaaagaaacggcgtcgctacacccactctttctatcttatacaacctacttgtgctagtacaggccaaactaaaggagcggaaaggcctattgaagttcgacgaaaaaactgccactcttgtggacgagtag

SEQ ID NO: 2455 - DNA, 1071 bp, Saccharomyces cerevisiae
atgttaaaagttcctttgagtgatgttctttcacagaagatgctgtttttaaaaagttttagatattttcattgcacaaaatacttcagcagagacaatgcatcatctaccacagatatatttcgcaacgcaatgaaacgtaaacgtgagctggcaaatcttaaagagcaaagtcatggaaatgtggcaagaaatgctgcttttcctaaagagtatattaagcgcccgaaacaagtgccaaggaatgctactaacaggaaaaaaatcctgattacttggagcaccgggacagatcgagctaaagaggcagctaattcagttgttagtgagatattcaaaaaaaatcacaagggaaacatcaaagttgtggatcccactacccaccgaattgaagcatccaatattcggtattttgccaagggcattgatctcgataaagttggactcagtattgttaatgtagagcaaatcgataatgaaaatcaaattccacttgttaagatagtcgaaagtcgtgtagccttaaaaaaatattcagactttctggctaaaaaaaaggaaaaggaactgatggaattgggagtactgaataagtcttacaagaatttggtgactgataaaaaagaagataacttgaagcatattaaaatatcatggcagattgaaagcgatgatttaaaaaggcagaaggctcacgaaatagtttcgctattgaaaaaagggaataaagtaacgttatatcttgatgacaagaataacataaattcaaacaattggcttgaaaattttgaggagctggaccgctctcaaaaaggtgaaccacccaggctaccagaatcagttttccagaaaagagctgctgtcttggagacattgaaagagatagttagcgaatatgctaatgatcctgttctgctaggtaacatgaactcgaaaatgataatgaaacttataccaaaggacgttaaaccacaaaacaacgataagagggcgttaaaggaattgagaaagaaggagaggcaagaaaaattgcaaaaaaggattcagagaaaaaaaatgaatgaaatgtaa

SEQ ID NO: 2456 - DNA, 1074 bp, Saccharomyces cerevisiae
atgtctcaaaatagtaaccctgcagtagttctagagaaagtcggcgatattgccatcgagcaaagaccaatccctaccattaaggacccccattatgtcaagttagctattaaagccactggtatctgcggctctgatattcattattatagaagcggtggtattggtaagtacatattgaaggcgccaatggttttaggtcatgaatcaagcggacaggttgtggaagttggtgatgccgtcacaagggtcaaagttggtgaccgtgttgctattgaacctggtgttcctagccgttactctgatgagaccaaagaagggaggtataacctttgcccacatatggcatttgctgcaactcctccaattgatggtactcttgtgaagtactatttatctccagaagatttccttgtgaaattgccagaaggcgtcagttatgaagagggcgcttgtgtcgaacccttatcagtcggtgtacactctaataaattggctggggtccgctttggtaccaaagttgttgtatttggtgcaggtcctgtggggcttttaactggcgcagtcgcccgcgcttttggtgccaccgacgtcattttcgtcgatgtattcgacaacaagctacagagagcaaaagatttcggagccacaaacactttcaattcttcccagttttccaccgataaagcccaagacttggccgatggggtccaaaagcttttgggcggaaatcacgcagatgtggtgtttgagtgttcaggtgctgatgtttgcattgatgccgctgtcaaaacaactaaggttggaggtaccatggtgcaagtcggtatgggtaaaaactacactaattttccaattgctgaagttagtggaaaggaaatgaaattgattggatgtttccgttattcattcggtgattatcgtgacgctgtgaacttggttgccacaggaaaagtcaatgtcaagccattgataacccacaaatttaaatttgaagatgcagccaaggcttacgactacaacattgcccatggtggagaggtagtcaagactattatctttggtcctgaatga

SEQ ID NO: 2457 - DNA, 1074 bp, Saccharomyces cerevisiae
atgacgcgagatagcccagattctaacgacagctataagcatataaacaagaatactacacaaaaaacctcgtttgatagaaattcattcgattatattgtacgatcgggattagctggaggtatatcaggttcatgtgcgaaaacactaatcgcacccttagatagaataaaaattttatttcaaacatcaaatccgcactacacaaagtacacaggctcactaataggattagtagaggcagccaagcatatatggatcaatgatggggtaagggggttttttcaaggccattcagcaacccttttaaggatttttccatatgctgctgtcaaatttgttgcttatgaacagattaggaataccttgattccctcaaaagaatttgagtcacattggagaaggttggtgagtggttcactggcaggattatgcagtgttttcataacatatccgttagatctcgtgagggttaggttagcatatgaaacagaacataagagagtaaagctaggaagaataatcaagaaaatatataaggaaccagcttcagccacgctaatcaaaaatgattatattcctaactggttttgtcattggtgtaatttttataggggttatgttccaactgtacttggcatgataccatatgcaggtgtttccttttttgctcacgatttacttcatgatgtgctgaagagtcctttctttgccccttattcagtattagaactttcagaagatgatgaattggaaagagtacagaaaaagcagagaaggcctttgcgtacgtgggctgaattgatctctggtggtctagctggtatggcctcccaaacggcagcatatccatttgaaattattaggagaaggctccaagtaagtgcactgtcaccaaaaactatgtatgatcataaatttcaatcgatatctgaaattgctcacataatatttaaagaacgtggagtacgtggattttttgttggtctaagcataggttatattaaagtaacacctatggttgcatgtagttttttcgtctatgaaagaatgaaatggaattttggcatttaa

SEQ ID NO: 2458 - DNA, 1074 bp, Saccharomyces cerevisiae
atgagcccaagtccatcagtgtcgccaagaaggacgctcaataacaaatcatcttacatcaataacagcggtgggctggtcctgcctcctacgcagtttaatttgaatcagcagccagtcctgagcttccaacaaaaagcgactttcgattccaaccagcagtttttctattatccagagtcacccacaaaaaacctgagaccaaggtttaacagtatttcgcaggttaataaaggagttaatgaagaccattataccgggggcggtagcagtaataataacaggccatctagatatacaaataccatgggcgctgcaaacaccaatgtaaattcccatccgcatcatcagtcggtgtcgcatttaaattctaaatctcttaaattcaatcaaacgaaggaagtgagcagcataaatgaaattatttttccttccagaacgtgtacaaagaaacggtattttaccaagccaattgatttgtatggtacaagaagtagcactagtgtggcacctaagttgacgaattctcccacgaaatcaaaaacaaatttcaacatcaagaagtgcatcttacctaggtccgtcgttaccacatataaattaccatctccagtgcacgaaacgatagacgatatatccaaaaaaatcataatcctgctaatttcgttgaagtttgagaaaaactatcacttcttgcaacctattcaattgtccacaaatagtaagacacggatctcaaaatcactagacgaattatgcggagtgcagctgacatcaacgttacggcaacaaaagcagctgcaaggtaacagcaagcccgtaaagaatctccctaattccaatgcgaagcagagagccggggccagtgtttccacaaatgccaacgaaagctttgaattgagttttgatggaaaggcaatggatagatctgatatatttcgaatggtagattcttttagcatcgccatttcagatgaagatgaggaagatgaggaggaggatagctttcagcagagaagtgcgaacaacagaatcctccctgcggagatactaagtaatgaacctttgaaatga

SEQ ID NO: 2459 - DNA, 1074 bp, Saccharomyces cerevisiae
atgaggttagctgtggttgtgaccctacttgttcactgtttcctagtgacatgctctccaggagataatttagatgagtttatagactgtacgtatgcgtgcgagtataacagaagatgtccgaattcccaaataaactacattgaccctgaaaccaacatgtttcatgatattgagtttttcgataccccgcctttgtactctaagttattgttctgggattgtatctcagattgtgattaccaatgtcagcacatcattacgcgctggagaattgacgaagaggaagaaatataccaattccatgggaaatggccatttttgagagtattggggactcaggaattcttctcgacgatattcagtataggtaactttattccacattataagggatttgtaaagttttctagaatcatacgcgaagagggagataggaggagaaaaaacagcagaagtatactgatttggaactacctttacgttactgtggcgggaatgttggcttggacagcaagctcggtctttcactgtcgtgatttgatcataacggagaagctagattactttttcgcaggtttaactgtcctaacagggtttcatgcaatatttgcaagaatgacttccatgttcctgtaccccaagatagcacaagcgttcactgcgtcagttgcggcaatctttgccctgcacatcttgagactctatgttgactggtcgtacacatacaacatgagattcaacatttttttcggtgttttacagtatattttattgataatgttatcatgccaaaactaccatgctctgcaaaagcaaaagctaatgggcgaattcaagaaaaccgcgtactccagcttcaagcggcaaatcttcaaactgtgtgtcattccaattcttcttgtgattgtaaccacaatggccatgtcattggaactgtttgacttttttagttacgaatggcagattgatgcccatgcgctatggcatctgtgcacaatatggccctcgtgggtattgtacgactttttcctcgaggattatgcctattggggtaatagacaattgtactaa

SEQ ID NO: 2460 - DNA, 1074 bp, Saccharomyces cerevisiae
atggaaaagaaggtaatatgtcaagatatcttttggtcatgtgatggtacatcgtttgtttctgtgcataatgattttggcatcagacaatatttagtgccggaggaaagtaatacggacaagctaaacagaaacctccttctaccatttacaaggttttttagaaaccagtctattgtttcatgtgcaatagacccgttttacacgctttataacgagaattccgacaggttagctggtgacagaatcgtggttggaggaaaaaacttccctctacaactatactctttgatggacgggcagtgtatcctcagctatgacacgatgaacaaaataaatggagaatacgaaactgtatacagtgtgaaaatcgatgttgagtctcgtgtatacactggctcatgccgtaacaaagtggcgatatacgacaagagcagacgagatgccgtgtggatgaaccagagtaccaaaaaagcaagcaagggaagacaaagcattatatcttgctttgaagagcaaccaatgggagggcaagctctctcaagaggatctctattgtgtggcagttatgcgaatgaaatgtttcaggtagactgccgtcatcaacgactagagagactgaactacacccgcacagttgcaggtgggattgtacaaatccttacaagcgataacgggcgttacgtgtacgttgtcagacgcaacagtgacgcgattagtatttacgatcggcgaaacctgcagcacgagcttaacgtattgcgcctaccgtttcggatccaccacaactctgcaaagttgaaggcatatatagatacggcttacggactaagtatggggacgccgcagggaacaatattgaactggggtcgagaccttgtggaatttggaggtgttccctcacacaatagtgttgaagacccactaatcacgtctatcccgccagagtcagagtggcgcactaaccttgattctactattcctgccacggtagtgaagaattgtcctggggatcccgaactgttcgccctatctcatgggggcacaatttcattatgcaggttcggcggctaa

SEQ ID NO: 2461 - DNA, 1074 bp, Saccharomyces cerevisiae
atggcattggaaagagaattattggttgcaactcaagctgtacgaaaggcgtctttattgactaagagaattcaatctgaagtgatttctcacaaggactccactactattaccaagaatgataattctccagtaaccacaggtgattatgctgcacaaacgatcatcataaatgctatcaagagcaattttcctgatgataaggtagttggtgaagaatcctcatcaggattgagcgacgcattcgtctcaggaattttaaacgaaataaaagccaatgacgaagtttataacaagaattataaaaaggatgattttctgtttacaaacgatcagtttccgctaaaatctttggaggacgtcaggcaaatcatcgatttcggcaattacgaaggtggtagaaaaggaagattttggtgtttggatcctattgacggaaccaaggggtttttaagaggtgaacagtttgcagtatgtctggccttaattgtggacggtgttgttcagcttggttgtattggatgccccaacttagttttaagttcttatggggcccaagatttgaaaggccatgagtcatttggttatatctttcgtgctgttagaggtttaggtgccttctattctccatcttcagatgcagagtcatggaccaaaatccacgttagacacttaaaagacactaaagacatgattactttagagggagttgaaaagggacactcctctcatgatgaacaaactgctatcaaaaacaaactaaatatatccaaatctttgcacttggattctcaagccaagtactgtttgttagcattgggcttagcagacgtatatttacgtctgcctatcaaactttcttaccaagaaaagatctgggaccatgctgcaggcaacgttattgtccatgaagctggaggtatccatacagatgccatggaagatgttcctctagacttcggtaacggtagaacgctagctacgaagggagttatagcgtcaagtggcccacgcgagttacatgacttggtggtgtctacatcatgcgatgtcattcagtcaagaaacgcctaa

SEQ ID NO: 2462 - DNA, 1074 bp, Saccharomyces cerevisiae
atgggcgatcataatctgccggattttcagacatgtttgaagttttctgttacagctaaaaagagctttctatgtatgtatagagacagcgtctcaaaggaaaaattagcctcttcgatgccaagtacttgtgatatacaactgaagagggcaatcaatgacgcttatccgggcggaggaataaaggtcacggttctgaactcaacaactgcaagcttggactcgttagcaactacacatgttaaggaatttgagattgttatcattccagacataaattctcttttacagccagaccaagcgaaattagtaaaaattatgagagattgcacagtggcgattgagaaggcacagtcaacacgtatatttataggagtggttcattggaataatcccgtgcagccttcaggcgccgctaaggatggggatgaagcaggtaaaccagctcccaaaactcgcatcttcctgcccacgtctttccgtatgggcgcttggctcaaacacaaattctggtttgcatgtgcacccccatatttggattttgaaagttcaactgagtctagcattaatacaagagccaataatagcattggtatggctgaggaagagaagcaggagccagagagcaagaggtcgatcatattaaatgaagaggcaaatctgaacgatgtatttgtggggtccactgtaagacggtatattctcgatatcatggtccatttgcgaacgcatagattgacgtataacgccaaagccggcggggtatatacaaattcattggacgacgtggtgttattgtctagattaattggtctacatagcggcaagatgtttgtgtcaccttcacatgtcaaagaggcgtccaggtggtacttccccatgcacttggaattggttcagcgttcctccatggatagttccttattgtacggtagcgaccccaacttggtggacgaaatgctagagaaacttgcgaagattaagtgtgaggaggttaatgagtttgagaatccccttttcctggaatctctcgtagtgaaaaacgtactaagtaaagtcgtgccgcccgtgtaa

SEQ ID NO: 2463 - DNA, 1074 bp, Saccharomyces cerevisiae
atggttcgtgccttcaaaattaaagttccagcttcttccgccaatatcggccctggttatgatgttcttggtgtcggtctttctctattcttggagttagatgtcaccatcgactccagccaagctcaggaaacaaacgacgatcccaacaactgcaagctgtcttacactaaagaaagtgaaggctattctacggtcccattgcgttctgatgctaacctgattaccaggactgcgttatatgtgttgcgttgcaacaatattagaaacttcccctccggaaccaaagttcacgtctccaacccaatcccacttggccgtggattgggttcctctggtgcagcagttgtggcaggtgttattttaggtaacgaagtggcccaattgggtttctctaagcaacgtatgttggactactgtttgatgattgaacgtcatccagacaacataaccgctgctatgatgggaggcttttgcggttcattcctaagggacttgaccccacaagaggtggaaagacgtgagattccattggctgaggtgcttccagaaccttctggtggtgaagataccggtctggttcccccattacctcccaccgatatcggtagacatgtcaaataccaatggaaccccgccattaaatgtattgcgatcatcccacagttcgagttgtccaccgccgactccagaggcgttcttccaaaagcctacccaacccaggacttggttttcaatctacaaagattggccgtcttgaccacagctttgaccatggacccacctaatgccgacttaatctaccctgctatgcaagatcgtgtccaccaaccttatagaaagacattgatcccaggtctcacggaaatcttatcatgtgtcaccccatccacataccctggcctattgggtatctgcttgtcaggtgcaggcccaactatcttggctttggccactgagaatttcgaagaaatctctcaagaaattatcaacaggttcgccaaaaacggcatcaagtgctcctggaaactactggagcctgcctacgatggtgctagcgtcgaacagcaatga

SEQ ID NO: 2464 - DNA, 1074 bp, Saccharomyces cerevisiae
atgtctgaacttaatgcattattaaaagatatcaacggctcgctcactgcgacatcagaatccttggagaggttgtctgggatttatagtaattctgcgaccgatgagattcctgaaagtaaccaactacatgagcatctattttacgacgctaagaagcctgctgagaaagtatcgctgctatccttaaaaaatgggagcatgctagggtacataaattctctattgatgcttataggcaataggctagacgacgagtgcaaagatccttctgctatggatgcacgtgaacgctctattcaacaccgtgtggtattagagcgtggtgttaaaccactagaaaaaaagttggcttaccaattggacaagctgactagagcatatgtgaaaatggaaaaggaatataaagacgctgagaagcgtgcactggaaaaatctaccttagtgaatcatagcggcaacgacgatagcgaagatgatgagtctagtgaggatgaaatagcatacaggccaaatacctctggaattatcaacacaaataaaaaatcatcagcatacagggtggaggaaacggctaagcaagaaaacggggaagaaaacgatgacaatgagactggcgtgtataaaccaccaaagattacggctgttctaccaccgcaacaaacgcattttgaagatagattcgatgccagagaacacaaagatcgtagtaacaaatcgcgtatgcaagccatggaagaatatattagagagtcatcggaccaaccggactggagtgcatctattggtgctgacattgtgaaccatggaagaggcggtatcaaatctttgagagacacagagaaggaacgtagagtcacttcattcgaagaagataattttaccagattgaatattacaaataaagctgaaaaaaggaagcaaaagcaacgagaaagaaatgcaaggatgaacgttatcggtggtgaagattttggtatattcagctcaaagaggaagctggaagatagcacttcgagacgtggggccaagaagactcgttctgcctgggatagagctcaaaggagactgtag

SEQ ID NO: 2465 - DNA, 1074 bp, Saccharomyces cerevisiae
atgtctgtttctaccgcctctacagagatgtcggttaggaagatcgctgctcatatgaaaagcaaccccaacgctaaagtaatctttatggtgggtgccgggatatccacttcttgtgggataccagacttccgatctccgggaactggcctgtaccataacttggccaggttgaagttgccgtaccctgaagcagtgttcgatgtcgattttttccaatcggatcctttgccattttacactttggctaaagagttgtatcccggaaatttcagaccttctaagtttcactatcttttgaaattgtttcaagacaaagacgttttgaagagagtatatacccagaatatagacactttagaaagacaggccggtgttaaggatgatctgatcatcgaggcccatggcagttttgctcactgtcattgtatcggatgtggtaaagtttatcccccacaggttttcaaatccaagctggcagagcatcctataaaggattttgtcaagtgtgatgtgtgcggtgaactggtaaagccggcaatagttttttttggcgaagatctaccggattccttttcggaaacttggttaaacgattcagagtggcttcgtgaaaaaatcacgacatctggaaaacatcctcagcagcctcttgtcatcgtcgttggcacctcactagccgtttatccctttgcgtctctgcccgaagaaattcctcgaaaggtaaaaagagttctgtgcaatttggaaacggtgggcgattttaaagctaacaagaggcctacagatttaatagttcatcagtactcggatgagtttgccgagcaactcgttgaagaattaggttggcaagaagatttcgaaaagatacttacggcccaaggtggaatgggggataactctaaagagcaattacttgaaattgtacatgatttagagaatttgagtttggatcaatctgaacatgagagtgcagacaagaaggataagaagctacagcgtctcaatggccatgacagcgatgaagatggagcaagcaactcctcttcttcacaaaaagccgctaaagaataa

SEQ ID NO: 2466 - DNA, 1074 bp, Saccharomyces cerevisiae
atgtgcagattcttgattttcaaaggcaaacaaccgattcggctatctcatcttttaacaagaccagctcattctatcataaaccaatcatttgatagcagattacggctagacagaagaaggccaatgaatggtgatggttttggtgtcgcttactatccattggataccgagttaagcgaggacggtccatgccttttcaaagctattactcctgcatggaacaaccaaaatttgagtacattagcagaaaaaactaaatctgatctggtctttgcgcacgtaagagcctctacatatggtgtcctatctgagaccaattgccatccgtttacataccacagcttatgttttatgcataatggcggtatatctaatttcaaaggaatcaagagaaaattattgaatcatatcaaagacgaatacctgaattttattcaagggagcacagactccgagtgcgcatttgcattattcttagacactttagacaaattgggttacgacccaaagaagcaggacggcgatttcggtaatgttgcactaagaaaggcaatgttacgaacgattgactacatcagagattggactaaagaagcgaacaaggacgaggcacatgtggagccatctctcttaaattttgctgtaactgacggatccaccgttgtcgtttccaggtatataacttcaaagacggacgaggcagcatctttgcatttcagttgtggttccagctttgtagaaacttcaccaggagaatacagggtagaaaggttggatagaaaccaagatgtaattatggttgcatcggaacctttgactttcgagagaggtgattggactgcagtacccaccaacagcatattgaccattaagaaacagacaatattactacaccctattatcgatgagtactaccaagaagatccgttatacctaagaagttcaaccctcgcagaaagcaaggggctcatgggttctataccactagcaaaagccgtagaaaagaacgttcctccactagaaagagagggccgtacgagacctccaaccgctgtcgcacatatagcatga

SEQ ID NO: 2467 - DNA, 1076 bp, Saccharomyces cerevisiae
atgtatgtgatgcagtgaataatgaatctatgaaagtttatcaggaataagatagaattgttataataactccctcttgaggaatgcgagtttgatgagttatcacctgaaacaccagcgttattgaaaagtgatatgggtaatatatgccaagaacgatactgtgttccatttgcatcatgaatatgctagtgaagccagatgtttctataatcggagttttagcactaaaaggcaaaagaggaaacttgtggaagaattttttttctgtgcagtttaccattaagatatttatagcgataagtgagaccattaatatgagtattcaatacgagaaccagttacgtgataaaagttactcgagctgctgcagtatccagcatacataataaccatgtcatttttctatagcgagttttaaagtgtctaccaccgcaatttctatctttcgacgcgaatagactttttccttcttacagaacgataataactaacatgactttaacagggctaatttacgtactcaaaagagacttgccgcttctgtcgtcggtgtcggtaagagaaaggtttggttagatccaaatgaaacctctgaaattgctcaagccaactccagaaacgccattagaaaattggttaagaacggtaccatcgtaaagaaggccgttaccgtccactctaaatccagaaccagagcccatgctcaatctaagagagaaggtcgtcacagtggttacggtaagagaaagggtaccagagaagcccgtttaccatcccaagttgtctggatcagaagattacgtgtcttgagaagattattggctaagtaccgtgatgctggtaagattgacaagcacttgtaccatgttttgtacaaggaatctaagggtaacgctttcaaacacaagagagccttggttgaacacatcatccaagctaaggctgatgctcaacgtgaaaaggctttgaacgaagaagctgaagctagaagattgaagaacagagctgctcgtgacagaagagctcaaagagttgctgaaaagagagatgctttattgaaggaagacgcttaa

SEQ ID NO: 2468 - DNA, 1077 bp, Saccharomyces cerevisiae
atgagtagtgttggcgattttgaagaaattattttgcatgatttaaaaccttattatcacgttcccggtgccatacatagtgaaggaataaccttcgttaaggaaaccggtacactgttgtgggttgatatttttaaaggagaggttcataaagtcgaagacatagaacagcctgaatccagtcattcttttttttccattagtagagccaattatggcaagaatgcgtcaattgagtaccctcccaatccagatgaattaaaagaatccgtgggctgtatatttccaatacttgatggggcttcacaaaatgaaatcaaacaagtattatttggtagtaaatttggcataggaaaattggattttagcaaaagtgaatgggaatatgtcattttgtattccgaatgtcctgaattgagtacagacagagcatataagttgagatctaatgatgggaacgtttcgccagatggaaaatatatttatgtggggctaatgagcgattttccatttgatttggaacctattgggtgtttgcttcgtgttgacctattagctcacaagatagagcttgtttggaattgcttgttaattcctaacgcgatccactgggatgaaagtgatcaaaagacgatgtacgtgactgattctttaaacttcactatttggaaatgtcctggtggcgacttgctaaaacgtgacgagttaattgacgtgaagaactccaacaatcaatcttttgagtctcctgaaccagatggaagtgcaatttggtttagcaaagacggaaaacattctgggtttctgtttatcactgtctggtccaccagtaaggttcaaatgttcgatttaactaacggaaaattgctgaaggagttcattttgccggagcagacaccaagagtttcatgttgttgttttgttggtaaagatctcttcgtgaccactgccaatgcagaaatcaacgatgctgtaagaaccaatactgacaagaatggtggctgcatctacaaaattccaaacgtgctagacggaaatgttcctctggaatctacaaagcgacaacctctccactag

SEQ ID NO: 2469 - DNA, 1077 bp, Saccharomyces cerevisiae
atggatgcaacatcgaggatggagcagcctgatgtctttgtaagcaaactctaccacctgctgcaggggaacgcttactcgaacataatacaatggtcgactgatggcagcaagctcgtcatttggaatccggaccagttcaccaaagtcatcctagagcgattttttggtattcacacctttgcagcattcgttaagcaattgagcaaatataacttccagaaggcgggccgcccggactgcgtggagttttccaacattcattttcaaaaagataacattaatagcctctcactggttaaagctcatcagtctgccgccactcccaatgtcgccgccgtcaataatatgaataagcagtgtacttttcactgggaccctttcaaagtgaactccattctaagcaaggccatcggcaagccttccttcgagaaattagtgaaaaatgttgacaggcttcagggcaatcttgatgagcttaagtcgacaaacgcagatagtctgcgtattataagggaaattaacgccagcttacagacaatctcctaccaccagtttcacgcctaccaaaccgctaacttccttcaagaaaattttgaagccatcaaaaaggttgtatgcccggactcttgtctacaacaccagcaacgccaaccaaagcgccccaaacgctactcgttgctgttactaataccaaacgcatccgaattgtcagaaacacctttgatgcgcttcgccggcgtgttcgaatttatgaactgctctttggatacggccactcagtggcacccgcagttgcatcccgaggcatacgaccttcttttcgtcaccgtgtcgcccaacatgcaacaagaacatctcatctacttcaagagactgagaaacctactcccaagctttcctgtaatagccattattaacagacccgtctcccctcaagataccagcattgctccctccaactactctcgctattatttccaccattttttgcagttggggttcagtgacatcctagttagccccttcaccccaacacaacttataacgctcctttccaaacatcttcgaacgtga

SEQ ID NO: 2470 - DNA, 1077 bp, Saccharomyces cerevisiae
atgttgccagaaaagagactattgactccagacgatatgaaactatgggaagaatccccaacaagagctcatttcactaaatttattatagatttggctgaatctgtcaaaggacatgagaattcccagtacaaagaaccaatatcggagtcaataaacagtatgatgaacttgctttcgcaaataaaagatatcactcagaagcacccagtaataaaggatgcagatagctcgagatttggtaaggttgagtttagggacttttatgacgaagtttcacggaattccaggaagatcttacgttccgaatttccctctctcacagatgagcagttggaacaattatcgatttatctagatgaatcatggggaaataaaagaagaattgattatggttcaggtcatgaattaaatttcatgtgtttactttatggactctatagttatggaatattcaatctttcaaacgattcaactaacctcgtgctgaaagtttttatagaataccttaaaataatgaggatactagaaactaaatattggcttgagcctgcgggctctcatggtgtttggggattagatgattatcatttccttccatttctatttggtgccttccaattaaccacccacaagcacttaaagccgatatcaattcacaataatgagctcgtagaaatgttcgctcatcggtacttatattttggttgtatcgcttttattaataaggtcaagtcatccgcctccttgagatggcattctcctatgctagatgacatcagcggtgtaaagacttggtcaaaagttgctgaagggatgataaaaatgtataaagccgaagtccttagtaaattgcccatcatgcaacatttttactttagcgagtttttgccttgtccggatggtgtatctccaccaagaggccacatacatgatgggactgataaggatgatgagtgcaattttgaaggacatgttcatactacttggggagactgctgtggtataaagttaccgagcgctattgcggctactgagatgaataaaaaacatcataaaccaataccttttgattag

SEQ ID NO: 2471 - DNA, 1080 bp, Saccharomyces cerevisiae
atgagcactaaagttgttaatgttgccgttatcggtgccggtgttgttggttcagctttcttggatcaattgttagccatgaagtctaccattacttacaatctagttcttttggctgaagctgagcgttctttaatctccaaggacttttctccattaaatgttggttctgattggaaggctgctttagcagcctccactactaaaacgttgcctttggatgatttaattgctcatttgaagacttcacctaagccagtcattttggttgataacacttccagcgcttacattgctggtttttacactaagtttgtcgaaaatggtatttccattgctactccaaacaagaaggccttttcctctgatttggctacctggaaggctcttttctcaaataagccaactaacggttttgtctatcatgaagctaccgtcggtgctggtttgcctatcatcagtttcttaagagaaattattcaaaccggtgacgaagttgaaaaaattgaaggtatcttctctggtactctatcttatattttcaacgagttctccactagtcaagctaacgacgtcaaattctctgatgttgtcaaagttgctaaaaaattgggttatactgaaccagatccaagagatgatttgaatgggttggatgttgctagaaaggttaccattgttggtaggatatctggtgtggaagttgaatctccaacttccttccctgtccagtctttgattccaaaaccattggaatctgtcaagtctgctgatgaattcttggaaaaattatctgattacgataaagatttgactcaattgaagaaggaagctgccactgaaaataaggtattgagattcattggtaaagtcgatgttgccaccaaatctgtgtctgtaggaattgaaaagtacgattactcacacccattcgcatcattgaagggatcagataacgttatttccatcaagactaagcgttacaccaatcctgttgtcattcaaggtgccggtgccggtgctgccgttactgccgctggtgttttgggtgatgttatcaagattgctcaaagactttag

SEQ ID NO: 2472 - DNA, 1080 bp, Saccharomyces cerevisiae
atggccttggtctctagaaggtcgacaagatcggaaagcacctcaataacaaaggaagagcatacaggagaaggttcattgacgaagttgttcttccgatggcttgttaccttggagggtgatcaggatataaacgatggaaaaggttatatatcgttaccgaatgtctcgaattatatattcttccttggtggcaggttcaggacagtaaagggcgccaaaccgttgtggttaggtgttctccttgctattgtatgtcccatggttctcttctccatatttgaggctcacaaattgtggcatacccaaaatggttataaagtgctggtcattttcttctattatttttgggtcataacgctagcatcctttatcagaacagccactagtgatcctggcgttcttccgagaaatattcatttaagtcaactaagaaataattatcagatcccgcaagaatattacaacttgataacactaccaacacattcttcaatttcaaaagacattactatcaagtattgtccatcatgtaggatatggagaccacctcggtcttctcactgttccacatgtaacgtctgcgtaatggttcatgaccaccattgcatatgggtcaataattgcataggaaaaaggaactaccggttctttttaatattcctgttaggtgcaatactttcgtccgtcatattattaactaattgtgccatccatattgcacgggaatcaggggggcctcgcgattgtcccgttgcaatattgttactttgctatgcagggctaaccttatggtatccggcaatactgtttacttatcacatatttatggcaggtaatcagcaaacaacaagggaatttttgaaaggtattggatcgaaaaaaaaccctgtattccatcgtgtggtcaaggaggaaaacatatataataaggggtcctttttgaaaaatatgggtcacttgatgttagaaccaaggggcccaagctttgtaagtgccagaaagccacatgaagctggagattggagatttatggatttatcgccagcacacagctttgaaaaaatacagaaaatataa

SEQ ID NO: 2473 - DNA, 1080 bp, Saccharomyces cerevisiae
atgggtgttgaacaaatcttaaagagaaagaccggtgtcatcgttggtgaagatgtccacaacttattcacttacgctaaggaacacaagttcgctattccagctattaacgtcacctcttcttctactgccgtcgctgctttagaagctgctagagacagcaagtccccaatcattttgcaaacctctaacggtggtgctgcttacttcgctggtaagggtatctctaacgaaggtcaaaatgcttccatcaagggtgctattgccgctgcccactacatcagatccattgctccagcttacggtatcccagttgtcttacactctgaccactgtgccaagaagttgttgccatggttcgatggtatgttggaagctgatgaagcttacttcaaggaacacggtgaaccattattctcctcccacatgttggatttgtctgaagaaaccgatgaagaaaacatctctacttgtgtcaagtacttcaagagaatggccgctatggaccaatggttagaaatggaaatcggtattaccggtggtgaagaagatggtgttaacaacgaaaacgctgacaaggaagacttgtacaccaagccagaacaagtttacaacgtctacaaggctttgcacccaatctctccaaacttctccattgctgctgctttcggtaactgtcacggtttgtacgctggtgacatcgctttgagaccagaaatcttggctgaacaccaaaagtacaccagagaacaagttggttgcaaggaagaaaagccattgttcttggtcttccacggtggttccggttctactgtccaagaattccacactggtattgacaacggtgttgtcaaggtcaacttggacactgactgtcaatacgcttacttgactggtatcagagactacgtcttgaacaagaaggactacataatgtccccagtcggtaacccagaaggtccagaaaagccaaacaagaagttcttcgacccaagagtctgggttagagaaggtgaaaagaccatgggtgctaagatcaccaagtctttggaaactttccgtaccactaacactttataa

SEQ ID NO: 2474 - DNA, 1080 bp, Saccharomyces cerevisiae
atgtccgaagttatcacaattaccaagcggaacggtgccttccaaaattcatctaacctgtcctataacaacacagggatatcagatgatgaaaatgatgaagaagatatctacatgcacgatgttaactcagcttctaaaagtgagtctgattctcaaattgtgacgccaggtgagctggtcactgatgaccctatctggatgagaggtcacggtacgtattttcttgataatatgacgtattcctctgttgctggtactgtatcccgtgtcaataggctgctatcggtaattccattgaaaggtcgttatgccccagaaactggtgatcacgtcgtagggagaattgctgaagtgggtaacaagagatggaaagtagacattggcggtaagcaacatgcagtacttatgttgggctctgtgaatttaccgggtggtattctaagaagaaaatctgaaagtgatgaactacaaatgagaagcttccttaaggaaggtgacctcctgaatgcagaagttcaatcattatttcaagatggtagtgcctctttacatacaaggtctctaaagtacgggaagttaagaaacgggatgttttgccaagtcccgagttcattaatagtgagagccaagaaccatactcataatttgcccggcaacataaccgtagttctcggagtcaatggttacatatggttaaggaaaacatctcagatggacttagcgagggatacgccgtctgcaaataacagttcctcaattaaatcaactggacccactggtgcggtatcattaaatccctccataacaagactggaagaagagtcttcatggcaaatatattcggatgaaaacgatccttccatatcgaacaacatacgacaagcaatttgccggtatgcgaacgtgatcaaagcgttagcgttctgtgaaataggcattactcaacaacgtatagtaagtgcttacgaagctagtatggtttattcaaacgtaggtgaactgattgagaaaaatgtaatggaatccataggcagtgacattcttaccgccgaaaaaatgagaggtaacggcaactaa

SEQ ID NO: 2475 - DNA, 1080 bp, Saccharomyces cerevisiae
atgtcgtttactgctccttcagatcccgtcaataaaccgacaaaagtgaaggtatcacagttgtgtgaactatgtcattcaagaaaggctctcattagaagacccaaaaacctgtctaaactttgcaaacaatgcttctgcctcgtgttcgagacggagatccataacactattgtagcaaataacttgtttcagaggggagaaaaagtagccgtgggggcctctggtggtaaagactccacggtgttagcgcatatgctgaagcttctgaatgaccgttacgattacggcattgagattgtactgttgagtattgacgaaggaatcatcggatacagagatgattccttggccacggtgaaaaggaatcagcagcagtatggccttcctttggagattttttcctttaaggacctctatgattggacaatggatgagattgtatccgttgctggtataaggaacagttgcacgtattgtggtgtttttagaagacaatcattggaccgtggtgctgcaaagctgggcatatctcacgttgtcaccggccacaatgcagacgatatggcagagacagtactaatgaatatcctacgtggtgacgtagcaagattggaaaaatcgactgcgattatcacacaaagtagcggctctcccatcaagagatcaaaaccatttaaatattcttaccaaaaggaaattgtcctgtatgcgcactacatgaagctggattatttttccactgagtgtacctatgccccagaagcgtttaggggcactgcgagagaatacatgaagaatctggaagcagtgaggcccagttgcattatagacatcatccaaagtggcgaaaatttggcattaaaggctaaaaaatctaacgctggaaagagagtcgtcaaatttgttgacggcaatagatgcgctagatgtggatatctgtcgtcaaataacatttgcaaggcgtgcatgttgctggaaggactggagaaaagtagagcccaagtggcaatcgagaatgacacttctgccgatggtgcagccttgaagctgagagctcttgagaaactcagcttttga

SEQ ID NO: 2476 - DNA, 1080 bp, Saccharomyces cerevisiae
atgtggtgcatgagaagattgccaacaaattcagttatgacggtggctcgaaagagaaagcaaactacgatcgaagacttctttggtacaaagaaaagcactaatgaggcgcccaataagaaaggtaaatcgggcgctactttcatgaccataacaaatggcgcagctatcaagacagagacaaaggcggtcgcaaaggaggcaaacacggacaaatatcctgctaattcaaatgcaaaagatgtatattcgaagaacttgagcagcaatttacgtacactactgtcgctggagctagaaacgattgatgattcgtggtttccacatttaatggatgaatttaaaaagccatattttgtaaagttgaaacagtttgtcactaaagagcaagctgatcatacagtatttccgcctgcaaaggatatttactcatggaccaggctaacgccttttaataaagttaaagtcgtgattatcggtcaagatccctaccacaactttaatcaggcgcatggcttggcttttagcgtcaaaccccctacaccagcaccaccgtcattaaagaacatatataaggaactgaagcaagagtatcctgattttgttgaagataataaagtgggagatttaactcactgggcttcacaaggggttttattgcttaatacctcgttaactgtaagagcacataatgcaaactcgcattctaagcatggttgggaaacttttacaaaaagggtagttcagttgttgatccaggacagagaggccgacggtaagagtttagtattcctcttatgggggaacaatgctatcaaattagtagagtctctgttgggatctacttccgttggaagcggtagtaagtaccctaatatcatggtgatgaagtcagtgcatccgtctccattaagtgcaagtagaggattttttggtaccaaccatttcaaaatgataaacgattggctatacaatacccgcggagagaaaatgatagactggagtgttgttcctggaacgtcattaagagaagttcaggaggcaaatgctcgcttagagtcagaatcaaaggacccttga

SEQ ID NO: 2477 - DNA, 1083 bp, Saccharomyces cerevisiae
atgaagctactaaccttcccaggtcaagggacctccatctccatttcgatattaaaagcgataataagaaacaaatcaagagaattccaaacaatactgagtcagaacggcaaggaatcaaatgatctattgcagtacatcttccagaacccttccagccccggaagcattgcagtctgctccaaccttttctatcaattgtaccagatactctcgaatccttctgatcctcaagatcaagcaccaaaaaatatgactaagatcgattcccccgacaagaaagacaatgaacaatgttaccttttgggtcactcgctaggcgagttaacatgtctgagtgttaattcactgttttcgttaaaggatctttttgatattgctaattttagaaataagttaatggtaacatctactgaaaagtacttagtagcccacaatatcaacagatccaacaaatttgaaatgtgggcactctcttctccgagggccacagatttaccgcaagaagtgcaaaaactactaaattcccctaatttattatcatcttcacaaaataccatttctgtagcaaatgcaaattcagtaaagcaatgtgtagtcaccggtctggttgatgatttagagtccttaagaacagaattgaacttaaggttcccgcgtttaagaattacagaattaactaacccatacaacatccccttccataatagcactgtgttgaggcccgttcaggaaccactctatgactacatttgggatatattaaagaaaaacggaactcacacgttgatggagttgaaccatccaataatagctaacttagatggtaatatatcttactatattcatcatgccctagatagattcgttaagtgttcaagcaggactgtgcaattcaccatgtgttatgataccataaactctggaaccccagtggaaattgataagagtatttgctttggcccgggcaatgtgatttataaccttattcggagaaattgtccccaagtggacactatagaatacacctctttagcaactatagacgcttatcacaaggcggcagaggagaacaaagattga

SEQ ID NO: 2478 - DNA, 1083 bp, Saccharomyces cerevisiae
atgcaagcggatatgcatggaaaacttcacgctgccttagaagatggtttcttcctctttccttttgaacagcaacaacaacctaacatttattatgacacaaccaccgatcaagaagaccgtccttgtttttcttttggatctacaatttcccctagaagttggcattttgaaaagtctgacaaaattgcctcatctcagctgcagaacttggttcatacacaaccaattcatttaattaatcctcaaatattgttcaatgaagagtttctgaatttggaaaatattgattctcagcctatttccaaggaaacgaaaactacgaaggactgcacaatggcaactggtcctgaaagaggaaaaaagagctctgaaagtaccagatcctcttcattatcatctcttttttctaatgatgaatccgcatctacgttccactcatcattcaataaccatgataactttcaaaagagcaacagaaatggagatgatatcgatattagtgacacaataaaatatgaaactaatacaaatgcacaaaaagatatcaaaatattccaagaaaattttgaattcaatgaattcccatacacacaagacttctacccatataccactaattatacctattcaaaacccacaaatattcatgaatcaataaattcaaaaaacacggattcatactcccaatatcaagatcagtttccaccacatactgataacatacattcctttaataatcgtcactatagcaaccataaaagcactaattgtaattactataataataccagcaataataacaacgcctccgataatgtatatgaggcagatccatttatagatgaacctcaggtgccctcctactattacccattagaaattgccttcgacgttgaaaaatcaccaccgccatcactacaaaaattaaattcaaaagagttagaattcctaaaaaagttgaactccaaactgtcaagatatgctgcggcttactccttcagcagttctaatgatcaagattattatgacaaggtcaggtttcaagaaatatcctacaagtttagtaaaacctattcttaa

SEQ ID NO: 2479 - DNA, 1083 bp, Saccharomyces cerevisiae
atgcttaacagaacaattgctaagagaactttagccactgccgctcaggcggaacgcaccctacccaagaagtatggcggtcgtttcaccgtcactttgatacctggtgacggtgttgggaaagaaatcactgattcagtgagaaccatttttgaggctgaaaatatcccgatcgactgggaaactataaacattaagcaaacagatcataaggaaggcgtctatgaagctgttgagtctctaaagagaaataagattggtcttaaggggctatggcacactcctgctgaccaaacaggtcacggttcactaaacgttgctttgcgtaaacaactagatatctacgccaatgtggcccttttcaaatccttgaagggtgtcaagactagaattccagacatagatttgattgtcattagagaaaacacggagggtgagttctcaggcctggaacatgaatccgtccctggtgtagtggaatctttgaaagttatgactagacctaagacagaaaggatcgccagatttgcctttgacttcgccaagaaatacaacagaaagtctgtcacagctgtgcataaggcaaatatcatgaagttaggtgacggtctgttcagaaatataataactgaaattggccaaaaagaatatcctgatattgacgtatcgtccatcattgtcgacaatgcctccatgcaggcggtggccaaacctcatcaatttgatgtcctagttaccccttcaatgtacggtaccatcttaggcaacattggcgctgctttgatcggtggtccaggattggtggcaggtgccaactttggcagggactatgctgtcttcgaaccaggttccagacatgttggtttagatattaaaggccaaaatgtggctaacccaactgccatgatcctttcctccacgttaatgttgaaccatttgggtttgaatgaatatgctactagaatctcaaaggcagttcatgaaacgatcgcagaaggtaagcataccactagagatattggtggttcctcttctactactgacttcacgaatgaaatcatcaacaaattatctaccatgtaa

SEQ ID NO: 2480 - DNA, 1083 bp, Saccharomyces cerevisiae
atggatttaagtttcacgactaaaagtgtcaaaattaatggtcaaaaccatcgaatattactgcaaaacgaaaacggaccttgtgccttgttagcacttgcaaatattctaatactttcaccagatcatacacgtttttccaatgagttaataaggttggtaaataagggaagtcaaatatctttaaaagaacttattgaagtcttagcagatatcgctttacaagttacagataaacctagtactgatataagtgagttactaagtttgttacctagattacatgaaggtttaaatattaaccctgagtttaatgggtcttttgaaaatactaaagagatgtcaatatttcgattgtttaacgttgatgttgtccatggctgggttatcaacagtttcataaatgaaaacattgatgagaaactatctcattattcttatgaatctgcgcagagaatcttaacacaagcagctgatataaattgtggaatttcccaagatgaaaactcggacgaagttttacgtgatgccatgcatttgggtctgtttttgaacgaatcaccgactcagttgaccgcctttggactcctacgattgagagaaaagctgctacacaacaaattctccattttattcagaaatgaccatttttctacattgttcaaatacgaagatcgattatacacattggttacggactttggttataaaaattgtaaagatattgtatggcaatccctagattcggtggacggctcctgcgatgctttttttgccggtaactttagtgcagcagaggtaaatggacagcaattgtcaactgacattgaacgtgattttggaactggaaatttgctacttgaagaaattcagcaaattgaaaacgataaagaactagccaaacagttacaggaacaagaacaagaacgtgttacgaaatttgaagcaaaaaggaaaatccattctcacaaaaaaaactcagaaatacacgcaccagtcaaaaaagacaagtttaagcgaagaagcagccttctcaatgcaaaagcttctgaaaaagagaaaagtgagtgcgttgttatgtaa

SEQ ID NO: 2481 - DNA, 1083 bp, Saccharomyces cerevisiae
atgtcctcacaagaatatacaacttttatagatataccagtgacaagagcgcaggttgaacactgttcttactcgttttggtcctcactgtatcccaaatatgtgccaaaatccatagtgttaaaatccttaccgaaaaaatttattcaatatttggaacaagacggtatcaagctaccccaagaggaaaactccaggtctgtgtacaccgaggaaataataagaaatgaagataatgactatagtgattgggaggacgatgaggataccgccaccgaatttgtccaagaagttgagccattgatagattttccagaattacaccagaaattaaaggatgctttgaacgaattaggtgcagtggctcccaagttaaactggtctgcaccaagagacgctacctggattttgccgaataacactatgaagtgtaacgaggtaaatgagctttacctattgttgaacgcatccaattacataatgcatgaccttcaaagagcatttaaaggctgcgtggacggggatgatataaaaggattgaaatttgacttggtacttagacaatggtgtgatatgaatccggcactcgaatttagggtcttcgttaagaatgcgcatatcgttggggccacccagcgtgatttaaattattatgactatttagatgagttgtcagataccttcaaggaccttattgatgaaatagttcatgatgtcgtcctgcccaagtttcctgataaaagtttcgttcttgacgtttatattccaagacctttcaataaaatcttcattgttgatataaatccgtttgccaggaagacagattctttgctattttcatggaacgagattgctgcgatagcacctccgaagaatgatgttgaagattatgaattaaggttagtgacgaggcataacacggggagattcgcttcaaaagagcactccgaaaatcatgttccacaggatctcgtagaagctagtttaaatcctgaagcaatccgagagctcactcaaaaatggaaagaactactctctcaacaggcaaaggaagaaagcagtgatagtgagaatgaaacttag

SEQ ID NO: 2482 - DNA, 1083 bp, Saccharomyces cerevisiae
atgtcgacattgttatctgaggtagaaagtatcgatactttgccgtatgtgaaggatacaacaccgacaggaagtgactcgtcatcatttaataaattattggctccttccatagaggatgtagatgctaacccagaggaactgaggactttacgtggccaaggacggtattttggaataacagattatgactcaaacggtgcgataatggaggcagagccaaagtgtaataattgttcgcaaagaggtcatttgaaaaggaattgtccccatgtgatatgtacttactgcgggtttatggatgatcattactcacaacactgccctaaggctattatttgcactaattgtaatgcaaacggccattataaatcacagtgtcctcataaatggaagaaggtgttctgcacgctttgcaatagcaaaagacactcaagagaaagatgtcctagtatttggagatcttatttattaaaaacaaaagatgctaaccaaggtgacttcgattttcaaacagttttctgttataactgtgggaatgccggtcattttggcgatgactgtgctgaaagaaggtcatcgagagtgccgaacactgatggaagtgcattttgcggtgataacttagccacaaaatttaaacaacactattttaaccaattgaaagactataaacgtgaagcttcacaaaggcaacactttgataacgaacatgaattcaacctgcttgactatgaatataacgacgatgcatacgacctccctggctcaaggacttatagagataaaatgaaatggaagggcaaagtgcagtcaacaaggaacaaaaatagtagcaataatagatatgaaagcagtaataacaggaagaagaagtcaccatttagcgcacagaactacaaagtgacgaaaaataaaagagttcagacacaccccttagatttccccagaagtagccaaaacaacagaacgaacgattattcgagccagttcagctataatagggacgacttccccaagggtcctaagaataagaggggccgatcatcttctaacaaaagccaaagaaatggccgttattga

SEQ ID NO: 2483 - DNA, 1083 bp, Saccharomyces cerevisiae
atgtcgagctcctccaaggcttctgcaagttcatccttgtcaagcacagccacctcttcaacttctgcaactagaggcagcgacggatgtgttgtttgcgattcaactgcatcatgccctgtttgcgcttcaggagaatattgtgttatgacttcattaacatgtgacaagtgcccatccacatactgtgcgaaacagtccgattcacaactgagtagtttatcttcctcctcctctagttctagttccagtaattcaaatgagaaaacctcgttgattgtggggttcaccgtgggtattgtaggtggtgcgatgcttattgccttggtggcgttgtatttcatcaacaagagatattggaagcccaaaaggcaaaaaaataaagctttgaaattggaagaggcatcgcaaagttacgggaatgaagaggaatacttcgacgatgaagacgatgatgatgaagacgatgaggatgatggcggtatgagaaaagatgaaagtcacaccctgttcaatacgtcactggtacctccaactctcaacgtgccgggaaacagaagttcagcatctaccactcgtacaagggcttctaatattttgcctattgcctacattcctggtgtgacaagcggtttgagtaccgacaaactgcaatcaaaactacgctcgagctctaagagacaaaatgcagctggtgatatcaggtcacatataaccttaggttcttccatcttggatggtctggatgacgaagatgacgagcataaccaggtactcaataaggacgcagacgataacctcataactgctattcgtgctaaacctaaactggttcaaatcgcagaggaagagagtgataaggagattcaggacttggatgtcattgaagaacagacagaggcggatgatctttcacacatggcaaaaagcgaggcaagccatggtaataacgacgaagatgacgatgaagaaggaagttttatactggacttggaaattccagaatcgatacgcgagagcacccagggcagtcgcactgagagcccgtttgaggacaagttcgaaatacacgatgaacgataa

SEQ ID NO: 2484 - DNA, 1083 bp, Saccharomyces cerevisiae
atgtcgatagtctacaataaaacaccattattacgtcaattcttccccggaaaggcttctgcacaatttttcttgaaatatgaatgccttcaaccaagtggctccttcaaaagtagaggaatcggtaatctcatcatgaaaagtgccattcgaattcaaaaggacggtaaaagatctcctcaggttttcgctagttctggcggtaatgccggttttgctgctgcaacagcatgtcaaagactgtctctaccatgtacagtcgtggttcctacagcgacaaagaagagaatggtagataaaatcaggaacaccggtgcccaggttatcgtgagtggtgcctactggaaagaagcagatacttttttaaaaacaaatgtcatgaataaaatagactctcaggtcattgagcccatttatgttcatcccttcgataatccggatatttgggaaggacattcatctatgatagatgaaatagtacaagatttgaaatcgcaacatatttccgtgaataaggttaaaggcatagtatgcagcgttggtggaggtggtttatacaatggtattattcaaggtttggaaaggtatggtttagctgataggatccctattgtgggggtggaaacgaatggatgtcatgttttcaatacttctttgaaaataggccaaccagttcaattcaagaagataacaagtattgctacttctctaggaacggccgtgatctctaatcaaactttcgaatacgctcgcaaatacaacaccagatccgttgtaatagaggacaaagatgttattgaaacctgtcttaaatatacacatcaattcaatatggtgattgaaccggcatgtggcgccgcattgcatttgggttacaacactaagatcctagaaaatgcactgggctcaaaattagctgcggatgacattgtgataattattgcttgtggcggctcctctaatactataaaggacttggaagaagcgttggatagcatgagaaaaaaagacactcctgtaatagaagtcgctgacaatttcatatttccagaaaaaaatattgtgaatttaaaaagtgcttga

SEQ ID NO: 2485 - DNA, 1083 bp, Saccharomyces cerevisiae
atgtcttatcctgagaaatttgaaggtatcgctattcaatcacacgaagattggaaaaacccaaagaagacaaagtatgacccaaaaccattttacgatcatgacattgacattaagatcgaagcatgtggtgtctgcggtagtgatattcattgtgcagctggtcattggggcaatatgaagatgccgctagtcgttggtcatgaaatcgttggtaaagttgtcaagctagggcccaagtcaaacagtgggttgaaagtcggtcaacgtgttggtgtaggtgctcaagtcttttcatgcttggaatgtgaccgttgtaagaatgataatgaaccatactgcaccaagtttgttaccacatacagtcagccttatgaagacggctatgtgtcgcagggtggctatgcaaactacgtcagagttcatgaacattttgtggtgcctatcccagagaatattccatcacatttggctgctccactattatgtggtggtttgactgtgtactctccattggttcgtaacggttgcggtccaggtaaaaaagttggtatagttggtcttggtggtatcggcagtatgggtacattgatttccaaagccatgggggcagagacgtatgttatttctcgttcttcgagaaaaagagaagatgcaatgaagatgggcgccgatcactacattgctacattagaagaaggtgattggggtgaaaagtactttgacaccttcgacctgattgtagtctgtgcttcctcccttaccgacattgacttcaacattatgccaaaggctatgaaggttggtggtagaattgtctcaatctctataccagaacaacacgaaatgttatcgctaaagccatatggcttaaaggctgtctccatttcttacagtgctttaggttccatcaaagaattgaaccaactcttgaaattagtctctgaaaaagatatcaaaatttgggtggaaacattacctgttggtgaagccggcgtccatgaagccttcgaaaggatggaaaagggtgacgttagatatagatttaccttagtcggctacgacaaagaattttcagactag

SEQ ID NO: 2486 - DNA, 1086 bp, Saccharomyces cerevisiae
atgaaaggtttaattttagtcggtggttacggtaccagattgagacctttaactttgaccgttccaaagccactggttgaattcggtaatagaccaatgattttacaccaaatcgaggctttagccaacgctggtgttactgacatcgttcttgctgttaattacagaccagaagtcatggtggaaactttgaagaagtacgaaaaggaatatggtgttaacatcactttctctgtagaaactgaaccattaggtactgcaggtccattgaaattggctgaagatgttttgaagaaggacaactctccatttttcgtcctaaactccgacgtcatttgcgaatatccattcaaggaattggctgacttccacaaagctcacggtggtaaaggtaccattgttgctaccaaggtcgacgaaccttctaaatacggtgtcattgtccatgatatagctactccaaacttgattgacagatttgttgaaaagccaaaggaatttgttggtaacagaattaacgccggtttgtacattttaaacccagaagtcattgacttgattgaaatgaagccaacttcaattgaaaaggaaactttcccaatcttggtcgaagaaaaacaactatattccttcgatttggaaggtttctggatggatgttggtcaaccaaaggacttcttgtctggtaccgttctttacttgaactctttggccaagagacaaccaaaaaaattggctacaggtgccaacattgttggtaatgccttgatcgacccaaccgctaagatttcctccactgctaagattggcccagacgtggttatcggtcctaatgtcaccatcggtgatggtgttagaatcaccagatctgttgttttgtgcaactccaccatcaagaaccactccttggtcaaatctaccatcgtaggctggaactctaccgttggtcaatggtgtcgtttggaaggtgtcactgtcttgggtgacgacgttgaagttaaggacgaaatctacatcaacggtggtaaagtcttacctcataagtctatctccgataatgttccaaaggaagctattattatgtga

SEQ ID NO: 2487 - DNA, 1086 bp, Saccharomyces cerevisiae
atgactactgctgttaggcttttaccttcactgggcagaaccgcccataagaggtctctctacctgttctccgctgctgctgctgctgctgctgctgcaacttttgcttactcgcaatcccaaaagagatcatcgtcttctcccgggggtggtagtaaccacggatggaacaactgggggaaggcagctgctttggcttccactacaccgctcgttcatgtcgcctctgtcgaaaaagggaggtcatacgaggacttccaaaaggtgtacaatgcgattgcactcaagctgagggaagatgacgaatatgacaactatataggctatgggcccgtattagtccgtcttgcttggcacacttcagggacctgggacaagcacgacaatacaggcgggtcatacggtggtacatacagattcaaaaaggagtttaacgatccatccaatgcgggcttgcagaatggcttcaagttcctggagcccattcacaaagagtttccctggatctcctcgggtgatctgttcagtctagggggtgtcactgccgtgcaggaaatgcagggtcccaagattccatggagatgtggtagagtcgacacgccagaggatactacccctgacaacgggagactgcctgacgctgataaagacgctgactatgtcagaacattttttcaaagacttaatatgaatgacagagaagtagttgctcttatgggggctcacgctctgggcaagacccacttgaagaactctggatacgaagggccatggggagccgctaacaacgtctttaccaatgagttttacttgaacttgctgaatgaagactggaaattggaaaagaacgacgcgaacaacgaacagtgggactctaagagcggctacatgatgctgcccactgattattctttgattcaggatcccaagtacttaagcattgtgaaagaatacgctaatgaccaggacaagttcttcaaggatttttccaaagcttttgaaaaactgttggagaacggtatcactttccctaaagacgcgcccagtccatttattttcaagactttagaggaacaaggtttatag

SEQ ID NO: 2488 - DNA, 1086 bp, Saccharomyces cerevisiae
atgagcactcccaggaaggccgccggtaacaacgagaatacagaagtctcagagatcagaaccccctttcgggagagagcccttgaagaacaacgtctcaaggatgaggtactgatcagaaatacgccaggttatagaaaacttttatctgcttctactaagtctcatgacatcctcaataaagatccgaacgaagtacgaagttttttacaagacttaagccaagtgttagcacgcaaatcacaaggcaacgatacaactactaataaaactcaagcacggaatctaatagatgaattagcgtacgaagagagccaaccagaggagaatgagcttcttcggagcagaagtgagaaactgacagataacaacattggcaatgaaacgcaacctgattatacttccttatcgcaaacagtatttgcaaaattgcaggaaagagacaaaggcttgaaaagtaggaagattgacccgataataatacaagatgttcccacgacaggacacgaggatgaattgacagtgcactctccagataaagctaacagtatctctatggaagttttgcgcacgtcgccaagcattggaatggatcaggtagatgaaccgccagtacgtgatccggtaccaatttccataacgcaacaggaagaaccactatctgaagatttaccaagcgacgataaagaggagacagaagaagcagaaaacgaagattattcgtttgaaaacaccagtgacgaaaatttggatgatataggcaacgatcctatccgtttaaatgtccctgcggtgagacgttcttctataaaaccgctgcaaataatggatctaaaacatcttacaaggcaatttttgaatgagaataggataatattgccgaaacaaacgtggtctactatacaggaggaatctttaaatataatggatttcttgaaacaaaaaatcggcacgttacaaaaacaggaattggtagattcgtttatcgatatgggtattatcaataacgttgatgatatgtttgagctcgcgcacgaattgcttcccttagaacttcaatcaagaattgaaagttatttgttctaa

SEQ ID NO: 2489 - DNA, 1086 bp, Saccharomyces cerevisiae
atgatttctgctaattcattacttatttccactttgtgcgcttttgcgatcgcaacacctttgtcaaaaagagattcctgtaccctaacaggatcttctttgtcttcactctcaaccgtgaaaaaatgtagcagcatcgttattaaagacttaactgtcccagctggacagactttagatttaactgggttaagcagtggtactactgttacgtttgaaggcacaaccacatttcagtacaaggaatggagcggccctttaatttcaatctcagggtctaaaatcagcgttgttggtgcttcgggacataccattgatggtcaaggagcaaaatggtgggatggcttaggtgatagcggtaaagtcaaaccgaagtttgtaaagttggcgttgacgggaacatctaaggtcaccggattgaatattaaaaatgctccacaccaagtcttcagcatcaataaatgttcagatttaaccatcagcgacataacaattgatatcagagacggtgattcggctggtggtcataatacggatgggtttgatgttggtagttctagtaacgtcttaattcaaggatgtactgtttataatcaggatgactgtattgctgtgaattccggttcaactattaaatttatgaacaactactgctacaatggccatggtatttctgtaggttctgttggtggccgttctgataatacagtcaatggtttctgggctgaaaataaccatgttatcaactctgacaacgggttgagaataaaaaccgtagaaggtgcgacaggcacagtcactaatgtcaactttatcagtaataaaattagcggcataaaaagttatggtattgttatcgaaggcgattatttgaatagtaagactactggaactgctacaggtggcgttcccatttcgaatttagtaatgaaggatatcaccgggagcgtgaactccacagcgaagagggttaaaattttggtgaaaaacgctactaactggcaatggtctggggtgtcaattaccggtggttcttcctattctggatgttctggaatcccatctggatctggtgcaagctgttaa

SEQ ID NO: 2490 - DNA, 1086 bp, Saccharomyces cerevisiae
atgcgctcctccatgtttagatgtgtgagtcgcgctcattacagcacaagtgtcacagaagatttcataaatagcattctagcaagggctcaagaggcaacagcaaaagcttcctccaatgctctcaaattggacaagatgaaggagggtagaatgcaaaataagaggagaaacgggaatcagaataggaatagtatgaacaataaagaaagcaggggtagagagggaaatcaaggagaaagaaacatgagactgaaaaaccgttctagtgattctgttcgtgctaacaagcagcagtggaataaaggtgctaatacgtcttttgtaaagaatcctactggaaatacagtagttatgcagccacagttcaaaaagatgcagaatggcaaaaataatttgaaaggagatgcgagagtcgaagatgatttacttgatgtcttcaattcgtcgatggagcaaaaacctgttaatttcaatggaacccccaaatctaaagcaaggtttcaaaaaaagagtcatatcttaacagcatctaaaaggagaaaggctcctcaacagcagctacagaaggttatcaagagacctgtcagttcagaatatgtactagaagagcccactcctttatctttgttagaatatactcctcaagtttttccaacaaaggaatccagattagtcaactttaccttagatagcttgaaaaaatccaattaccccatttacagatcgccaaatttgggaatcctcaaagtacatgatttcaccctaaacacgccaaactttggtaaatatacaccaggatcctccttgatttttgccaaagagcctcaattgcagaatttacttattgaagaagacccagaagattttcataggcaagtaacaggagaatatcaactcttaaaaccatatgtgaaaaaagattttgaaaaactgacgaaatctaaagatactgtgagtaagctcgtacaaaatagtcaagttgtgaggttatcattacaatctgttgttatgggctccgaggaaaagaaattggtatatgatgtttgttctggaatgaaaccaatttctgaattacaacagtaa

SEQ ID NO: 2491 - DNA, 1086 bp, Saccharomyces cerevisiae
atgctttacccagaaaaatttcagggcatcggtatttccaacgcaaaggattggaagcatcctaaattagtgagttttgacccaaaaccctttggcgatcatgacgttgatgttgaaattgaagcctgtggtatctgcggatctgattttcatatagccgttggtaattggggtccagtcccagaaaatcaaatccttggacatgaaataattggccgcgtggtgaaggttggatccaagtgccacactggggtaaaaatcggtgaccgtgttggtgttggtgcccaagccttggcgtgttttgagtgtgaacgttgcaaaagtgacaacgagcaatactgtaccaatgaccacgttttgactatgtggactccttacaaggacggctacatttcacaaggaggctttgcctcccacgtgaggcttcatgaacactttgctattcaaataccagaaaatattccaagtccgctagccgctccattattgtgtggtggtattacagttttctctccactactaagaaatggctgtggtccaggtaagagggtaggtattgttggcatcggtggtattgggcatatggggattctgttggctaaagctatgggagccgaggtttatgcgttttcgcgaggccactccaagcgggaggattctatgaaactcggtgctgatcactatattgctatgttggaggataaaggctggacagaacaatactctaacgctttggaccttcttgtcgtttgctcatcatctttgtcgaaagttaattttgacagtatcgttaagattatgaagattggaggctccatcgtttcaattgctgctcctgaagttaatgaaaagcttgttttaaaaccgttgggcctaatgggagtatcaatctcaagcagtgctatcggatctaggaaggaaatcgaacaactattgaaattagtttccgaaaagaatgtcaaaatatgggtggaaaaacttccgatcagcgaagaaggcgtcagccatgcctttacaaggatggaaagcggagacgtcaaatacagatttactttggtcgattatgataagaaattccataaatag

SEQ ID NO: 2492 - DNA, 1086 bp, Saccharomyces cerevisiae
atgttttctggctttagttcttttggcggcggaaatggttttgtaaatatgcctcaaacgtttgaggagttctttagatgctaccctatagctatgatgaatgatagaatacggaaggatgacgcaaacttcggcgggaaaatattcctgccaccaagtgctctaagcaaactatccatgttgaacataagataccccatgctttttaaactaactgccaatgaaactggacgtgtgacacatggaggtgttttagaatttattgctgaagagggcagagtttacttaccacaatggatgatggaaactttgggtatacagccaggatctctactgcaaatttcatctactgatgtacctctgggccagtttgtgaagttagaacctcagtctgtagatttcttggatatttccgaccccaaagcagttttggaaaacgtactgaggaatttctcgactttgaccgtggacgatgttattgagattagttacaatggtaaaactttcaaaattaagatcttagaagtcaaaccagaatcatcatcgaagagtatatgtgtcattgaaacagatttagtaacagattttgctccacctgtaggatatgtggaaccggattacaaagcgctgaaagctcagcaagataaagaaaaaaagaattcttttggtaagggccaagttttggatccctcggtgcttggccagggatcgatgtccacaagaatcgactatgcgggtatcgctaacagtagcagaaacaaactatctaaatttgtaggtcagggacaaaacatatctggtaaagctccgaaagcggagcccaagcaagatataaaagatatgaagataacgtttgatggcgagcccgccaagctagatctgcctgaaggccaattattctttggtttcccaatggtcctaccgaaagaagacgaagaaagtgccgctggtagcaaatccagtgaacaaaatttccaaggccaagggatctcactaaggaagagcaataagagaaaaacgaaaagtgaccatgattcgtccaagtccaaggctcccaaaagcccggaagtaatcgaaattgactaa

SEQ ID NO: 2493 - DNA, 1089 bp, Saccharomyces cerevisiae
atgagatctttaaatacccttttactttctctctttgtcgcaatgtccagtggtgctccactactaaaaattcgtgaagagaagaattcttctttgccatcaatcaaaatttttggtaccggcggtactatcgcttccaagggttcgacaagtgcaacaacggcgggttatagcgtgggattaaccgtaaatgatttaatagaagccgtcccatctttagctgagaaggcaaatctggactatcttcaagtgtctaacgttggttcaaattctttaaactatacgcatctgatcccattgtatcacggtatctccgaggcactagcctctgatgactacgctggtgcggttgtcactcatgggaccgacactatggaggagacagctttcttcttagatttgaccataaattcagagaagccagtatgtatcgcaggcgctatgcgtccagccactgccacgtctgctgatggcccaatgaatttatatcaagcagtgtctattgctgcttctgagaaatcactgggtcgtggcacgatgatcactctaaacgatcgtattgcctctgggttttggacaacgaaaatgaatgccaactctttagatacattcagagcggatgaacagggatatttaggttacttttcaaatgatgacgtggagttttactacccaccagtcaagccaaatggatggcaattttttgacatttccaacctcacagacccttcggaaattccagaagtcattattctgtactcctatcaaggcttgaatcctgagctaatagtaaaggccgtcaaggacctgggcgcaaaaggtatcgtgttggcgggttctggagctggttcctggactgctacgggtagtattgtaaacgaacaactttatgaagagtatggtataccaattgttcacagcagaagaacagcagatggtacagttcctccagatgatgccccagagtacgccattggatctggctacctaaaccctcaaaaatcgcgtattttgctacaattatgtttgtactccggctacggcatggatcagattaggtctgttttttctggcgtctacggtggttaa

SEQ ID NO: 2494 - DNA, 1089 bp, Saccharomyces cerevisiae
atgtcccgtccacaagttactgttcactctttgactggtgaagctactgccaatgccttgccattgccagctgtcttctccgctcctatccgtccagacattgtccacactgttttcacctctgtgaacaagaacaagagacaagcttacgctgtttctgaaaaggctggtcaccaaacctccgctgaatcctggggtaccggtcgtgccgtcgctcgtattccaagagttggtggtggtggtaccggtagatccggtcaaggtgccttcggtaacatgtgtcgtggtggtcgtatgtttgctccaactaagacctggagaaagtggaacgttaaggttaaccacaacgaaaagcgttacgccactgcttctgctattgctgctactgctgttgcctctttggtcttggccagaggtcacagagtcgaaaagattccagaaatcccattggttgtctccactgacttggaatctattcaaaagaccaaggaagctgttgctgctttgaaggctgttggtgctcactccgacttgttgaaggtcttgaagtccaagaaattgagagccggtaagggtaagtacagaaacagaagatggactcaaagaagaggtccattagttgtctacgctgaagacaacggtatcgtcaaggccttgagaaacgttccaggtgttgaaactgccaacgttgcttctttgaacttgttgcaattggctccaggtgctcacttgggtagattcgttatctggaccgaagctgctttcaccaagttggaccaagtctggggttccgaaaccgttgcctcctccaaggtcggctacactttgccatcccatatcatctccacttctgatgtcaccagaattatcaactcttccgaaatccaatctgctatcagaccagctggccaagctactcaaaagcgtactcacgttttgaagaagaacccattgaagaacaagcaagtcttgttgagattgaacccttacgccaaggtctttgctgctgaaaagctaggttccaagaaggctgaaaagactggtaccaagccagctgctgttttcaccgaaactttgaaacacgattaa

SEQ ID NO: 2495 - DNA, 1089 bp, Saccharomyces cerevisiae
atgtcccgtccacaagttactgttcactctttgactggtgaagctactgccaatgccttgccattgccagctgtcttctccgctcctatccgtcctgacattgtccacactgttttcacctctgtgaacaagaacaagagacaagcttacgctgtttctgaaaaggctggtcaccaaacctccgctgaatcctggggtaccggtcgtgccgtcgctcgtattccaagagttggtggtggtggtaccggtagatccggtcaaggtgccttcggtaacatgtgtcgtggtggtcgtatgtttgctccaactaagacctggagaaagtggaacgttaaggttaaccacaacgaaaagcgttacgccactgcttctgctattgctgctactgctgttgcttctttggtcttggccagaggtcacagagtcgaaaagattccagaaatcccattggttgtctccactgacttggaatctattcaaaagaccaaggaagctgttgctgctttgaaggctgttggtgctcactccgacttgttgaaggtcttgaagtccaagaaattgagagccggtaagggtaagtacagaaacagaagatggactcaaagaagaggtccattagttgtctacgctgaagacaacggtatcgtcaaggccttgagaaacgttccaggtgttgaaactgccaacgttgcttctttgaacttgttgcaattggctccaggtgctcacttgggtagattcgttatctggaccgaagctgctttcaccaagttggaccaagtctggggttccgaaaccgttgcctcctccaaggtcggttacactttgccatcccacatcatctccacttctgatgtcaccagaattatcaactcttctgaaatccaatctgctatcagaccagctggccaagctactcaaaagcgtactcacgttttgaagaagaacccattgaagaacaagcaagttttgttgagattgaacccttacgccaaggtctttgctgctgaaaagctaggttccaagaaggctgaaaagactggtaccaagccagctgctgttttcgccgaaaccttgaagcatgactag

SEQ ID NO: 2496 - DNA, 1089 bp, Saccharomyces cerevisiae
atgatcaataatcctaaggtagacagtgtagcggagaaacccaaagctgtgacatcaaagcagtcggagcaagcggcttcgccagaaccaacaccagccccccctgtttctagaaatcagtatccgatcacgttcaacttgacttcaaccgcaccctttcatcttcatgaccgtcatcgctacttacaagagcaagatctttacaagtgcgcttctagggattcgttgtcttccctgcagcaactcgcccatacacctaatgggtcgacaaggaagaaatatattgttgaggaccaatctccctatagttcggaaaatccagtcattgtgacctcttcctataaccatacggtttgcacaaactacttaagaccaagaatgcagtttacagggtaccagatatcaggatacaaacgctatcaggtaacagttaacttaaagactgtagatttgccaaagaaagattgcacgtcgctgtcccctcatttatctggatttttgtcgataagaggactcacgaaccaacacccggaaatcagtacatattttgaagcctacgcggtaaaccacaaggaattagggttcttgtcctctagctggaaagatgaacctgttttaaacgaattcaaagccacagaccaaacagacttagaacactggataaatttcccctcctttagacagcttttcctgatgagccaaaaaaacggtctcaactcaactgacgacaatggcactacaaatgcagccaagaagttgcctccacagcagcttcctactacaccaagcgcagacgctggtaacatatcaagaatttttagccaagagaaacaatttgacaactacttgaacgaacggtttatatttatgaaatggaaggaaaaatttttggtaccagatgccctattaatggaaggtgtagacggcgcatcttatgatgggttttattacattgtccatgatcaagttaccgggaacattcaagggttttactatcatcaagatgctgaaaagttccaacagctggaattagtaccatctttgaaaaataaagtcgagtccagtgattgttcttttgagtttgcttga

SEQ ID NO: 2497 - DNA, 1089 bp, Saccharomyces cerevisiae
atgctggttccacctgctaactttgggattgctgaagaaggaatatatagatgttctaaagtggagacattaaatttatcctttctggaaactctcaatttaaagacagctatatttattggaggtcaagaaccatccaagtttttcaaagattttttcacaagatcatccataaaatggattgttttaaggatgtctgatttctcggctgcggcagttccggtaaaaagctcttctgtatctaacgcaaatttatattcgaataataacagtactctatcattacaggaagaaaagaaaaaatccactgcaaatgggtcacaaaattctactacaggggatcctgtaattcaggaggaattggcttaccacttgactgacaatgatgacttaatgctgattaagagcacgtgtttaaaaagaactttcaaaacattattgaatgtggataattataatgttttattggtagataagaccgcgttggtcattggtatacttcgaaaaattcagaaatggaatattgcatcaatcataaatgagtacagattattttctggtaagaatagaaattattttgcggaaacatttctagaaataattaacattgagatagaacaggagaaggataataagacaattgtggacaacaaagcaaaaaaattgccccttgagaataataggacgcattcgatagagtataaggccaattctggcaaacttattagagtaaatgaagatgacctttgcagagagccagaagtgcctcagcggcttttgacattaataaatcaaatcgaaaccaaagtgaaaaataataaagtattacaagtaagtggagttctaggagacgatttgaagaaaacctcttctgacctaggaatttttggccataggtatagattagcatttaataaaaaagaaaatggagattatggctattataaagcaaggggaaaagataacgtcaaaataaggataccctgtgattctgaattaccagattggttcaggtttcaacgagatttgtgggaaaaagaaaacgttccggaagagcatcacttttatagggaacatatttttacatag

SEQ ID NO: 2498 - DNA, 1089 bp, Saccharomyces cerevisiae
atggagaaaagcgaaagtaattctgaaggactttatctccaaaatatattaaatgttccccctccgcagcgatttattgtgctcataatacttgccctttggatctggacatggatattaaaattcttcttgcatagtaatttagacgtatcccaagtcatactcacgagagtaccgcacgatatacgtccaggttatactctacagcaattgcatagaacagctagaaattttgctttgaagataacaaggattattataccgttccactttgccactgtgttcctttttgagttcatgaatattatagaaggtccactcaaaaatatcattctcatcgtatattttctaccattgatccaatgtgtcactatattttggtttctgttgaaagagtgccagataataaaatattgtactaggagatgtttgttgatagaatcctccccccgttccttaaggaatacctacattttaatctctgacacgttgacatcgtttgcaaaaccattgatagacttcacattgtttacctctctaatttttagagaacccttcacacattttgatctatccgtagcccttcttcctgtactggtaagactactgcagtgtttgagagaataccgtttactgcacgaagcaactttactattcaatgcattgaaatacagttgtaatcttcccattcttttttgcacctggagatcaagagtgtatgagggatccatcaacgaagaaagactacaccacgttcaaagatggtttatgctaattaattcttcctatacgttattttgggatgtaaggatggattggtcattggactcgttaacctctttaagatccagatccaaaagtgccgtcacattaaagaaaaaaatgtatcattcggcgattctcgttgactttttgctgaggttctggtggctatgggtatatttatcgcagaatctgaaattagttgccgcagatagcgactacatttttttccaaggcgaaatgcagtatttcgaagtaattagaagaggcatatgggtcgttttcaaattggacgcagagtattatattaagtttgcaagcaaataa

SEQ ID NO: 2499 - DNA, 1089 bp, Saccharomyces cerevisiae
atgggtaactttccagctccaaaaaacgatttgatattgagagccgcaaagggtgaaaaagtcgagagaccgccatgctggataatgcgccaggcaggtcgttacctgccggaatatcacgaggtgaaaaacaatcgtgatttctttcaaacttgcagggatgcggaaattgcttctgagattactatccagccggtaagacgctatagaggcctcattgatgctgctattatttttagtgatatcttagttattccgcaagccatgggtatgagggtcgagatgctcgaaggtaaaggtccacatttcccagaacctttaagaaatccggaagacctccaaacggtattagactacaaggttgatgttttgaaagagttagattgggctttcaaggcaatcaccatgacaaggatcaagttggatggtgaggttcccttatttggcttttgcgggggaccttggactctaatggtttatatgacggaaggcggtggatcccgtcttttcagatttgccaaacaatggattaacatgtatccagagctttctcacaaattattacaaaaaatcactgatgtggccgtggagtttctgagtcagcaagtcgtggcgggtgctcaaatactacaagtttttgaaagttggggtggtgagctttcgtctgtagattttgatgagttttccctaccatatttaagacaaattgccgaaagagtgcctaaaagattgcaagaattaggtatcatggaacagattcctatgatcgtttttgcgaaagggtcgtggtatgctttggacaagctatgctgttcaggatttgacgttgtttcgttggactggtcctgggacccaagagaagcggtaaaaataaacaagaaccgtgtcaccttgcagggcaacctggatcctggcgtcatgtatggttctaaagaggtaataacaaagaaagttaaacagatgattgaggcttttggaggtgggaagtcccgctacattgttaatttcggtcacggtacccaccctttcatggatccagacgtcatcaagtttttcttggaggagtgccacagaattggttcgaagtaa

SEQ ID NO: 2500 - DNA, 1089 bp, Saccharomyces cerevisiae
atgtctcgcaaatttgatttaaaaacgattactgatctttccgtcctagttgggactggcatatcattatactacctggtcagtcggctactcaacgatgttgaatcaggaccgttatcaggtaaatcaagggaatcaaaggccaaacagtccttgcaatgggaaaagctggtgaaaagatcaccggcattggcagaagtaacattagatgcatatgaaaggactatattatcttctatcgttacgccagatgaaataaatattacattccaggatattggtggcttagacccgcttatttcagatctacatgaaagtgtcatatatcccttgatgatgccagaagtatattctaatagccctttacttcaagcacctagcggtgtcttgctatatgggccaccaggatgtggtaaaaccatgttggcgaaggccctagccaaggaaagtggtgctaattttatctcaataagaatgtcatctataatggataaatggtatggtgaatctaacaaaatagtcgatgcaatgttttcattggcgaacaagttacaaccttgtataatattcattgacgaaattgattcattccttagagaacggtcttctacagatcatgaagttacggcaaccttaaaagctgaattcatgactttatgggatggcttattgaataatggaagggttatgattatcggtgctactaatcggataaatgacatagatgatgcgtttttgaggaggttaccaaaaaggtttcttgtttcattgcctggttctgatcaacgttacaaaatattaagtgttttattaaaagacactaaactagacgaagacgaattcgacttgcaactgattgcagacaataccaaaggattttctgggtcggacctgaaagagctttgcagagaagcggccttagatgcagcaaaggaatacataaaacagaagaggcagctcattgatagtggtacaatcgatgttaatgatacttcttccttgaagataagaccattaaagacaaaagattttacaaaaaaattaagaatggatgctacaagtacgttgtcatctcaacctcttgattaa

SEQ ID NO: 2501 - DNA, 1092 bp, Saccharomyces cerevisiae
atgaacggatctcccactcctaagcgatattcatccaaatcttcaaggctttacgacgactactataacatcccgtatcaatattccaatccgactccaatgaatagagactataatgacgtggggtcacgtatcaatgcagataaactggtaccagaggaatacaaacggaatacagaatttatcaacaaagctgtccaacaaaataaagaacttaacttcaaactgagagaaaagcagaacgaaatattcgaactcaagaagattgcagaaactctgcgctcaaagctcgaaaaatatgttgacattaccaaaaagcttgaagaccaaaacctcaacctacagataaaaataagcgacctagaaaagaaactttctgacgctaattctactttcaaagaaatgagattccccaaggtcaaggaccccatggtagatgacgaccctgtctccgaaaattatgatcagataaatgtaccaaaacacagagcaccggatgctacaggtaatcctcgtacaactaacaaagtctccaatacttcagaccaagatagcagactaaaagccattgaaagaaccctctcggtcctcacaaattatgttatgaggtcagaagacggtaataacgacaggatgtcacccttaccttctcctttaaatacgatattgccaataaataatcgtctgaattttcaagagccaaagagatataatccaaccgttaaggtaaatccgtctgatgacgatatcatgatgtatgaaagtgcagagctgaagcgtgtcgaagaagaaatagaggagctaaagagaaaaatacttgttaggaaaaaacatgacttaagaaaattgtctttaaataaccaactccaagagctgcaaagcatgatggacggtgatgacaatataaaacttgacaatgtttcgaagcataatcatgctacgcatcgtcattcttcccaatccagtcgcgattactcaccctcttcggatgcttgcttggagtgttctaatgatttatacgagaaaaatagagtcaagcctgaaaataatatgtcagaaacattcgcaactcccactcccaataatcgatga

SEQ ID NO: 2502 - DNA, 1092 bp, Saccharomyces cerevisiae
atgatgaatgaagaggattctacagaaacgaaaagcctagtcataactaatggcatgtttatcatagacgacatcgagcgtagtaaatataatattcactataagaatgtcccaggaggcggagggacttttgccattttgggtgcatgcataatatcttccggcaatgtcacatccaaaggtttgaagtggatagtggacagaggctctgactttccaaaggaagttataagggaaatagactcatggggtactgatgtgaggtttcgagatgactttagcagattaactaccaaagggttgaattattacgagggaagtgatgatttgagaaagttcaagtttttgacgccgaagaagcagattaacgtcgatgactggatttccacatttgggcagaagataattgatgaaatgcatgcgtttcatttgctatgttctgggtctagatgcttagacataataaacgatctgctacgggtgaaaagttcaaagggcacaaaaccaatcgtgatttgggagccattcccagatctttgcgactttgatcatcaaaatgacattaaaagtgtaatgcagaggaacgatgttacggtaatattatctccaaatgccgaagaatcaagtcgcttatttggtttaagtagcaaggaaccgactagtttggaagaatgtctagcattagcgcatcgtttcgatgatttcatggatgaaaacaatatgtgtattctacgatgcggtgccctcggaagcatatcggtaagtgagaagtttaagaacggacgaacctatgaccatttccccgcctaccatttcaaaactcagtctaaagtactagatcctactggcgggggaaactcgttccttggcggctttgcagtttcttatgccctaacgaaaagcttagatattgctagtatatgtgggaacatcgctgcaggcgcaataattgaacaattcggaataccgaggtacgatccaattgctaaaacctggaacggaatcacattcttggatagactgaaattttacctttcacagtccggtcttcaatataatataaacgatctttacaaaagtctaacacgatga

SEQ ID NO: 2503 - DNA, 1092 bp, Saccharomyces cerevisiae
atgattgggtccgcgtccgactcatctagcaagttaggacgcctccgatttctttctgaaactgccgctattaaagtatccccgttaatcctaggagaagtctcatacgatggagcacgttcggattttctcaaatcaatgaacaagaatcgagcttttgaattgcttgatactttttacgaggcaggtggaaatttcattgatgccgcaaacaactgccaaaacgagcaatcagaagaatggattggtgaatggatacagtccagaaggttacgtgatcaaattgtcattgcaaccaagtttataaaaagcgataaaaagtataaagcaggtgaaagtaacactgccaactactgtggtaatcacaagcgtagtttacatgtgagtgtgagggattctctccgcaaattgcaaactgattggattgatatactttacgttcactggtgggattatatgagttcaatcgaagaatttatggatagtttgcatattctggtccagcagggcaaggtcctctatttgggtgtatctgatacacctgcttgggttgtttctgcggcaaactactacgctacatcttatggtaaaactccctttagtatctaccaaggtaaatggaacgtgttgaacagagattttgagcgtgatattattccaatggctaggcatttcggtatggccctcgccccatgggatgtcatgggaggtggaagatttcagagtaaaaaagcaatggaggaacggaggaagaatggagagggtattcgttctttcgttggcgcctccgaacaaacagatgcagaaatcaagattagtgaagcattggccaagattgctgaggaacatggcactgagtctgttactgctattgctattgcctatgttcgctctaaggcgaaaaatttttttccgtcggttgaaggaggaaaaattgaggatctcaaagagaacattaaggctctcagtatcgatctaacgccagacaatataaaatacttagaaagtatagttccttttgacatcggatttcctaataattttatcgtgttaaattccttgactcaaaaatatggtacgaataatgtttag

SEQ ID NO: 2504 - DNA, 1092 bp, Saccharomyces cerevisiae
atgctagataacatgcaatttcattctccagcaccggaacatcctcaattgaatgggggtattaacaaaattcccgcttcccacaaaataggttacaaattaaaccagcaagtgcagagattggctgtggtcaggaataatattgaagagagattgaactcgatggaatcctcacacggacagatatccgatagtagcgttgtccgtgctatcgatgcaagtatcgatgacttcctaataccttcacctccattatcgccaaagctgaggcaatgccccataataagccagcctcagctggttaatgtggaaagcgaccatagggagctgatcatgttgacccccgtttgggaagcgggcttgaactctcagaagtacaaccataatacaaggaatttcttatcgcaatatagcttcttccgagatatgaaaacaacgaaaaggattcctaacaaagaaaataggaaattgaaagtggtaaaatctgttgtgaactcagaagctctgcccaagagaagaagatacgataggaaaattaagagaagatcaagggagttgtacgaagatgatggaaacaggtcagaaaactatgatgaagaaagtgctcaagaagttccagttagatcagtgactccgatacgtcaagttaaaaggtctcttcatactatttcttcgccattggcctcacagggcgtagtgaataatgtccccaagtatattccaagcatgtcgtgggaaaagttgccggattactcacctcctcttcacactttgccgaatagtaataataaagttttaaaagtggaatggaaaggctctccaatggacttgaatcatgatcctctcaaacagcgtctgcatcctgcagaactagttctcgcacagattctgagacttccatgtgatctttatttggactctaaaagaagatttttcttggaaaaagttcatagattcaaaaaggggttgccgttcaggagaacggatgctcaaaaggcttgtagaatagacgttaataaagcatcaaggctatttgcagcatttgaaaaggtaggttggttacaagataaacattttgaaaagtatttgtaa

SEQ ID NO: 2505 - DNA, 1092 bp, Saccharomyces cerevisiae
atggagcaccaacaattgcggaagtacgtcgaattgtacaataaggaggtcgaggaattctacaatggtgccgcgtcaggccgcccagctgagttccatccttccaaagtacatgtaaagagcatccatgaaaaggcgggtaccgccaatgctggtgtagaaatctctagcgttggtgtagactgggacagcgaggagaagaatacctttttctggtgcctttcacgctatagtatccaccgtgtagacgagtggcgctcattgttgcctcggaagagcgccatggagattctaggttattacaggttgttaaggagagcgagtgcgagcgcgagatcgcgtaaggcgggtgacgacggagcgcccattgcgtacgaaatgagcgctgagtgggttgccctggagacaaaactgagcgagacagtgatggccatcacggaaggcgcagccgaggttgccgatgaggaaggacactgcgagggccttatcgattatgaaagctggaaacgcaggtgggtggccatctactcgcacagccgtatcgcggagataagacccttgccccgccacgcgctgccgctatcgcgcagcgcgacgcagactttggagcgctgcgtaagtcgctacacacgtacattgctgtggtgcacggcccttgcgggtatggcttcccgcagcgtcagcgccagggcggccgaatctcgaggacacaagtcgctaccgacggtggtaactcgccggcaagttgagcgtgcactatgcacagaagcccgatcacgtgacctacacgtgcttccaaggcgcattgttttgacactgcgcaaatgggaactagactatccgcgagagggcaaactgttccgcaccaaggagatggcacatctgtttctacaaagccagttgtccagacgggatgcgcccccagtccatcaagacgaaaatcaagaaaatcaagaaaatcaagaaaatcaagaacaagataacactgcaagtgaaggtgaaagcgaggcagaaagggatgaaatcgacgaagcggacttgttccgatcagcattacatgaaaatcagttgctaaaatggttatccaaatga

SEQ ID NO: 2506 - DNA, 1092 bp, Saccharomyces cerevisiae
atgggaatgaagtacgtattgcctttgcgactaattggtctagcgtacctgttggtgctatttcaggtgcatagggtaactgggtgggagttgtcatatgagcagtaccatgcagcgcatctgaacgaagctatcaacccagacagcggttggaacaaaagtaccaagaacctgctgttgccttttaacagaacgcgcgtacccggatcggaaggctcgcgcgagatccagcgcttcatcatcgagcacttcaacaatacgctggcgggagaatgggccgttgagacgcaagcctttgaggagaacggttaccgcttcaataaccttgttatgacattacaaaacaatgcgagcgagtacttagtgctcgctgctcattatgataccaagatagcgcccacggggatggtgggcgctatcgacagtgccgcctcgtgtgccgcgctgctatatacggcccagttcctaacgcacatcgcgtgccacgagcgcacgaaagagtacaatgacttagagtcgaacactgtagtatcgaattctaccttgggtgtaaagatcgtattctttgatggagaggaggccattgaagagtggggccccgaggactcgatttatggagcacgccgattagccgcccaatggcttgctgacggcacgatgacaagaattcgcctattatttcttctggatcttttaggaagtggcgaagaggagccgctagtgcccagctactatgcagagacacatcaagaatatcagctgctcaatcgaatagaggatgacttgttatttcgacgtggagatgaaatcaacggcgaatcggcattagccgccgaagtcgcgcgtcaacgcaaacatctggaccccacggactatcgatttttagggctcgggcattcggtcatcggagacgaccacacgccattcctggccgccggagtacccgtattacatgcaatcccgctaccattcccaagtacatggcacaccgtggatgatgacttccggcacttagacgccgcggagactcgtcactgggcgctgcttgtgtgcgaatttgtagtacagtcactacgctcccgtaaccagtga

SEQ ID NO: 2507 - DNA, 1092 bp, Saccharomyces cerevisiae
atgggagaggtatacgaaaaaaataacatagattttgattcaatagccaaaatgttgttaattaagtataaggatttcatactgtctaaattcaagaaagctgcacctgtagagaatataaggtttcagaatttagtccatacaaatcaattcgcacaaggagtcctaggtcagagtcaacatctctgtacagtctatgacaatccttcatggcattctatagtcctggagacattggatctggatctaatatataaaaatgttgataaggaatttgccaaagatgggcatgcagagggggaaaatatatacacggattatctagtaaaggagctgcttcgctacttcaaacaagattttttcaaatggtgcaataaaccagattgtaatcattgtggccagaacacttcagaaaatatgacacctctgggcagtcaagggcccaatggagaggaatctaaattcaattgcggaactgttgagatctataaatgcaaccgatgcggaaatatcactagatttcctcgttataacgatccaattaagttgctggaaactagaaagggaagatgcggtgaatggtgcaatttatttactttgattttgaagtcgtttgggttagatgttcgctacgtctggaatagagaagatcatgtttggtgtgaatatttttcaaattttttgaataggtgggttcatgtcgactcctgtgagcaatcattcgaccaaccatatatctattcaattaactggaacaagaaaatgagttactgtattgcgttcggtaaagatggcgttgttgacgttagtaaacgctatatcctccaaaacgagctgcccagagatcaaatcaaggaagaagatttaaaattcctttgtcaatttataacgaagaggttgaggtattcgttaaatgatgacgagatataccaacttgcatgtcgcgatgagcaggaacagatagagctgattagaggaaagacacaagaaacgaaatccgaaagcgtcagtgccgcttcgaaatcatctaatcgtggtagagaaagtggatcggcggattggaaagcacagcgtggggaggatggtaaatag

SEQ ID NO: 2508 - DNA, 1092 bp, Saccharomyces cerevisiae
atggtatacacaacaccgcaacaacagcagagattcagctccacaccgcaatctagccacactcttatcttctcgccaatcagagccccttcaatgcaaacgccctcctcattggattaccaatcaccttcaattgttgtgtcatcgtcttcaatgaaggttcacggccggtcttccagtttcggtaaattttcactgtctattgggcaaaatggtaaggctacaatactggggcctataaacgtccttcccactgatacatcgaaaatggagaaacctgtaccaaagaaaaagcctgttacttctgaccgtgtcgaaaagactcgtatattatctttgttgaaaaaaatgagaaacaagagcagtactgtcaacaaaaaatatagtaaagtaccattaaagtctacgacaagtttgcaaccagcagctactgcaccttcaccactagtgtccaacatcataaagccgtctcccaaaaagttagcttccccaagaactccgaatgcaaactccaatttaaatctaaactttacttcatttcagattaaaacaggtttcactcccaatctcgatggaattttacttgaaaacttcacgtctcctaacacaaccgctgattcacagggtaattccgccagtaacatcataaataataatcacggtagcgcaaataataccaaccaatttctttttaatctaccacttcaatcatcaccaaggcaattcaggtctcctgcaagattaatagatccccttcccatatcggactggaacaccagtctcttgatgtcacccccaagaacgacgaattttgaatctgcaaacaatcacttcaattcaaattttgctcaagcatcgatgttaagacgcccttcactaccgcacatagatgaggtgattccacaggactctaatccagccaattactcagatagatcggactatctatctgtggaccagaacgccaataatcataatggtgcactttcagaacagacctataataatataatgaaatcttctatgatttcgttacctatagaaaaagatgatgccacaatggcactacgaaaacttgtctccagagagtag

SEQ ID NO: 2509 - DNA, 1092 bp, Saccharomyces cerevisiae
atgtctccgaagaatataacaaggtcggtgatcccggctatagatttgtattgccgcaaagcaaattttaaaactctaaaatcattgtcgatgatcctaggtagtaaaaaagaatggtatgacactaaaaaggcgccattgagaacctttttggtctctcgatgtggcattttcgagcagttgaggggtcgtctcgttgaagatggcaaagtcaacttgtttagtgttttcctgacaaacgactcattttctttttgcaagatgaccgttgatgataagttcaacactagcttggtcgattggcaaaaaataccctttgacagtacatttgcaactgacagaagacagaatatcagtttactacctgttgatacactgtttgcaactgaaaagatcatatcgattcttggtgtatctcctaatatgacgaatcttgtttctatagaaagagagcgatcagacctggtggattttaattgtaaactgcaatcaaacatcctagaacacctactatacgcgaaatgccaaggagtgtacgtaacttctaccaatgaaaaagctcgtttgcttgcagctgtctgcaatcctgaattcattgacaccttctggtgcgaattgactcccataagagtctcattaaaggaaaacccttccatttctgtacctcgagaatatcagatgtacgatccggtggtacgtgccactataaaggaggttgtcaccaagcgattactgcgatccgccttcgataatgacatcgacccgctaatgtgtcttcatttggataaaggctggaaacttaaattccccatactatcctcgacaacgggcctaaacttctccctgaaggattgtctttccctggacacaggaaaagatgcatctgatatgacagaggtgtttctcgctactatggagtcgagtaaagttcttcgtacgtatagcaacctcgttgacattgtgatgaaggacaatggtaggttggactcaggcgtcctaaagcaattcaacgactacgttaagcaagaaaagctcaatctacaacattttcaggccggttcctcaaagtttctcaaaggcgcaaagatataa

SEQ ID NO: 2510 - DNA, 1092 bp, Saccharomyces cerevisiae
atgtttactcgaaggtttattccagttgttcagtcaactaagcaaaacatcggtaaatatgtgcgaaaagatgctaggttcactttattaacatacaacatgctctcaccgtcatatatgtggccacaggtatacacatacgttgcagagccatacaaaaactggagttataggcacagactgctggagaaagaacttttgaatactttcaaggctgatattatgtgtctccaagaaatgaccgcaagagattatgaagattattggcacgattccataggggtagatgtcaattatgggtccaaattcatttccaagacacccccaaagtattggaaaaaaccggttaaagatatggacggtgtatctattttctataatcttgcaaaatttgactttatatcgtcatcagggatctacttaaaccagctactgaatgttttcaatcaaagggaactgaaatacttatacaataagaaggtaacattaaccgatggtgcttccaatgttattggtgaagacagcttattggatgttttaaaaggcaagaatcaggtatgcttattcgtatctctaagacataaggagacgggtactatttttgtcgttttaaatactcatttgtattggaaatatgacgaagttaagctaacacaatgcatgattataatgagagagttatcaaagatcattaagcagctcctaccgggagatgtaaaaggccaagaaagggtgaagattttattcactggtgatctaaattctacaagagattcgctagttgttaattttctgcaaggtcagatagttagccatggagaccttaatcttattaacccaatgaggccgtatttggatcgttgtgtctatgacgatataccaaaggattattttgtacatacgtgctattcaggaaaattgaagggcatctttgattacgtatggtaccatgattcagattttttactaactaagatcctaaccggtaatgaagtatcagacgaattgctagcgtctaatcagttgggtttacccaatgaaaaccatcctagtgatcatatacctctactaacagaattcaaaatactgtga

SEQ ID NO: 2511 - DNA, 1093 bp, Saccharomyces cerevisiae
atggttaagaaagttaataatccgctaaaaatcgattatcagaacgggataatagaaaatcggcttctgcaaattagaaatttcaaagatgtaaatacgcccaaactaagtatgtatctatgagatctaacagaaatcaggatcaattaactaactttcaaacatatataagtgcagtcaatgtatggagtataagaatagatccaagagactcgaagaaagtaatagagtatgtatatgatttttgcttttgtattcatggaagtaaactaactagtaaagtaggctaattcgaaacgattttcagaaaaatgaccctgtttcattgagacatttgaaaaggatccgcaaggacatcgagacctccaccttggaagtggtgttgtgttcgaaagagtatatttgcgacgaaggtgaaataaacaataaattgaagagtatttgggttggaacgaaaaagtatgaactgagtgatgatatcgaagtgcctgagtttgcgcccagcacaaaggaactgaacaatgcctggtctgtgaagtactggccgttgatttggaacggcaaccccaatgatcaaatattgaacgactataaaatagacatgcaggaagtacgaaatgagctatcgcgtgcgtcgacgttgtctgtgaagatggcaacggcaggaaaacagtttccaatggtgagcgtctttgttgacccatcaagaaagaaggacaaagtggtggcagaagatggcagaaactgcgaaaactcgctacccatcgaccacagtgtaatggtgggcatccgtgcggtaggcgaaagactcagggagggtgtagacgaagacgcaaactcttatctgtgtcttgattacgacgtctatttgacccatgagccgtgctcaatgtgctccatggccctgatccattctcgtgtgagacgagtggtcttccttacagagatgcagcgcaccgggagcttaaaattaacgagtggtgacgggtactgcatgaacgataacaaacagctaaactcaacatacgaagcctttcaatggatcggcgaggaatatcctgtggggcaggttgaccgggatgtctgctgctag

SEQ ID NO: 2512 - DNA, 1095 bp, Saccharomyces cerevisiae
atgaatgatgaaattaatgagccaccgcccaatatatgtgagcagtgcttaggtgatgaggctaatatacgaatgactaaaattccacaaggctctgaatgtaagatttgtaccttaccgttcaccttataccattttaagacgtctaaacgaagcaataatatcattaaaacattaatatgtgtacggtgcgccactcagagaaacatttgtcaatgctgtatgcttgattcaagatggcacatccctatacaactgcgggatcatttaatatcccttgtgaacgaggaaaacgttatgacggaggaagcaaaaaacgacatgatgaaaaggtttctgtcactaaaaaacgtgaaattaggaggagctcagattacgagtgatccgtcagaagcagataatatcgttgataaattgaaaaatatacttctgcgagcaacatcagatggcccaagtactccgttaataaaaaacacaactgcattgtataaaaatgaaaaaggtgcaaatgaggtcaaaaacttggaaaagtacgcgtccgtggacatttctcatattttgaagaaactacccttgaatgaatcgtttttaaaaaacccctccaccaaatcattttttctgtataatattgatgcctcgatccctgaatggaaaataactgatacagtttcgcaattattgggtataaagaaatggaaggatggaaattcattgtcattaatagtcaaccacaaggcgaagtgtggtggcctaagatttcaatctagtgaattgggggagcggtttgtcagtaaaataagtgagacacttgtcacaccaaagggcctaaagagaggagttttacttattgaccgttttagaatctttatcattccgtggtcgtctggcttttcagctgcgtcattcggaaccaacactgcagaaaatataaaacttagtttaagtttgaataagcttattcagttggagctagggctttcttttcctacaaaaagcacagataacgcaaagaatgacaagaaaaagacatcaaaaaaagttcataaggacagatcaaagaaatcgaaacctcgcgctaacaagttaacaatatag

SEQ ID NO: 2513 - DNA, 1095 bp, Saccharomyces cerevisiae
atgatttctattgtattggaattgttccagaacttgtgctgctgtcgcggattttccgatgctactattagggtaaatgataaacgatataggattcaacgactacttggagaaggtggaatgtcctttgtgtatttggtacaactgtcaaagaattctctgattatagacaacggcatcgcaacaccagaattatacgcactaaagaagattatttgtcctagtgtggaaagtatatccaatggtatgcgagaaattgaaaattacaaacggtttcaaagtccttatgttataaaaagtatcgactcacaagtaatgcaggaaaaagatgggtcaaaaacaatttacatagtactaccctattattcattagggagtttacaagactctattaatcggaggttactcgagggcacctttgtatcagaggcagaatgcgtaaggataatgcttggagttacaagaggtttactttgtttacatgatcctgcgtcaagacaagataacgctacttccagagtaaatgtcgatgcggtttctatgacttatagcgatgaaacggcgatgctcctagaagacacccccttagagatggacatgctttcctccaactcagcaggttcaatagcatatgcacatcgcgatattacaccttcaaacattttgttctcttcagacggtttaccagtaattggtgacctcggctcctgctctcaagctgatataacaattgaaaacagacatcaactcagcgaactacaagaatgggtcaatgacaattgtacgttgccatatactccaccagaacttctgaacttgaaattaaatcaggttttgagctctaaggttgatatttggtctttgggttgtacgttctatactttaatgttcggtatctccccctttgagcgagaagagcagatacatggagcttctttaacctacgctataaacactggtaagtacagtttcccgagaaattccagattttctgaggggcttttgagtgtaatcaagaaatgcattcaagtggatcctatacaaaggcctactaccagccaattattaaatcttttacaagatttagacacttga

SEQ ID NO: 2514 - DNA, 1095 bp, Saccharomyces cerevisiae
atgcaaactgtgttgaaatatttgttgcttattatgtgtggaagcttttgtgcttcggaggaattgcaaaaccagaccaatgttcctgcaatattcttctcttacaaactgtatgtagaacaagaaacattaatctttagtaactttcatttttcttactaactagatgttatacacatatttgtacttttggatagaactcccggtattttaaagtatcaagaggattatgatagggctgtgactttaccaagagacacctttattgaagcggctgagaaattcttaggtgtatgtaatgctgacacttatgtgtttattaatcaaccaggcctgaggaaattggacttcttggaatttgaaacagagtttgtttcgttacagagatatataagacggagttcaaccgcgattaagttcgaaaaggtagacctattgcctcaagatttatactatgatcttgcagagtttgtaaaggagtattgtaacgtagaccaggtgttgaacttacgaggtaataatacagaagatttccagccctttattgatagcgaaaaaagagtgattataatagagtaccctaagttaccagaggacactaatgaacgtaaagaagcattccgccattatgacaagtatttgaggactatactggcgcagattccgtcgccagaacaaaatgtcatttacacctcgttaaacccaggaactacgctggctcacgagtcgatcatccctatccaaatatttccagatatctttgacataaaatccagagtgggtgaagtggaacaaaataatagagttttggatgtgcctcgtctgtcgtttaatgactatactccacgattttcagagccaccttcggagtatgtctcaatatttgattcacaattaattgagaataacagaggtttattacagctgattttcacaattttggttgggtatattcttattcagttttttttcacaaaaaaaactattgtagatgagaagattactaataaaaaggacaacgtgaaacagacgtcaccacaactgctcaaaaaagtgcaagagatccagaaaaagccatcccagcaagtatcttga

SEQ ID NO: 2515 - DNA, 1095 bp, Saccharomyces cerevisiae
atgccaagtacgtcgttaatcttctccttttaaggggttgagaatatttttattaaaaaatcatacttgctatgattttgaggatcgggtcctcataaatattttgaagagcctttgttgaatttttttcttttcgttttgttcaataatggacggttcttcatagaatactttttttttcggagaaaacctttacactgaactcccgacacttcaggtaaagcgttccgaagtaattcaacattagaagaggaacatttccccagttctgattatgtctgttgaagataactcaagtattctaggcttaatacagaaatgtgttaggtttgagaactccatcatggattatgcatattcgtcagtgacgtgcacaattcttttgaagataggaagaacaaaacttcaataattgctttaataatatttatgtagtgatcttgatcctcgcattcgtttgaaaaagagagcgctcactaacaatggttgtaattatcttgtaaaacaggagccccaagaacatattccaagacttactctaccccaaagagaccttacgaatcttctcgtttggacgcagaattgaagttggccggtgaattcggtttgaagaacaagaaggaaatttacagaatttccttccagttatctaagattcgtcgtgctgcaagagacttgttgacaagagacgaaaaggacccaaagagattgttcgaaggtaatgctttgattaggagactagttagagtcggtgttttatccgaagataagaagaagttagattatgttttagccttgaaggtcgaagatttcttggaaagaagattgcaaactcaagtctacaagctaggtttagccaagtctgtccaccatgcaagagttttaatcactcaaaggcacattgctgttggtaagcaaattgtcaacatcccctctttcatggtcagattggactctgagaagcacattgactttgctccaacatctccattcggtggtgctagaccaggcagagttgctagaagaaatgctgcaaggaaggcggaagcttctggtgaagctgctgatgaagctgatgaggccgatgaagaataa

SEQ ID NO: 2516 - DNA, 1095 bp, Saccharomyces cerevisiae
atggctggaaatgcaaactcagtagacgaggaagttaccaggatattaggaggcatatatcttggcggaatccgtccaattattgaccacagaccattgggtgcagaatttaacattactcatattctttctgttatcaaattccaggtcattccagagtatctaataaggaaaggttacacgctaaaaaacatacccatcgatgatgatgatgtgactgatgtgctgcaatacttcgatgaaacgaaccgattcattgatcaatgcttgttccccaatgaagttgagtattcgcccagattagtagatttcaagaagaaaccacaacgtggtgctgtttttgctcattgtcaagcaggactctcgagatctgtaaccttcatagtagcctacctaatgtatcgttatggattgtcactatcaatggctatgcacgctgtcaagaggaagaaaccgagtgttgagccaaacgagaatttcatggaacaattacatctctttgagaaaatgggtggagattttgtcgatttcgacaacccagcctataagcagtggaagctgaagcaatctatcaagttagatccatcgggcagcgaattggtctccaattctggaatgtttaaagattcggagtcgtcgcaagacttggataaattaactgaagctgagaagagcaaggtcaccgcagtgagatgtaagaagtgcagaaccaaattggcgttatctacatctttcatcgcgcatgacccaccaagtaaggaatcatcagagggacacttcatcaagagggccgccaactcccatcgtattattgatattcaagagtcacaagcaaattgctctcattttttcatcgaacctttaaaatggatgcaacctgaactacaaggcaagcaagagttagaagggaagttttcatgtccaggctgttcaagtaaagttggcggttacaactggaaaggatctaggtgcagttgtggtaagtgggtcatccccgctatccacctgcaaactagtaaagtggatcaatttcccttacaatccactgctttgcccaacatggttaattttgaatccgagaaagtaaatagataa

SEQ ID NO: 2517 - DNA, 1095 bp, Saccharomyces cerevisiae
atggtacaagaaatcgatttaggtttgacatgtgatatgcatgttcatgtaagagagggtgcgatgtgtgaactagtcacccccaagattagagatggtggggtttcaattgcttacatcatgccaaatttacaacctccaattaccacactagatagagtgattgaatacaaaaagacactgcagaaactagctcctaaaactaccttcttaatgagtttttatctttcaaaagacttaactccagatttaattcatgaagctgcccaacaacatgccattcgtggagtaaagtgttatccagcgggagtaacaacaaattcggctgctggggtggatccaaatgacttcagcgcattttacccaattttcaaggctatgcaagaagagaacctggtattaaatttgcatggggaaaaaccttctgtccatgatggagacaaagaacctattcatgtattgaatgcagaggaagcctttttgccagccttgaaaaaattgcataatgatttcccaaacctgaaaataattctggaacactgcactagcgagtcggcaataaagacaatcgaggatataaataagaacgtgaagaaagccactgacgtaaaggttgctgccacattaacggctcatcacttatttttaacaattgatgattgggccggaaatccggtaaatttttgcaaacctgttgcgaaacttccaaatgacaaaaaggctctagtcaaagctgctgtatcagggaaaccatattttttctttggatctgattcagcacctcatcctgtacaaaataaggccaattacgagggtgtttgcgcaggagtttactcacaatcttttgcgatcccttatatcgcccaagtttttgaagagcaaaatgccttggagaacttaaagggctttgtttccgacttcggaatttccttttatgaggttaaagatagcgaagtggcttcttcagataaggcaatattattcaaaaaagaacaagttatccctcaggttatcagcgatggcaaagacataagcatcatcccatttaaagcaggtgataaactaagttggtcggtgagatgggaacctcgttaa

SEQ ID NO: 2518 - DNA, 1095 bp, Saccharomyces cerevisiae
atgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgttccacttccagatgaggcgctggaagcctccaagaaggctgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccaccgaagtcggtgatgctgtcgccgaagaagttaagaaaatccttgcttaa

SEQ ID NO: 2519 - DNA, 1097 bp, Saccharomyces cerevisiae
atgtctgttacaggaactgagatcgatagtgatacagcaaaaaatattcttagtgtagatgaattacagaactatggtattaatgcctcagatcttcaaaaattgaagtctggtgggatatacacagtcaatgtatgttataataacatttttaaaacctctgctgtagaggttctttccccctttcttttactaactaataatttggaaaggaacttttatagaccgttttgtcaacaacaagaagacatctatgtaaaattaaagggttaagtgaggtgaaagtggaaaaaattaaagaagctgctggaaaaatcatacaggtgggatttatccccgctactgtacaattagatataagacagcgtgtgtactccttatcaactggatctaagcaactagattcaatcctaggtggtggaataatgacaatgagtatcactgaagtatttggtgaatttaggtgtggtaagacacagatgtctcatactttgtgtgttaccacgcagcttccgagggaaatgggtggtggtgaagggaaagtagcatatattgatacagaaggcactttcaggcccgagaggattaagcaaattgcagaaggttatgaattggatcccgagtcatgtttggcaaacgtttcatatgctagagccttgaatagtgaacatcaaatggaacttgttgaacaattgggtgaagaacttagttctggagattatcgccttatcgtggtagattctataatggcaaacttcagagtagactactgcggtagaggtgaactaagcgaaagacagcaaaagctaaatcaacatcttttcaaattgaatagattggcagaggaatttaatgttgcagtatttctgacaaaccaagttcaatcagacccaggtgcttctgcattatttgcctcggcagatggtaggaaaccaattggagggcacgttctggcacatgcgtcagcaacaaggattttgttgagaaaagggcgtggtgacgaaagagttgccaagttacaagattccccagatatgcctgaaaaagaatgtgtctacgtaattggtgaaaaaggtattaccgattcaagtgactag

SEQ ID NO: 2520 - DNA, 1098 bp, Saccharomyces cerevisiae
atgaaattatccgctctattagctttatcagcctccaccgccgtcttggccgctccagctgtccaccatagtgacaaccaccaccacaacgacaagcgtgccgttgtcaccgttactcagtacgtcaacgcagacggcgctgttgttattccagctgccaccaccgctacctcggcggctgctgatggaaaggtcgagtctgttgctgctgccaccactactttgtcctcgactgccgccgccgctactacctctgccgccgcctcttcttcctcctcttcctcttcctcctcttcctcttcttcctctgttggttctggagattttgaagatggtaccatttcctgttctgatttcccatccggacaaggtgctgtctccttggactggttaggtctaggcggctgggcttccatcatggacatgaacggtaacaccgccacctcttgtcaagacggatactactgttcttacgcttgttctccaggttacgctaagacccaatggccttctgaacaaccttccgatggtagatccgttggtggtttatactgtaagaacggtaaattataccgttccaacaccgacactaacagtttgtgtgtagaaggtcaaggctctgctcaagctgttaacaaggtctccggctccattgctatctgtggtaccgattatccaggttctgaaaacatggtcgttcctaccgtagttggcgctggttcctcccaaccaatcaacgtcatcaaggaggactcctactatcaatggcaaggtaagaagacctctgcccaatactacgttaacaacgctggtgtctctgtggaagatggttgtatctggggtactgagggttccggtgtcggtaactgggccccagttgtcttgggtgctggttacactgatggtatcacttacttgtccatcattccaaacccaaacaacaaagaagcaccaaactttaacatcaagatcgttgccaccgatggctctaccgtcaatggtgcttgctcttacgaaaatggtgtctactctggctctggctctgacggttgtactgtttcagttacttctggttctgctaactttgtcttctactag

SEQ ID NO: 2521 - DNA, 1098 bp, Saccharomyces cerevisiae
atgagtgatcttgacgaagaaagtcaaattgaaactcagatcgatgctcctatcgaagatattatacgaggatctgagcttaccactacaaccgctgataaagagactttgaaatctgcaaatgaattattagattctctagaacactcgcacagagtcgacctttcgttgcatttatactctgcgtacctcttgaaaagactattgtataaggcaaatgaaaaaaaacatttttatgaagtaaaccagtttgtgaagacccaaattaaggataactggacgagctggcctaatcccaatacaattattgaccctagtgtagacaaattgtatgaagatataccggaaggtattgcaaatgtaagcgtacagccgggggagatctcaaatagggctttaatgcacgcctctgatatgatgagggttgagctggatgctcaatggcaaaaatttctctctaagtctgccttggaccatgatgtaactctagatgtggatgaattgaacattccaaacgaaatatcccggaatatcttagttaaactggacagcttattcgaagggttgcatgataaaatagccaaagagaacgaattcgatgtaaggcaagataagcattctaataatataagggcgaatcagatagacgacgagcccatgcaggccaatcgacgaattaaatacacatatcatgacttggtttcaagaggttgtgaaatgaacgaggatatgacggatatctacatgaaatcattagagctatataacgatatcccagaaaagtataaaaagagaaaattcagactgcccaaacaaattctaaaaaagtatcaccagccaaaaaagaccagttcatacttaaaggagctattaagtaaaacaagagaagatttcatacctgtggaaaagttattgaaggataaacggttgacatcaaaggacaaatccaagctacaacgcttaaatcgtgaagagacggaagatgctctaaacaaaagaacattttttcaggtaaagggctacttagaggatgagaatgagatctctgattacgagttggacgactgcctcatagaactgcctaatgggaacatatga

SEQ ID NO: 2522 - DNA, 1098 bp, Saccharomyces cerevisiae
atgccacctctacccgtgctcaacagacctcaaattcatacgtctgttactgaaataagtcatgcaattgatcgtacaatcaaggaagagctctttcccgttgcctacactactgaagaagagcaatatttcaaaactaaccctaaacctgcctatatcgatgaattgattaaggacgctaaagagtttattgatttgcagtattccctgaaaaggaacaaaatagttcttatcacctctggtggtactactgttccattggaaaacaatacagtacgttttatcgataatttttctgcaggtactcgtggtgcatcgagtgctgaacagttcttagcgaacggatatagtgttattttcttacatagggaattctcattaactccgtataataggtccttctcccatagcattaatactttattcttggactacattgattctgaaggtaaaatcaaacctgaatttgctgagaatgttttgaagaacaaaaagctttatgacaagtatatggagaaagaggagaaactacttttactaccattcaccacggtcaaccaatacttatggtcactgaaaagtatagccaagctattgaataatagtggttgcttgttttatttagctgctgctgtcagtgatttttttgttccatattcaagactacctcagcacaagattcaatcaggagacaacggtaagatgggagcaaataatgacactgaaggtacaactaggactacgcctgatggtaaactgattgtgaatcttgaccctgtccctaagtttttgagaagattagtggaatcatgggccactcaagcgatgatcgtttcgttcaaattagaaactgatgaatccatgctgctttacaaatgtacacaagccctggatagatacaaccatcaactggttatcggaaaccttttacagacaagaaacaaacaggtcattttcgtatcccctgaaaacagaaagggagattgggtacgtttggatgaaaaacaccatagcattgaagagatgataatcccagaagtcatcgcacgccatgacaaatgggtggcgcattcgaaaactaagctagctacgaaataa

SEQ ID NO: 2523 - DNA, 1098 bp, Saccharomyces cerevisiae
atggatttggtcttagaagtcgctgaccattatgtcttagacgacttgtacgctaaagttctgcccgcttcgttggcagctaatattcctgtcaagtggcagaaattgctagggttgaacagtgggttcagcaattctacgattttgcaggagactttgaactccaagaatgccgtcaaagaatgtagaaggttctacgggcaggtgccattcctgtttgatatgtcgacgacgtcttttgcatcgctattgcctcgttccagcatcttgagagaattcctctcactatgggttattgttacgatctttggtttactactttacttattcacggctagtctcagctacgtgtttgtgtttgacaagtcgattttcaaccatcctcgttacttgaaaaaccaaatggcaatggaaatcaagttggcagtcagtgctatcccatggatgtcgatgttgaccgttccatggtttgttatggaattgaacggccattctaaactatacatgaagattgattatgaaaaccacggtgtaaggaagctcattatcgagtacttcactttcatctttttcactgattgcggtgtgtatttagcgcacagatggttgcattggccaagggtctaccgtgctctgcacaagcctcatcacaagtggctggtctgcacacctttcgcatctcattctttccatcctgtagacgggtttttgcaatccatctcgtaccacatctacccattgattctgccattacacaaggtttcttatttgattctgttcacttttgttaacttttggactgttatgattcatgacggtcaatacctatcaaacaatcctgccgtcaacggtactgcctgccacacggttcaccatctatatttcaactacaactacggtcaattcaccactctgtgggacagactagggggttcttaccgtagaccagatgactcattgtttgatcctaagttaagagatgctaaggagacctgggacgctcaagttaaggaagttgaacatttcatcaaggaggtcgaaggtgatgataatgatagaatctatgaaaacgacccaaataccaagaagaacaactga

SEQ ID NO: 2524 - DNA, 1098 bp, Saccharomyces cerevisiae
atggctcaaaattttggaaagattccttctcacaagtcttacgtattgagcttatatcggaccgttctcagaaacattccaaagtgttgccactcatatgcgtttcaatatgaaataaaaaaaacactttcaatacaattgttcaaacacaagcatgacaagtcaagttggagtgtttatactttactcaatgaattcagtttgttgaacaattgccttttggaaggtaaattacaagaaatcaaaaacttaatgaagccattaaaaaagatgaaaaaacaactgaaaacaacgaaaatcctcaactctttgacttcattaggggatgtaaagaccaacgacccagaagaagtaagaagatttcatgttctaagtgcttacattaagcgaaaacaagatttgggccttttacctgcatacataccaaaaacgtatcagcacaaactcctattaccattagcattgaacgaacatgcgtgcctgaaactatttcatattcagcaaaaattgaaaaatggcccaccttctgctgggctgtcatatacaaaagaaggaaggaatcaaatatggtttgttcggtcaccaattaacaagggcagacaacaatcgaaaaagctgggaatattgatacgaaaagaaaggaaggattctcagaaaaatatcgataatctcaatttttgcgaaattaatgctgcttgggcattacatgaggccatttgggaggaatatctagagtcgaaaaagattattaaagtaaacttaccgaaatacttggaatacgctgcaaatatcccaaagtctactaaatgtaatccttcgagtcaatatcagaaagttaaagaatgggtagatcccgtgagagaaataatgttcgaattacattccaaaagttttcaaagagtggagtactttaacaaatataaggaaaagcttttaaagaacggtggccaactagcatattttgataaaaagtcaaaagaaatgtacgccaaacggttgacactattcagaaaaatgagcaaagaaacattaccatatgtgacactctttatagaagggagggacttgccaagtgttttggcgaaatacggtttttaa

SEQ ID NO: 2525 - DNA, 1098 bp, Saccharomyces cerevisiae
atggctggaaagaaaattgctggtgttttgggtgctactggttccgttggtcaacgtttcattctgttgttggcaaatcaccctcatttcgaactgaaagttcttggtgcctcttctagatcagctggcaagaaatacgttgacgctgtgaactggaagcaaaccgatttgctaccggaatctgctaccgatattattgtttccgaatgtaaatctgaattctttaaagagtgtgacatcgtcttttccggattggatgctgactatgctggcgctatcgaaaaggaattcatggaagctggtatcgccattgtttccaatgccaagaattatagaagagaacaagatgtgccattgattgttcctgttgtcaatcctgagcatttggatattgtagctcaaaagcttgacaccgccaaggctcaaggtaagccaagaccagggttcattatctgtatttccaattgttccactgcaggtttggttgcaccattgaagcctttgattgaaaaattcggtcctattgatgctttgaccactactactttgcaagcaatctcaggtgctggtttctccccaggtgtaccaggtattgatattctagacaatattattccatacattggtggtgaagaagacaagatggaatgggagaccaagaaaatcttggctccattagcagaagacaagacacacgtcaaactattgactccagaagaaatcaaagtctctgctcaatgtaacagagtcgctgtttccgatgggcacaccgaatgtatctctttgaggttcaagaacagacctgctccatccgtcgagcaagtcaagacatgcctaaaagaatacgtctgcgatgcctacaaattaggctgtcattctgctccaaagcaaactattcatgttttggaacaaccagacagacctcaaccaaggttggacaggaacagagacagcggttacggtgtttccgttggtagaatcagagaagacccattgttagatttcaaaatggttgtcctttcccacaacaccattattggtgccgctggttctggtgtcttgattgccgaaatcttactagcaagaaacttgatttaa

SEQ ID NO: 2526 - DNA, 1098 bp, Saccharomyces cerevisiae
atgggaaagaaaaatagaaagggaaaagaaaataatgctgctaaaacctcttttctaaaagtagagaatattaaaaacactaattcgggattggagcttccatcgcaagactatacaaacgttgaagaaaaagaaagtagcccgaaaactgactttccattaattacaaaggaacatgtaaacacgaaaactgacagcaatattctcgattatcccaccataggcgatttagtttcctcagtagagaaattatgtgtcttgaaagaattgaagatagcatttccagaagtagatgatacattaattaaagccattttaattgcctcccaaggggttttggagccggcattcaattctttactctactactcaagtccggaggaaaacactgactttgcattaccaatgaagccgataagtgtggaagactatagtaaaataaatgtgtctgagattttgcaacgtgaaatattcgatgatattgaagacgaattttctggtcaaggaataaatggctccatggtaatttcaaaaattgaatcagaactaagttctttggccgaacacattggcaacattagcacccccggatcgaatagagaagtcgccgaatcgactaggaacgtggctgttgcagagggccataatacaattttatcaaacgaagatagtatactcaagggaaaagagaagggaaaagaggaggaaaaggagaagggagaagaaaagggagttaacagcttaaaaggcgccgctgtgaaagttgttgcgaagtcattgaagaataatcgcattcccgtcactgtgaagagaaatgagccttcaaacaatttatttgacgttttaaactgcgacgaaagcgaggaagaagaagagcaagatgtcgaaaccaatacgtcgaatcaagaaaggaagaaccagggcggtaatactgaagtgccggaggctcagcgtgacagtgcagataggttacctgccaaggacgacggtggatacaaatctgcctttggcactgatagttgtggtctatttgcagctgacgctaaagatgaaaaaaagcaggttcatccatctagacaagaattaagttttacgtag

SEQ ID NO: 2527 - DNA, 1098 bp, Saccharomyces cerevisiae
atggtattggctaaacaatgggttttgaaaaacctaccaactcctggtgaaccatttaactttcattttcacgatcctgcatgtactttcgagctcattgaaaaggaactctcttcagaacaattaaaggacggtgaattactactggaaacaacttatttatctaatgatcctgcccaaaaattttggatatcatcaatggacaaaaattacgccaaaggtgtccagcctggtgaaattattcctgcaagaggaattggtaaagtcttggcctctagaaataaagcattctctcctggcgattatgtctctgcagtgaccggctggactacacatgccataatttcgcaagaaaatgttcaagggctgagaaagcttgacaaaaacaaagttggtaaattatggtggtatctctctgtcttaggtggtacgtctttaacagcttattttattttctttacttatgctcaattgcaagaaagagaagaggactatggaaaagtttacctaatctccggtgcagctggtgccgtcggtaccgtttgcattcagctggccctaaacgtttttaaggcttcaaaggttattgctatcgcaggtggaccagaaaaggttgcttttgttgaatcctttggtgataatgtagtcggtgttgattataaagatccaagtttcaagcagaaacttatcgaggccgctggaggtgagaataccgtggattactttatcgataatgttggcagtaatgtgttggaagcaggtgttctacttctaaagcaaagggctatgttgatagcctgtggtgctataagtgcctataatgatccatctaaatttgtctttaaggggtatagctttattctgactaaacgattggtcgttaaaggagtactagtgacagataatattgatgattttccaaaggcattagataaattgggttctctggttaagcatggtaagattgacctcttgaaatccgctacccttgaagatggtaccggtgataagttcaagaatgttccattgatatggaagggtctatttagcggtgttaataaaggtaaacttattaccaaggttaacaatgaggagtga

SEQ ID NO: 2528 - DNA, 1098 bp, Saccharomyces cerevisiae
atgtcagacgagattgtaaccaacaaatctgttacttatgttaacaatactactccagtcacaattacatcatcggagctggacttgagatcatgttatcaagatgacgaagttgttatagaagtccatgctgctgctttgaatccaattgattttattactcaccagctttgtaactcctacatatttggcaagtatccaaagacttattctagagattacagtggtgtcatcattaaagcgggaaaggatgtcgacaatcgctggaaggttggcgacaaagtgaatggtatgtacagtcatatttatggtgaacgtggtactttaacacactacttgatactcaaccctgccaaagatgtacccatcacacatatggtggaggttccaaaggacgaaaatgacccatatgacgactttgtatatgctgctgcctggcccctaacatttggtacagccttttctacattatacgatttcaagaaagattggacttctgattcgaaagttctggttattggcgcttcaacctctgtgtcatatgcttttgtccatattgcaaaaaactacttcaacatcggcactgttgttggcatttgtagcaagaattccattgaacgcaataagaaattaggatatgactacttggttccctatgacgaaggatccatcgttgagaatgttaagaaattaaagcaaagcgtgttggaaaacgacaaatttgacatgatttttgattcagtgggtaaccatgatttcttccctgtcattgatcaatttctaaaacctaaggcgaaaaattccttttacgttacaattgcaggaaataacaaggccgattataagaatatcagttggagagatttcgtatcattgagttctattttaaaggctataaacccattcaaaaaatacaactggcgctttggacacccttatccccccaacaacttcattgaagttggcaacgaaatgatcaagaagggcacttataagccacctattgattccgtctacgagtttgatcaatataaagaagctattgacagactgatgtccaacagagctaagggtaaagtggttgttaagatgaaatga

SEQ ID NO: 2529 - DNA, 1098 bp, Saccharomyces cerevisiae
atgtctttttttaatcgatcaaatacaacctcagctttgggaacgagtactgcaatggcgaatgaaaaggatttggccaatgatattgtcattaatagcccagcagaggactcaatatcggatattgcgttttcaccgcaacaagatttcatgtttagtgccagttcctgggacggtaaggtacgtatttgggatgtccaaaatggtgtacctcaaggtagagcgcagcatgaaagctccagccctgtattatgtaccagatggtcgaatgatggtacaaaagtagcctcaggcgggtgtgataatgccctgaaattgtacgatattgccagtggtcaaacacagcaaattggaatgcattctgcgccaataaaagtattacgttttgtacaatgtggaccatcgaacacagagtgtatagtaaccggatcctgggataaaaccataaaatattgggatatgagacaaccccagcccgtatccaccgtaatgatgcctgaaagagtatattcgatggataataaacagtctctgttagtagtggctactgccgaaagacatatcgctattatcaatctagcaaacccaacaacgatttttaaggcaaccacgtcacctttaaaatggcaaactcgatgcgtggcatgttataatgaagccgatggatatgcgattggttcagtggaaggtagatgctccataaggtatatcgatgatggtatgcagaaaaaatcaggcttttcatttaaatgccatcgtcaaaccaatcctaatagggcacctggctccaatggtcaatctctagtgtatcctgtaaatagcattgcatttcatccattatatggtacttttgttacggctggtggtgatggtaccttcaatttttgggataagaatcaaaggcatagattgaaaggctatcctactttgcaagcatctattcctgtatgcagcttcaataggaatggtagcgtatttgcgtacgctctaagttatgattggcatcaaggccatatgggcaacagacccgactatccaaacgtcattaggctacatgccacaactgatgaagaggttaaagagaaaaagaaaaggtga

SEQ ID NO: 2530 - DNA, 1098 bp, Saccharomyces cerevisiae
atgttgcttatgagacgctttgcctttttaacttcttcagtatattttaaatatataccaatttattcacaatatcattactcttctcagtttccaattaacatgaatcctaaaaaagtggcccaattgcccgttcacaataaatcaacgcttccaccacaggaaataatcgatctttttaaaataacattcttagaagagctatatccaaaagatcaagacaatgaaaagtcaccgttaactgaacaaatacaggcggtaaaatctgacctttataacagagattacaatgctgctttcaataacgactcgaaaagaatagcatattgttgtcgttggtcaccgtccagagcaacaagttacgcatcagtatttgcacatttccctgagcttctaaagattatcagatgcgaaattgatgacaaggactcaaatgtgctctgcataggtggcggcgctggtggtgagctggttgcattagcgagcatattcactttatcgagagatttttcgtctaaatttgcctctgctttgaaaatagacaacgaagtaaacaaaaagcctagaaatttaaacatacaactagtagatatcgccgactggtccacagttgttgaaaagctaacagctacaataaagtcgaaatggctatatggtgattcagaagcagagtcatttaacgtcaactttacccacaaggactgcctacaaatgacagagccacaagatatcaagatatatcaaggcctcgacctaataactctactttttactacaaatgaactatttacacagaaaaaagtggagagtataaaatttctgcaacggttaaacgagaactgtgccccaggctgccatcttctcatactagagagtgcaggaagctattctcacattaccatcaacaacaagaagttcccaatccaatttcttatcgatactatcttagtaggcaatagaaaggacaagggaacgacaggtccatggtcactagtatccgagaacgacagtatttggtatagaatggacccaaaactcgactactcgattccattggaaaacatgcgattcttttaccgtctttatgtcaagaactaa

SEQ ID NO: 2531 - DNA, 1101 bp, Saccharomyces cerevisiae
atgaattacatggcttatgattatgatccccaacattcgttggaaacgtcctttaacaatttggcatttcatccccaccaacagtcacagcaacaagccctatacgaatctggtgaaagaaacgatgccaggccgggattaatgaacaccttaggtcaggcgagtaaaatgaataattccatgcttcctcaaggttcgtcggctagtcccttaacgggtcaacatagcttgaacagtacaacaaatttcaacatgcccccatcaatgaatacctataattaccagaatgtaccacaagcatctatgagaaatactctcaatcataacaatatcatgaatggggcaactgctaatgattattggctggatccaatgaataatatgacaaataacaaggatactaatgggaatcctaatgactcgatgtcatcaatgtctaatatgaccgctaaaacctcaatcaatagtacggcattcaagaattcatttgttccttttaatcatgtgacagcgctctcaatgaataatgtcaacagcaatgagatgaattcaaataaagatgacagaatggaagcattggaagtagaactacaaataaaggaaagtcaaatcgaatcactcgagaacgaaattcaaaggctaaagaaaattttcaacgaggggctaaactacaagcagaatgagcataagtatgagaaggaaaactgccatataccccaaactttcgaattgccagcttccttggaagtgatattcagaaaactgtcatcgtcactgcatgcaaaggaaaaggagttagcagagacgaaagaaaatctggaaagtatattaactgcactggcgctaaatccaacaaattcagtgactaagtatggcaggtatgatgcagaatcgattgctcacaaaatggtggtaagattagaaaacttaacaaacgagaacaaagaaatggccaagatgttagcatatggcagatcaaaagagacccaaattgaactgcagttggccaaaaaagaaaatctagaattaagagaaaaaatcgcatctttggaagcccatttggcttcaaaggagtcttcaaaggaggacgttgctaattga

SEQ ID NO: 2532 - DNA, 1101 bp, Saccharomyces cerevisiae
atgacgtggatactaagtactggtatgggccctcatgaggacaagtatgccaagcatgagcgagcgacctttaaaaagacgtacagttctatgaaaacgctgtctttgaatcatttaactgccaagcagcatatgctgatggccttatgcagggacatatcccttttaccgccgttaacttacatcttcacatctctgcggaaggcttggagagtctccatgcgcaccagcataacgctttacgagccacaatcactaagagatgcgttcacttatttctggcaaaaactcaatagcgcttacgacaataactcatcatttgaaggagcttcgcaaaaggctgtgaatggcgacggtaaggattcactcctattatccgcactcactacagcaagagcgtctgaatatctcctttgctcactttggtgcctggtgtctttatacctctcgtatgccattctcgactctttgatggtccgatggatcgtcaagtactctactgtggccgccattttaagaatgttttccatgtcattgatcattgtcaccttagaactccttcttttgtcgtctttgtctccggaactcgactattttttgcatacatggatactcattagttgtgtactaacagcagtgtacatttggcaaagttatcttacctcggatctgaggtatatcaggaaccaggaaggcgaagtacaagaggatactaatgttccagaagaaacagaagactatgaggatggtgaagatgacgctgatgaagactcacatgttgtggtagccgacgaaagtacagtagatgttccttccaacgacagtctctccgataacagtgatggcggattgtttcctgttaacaggccctcagtctctcattcacaaagccctaaaagacccaaaaaatatccaaaaaaagcattcaattttaccactaagcgaacgatagatctatataaaatcacggttctttgtgtcgtccctgtgggactagctagttttatcaccatgttaggtttactgcgaaacctgttcatccaaagattggatgtagagcaattagaaagaatactgcatgaaatgcatccccccgcatga

SEQ ID NO: 2533 - DNA, 1101 bp, Saccharomyces cerevisiae
atgactgctgaagaatttgatttttctagccattcccatagacgttacaatccactaaccgattcatggatcttagtttctccacacagagctaaaagaccttggttaggtcaacaggaggctgcttacaagcccacagctccattgtatgatccaaaatgctatctatgtcctggtaacaaaagagctactggtaacctaaacccaagatatgaatcaacgtatattttccccaatgattatgctgccgttaggctcgatcaacctattttaccacagaatgattccaatgaggataatcttaaaaataggctgcttaaagtgcaatctgtgagaggcaattgtttcgtcatatgttttagccccaatcataatctaaccattccacaaatgaaacaatcagatctggttcatattgttaattcttggcaagcattgactgacgatctctccagagaagcaagagaaaatcataagcctttcaaatatgtccaaatatttgaaaacaaaggtacagccatgggttgttccaacttacatccacatggccaagcttggtgcttagaatccatccctagtgaagtttcgcaagaattgaaatcttttgataaatataaacgtgaacacaatactgatttgtttgccgattacgtcaaattagaatcaagagagaagtcaagagtcgtagtggagaatgaatcctttattgttgttgttccatactgggccatctggccatttgagaccttggtcatttcaaagaagaagcttgcctcaattagccaatttaaccaaatggtgaaggaggacctcgcctcgattttaaagcaactaactattaagtatgataatttatttgaaacgagtttcccatactcaatgggtatccatcaggctcctttgaatgcgactggtgatgaattgagtaatagttggtttcacatgcatttctacccacctttactgagatcagctactgttcggaaattcttggttggttttgaattgttaggtgagcctcaaagagatttaacttcggaacaagctgctgaaaaactaagaaatttagatggtcagattcattatctacaaagactgtaa

SEQ ID NO: 2534 - DNA, 1101 bp, Saccharomyces cerevisiae
atgagtgatcgcaatacaagtaacagcctgaccttaaaagaacgaatgttaagtgccggtgctggatcagtactcacttctttgattttgacaccgatggatgtagtgagaatacggctgcaacagcagcagatgattcctgactgttcatgtgatggggctgccgaagtgcccaacgccgttagctcaggctccaaaatgaagacattcaccaacgtcggaggacagaacttgaacaacgcaaaaatattttgggagagtgcttgttttcaagaactgcactgtaaaaattcatcgttgaagttcaacggtactttagaagcattcacgaaaattgccagcgtcgaaggtattacaagtttgtggaggggtatttctttgaccctattaatggctattcctgccaacatggtttattttagtggttatgaatatataagagacgtttctcctatagcctcgacgtacccaacattaaaccccctcttttgtggtgcaattgcgagggtatttgcagcaacaagtattgcacctttagaattggttaaaactaaactgcaaagtataccgagatcatcaaagtccacaaagacatggatgatggttaaagatttattaaacgaaacgaggcaggaaatgaaaatggtgggtccttctcgggccctcttcaaaggtttggagatcactctgtggagagacgttccgtttagtgcaatatattggagttcctatgaactttgcaaggaaagactatggctagattctactcgatttgcatctaaggacgcaaactgggtccattttataaacagttttgccagtggttgcataagtgggatgatagctgctatatgcacacacccttttgatgtcggtaagacgagatggcaaatatccatgatgaacaatagcgatccgaaaggcggcaataggtctagaaacatgttcaagttcttagagactatatggcgtacagaaggtcttgcggccctctacacgggcctggcagccagagtaattaagatacgcccaagttgcgccatcatgatatctagttatgagatctccaaaaaagtatttggaaacaaattgcatcagtga

SEQ ID NO: 2535 - DNA, 1101 bp, Saccharomyces cerevisiae
atgcaatcgagcttacctcaatttacgttcaaatggcccaaaggacccgaagcaattattctgacaggcacgttcgacgactggaaaggtactttgccgatggtgaaggaccccagtggcgccttcgaaataacgctgccagtaacgtttgatagccctagcagcaagttttatttcaagtttattgttgatggccaatggctgccaagcaaagactacaaggtgaacatcgacgagggagtggaaaacaactttattaccgaggaagacgtaataaagcaacgcgaaaatggctctagcacgctggtacctgaaagtgccggattagctgtttcaaagaatgcccctcttatcgaaccagaagctgaaaaacgtgcaaaaaaattaagaaagttcaagatcaagagagtgatcaagacaaataaacaaaccggagaaaggtcgatattttcccaagaagtggttgaattgcccgatagcgaggatgaaacccagcaggtgaacaaaacgggcaagaatgcggatggcttaagcggtactacaacgataattgagaataatgttggtgtaaacgaggaaaaagcaatcaagccgtatgaagagaatcaccccaaagttaatctagttaagagtgaaggatatgttacggacggtttgggtaagacgcaatcttctgagtctagattatatgaactatcggccgaagatcttgaaaaggaagaagaggaagaggacgaagataaaggcggcggtaaggacaccagtacaagtgcagacgctgaagcttcagaagatcaaaataaggaaccattaagtaaatccgctaaatttgaaaaaccggaagaaaaagtacctgtaagctcaattacaagccatgctaaagagacttctgtgaaaccaaccggcaaggttgcgactgagactcaaacttacgagacgaaacagggcgctcctaccgctgccgcaaaaaaaatcgaagctaagaaagctactagaccttcgaaacctaagggcacgaaagaaacaccaaataaaggtgtccaaaagaaccctgctaagaatggagggttctttaaaaagttggcccagcttttgaagtga

SEQ ID NO: 2536 - DNA, 1101 bp, Saccharomyces cerevisiae
atgctgtggaaaaattatgttctatccagttcccgaataacacgtaggcttcataagtcacctagaaagagcagcttctctaagaacttttttatcacaggctgcctactgacagttggagcagtaagcagttatttaacctacaggtacacaagtgagagggaaaacaaacatgagttatctccatcttattttgtcaagtacaagatttcacacaagcgagatattgattcatcacattttttattggaagtaactccgttgtttaagcagaaagttaacatatggtcattgatgactgcggaaaatctgtggtccgtcgagatcaaacaaccggaagtcatggtggtccgcaattatacgcctctaccgcttaaatttaacccagcttcaaaagagattgaaatcttaaaagatggtgacaatgcagatggaaaattatctttctatattaagaagtatgagaatggagaagttgcaagatggttacaccatcttcccaagggacatataattgaaataagaggcccgtttatcgattatgagtttcctcatttgcctaatgagctaaaaagatctcgcgattgtttatacatggataatcgcaatgaaaggggcaataacgttagagaaaattcccaatttatttaccagccttatgacataatgatgttcaccgctggtaccggaatagttactgcgttgcaactacttttgactgaatcaccatttagaggtactataaagttatttcatacggataagaacattaaacaactgggacccttgtatcctatccttttaagacttcaagcttcaaacagggtccagttaaaaatttttgaaacagaccgacaaactaaacaagacgtattgaaaagtatccagaaatcaatcacgaagccctacccatacaaaggtctgctccccttttccaacgttaacaacaagaatattatgcctgtgttggcattggtatgcggccccgaaagttatattagtagcatatctggaagaaaatacgatcttaatcagggaccagtaggagggttactttccaaagaaggctggaactccgataatgtgtataaactttcataa

SEQ ID NO: 2537 - DNA, 1101 bp, Saccharomyces cerevisiae
atggcggtgttgtgtggtgtatgcggaataaaagagttcaaatacaagtgtccaagatgtttggtgcaaacttgctctttggagtgttccaagaagcacaagacaagggacaattgctcaggtcaaacacatgatcctaaggagtatatatcgagtgaggcgttgaaacaggcggacgacgacaagcacgaacgaaatgcttatgtccagagggactacaactatctgacgcagttgaagcgaatggtgcatgtacaaaagatggatgctagaatgaagaacaagcgggttctggggcctgtgggcggccacaactctaatttcaagaagagaagatacgatatagatgaggatgatcgtgatagcacggagtgtcagaggataattaggaggggggtgaactgtttgatgctacccaaggggatgcagcgatcatcgcaaaacaggagcaagtgggacaaaacgatggacctatttgtatggagcgtggagtggattctatgtcctatgcaggaaaagggtgagaaaaaggagcttttcaaacatgtcagccaccgtatcaaagagacagactttttggtgcaagggatgggcaagaacgttttccaaaaatgctgtgaattctatcgcttggctggaacaagctcttgcatagagggcgaagacggttcggagaccaaagaggaaagaacacagatcctacagaagagtgggctcaaattctacacgaaaacgttcccttacaacaccacgcatataatggattcaaaaaaactggtggagttggctatacatgagaaatgcatcggagaattgttgaagaacaccacagtgatcgagtttcccacgatattcgttgccatgacagaggctgacctaccagagggctacgaggtgctacaccaggaaccccgcccacttgagcatacgagtacactgaacaagtttattgacaatgcaagggaggaggaagacgctgaagaggactctcaaccgacagaagaacctgtacagaaggaaacacaggacgccagcgacagcgacagcgacagcgacgatgactacaatccgggcttatccatggatttcctcactgcatga

SEQ ID NO: 2538 - DNA, 1101 bp, Saccharomyces cerevisiae
atggcgtcagtaacagaacaattcaacgatattattagcttatactcaacaaaattggaacacacatctttgaggcaagattcaccagagtaccagggattattactttccacgatcaagaaattattaaacttaaaaacagcaatttttgacaggttggcattgttcagtactaatgagaccattgatgatgtgtctactgcttccatcaaatttctagcagttgattactatttaggattattgatatcaagacgacagtcgaatgattcggatgttgctcaaaggcagtctatgaaattgatttacctgaaaaaaagcgttgaatctttcattaatttcctgacactattgcaggattataagcttctagatcctttggttggtgaaaaactaggtaacttcaaggatcgttataaccctcagcttagcgaattgtacgcgcaaccaaaaaataacaaagatttatctggagcacagttgaagagaaaagaaaagattgagctattccagcgcaataaagaaattagcacaaaactgcactgcttggagttggaattaaaaaacaacgacgaggaccacgaccatgatgaattactaagagaactatatttgatgaggttacatcactttagtcttgatacgattaacaacattgaacagaatttatttgaatgtgaaatgctctctaatttcctcaaaaattccgtacatgaagtcaaatcatcaggtactcagatacgaaaagaatcgaatgatgatgattccactggttttaccgataaattagagaatataaataagccattgatagacaaaaaaggtcaagtcttgaggaacttcacgcttgtcgacaaaaggcaacaactgcaacaaaaagtgcgaggatatggtcaatatggaccaacaatgtcggtggaggaatttttagataaagagtttgaagaaggtcgcgttcttcaaggtggcgaagaaccagagcaagcaccagatgaagaaaacatggactggcaagatagagaaacctataaagctcgtgagtgggacgagttcaaggaaagtcatgctaagggaagcggaaataccatgaatagaggatag

SEQ ID NO: 2539 - DNA, 1101 bp, Saccharomyces cerevisiae
atgtaccatgttcctgaaatgaggctacattaccccctggtgaacactcaatctaacgccgcaataacacccaccagaagttacgacaatacccttccttcgtttaacgagctatcacaccagagtacaatcaatcttccattcgtccaacgcgaaactccaaacgcatatgctaatgttgcccaattagctacgtcgccaactcaggctaaatcagggtattattgtcgctattatgctgtgccttttcccacatatccacaacaaccacaatctccatatcaacaagctgtacttccttatgccaccattcccaacagcaatttccaaccatcttctttccctgtgatggcagtgatgcctccagaggttcaatttgatggatcattcttgaacaccttacatcctcacacagagttgcctccaatcattcaaaacactaatgatactagcgtcgcacgtccaaataaccttaaatcaatagcagcagcgtcaccaacagtgacagcaacaacaagaacacctggcgtcagttcaacgtcagttctcaaaccacgcgttataactacgatgtgggaagatgagaatactatctgctaccaagtagaggcgaacggtatatcagtcgtgcgtagggctgacaacaacatgattaacggcaccaagttgttgaatgtcacgaagatgacaagggggagaagggatggaatattaagatccgagaaggttagggaagtcgtgaagattggctccatgcacctcaagggtgtttggattcctttcgaaagggcttatatcctggctcaacgtgaacagattctagatcatctgtacccgctcttcgtcaaagatatagaatccattgttgatgccagaaagcccagcaacaaggcatctttgacccccaaatctagccctgcccccatcaagcaagaaccatctgataataaacacgaaattgctactgaaattaagccgaagagtattgatgctttatcgaatggagcatctactcagggtgctggcgaactgccccacttaaaaatcaaccatatcgatactgaggcccaaacaagtagagcaaaaaatgaattatcataa

SEQ ID NO: 2540 - DNA, 1101 bp, Saccharomyces cerevisiae
atgtctgaaaaatcagctagcaataacaaagctgaattcaaaaggcagtcatcgccattcagagaaatcatctctgcggatcacccaatttataaacctgctaagggaaggtactggctgtatgtggcgctaccatgcccatgggcacaaagaaccttgatcaccagggccctgaaagggctagcgcctataatcgggtgcagtgtagcgcattggcacctggatgacaaaggctggcgattccttgaagaaggagatgggaaaaccaatgaaaggcactggtttgacattgcaggcggaattagctcagtaaatttaaataccagtactcctgtggctaacatacccaataacgcgcatcggttgttggtcgacggaacagatgaaccgcattacgggtacaagagactaagcgacttctatttcaaaacaaagccagactataagggaagattcaccgtacctgttctttgggacttggaaacatgcactatagtaaacaatgaaagcagtgatatcatcggaattatgaattccgctgcgtttgatgagtttgtcggcgaagaataccgtcaagtccgtctggtacctcggtctctagaggcacagattacagagttcaactcttgggtgtacgataaaatcaacaacggtgtatacaaggccggttttgcagaatgtgcagaggtatacgagagggaggtaacaagcctttttcaatatcttgacaaattggaaaatcttctggacaagaagtacacagatttggaggcggagtatggtaagaacaacaaggacaagatactagatcgctactttgccatcggagacactctgaccgaggcggacgtgagactctacccaacgatagtaaggttcgacgtggtataccatcaacacttcaaatgcaatctggccaccatcagagatgattattcccgtatacacacgtggctcaagaatatatactggcgccacgaagccttccagcgcacaacggactttacccacataaaactcggatatactcgctcgcagccacgggtcaacccgattgggatcaccccactggggcccaagcctgatatccgacctccatga

SEQ ID NO: 2541 - DNA, 1101 bp, Saccharomyces cerevisiae
atgttttccagactgccaacatcattggccagaaatgttgcacgtcgtgccccaacttcttttgtaagaccctctgcagcagcagcagcattgagattctcatcaacaaagacgatgaccgtcagagaggccttgaatagtgccatggcggaagaattggaccgtgatgatgatgtcttccttattggtgaagaagttgcacaatataacggggcttataaggtgtcaaagggtttattggacaggttcggtgaacgtcgtgtggttgacacacctattaccgaatacgggttcacaggtttggccgttggtgccgctttgaagggtttgaagccaattgtagagtttatgtcgttcaatttctctatgcaagctatcgatcatgttgtcaattccgctgcaaagactcactacatgtctggtggtactcaaaaatgtcaaatggtcttcagaggtcctaatggtgctgcagtgggtgttggtgctcaacattcacaggacttttctccttggtacggttccattccagggttaaaggtccttgtcccttattctgctgaagatgctaggggtttgttaaaggccgccatcagagatccaaaccctgttgtatttttagagaacgaattgttgtacggtgaatcttttgaaatctcagaagaagctttatcccctgagttcaccttgccatacaaggctaagatcgaaagagaaggtaccgatatttccattgttacgtacacaagaaacgttcagttttctttggaagccgctgaaattctacaaaagaaatatggtgtctctgcagaagttatcaacttgcgttctattagacctttagatactgaagctatcatcaaaactgtcaagaagacaaaccacttgattactgttgaatccactttcccatcatttggtgttggtgctgaaattgtcgcccaagttatggagtctgaagcctttgattacttggatgctccaatccaaagagttactggtgccgatgttccaacaccttacgctaaagaattagaagatttcgctttccctgatactccaaccatcgttaaagctgtcaaagaagtcttgtcaattgaataa

SEQ ID NO: 2542 - DNA, 1103 bp, Saccharomyces cerevisiae
atgatattaatattattaataataattttaactaataataaagtttttatagaaactttatattattatttaatatttaattttcaattaatatctccttttggggttccggtccctggtccggcccccgaaactaaagatattaagaatttatatgaatcaattataaataattatattaatattttaaataaatatcttattaatattaataaagataatattaataaattaaaatttttagataattatactgaagaagaaaaaggttattatttatctggattatttgaaggagatggtaatatttatactagatgtttttcaattactttttctttagaagatgttttattagctaattatttatgtctttattttaaaattggtcatattacagctaaatataattttaataaagaattaacagctgttaaatgaaatattataaaaaaaaaagaacaagaagtatttataaattatattaatggtaaattattaacatataaaagatatgatcaatattttaaatataattttaataatcgtttaaatattaaattattaaaacctaaagaatttgatttactattaaatccttgattaacaggttttaatgatgctgatggttatttttatctaggttttcaaaaacataaaaatagtcaatgattaaaatttcatttagaattatcacaaaaagatagttatattttagtccggcccgcccccgcggggcggaccccaaaggagatattattaaaaaatattttaaacttggtggtattttaaaaagagattataaatctggtgctacagcttatatttataaagctcaatcatcaaaagctataaaaccttttattgaatattttaataattatcaaccattaagtcttagaagatataaacaatatttattattaaatattgcttacttattaaaattaaataaattacatatattacttaattctttattaatattaaaagaattaatattattacaaagtgttaaaaatatatctttagaaataaaaaatgaattaaataatagagttaaaattattattaataaacttcattataacaatatcgaataa

SEQ ID NO: 2543 - DNA, 1104 bp, Saccharomyces cerevisiae
atgcaacgcaatagtttagtaaatatcaaactaaacgctaattcgccatcgaaaaagaccacaacaagaccaaatacgtccaggatcaataaaccatggagaatatcccattcgccgcagcaaagaaacccgaattcaaaaataccttcacctgtaagagaaaaattgaacagattacctgtaaacaataagaagtttttggatatggaaagctccaaaattccatcacctataaggaaagcgacttcttccaaaatgatacacgaaaataagaagctacctaaatttaaatccctatcactcgatgactttgaactggggaagaaattaggaaagggtaaattcggtaaagtttattgcgttcggcacaggagtacaggatatatttgcgcactgaaagtaatggagaaggaagaaataataaagtataatttacagaaacaattcagaagggaggtagaaatacaaacatcgctaaatcatccgaatctaactaaatcatacggctattttcatgatgaaaaaagagtgtacctgctaatggaatacttagtcaatggggaaatgtataaactattgaggttacacggacccttcaacgatattttagcatcagattatatttatcaaattgccaatgccctagattatatgcataaaaagaatattattcatagagatattaaacctgaaaatatactaatagggttcaataatgtcattaagttaacggacttcggatggagtataataaatccgccagaaaatagaaggaaaactgtctgtgggacaattgactacctttctccagaaatggtggagtcaagggaatatgatcacactatagatgcatgggctcttggcgtcctggcgtttgaactactgaccggtgcccctccgttcgaagaagaaatgaaagatactacatataaaaggatagcagcactggatatcaaaatgcccagtaacatttctcaggatgcgcaagatttaatacttaaactactaaaatacgaccccaaagatagaatgcgccttggagacgtaaaaatgcatccttggatactaagaaacaagcccttttgggaaaataagcggttatag

SEQ ID NO: 2544 - DNA, 1104 bp, Saccharomyces cerevisiae
atgcacacaatgcatattccatccggtgatgttctgataccgaagccgaagcttattactgaagaaacagatccactgcatataataaagacgaggcaaaagacacatggtcggcccgtgaccattgcaggcccaatggttcggtattccaagttaccattccgtcagttgtgccgagaatataacgttgatatagtttactcccccatgattttggcaagagaatatgtccgtaatgagcatgcaagaatctcagacctttctacaaataatgaggacaccccgctaatcgtccaagtaggtgtaaataacgtggctgatttactaaaatttgtggaaatggttgccccatactgtgatggtattggtattaactgtggttgtcctataaaggaacaaatccgagagggcataggttgcgctctgatatacaattcagatttgttatgcagtatggtccatgctgtgaaagataagtatggcgacaaactaagaattgaaacgaaaataagaatacatgaggcattggacgagacggtggagttatgtagaaagctatgtgatgctggggtagattggattacgattcatggccgaacacgtagaactaggtcatcgcagccggctaacctggatgcgataaaatatatcatcgagaacatcagcgacaaaaatgtgcctgtaatagcgaatggggattgttttaagttatccgatttggaaagaatcaccaaatacactggtgcacatggtgtcatggctgtgcgtgggttgttaagcaatccagcgttatttgctggatatactacctgcccttggggctgcattgagaagttttgttattgggctctagagtttggtggcttgccttttcaattggctcagcaccatctgtactgtatgcttgaaaatatggagttgaagaaatctctgttaaagaaaatgatgaatcttaaaaattacattagtctgatcgactggtttaataaaacctttgagttcaagcgttacggcgaggatggatttggcatgggcgttgaaattccttataaagctaatagctgtgtgcagaggagcgcctcagtggttgagagacaagaatga

SEQ ID NO: 2545 - DNA, 1104 bp, Saccharomyces cerevisiae
atgcacataaatgtgagaggaactaggaaaataatttccaacgtttcatccttcacaccaagatatgaatttccaaagtacagtatgcctctcactgatttcaagggacaccaagtcaaagctcttaaaacatttgaaaagttgcttcctcaaatgaatatgataatagaactacgtgatatacgtgccccgttatctacaaggaatgtggttttcgatcgaatagcaagaaaggaacacgatgtgatgaaattagtggtatacactagaaaggatcttatgcccggcaataagccatatataggaaagttaaagaattggcatgaagagctgggagaaaagtttattttactggattgccgaaacaaaactgacgtcaggaatctactaaaaatactagaatggcaaaattacgaactagaaacaaatggcggatatctacctatgggataccgagcattgattactggcatgccaaatgttggaaaatctactttaataaatagcttgaggacaatttttcacaatcaagtgaatatgggaagaaaatttaagaaagtagccaaaactggtgcagaagctggtgttactagagccacaagcgaggttattagagtaacttcacggaatacggaatcaagaaatgaaatatacttgatagatactccaggaatcggtgttcccggtcgcgtttcagatcataatagaatgctaggactggcgttgtgtggtagtgttaaaaataaccttgtagatccaatatttcaagcggattaccttttatacctaatgaacttgcaaaatttgaacgatggaagaacagagctttaccctggaagcaccaattctcccacaaatgatatatatgatgttttaagaaggcttcaagtgaataaaagccaaaatgaaaaatcaacggctatcgagtggactaacaaatggaggttgcatggaaagggtatcatatttgaccctgaggtactgttgaataatgacgagttttcttataaaaactatgtaaatgatcaattggaaaagttaggagatctttcgtatgagggattgtctaacaaactaaaagggaaccccaatcaagtattctag

SEQ ID NO: 2546 - DNA, 1104 bp, Saccharomyces cerevisiae
atgccgcgaattactcaagagatatcttacaattgcgattatggcgacaatactttcaaccttgctattgatataggaggcactctggctaaagtagtcttctcgcctatacacagtaacaggctgatgttctacaccattgaaacagagaaaattgacaagttcatggaacttctgcattctattatcaaagaacataacaatggatgctatagaatgactcatataattgccactggtggtggcgccttcaagttttatgatttgttgtatgaaaattttcctcaaataaaaggtatatcgaggttcgaagaaatggaaggcttaattcacggtttagactttttcattcatgagattcccgatgaagttttcacttacaacgatcaagatggcgaaaggataatacccaccagttccggcaccatggactcaaaggctatctacccataccttctagtcaatatagggtcgggtgtctcaatattaaaagtcaccgaaccaaacaattttagtagagtaggcggttcttcactgggaggaggaactctttggggcctattatcactaattactggcgctcaaacttatgatcagatgctcgattgggcacaagagggtgacaattctagcgttgatatgctagttggagatatttatggaacagactataataaaattggtctaaagtcgtcagctattgcaagttcatttggtaaagttttccaaaatagaatgacatctaacaaatctttggaaaacaacgaaaataaattatattcctcacatgagtctattgagaaaaacaatggacaaatgtttaagaatcctgatatttgtaaaagtcttctattcgccatctccaacaatattgggcaaatagcttatttgcaagctaaaatcaataatatacagaatatatactttggcggatcttataccagaggacatttgactaccatgaacactttgagctacgctattaatttttggtcacaaggatcaaagcaagcgttttttctcaaacatgaaggctatttgggtgcaatgggtgctttcctaagcgcgtctcgtcattcatctactaagaaaacaagtacgtag

SEQ ID NO: 2547 - DNA, 1104 bp, Saccharomyces cerevisiae
atgccttcgacacctagctttgttagatctgctgtctcgaaatacaaatttggtgcgcacatgtcaggtgccggtggaatttctaatagtgtaactaatgcatttaacactggctgtaattcgtttgccatgtttttaaaatctccaagaaagtgggtttctccgcagtatacacaggaggaaatagataaatttaagaaaaactgtgcaacttacaattataacccattgacggacgtcttaccgcatggccaatactttattaatttggctaatccggatagggaaaaggcagaaaagagttatgagtcattcatggacgatctgaacaggtgtgagcaattagggataggcctgtataacttacatccaggttctactttgaaaggagaccatcagttgcagttaaaacaactagcctcatatttgaacaaagcaattaaggaaacgaaatttgttaaaattgtattagaaaatatggctggtactggaaatttagtaggaagttctctggtagatttgaaggaggttattggaatgattgaagataaatcaagaatcggcgtttgcatagatacatgccatacatttgcagcaggctacgatatcagcaccactgaaacgtttaacaatttttggaaagagttcaatgatgtaatagggttcaaatatctaagtgctgttcacttaaatgattccaaggctcctttaggagcaaatagagatttgcatgaacgcttgggtcaaggttatttgggtatagatgtgtttagaatgatcgcgcactctgaatacctgcagggtatccctattgtcttggaaactccatacgaaaatgatgaaggctatggtaatgaaatcaaacttatggagtggttggaatcaaagagtgagagcgaattgttagaagacaaggagtataaagaaaaaaatgatacgctgcagaaattaggtgctaaatcgcgtaaggaacagttagacaagtttgaggttaaacaaaagaagcgagctgggggcaccaagaggaagaaagccactgcagagccaagcgataatgatatcttgtcacaaatgacaaagaagaggaagactaagaaagaataa

SEQ ID NO: 2548 - DNA, 1104 bp, Saccharomyces cerevisiae
atggcattcaagttatggctactggatgaggaaacaatatacgagcacgtgttcgaacggtacacacaattggagggccagtccgggaaactggcgcaggatttgggtattcaggatagaaggggcggtgtgctagagataacgtttgaaccctctgggctggaaggcggcagaaaaaaaaagcgagtgagaagaagaaataaggctagtagtgttgaagaagatcagaatgttgctgtggatagctatcatgttagcgtggggcagtccatatcaagcttgcgctcgtccagagacaacggaaactccaccacaggatacgttttgtggtctaccacacctttcttcatcaactggctgctgtatagtactagcgctgcacctttccgtcttgggagtcaggtggaagtaacctgcgggtcttcttgcgaggggcacaagcttgagttgcccaggctggtcgacctcacgggcgctgatcgcggcaagagaggtatcttggaacttggagcaggaatatcaggtattttgcccgtgattcttggtaacttcgtcgacacctacgtgtcgacagatcagaagggcattcttaataaattaaaagataacatcatggaaaacttatcacagttgaccagaaagcggtgcatttcccgatcactaagattggaacttcccaccgtcgaaccagttggcgacgctgatatcaccgcagcgtcacttccatctaagtctacgttgcatttggaagtagccgctctagactgggagaagataaacttgcaagacaaaaagacccactctctgcatcctgagttgtcactcataggtgaaacatgttcttccgtgtacgttatagctatggatgtcatatacaacgagtacctgatagatccgtttctgaagacgctcaagcaactcaaacactggttacaaactacctacaatttgcaattccatgtcctcgtggggatacacttgcggtcacaagaggtgacaacactgttcttggagaaagccatcatagaatatgacttcacggtttatgatatcgttgaccaggtcatacaagagtcccgttttaacttttatcttatcacctag

SEQ ID NO: 2549 - DNA, 1104 bp, Saccharomyces cerevisiae
atgtcaatatcatcaaagataagaccaactcctcgtaaaccttcacgtatggctaccgaccattcttttaaaatgaaaaaattttatgccgatcctttcgctatatcatcaatttctttggcaattgtatcgtgggtcatcgccatcgggggctccatctcatctgcatccaccaatgaatccttcccacgttttacttggtggggtatagtataccaatttctaattatttgttctttaatgctgttctattgttttgatttagtcgatcattacagaatcttcatcaccacatctattgcagtggcatttgtgtataatacaaacagtgcaacgaatttagtgtatgcggatggtcccaagaaagctgctgcttcagcaggtgtcatcttactttccatcataaatttaatctggattctgtactacggcggtgataatgcttccccaaccaatagatggattgattcgttttccattaagggtatcaggccttcgccattagagaattctcttcatagagctcgtcgaagaggcaataggaacacaacgccttaccaaaataatgtctataatgatgctatacgagactcaggctacgcgacacagtttgatggatatccacagcagcaaccttctcacacaaattatgtatcttctacggcattggctggttttgagaatactcagccaaatacttcagaagccgttaatcttcacttgaacactctacaacaacgtatcaatagcgcaagcaacgcgaaggaaaccaatgataatagcaataatcaaaccaatactaatataggtaatacgttcgatactgatttttcaaatggcaatacggaaactacgatgggagacactttgggtctgtatagcgatatcggtgatgataatttcatttacaaggcaaaagcactgtacccatacgacgctgatgacgatgatgcttacgaaatctcatttgaacaaaatgaaatcctacaagtctctgacattgaaggcagatggtggaaggcaagaagggcaaacggtgaaacaggtattattccaagcaattatgttcaactaatcgatggtccagaagaaatgcatcgttaa

SEQ ID NO: 2550 - DNA, 1104 bp, Saccharomyces cerevisiae
atgtcatcttccgcccccaaatacaccactttccaagggtcacaaaattttaggttacggatcgtcttggcaacattatcagggaaaccaataaaaattgaaaaaatccgttcaggcgacttaaatcccggtctgaaagattatgaagtgtcttttctaaggctgatcgagtcggtcaccaacgggagtgtaattgaaatttcttataccggtactactgtgatttataggcccggtatcatagttggtggtgcatcaactcatatctgccctagttccaaaccggtaggttatttcgtcgaaccaatgctatatttggctccattttcaaaaaagaaattttctatattattcaaaggcataactgcatctcacaacgatgccggtattgaagctatcaaatggggactcatgcccgttatggaaaaatttggcgttagagagtgcgccctacatactttgaaaagaggttcaccaccactaggaggtggcgaagtgcatttggttgttgattctttgattgcgcaacctataactatgcatgaaatagataggcccataatttcatcgattaccggtgtagcatactctaccagagtaagtccgtcgcttgtgaatagaatgatcgatggtgctaagaaggtattgaaaaatctgcaatgcgaagttaacataacggcagatgtctggagaggtgaaaattcagggaagagtccaggctggggtattactttggttgctcagtccaagcagaaaggttggagttattttgcagaagatatcggtgatgcaggttctatacctgaagaacttggtgaaaaagttgcctgtcaattattagaagaaatatcaaagagtgcagcagttggtagaaaccagcttccattagcaattgtttacatggtcatcgggaaagaagatatcggcagattgagaattaataaggaacagatagacgaaagattcataatcctcttgagagatattaagaagatctttaatactgaagtctttttaaaaccagttgacgaggcggataatgaagacatgatagctactatcaagggtattggtttcacaaacacaagcaaaaagattgcatag

SEQ ID NO: 2551 - DNA, 1104 bp, Saccharomyces cerevisiae
atgttacgaagatctattcataccactaaaatcctccaaaaacctaatgctacttcgcatatttggtcggactttaccacaaggcctagttcactttctatccaatcttcaaaagtgaaaaattaccttttccagaagaaagcttctctagacccaccatctatcagcagaagaagtaaccgtatcaaatattcacctccagaacacattgatgagattttcaggatgagttatgattttcttgagcaaagatccagtaagttttatgagttggccaataagactaaaaatcccttgaagaaggatgcacttctcataaaagcagagatcaataatcctgaggtacaatacaattttcagtttaataacaagttgaacaatgttaaggatataatagattatgatgtgccagtgtacagacatttggggaaacaacattgggaatcgtacggccagatgttattgatgcaaaggttagaaacgttggctgccattcctgatactcttccaactctggttccacgggcagaagtgaatatcaaatttcccttctctactggtgtaaataagtggatcgaacctggtgaatttctatcgtccaatgtcacatccatgcgtcccattttcaaaattcaagaatatgaacttgtgaacgttgaaaaacaattgtatacggtactgatagtcaatcctgatgttccagatttgagtaatgactcatttaaaacggctttgtgttacggattggtgaatattaatttgacttataatgacaatttaatagatccaagaaagttccacagttctaatattatcgctgactacttacctccggtacctgaaaagaatgctggaaaacagagattcgttgtttgggtattcagacaacccttaatcgaggataagcaaggtcctaacatgttagagattgaccgaaaggaactaagtagagatgattttgatatcaggcaatttacgaagaaatacaatctaaccgctattggggcacatatctggagaagcgaatgggatgccaaagtcgccgccgtcagagaaaaatatggcctaccacctggaagggtttttagcagagttagaaggtga

SEQ ID NO: 2552 - DNA, 1105 bp, Saccharomyces cerevisiae
atgaaggtatgatttatgatactattattgaggggcaacagagaactttatatgtggaaaaatggcatgaaagtttgaaagtgagaaagaactaaacagaaccagacgtcgtaaagattttagaaattttttatggaaagaagcaggaagactaccatatactaattgatgcgtttgtggcgttatttttaaacaaacagagcgggtttacatatactgttactacaaaccgtgaaattgaagcagttcatatacttggagtatagtcaataaaagacaagctttttcatcttccacttaataatttctctagagtaataaacttcaccctattcaaacattaattttgcaatagtatactaacaaattttcttaataacctgttgaaaatttaaaatagttgaacatttcttacccagttaacgggtctcaaaagaccttcgaaattgatgatgaacaccgtattcgtgttttcttcgacaagagaatcggtcaagaagtcgatggtgaagccgttggtgacgaattcaagggttacgtcttcaagatctctggtggtaacgacaaacaaggtttcccaatgaagcaaggtgttttgttgccaactagaatcaagttgttgttgaccaagaacgtttcttgttacagaccaagacgtgatggtgaaagaaagagaaagtccgtcagaggtgccattgttggtccagatttggctgtcttggctttggtcattgtcaagaagggtgagcaagaattggaaggtctaactgacactactgttccaaagagattgggtccaaagagagctaacaacatcagaaagttcttcggtttgtccaaggaagatgacgttcgtgatttcgtcatcagaagagaagtcaccaagggtgaaaagacttacaccaaggctccaaagatccaaagattggttactcctcaaagattgcaaagaaagagacaccaaagagctttgaaggtcagaaacgctcaagctcaaagagaagctgctgccgaatacgctcaattgttggctaagagattgtctgaaagaaaggctgagaaggctgaaatcagaaagagaagagcttcttctttgaaggcttaa

SEQ ID NO: 2553 - DNA, 1107 bp, Saccharomyces cerevisiae
atgaaactggatagtatagacattacacactgtcagttggtcaaatctactagaactgctaggatttataggtcggatacatatgccattaaatgtctagcactagatttcgatatcccgccacataacgccaaattcgaagtatcgatattaaacaaactgggcaacaaatgtaagcacatcttacctcttctagagtctaaggctaccgataataatgacctattgttgttgtttccctttgaagagatgaacctttatgagttcatgcaaatgcactataaaagagatagaagaaaaaaaaatccctattacgatttgctaaatcccagtatcccaattgttgcggacccccccgttcagaaatatactaatcaattggacgtcaatcggtattctttgtcctttttccggcaaatggttgaagggattgcattcttacatgagaacaagatcattcaccgcgacatcaaaccgcaaaatatcatgctaacaaacaataccagcaccgtatccccaaagttgtacataattgattttggcatctcttatgacatggcaaataactcacaaacaagtgcggaacccatggatagcaaggtgacggatataagcacaggaatttacaaggccccagaagtgctttttggagtaaaatgctatgatggtggcgtggacgtgtggtcgttgttgataattatttctcagtggttccagagagaaacaagccgtatggggcacgttccggccatgattgatgacggcagcgacgacatgaactcagatggaagcgatttcagactgatttgctcaatattcgaaaagttgggcataccgtccattcagaaatgggaagaggttgcgcaacacggctcggttgatgcatttgttggtatgtttggtgcagatggcgatggcaagtatgtactggaccaggagaaagatgtacagattagcattgttgagaggaatatgcctcgactggacgagattgcggatgtcaaagtcaagcagaagttcattaattgtatcctggggatggtttcattttcaccaaacgaaagatggagctgtcaaagaatcttgcaagaattagaaaagccataa

SEQ ID NO: 2554 - DNA, 1107 bp, Saccharomyces cerevisiae
atgaaagccggaattgagcttataagtcacagccaggcttctcacgccacatatgctaattctatgacccttgcagaaaaggggccacaacgtttaaaaagacaattcaaagaacacagttcttcaaaggaaagtaacgtaagtcgttggctaaagattttcataagacagtttgatatttggtttcctgaaacgataccaacaatgaaagtgagatacgaactgcttagaaaaaacttcattaaagaaattttcaactcaagagcatttatctacccattcttagtaagtacatgatttttgtttgcattgatatgacttgttttatgactaacatatttaatttttatttgttaaccgtaggggttttatgaagtgctgacgaatcctgtttattggaagcatattttactgtttgcggtttgctatgccctgatttttgtcactattgctggtctcttttatgtcacacttgtaccgcttttagtgacatgggccatactgttattagggcctcttggtgtgatactggttcatattcaatggattttacaaacgaatgtcttgactgcctttgtttgtagaacactggtcctgacccatattacgaatcagatatttgatatatctttggtgttgcaagaccaagatgaatttctaaacgaggtgaaggtattgcctaaaccacaaaagccacatagaaaaatcgatgaacctgatgcggtgagaaatttcaacacaataaagggaagtcggatttttaagattcccagattactattcagaatgttttttaaagtctccaattttacttcactaacattactgtcgctaattcctattgtaggaccaatcttggcaaatcaactaatggccccaaaaagaacctttacctatttgcagaggtactttttactaaagggattcagtaagaaacaggccaaagattttcagtacgagcattacgcaagtttcatatgtttcggtatgtctgccggtctactagagttaatacccttcttcacaatagtcaccatatctagcaacactgttggtgcagctaaatggtgtacttcgctactaaagggtgaaagaaagaaggaatga

SEQ ID NO: 2555 - DNA, 1107 bp, Saccharomyces cerevisiae
atgaactcatggaacctgagttcttcaataccgataatacatacgcctcatgaccatcccccgacatcagaaggaactccagatcaaccaaataataaccgaaaagatgataaactgcacaaaaaaagaggcgattcagatgaggacttaagccctatatggcattgtgtcgtctccggtgggattggtggaaaaataggagattctgcgatgcattcattggatactgttaagacaagacaacagggcgcacccaatgtcaaaaaatacaggaacatgatctctgcatatcgtaccatttggctagaagaaggcgtgagaagggggctatacggcggttacatggctgccatgttaggctccttcccgtcagcggcaatcttctttgggacctatgaatatactaagagaacaatgatagaagattggcagattaacgataccatcacacatttgagcgctggatttcttggcgattttatctccagttttgtttatgttccatcagaggtcctaaagacaaggctacaattgcaaggaaggttcaataatcctttctttcaatctggctataattattcgaatttaagaaatgccataaagacagttataaaagaagaagggtttcgctcactattttttggatacaaagccactttagccagagatttgccatttagtgcattgcagtttgccttctacgaaaagtttaggcaattggctttcaagattgaacagaaagatggtagggatggtgagttgtctatacctaatgaaatattgactggtgcctgtgcaggtggactggcgggaatcattaccacaccaatggatgttgttaagactagagtccaaactcaacagccgcccagccaaagcaacaaatcatactcagtaacacatccacatgtaacaaacggcagaccggcagcactttccaactcgatttcgctcagccttcggacggtctaccaatctgaaggtgtgttaggtttctttagtggcgttggccctagattcgtctggacaagtgttcagagcagtataatgttgcttctgtatcaaatgaccctacgcggattaagtaacgcatttccaacggactaa

SEQ ID NO: 2556 - DNA, 1107 bp, Saccharomyces cerevisiae
atgaaggctgtcgtcattgaagacggtaaagcggttgtcaaagagggcgttcccattcctgaattggaagaaggattcgtattgattaagacactcgctgttgctggtaacccgactgattgggcacacattgactacaaggtcgggcctcaaggatctattctgggatgtgacgctgccggccaaattgtcaaattgggcccagccgtcgatcctaaagacttttctattggtgattatatttatgggttcattcacggatcttccgtaaggtttccttccaatggtgcttttgctgaatattctgctatttcaactgtggttgcctacaaatcacccaatgaactcaaatttttgggtgaagatgttctacctgccggccctgtcaggtctttggaaggggcagccactatcccagtgtcactgaccacagctggcttggtgttgacctataacttgggcttgaacctgaagtgggagccatcaaccccacaaagaaacggccccatcttattatggggcggtgcaactgcagtaggtcagtcgctcatccaattagccaataaattgaatggcttcaccaagatcattgttgtggcttctcggaaacacgaaaaactgttgaaagaatatggtgctgatcaactatttgattaccatgatattgacgtggtagaacaaattaaacacaagtacaacaatatctcgtatttagtcgactgtgtcgcgaatcaaaatacgcttcaacaagtgtacaaatgtgcggccgataaacaggatgctaccgttgtcgaattaactaatttgacagaagaaaacgtcaaaaaggagaataggaggcaaaatgtcactattgacagaacaagactgtattcaataggcggccatgaagtaccatttggtggcattactttccctgctgacccagaagccaggagagctgccaccgaattcgtcaagttcatcaatccaaagattagtgatgggcaaattcaccatattccagcaagggtctataagaacgggctttacgatgttcctcgtatcctggaagacattaaaatcggtaagaactctggtgaaaaactagttgccgtattaaactag

SEQ ID NO: 2557 - DNA, 1107 bp, Saccharomyces cerevisiae
atgaatcctaaatcctctacacctaagattccaagacccaagaacgcatttattctgttcagacagcactaccacaggatcttaatagacgaatggaccgctcaaggtgtggaaataccccataattcaaacatttctaaaattattggtacgaagtggaagggcttacaaccggaagataaggcacactgggaaaatctagcggagaaggagaaactagaacatgaaaggaagtatcctgaatacaaatacaagccggtaagaaagtctaagaagaagcaactacttttgaaggaaatcgagcaacagcagcagcaacaacagaaagaacagcagcagcagaaacagtcacaaccgcaattacaacagccctttaacaacaatatagttcttatgaaaagagcacattctctttcaccatcttcctcggtgtcaagctcgaacagctatcagttccaattgaacaatgatcttaagaggttgcctattccttctgttaatacttctaactatatggtctccagatctttaagtggactacctttgacgcatgataagacggcaagagacctaccacagctgtcatctcaactaaattctattccatattactcagctccacacgacccttcaacgagacatcattacctcaacgtcgctcaagctcaaccaagggctaactcgacccctcaattgccctttatttcatccattatcaacaacagcagtcaaacaccggtaactacaactaccacatccacaacaactgcgacatcttctcctgggaaattctcctcttctccgaactcctctgtactggagaacaacagattaaacagtatcaacaattcaaatcaatatttacctccccctctattaccttctctgcaagattttcaactggatcagtaccagcagctaaagcagatgggaccaacttatattgtcaaaccactgtctcacaccaggaacaatctattgtccacaactacccctacgcatcatcacattcctcatataccaaaccaaaacattcctctacatcaaattataaactcaagcaacactgaggtcaccgctaaaactagcctagtttctccgaaatga

SEQ ID NO: 2558 - DNA, 1107 bp, Saccharomyces cerevisiae
atgccaggccagataatcagcattccgtttttgtcgcagaacgaggacatggataaatacttgttggagtaccgcagtttgaagctccttcatcagtccagtaattccttccagtctcacaatgcgccctcccaccagtcgaactaccacccccattacaatcacatgaaatacaacaacactggtagctattactattacaacaacaacaataacagcagtgtaaacccacataaccaagctggtctacaatccattaacagatctattccatcggccccgtacggggcttacaaccagaacagagctaatgacgtaccatatatgaatacccaaaagaaacaccacagatttagcgctaacaataatttgaaccagcaaaaatacaagcaatatccccagtatacgtccaatccaatggttactgcacatctgaagcaaacgtaccctcaactgtactacaatagcaacgtcaatgctcacaacaacaacaacaacagcaacaacaacaacaacaacaacaacaacagcaacaacaacaacaatctttacaaccagacgcagttctccacgaggtacttcaactcgaactcctctccctcgttgacttcttccacttctaactcatcctctccatacaaccaaagcaccttcgaatacattttgccgtcaacttcggcagcttccacaaatttatcgtcgtcatcatcaaacaactctatgcacaccaacccaaccactgcaacatcgacatccgccgatttaatcaatgatttacccgtgggccccacgtccagttcgcttatctcggatctacattctccaccaactgtatctttcctaccagcaagccaaaccctgctcatgtcctccaccacatctagctctattggcaccaacataaacccaccgcaacattcaccatccccatcgcaaagggaggatttttcgacggcaccagtgaacatgtcttcgtccgcatcactcttgatgaatgattcttctttaggatgggggtctaaccacatgaacgtatcttcatcctctcaaccagcatcatcaagaccctttggcatttggaatactgacatgagcgtttggagttga

SEQ ID NO: 2559 - DNA, 1107 bp, Saccharomyces cerevisiae
atggaattggacgaatgtttagaaaggctatacaaggcccagttactacctgaagtgactgtaagggcactctgctttaagctgaaggaaatgctagtgaaggagtcaaacgtgattcacattcagacccctgtcacagtcgtgggggatatgcatggacagtttcacgatatgctggagatcttccaaataggcggccctgttcctgatacgaattatctgttcttgggcgactatgtagacagggggttgtacagtgtggaaacaattatgctattgattgtgcttaagcttcgatatcctagtagaattcatcttttgaggggaaaccacgagtcacgtcaaatcacgcagagctatggtttctacacggagtgcttgaacaagtacggtggcaattcaagagtttggcaatatttgacagatatatttgactatctagtgttatgctgtattatcgacgacgaaattttttgtgttcatggtgggctctcgcccaatgttcaaaccatagatcagatcaagattattgatagatttcgagaaattccacacgatggcgccatggcagacttggtttggtctgatccggaagaaaacaataaccccacgttagatcatccagataactctggacaacatttccaggtgtcacctcgtggagcaggttatactttcggaagaagcgtggtggagaaattcttacgtatgaacgatatgaacagaatatacagagcccatcagttatgtaacgaaggttaccagatatattttgatggattggttactactgtatggtcggcgccaaactattgttatcggtgcggcaataaagcatctattctggagctgtatagtaaagatcaattctacttcaacgttttcgaagaggcacctgaaaataaactgttgaaagagaacagtatgaacgacaatgccttagaagatagcatatctaatccggtagccaacaggaaattgattgcagattatttcgaagacgactctgcctccgcagatggctccacggaccctgaaatgtacatattttcagatgtataccaagccagatctgcttctaacagacatgttgattacttcttgtag

SEQ ID NO: 2560 - DNA, 1107 bp, Saccharomyces cerevisiae
atggcaagagcgttgagggatatatcattattcaatgatataagaaaggatcaaaattcggcaggagccaagcatgagagatataacatgagagatctccgaagtaagaagaaccagcatgtaaatggcatagatgattatgaagatgattcgcttgacagatttataagaaggaagaaatccagagttgtgaaatacattccatcattgtcagcgtataatgtgttcaatgaatttccttactatcctacgtcagccagtcagttactagacggcaaattagacgaatttctaatgctgtcagaacaatacaaaagtagattacccaaaatacgcaagctaggatggaatagattcaaaccaataggcattaataaaactatgtacgaattagaaatgctaaggtctcgagcacgagctcaaaacgcggaagggaacaatgaggaagacttcaggcagcacgattctagagaagaggatccaagaaacaatggctctataggacgcgtgatactgcctcatattctacaggaaaatgaagaatatgatactggtgagggtgttacaggattgcatagcatgccaaatgacagtatggccatacttgcgaataacagtgctaataattcgcaaaatgaggaagtatcagaggaggatgaaatatcatacgattatgatgcagagttcgatcatgttgtagatgaggatgataatgaggagggagaagtgccgggggaaggtgtggaaggtatagaagttcagagagagagaattgtgccggatgacttattaatgagacccacttcactgtcacgctccctacaacagtttgtggaagaggctcatcatttagatagaaacccatatgatattgacagtgataacgacggagaagattcaaaggtagaactggacatgaatccggattttgaagatgacgtgggaagagagcatgattataatagcgaatacagccaagagccgacttcttatggtgggattacacctgatctagcgagtaattggaggaattggactagggagaggataactagtttagatgaattaatggagagacgagccaggcagcaacgaggtcaagattag

SEQ ID NO: 2561 - DNA, 1107 bp, Saccharomyces cerevisiae
atggctagaaccataacttttgatatcccttcccaatataaactcgtagatttaataggtgagggagcgtacggaacagtatgttcagcaattcataagccttccggcataaaggtagctatcaagaaaatacaaccgtttagcaaaaaattgtttgttacaagaactatacgtgagatcaagcttttacggtatttccatgaacacgaaaacataataagtatattggataaagtaaggccagtatccatagacaaactaaacgctgtttatttagtcgaagagttgatggaaaccgatttacaaaaagtaattaataatcagaatagcgggttttccactttaagtgatgaccatgttcaatactttacataccaaatcctcagagccttaaagtctattcacagtgcacaagttatccatagagacataaagccatcaaacctgttactaaattccaattgtgatctcaaagtctgcgattttggactagcgaggtgtttagctagcagtagcgattcaagagaaacattggtaggattcatgacggagtacgtcgcaacgcgatggtacagggcacccgagataatgctaacttttcaagagtacacaactgcgatggatatatggtcatgcggatgcattttggctgaaatggtctccgggaagcctttgttcccaggcagagactatcatcatcaattatggctaattctagaagtcttgggaactccatctttcgaagactttaatcagatcaaatccaagagggctaaagagtatatagcaaacttacctatgaggccacccttgccatgggagaccgtctggtcaaagaccgatctgaatccagatatgatagatttactagacaaaatgcttcaattcaatcctgacaaaagaataagcgcagcagaagctttaagacacccttacctggcaatgtaccatgacccaagtgatgagccggaatatcctccacttaatttggatgatgaattttggaaactggataacaagataatgcgtccggaagaggaggaagaagtgcccatagaaatgctcaaagacatgctttacgatgaactaatgaagaccatggaatag

SEQ ID NO: 2562 - DNA, 1107 bp, Saccharomyces cerevisiae
atgggtattatcgacaaaatcaaagccatcgaagaagaaatggccagaacccaaaaaaataaggccacagaacatcatctgggtcttttgaaggggaaattggctagatacagacaacaactgctagctgatgaagctggtagtggtggtggaggagggtctggttttgaagtggcaaaatcaggtgacgctagagtagttttaataggttacccctccgtcggtaagtcctccttattgggtaaaattaccaccaccaagtctgagatcgctcattatgctttcacgacattgacatccgttcctggtgtattgaagtaccaaggtgcagaaatccaaattgtggatcttccaggtattatttatggtgcttcgcagggtaaaggtcgtggtaggcaagttgttgcaacagcaaggaccgcagatctagtattaatggttttagatgccacaaagagtgaacatcaaagagcatctttggagaaggagctggaaaatgtaggcatcaggcttaataaagagaaaccaaatatttactataagaaaaaagaaactggtggcgtgaaagttacgtttacctcccctccaaagaccaatttaaccgaacaggcaatcaaaatgatcttgagagattatcgtatccataatgcagaagttctggtaagagatgaccaatgtacgattgatgattttatcgatgttattaacgaacaacatagaaattatgtcaaatgtctttatgtgtataataagatagatgcagtatcattagaagaggtggataaacttgccagagagccaaacaccgttgttatgtcctgtgaaatggatttgggattacaagacgtcgttgaagaaatttggtaccagctgaacttgagtcgtgtgtatacaaagaagagaggtgttagaccagtatttgatgatcctctagtggtaagaaataattccactattggtgacttatgtcatggtatccacagggatttcaaagataagttcaaatacgcattggtttggggttcttctgccaaacattctcctcagaagtgcggcttaaaccacaggattgatgatgaagatgtagtttctttattcgcgaaatag

SEQ ID NO: 2563 - DNA, 1107 bp, Saccharomyces cerevisiae
atgtgtggtaggtttgccttagcttacgatagcggagatttgccgcaacttctaagagattggaacttaccggttaatacacccaaggacgcctcatcgaacagccagcatccacatgacgaggaagacaccaaagatcagcctaccgttagtaaggatatcttcaaggcctcttacaatatttcccctacaaactactctgcggtatatcgtcctgatactaaagcaatacaatttatgagatggggccttgtaccattctggaccaaggacgtttcacaattcaagacctatcgtacctttaatgcccgtttagagaatttacaagagagcaaaatgtggatgagaccctgtgagaagaaaaggtgtgctgtgcttatgagcggatattttgaatggaaaaccgtagggaaaaagaagacgccttatttcatttctagacgagacggcagattgatgtttgtagcaggaatgtatgattacgtcgaaaaggatgatttatatacgttcaccataataactgcacaaggccccagagagttagaatggctccacgaaagaatgccttgcgtgctggaaccaggcaccgaaagttgggatgcatggatggatgtggataaaacgacatggagcactgaagaactggtaaagctgctgaagccggactacgatgaatcaaagttacaattctatcaagttaccgatgatgtggggaagactaccaacaccggagagcggctgataaaaccgcttttgaaagaggattcggacatgttcagcgtaaagagagaaaaagaagaagccttgctagaaaatgataacgaacaaggtattgataatcgaggtgtaaagggtgacaaatcgttgaaaggcgaagatgtttttaatcaaaagaaaagcctcaaaaggaattcctatgatggattaaaaaagaatgaagaacaagaggaaacaactttaccagaggaaggaagtataggtgaccgagtgaagagagaagaagctaatttgtcacccaaaagagagggaaacagagagaagagaaatatagtaaatatgttgggaaaccagaaagactccagaggcaagaaaaaaataaaaaaatga

SEQ ID NO: 2564 - DNA, 1107 bp, Saccharomyces cerevisiae
atgttgtcagcagctagattgcaatttgcccaggggtcagttagaaggttgaccgtttccgctagagacgcacctactaaaatatctacattggctgttaaggtccatggagggtctcgttatgcaaccaaggatggtgtggcccatcttttaaacagattcaactttcaaaacacgaacactagatcagctttgaaattagtcagagaatccgaattattagggggaacttttaagtctaccttggatagggaatacatcactttgaaagctacctttttgaaggacgaccttccctactacgtcaatgccctagcagacgtgctatacaagactgccttcaaacctcacgagctcaccgaatctgttttgcctgctgctagatacgattatgcggtcgctgaacaatgtccggtaaagagcgccgaagaccaattgtatgccattacattcagaaagggtttaggaaacccattgttatacgatggtgtggaaagagtcagtttgcaagatatcaaggactttgcggacaaagtctataccaaggagaaccttgaagttagcggtgaaaatgttgttgaggccgatttgaaaagatttgttgacgagtcactgttaagcactttgcctgcaggtaagtcattggtgagtaaatccgaaccaaaattctttttgggtgaagaaaacagggtaaggtttatcggtgactccgttgccgccattggtatcccggtaaacaaagcctccctagctcaatatgaagtattggccaactatttgacctctgccctatccgagctttccggtttaatcagctcggctaaacttgataaattcactgacggcggcctatttactctgtttgtaagagaccaggacagcgccgtggtatcttccaacatcaagaaaattgttgcggatttgaagaagggcaaggacttatcccctgcaataaattacacaaagttaaagaatgccgtccaaaatgaatctgtttccagcccaattgaactaaattttgacgccgtgaaggactttaagttgggaaaattcaactatgtagccgtcggtgatgtttccaacttgccatatttggacgaattgtaa

SEQ ID NO: 2565 - DNA, 1110 bp, Saccharomyces cerevisiae
atgaatcagagcgatagcagcttgatggatttaccactggagatacatttatcattactagagtacgtgcctaatgaacttcgtgctgtcaataaatacttctacgttttgcataaccacagctataaggagaagagtttggcgtggatagctgaggacaactatatatgggccgttgtcaaacattcattatgtttatatgtcaagagtttggacccacttcgacagcatgccagagaaatcattcaagaaacgaaggaaccaggttttaatgtgccactgtgcatgactaaatacatcgcagattcttggtatattgtatacaatgcgctgcaatatcctggaaagataattaatatgggatgggacaaatataccaaaagtcaagattcaaatggttctgattctaccagtaactttaatagtcggcccaaggaaagaactcttatgcagtcgttgacagctttacctgttaacttttggtccaggaggaaggacgagcctacaccggtaaacgtttggttttatgtaaaaaatgcgcacgttgccagatacataccgaaaattattacggaaataggcatatgcaactatgggccgaagcagatcgtggcaagtgcaggatatatcaacgaattgataacatctgaaggaatatactgtgttaacctaggccaccttcccaggctatacgatgagcaaatttttgaaggcactggaacgacacatcttcccctggaactgaaagctatcgacaggacagattcagatgtttgtatcaatggtgatttagttctactcggttatgactttattccatatcagatatcgaagccgtggttactctttagaatcgaacccgtaaatagcattgaagcaatcttcaactatagtgaatgttctttttcataccagtttgcatggagtttggcctgcttacaatctgaagagaaaatttcatttcctagagacacgataattgggcacggtttaccttacaagccatccaaattgataagaattttcgtctacaagcatccggaacaaaagcaagatcttggtcaagaaatagcattgcccaactggaataccccttatcttcgaagatga

SEQ ID NO: 2566 - DNA, 1110 bp, Saccharomyces cerevisiae
atggatacagatttagatgtgcctatgcaagatgctgttaccgaacagctgactcccacagtatctgaagatatggatctcaacaacaattcatcggataataatgcagaagaattctcggttgatgatttaaaacctggttcctcgggcatagcagatcacaaatcttccaaaccactagaactgaataacacaaatataaatcagcttgaccaatggattgagcatttgagtaaatgcgagccactatcagaagacgatgtagcacgactatgtaaaatggcggtggacgtgttgcagttcgaggagaatgttaaaccaattaacgtgcctgttaccatttgtggtgacgtacacggtcaattccatgacttgttagaactttttaagattggtggcccttgtcctgacaccaattaccttttcatgggtgattacgtggatagaggatattattctgttgaaactgtatcttacctagttgccatgaaagtcagatacccacatagaattacgatactgagaggcaatcacgagtctaggcagattacccaagtatacgggttttatgatgaatgtttgagaaagtacggcagtgcaaacgtgtggaaaatgttcacagatcttttcgattattttcctataaccgcattagtagataataaaattttctgtctgcatggaggactttcccccatgatagaaaccatagatcaggtgagagagttgaacagaatacaggaagtgcctcatgaaggtcctatgtgtgaccttctatggtcagaccctgacgatagaggcggatggggaatcagtcccagaggtgcaggcttcacttttggacaagatgtcagtgagcaattcaatcacactaatgatctatcactaatagcaagagctcaccaattggtaatggaaggctatgcttggtctcaccagcaaaatgttgtcaccattttcagtgctcctaattactgctacagatgtggtaatcaagcagctatcatggaagtggacgagaatcataatagacaattcttacagtacgacccatccgtaagaccaggtgaacctagcgtcagcagaaagacgccagattactttttatga

SEQ ID NO: 2567 - DNA, 1110 bp, Saccharomyces cerevisiae
atggattttacgtctgatacgacgaattcgcacgacacatcgaattcgcatttaagtctggaagacgctgtgggtacacatcatgctggtgaagcagatgtaaacattgatggggacgagaagcaacaactatcgctattagatgatgatcaggtacgcgcactgaagctacaggaggagaaggatgcgctgttgacaaggagaaatactcttttacaagagatccagacgtaccaaaatatcttgatgaaggaaaataacagtaagactaaaaatggtgatatcctccaaaacgatatcacacaggattttcttaatctaatctcgatctcatcctctaatcctaattcggcgataagtgaccgcaagcgggtcgagaggatcaatgggctaactaacttgcagaaggaactagtaacaaaatacgacacgttacctttgttaaatatgaatctacggctaagttatttgagagaccacacatacccgcatcttcaagtttctgtgcaatcaagagacagagtacataacgatgggattgaagttttggtggtcaattataaattctgcagaaacacgatgaatccttttgaaattcagttcaaaatgttctataaatttgaagattccacactgctgaagtgggaaatcttgcgaatttccacaaacgttagactgaaggccaagcaattactggcaacacgtaacttccagaagtgtctattaagcctttatgagtttgataagatcaagtccaaaaaaactggaattttccaaaatttgattaatttattgaaaaggaaaaccaggtgttatctaatgaataatagtgactcattaattgtggaaagagttattagagaaggaagactcacgacgataaaattgcagataaatttcatcattacaatgcccggtgagagaggcaaacctcgtaactgttttctgcccatgagtaaaatttcaatagcgctatggaaggggggagaaagatttaaccagatagatttggacgagatatgctacggacttatcaaggaatatggtgtgaaaaccgggttaaaggagatctgcaacgtttgcctattcccggacatgtacgccaggtga

SEQ ID NO: 2568 - DNA, 1110 bp, Saccharomyces cerevisiae
atggttgtattcgaaataactatacttggggccaatggaggacccaccgaatacggaacacagtgttttatacttaagcctgctagaacagaggatccagaattaatagctgtagacggtggtgcaggaatgtaccagctacgggagatgttggtccaagggcgaaatgaaaatgaaggtgatgatgagcttgttccaagcttttatgaacatgatcgagagccaatagagttttttattgattccaaactgaacatacaaaagggattatccaagtccttgctacaatcattaaagaggcagggagagcattttgaaagcgccaatacaatgaagaaaacttacgaggttttccaaggaattaccgactactacattacccatccccatctggaccatattagtgggctggtagtaaactccccctcaatatatgagcaggaaaacagtaaaaagaaaactatttggggattaccgcatactattgacgttttgcaaaagcatgtctttaatgacttaatatggccagatttaacggcagaacgttcaagaaaattgaagctaaaatgcttgaatccgaaggaagttcaaaagtgcactatctttccttgggatgtaataccgttcaaagttcatcatgggataggcgtcaagactggcgcgccggtatacagcaccttctatatcttcagagacaggaaaagcaaagactgtataatagtttgcggagatgttgagcaggaccgcagagaatctgaagaatctctacttgaagaattttggtcttacgttgctgaaaatataccgcttgtgcatctcaagggtatattagtcgaatgttcatgcccattatcttccaagcccgagcaattgtatggtcatctatctccaatatatttaatcaacgaattatccaatttgaacactttatacaacagtagtaagggattaagcggtttgaatgttatcgttactcacgttaagtcaacacctgctaaaagagacccaagactaaccatactcgaagagttacgatttttagctgaggagaggaacttaggagacttgagaatatctattgcgctagaaggccacactttgtttctataa

SEQ ID NO: 2569 - DNA, 1110 bp, Saccharomyces cerevisiae
atgtatacaaaactaagatctatacaatcaggaacatttagcacagtttataaagcatggagtactacacataaccgctacgtcgctttaaagattactcctaaatacaaaacttcagaagccaacatgaagaacgagtatgatgtaatgaagattttgagttcttgtaatcctcaccccaacatctgttcgatgctcgacttttacacggatgactcgtactacatcatggtgctagaatactgcgaatgtggtgatctttatgactttctagatattgctaagagtcaaggtagcccgtcgtctccatctttgattcaaattgatatgcaaaagataatcaaacaactgtgctcagcaatcagctttgctcacagcttgggtattgctcatcgtgatatcaaaccagaaaatattttgctaacgataaatggtgacatcaagttggcagactggggtcacgctatccaatcccctaaatctaacgacttccagattggtaccgataattacagggcgccagaaactttctctggccgcgttagtaactcttgttttaagaagaatttcgatcggtcatcggctccattgtataacacataccaagctgactattggtcattgggtgccaccatattttatctgatgttcggcgattgcctttttagagtctccaaatcaaagaaggttcagcatctaaaaaatttcgatgagtttgaaaaagatccatttgcattcatttacaggaaatacgtagtaccaaggctctcctgtggttacaatgatgaagaagacctacacgttagcctgcagcatacgaggcagtacatatggcaagatctacccgacatttatgatgtcttccatttgtgcaagattatggttgataccttattaaaggtatcgaacgctaaagagaggtcgatggagaatttcatcaatgaagttgattctgcatggaacaaagatagctcgatggacagctgcttctcgtaccaaaataagattgatctgttttgggaacagtggtctgtgaacacggaaacagtaccagcaaagttccaattgaaaaattttgagaaaccttgcctaattcaagatggaaaataa

SEQ ID NO: 2570 - DNA, 1110 bp, Saccharomyces cerevisiae
atgtctactacagttgaaaaaatcaaagctatcgaagatgaaatggcccgtacccaaaagaacaaggccacatctttccatttgggtcaactgaaggccaagctggccaaactgagaagagaattgttgaccagtgcttcatccggcagcggtggtggtgctggtattggttttgatgtggctagaactggtgtggccagtgtggggtttgtcgggttcccgtcggtggggaaatctacattactgtccaagttgactggtactgagtctgaagcagctgagtacgagtttaccaccctggttaccgtccccggtgtcattcgttataaaggtgccaagatccaaatgttggatttacctggtattatcgatggtgctaaggatggtagaggtagaggtaagcaagttattgccgtggcaagaacctgtaacctgttatttatcatcctagatgtgaacaaacccttgcatcataagcaaatcattgagaaggaactggaaggtgtggggattcgtctgaataaaactccgccagatatcttgatcaaaaaaaaagagaaaggtggtatttccatcacaaacacagtcccattgacccatctggggaatgacgaaatcagagccgttatgagcgagtacagaataaatagcgctgagattgccttcaggtgtgatgccactgtggatgatttgattgatgttttggaagcttcgtcaagaagatacatgcctgccatctatgtgttaaacaagattgattctctgtcaatagaggaattggaattactttaccgaattcctaatgccgtgcctatttcgtctggtcaagattggaacttggacgagctgttgcaagtcatgtgggatagactaaatctagtccgtatttacactaaaccaaagggccaaataccagattttaccgaccctgtggtgctaagatcagaccgttgcagtgtcaaggatttttgtaaccaaattcataaatctttagtggacgactttagaaatgctctggtttacggtagcagtgtcaaacatcaacctcaatacgtggggttgagtcacattttggaagacgaagatgttgttaccatcttgaaaaagtga

SEQ ID NO: 2571 - DNA, 1110 bp, Saccharomyces cerevisiae
atgttattccctaaacgtctgattgtgtggggtgttctattgattttaagtttatcacaatttgtcctctacctgccagccacaacatgtacgaactctaagggacttaggttatgcgctccacagtttactataactgtgattggaggatccagtactgcaaatgagtttattgcaagtgtaagagaatttctgcgattgatttcgtacctgacaattgacatgggttggtcgaatgaattcactgatccaagtgtgtatgaggatgaaaatttggtggacacatttcagcctgataaggtttttgagctcaattattttggattttgtaaacggagtaataaaagcaaagtttattgtacctctaatgagaattatggcatggacgtacttgaagtacttgtcagagacgtcgggattcaattaggtaacatttccactacacgatcgaatgaaaccaaaaaattcggagactctctcgtattgacctaccgtttggcattgacatctattcgtgattttttgaaacacgacaagcacacaggaaatgccctatcaaaggctttgattggcagtcctgatccaaatgtaaaaggcgtgtcaccaacaaaaaactatctgaaaggcgtcaacctggcatttatactgatgatgttcaacggcatggttttttactttgcagtgttggaaataatagtcggattcctcagtatctgcgtagtgtcagcctttgggggagcacttagtgttgggaaacgacaccgcttatttcctatgcttttgaagtcatcaagttcaatattagttgttattgctacattgacaatattatgtaacatcgtatatttgattgcactgaaaacattagaacctgaagaggtaacagacgtaggatctgacaacgctgctgtacacactacaggctgggaactgttaaaagtaaacgtgggaagtgggttcattatggggctcgccaggtatgccatccagtgggtcctattggtactcgcatttcttgcagcaaatcattacaaagctaagcccaaaaagtctgataagtatacagaagacacatctaactccccttctccagacttgatggagaagtaa

SEQ ID NO: 2572 - DNA, 1110 bp, Saccharomyces cerevisiae
atgttgagaaatactttttttagaaacacctcgaggaggtttttggctactgtaaagcaaccttcaatcggaagatataccggcaaacctaacccttctaccggcaaatacacggtctcgttcattgaaggtgatggtatcggacctgaaatttccaagtctgtaaagaaaatctttagtgcagcaaacgtccccatagaatgggaatcttgtgatgttagccctatctttgtcaacggattaacgaccattcctgaccctgccgtacaatctatcacaaaaaacctggttgcactaaaaggtccactagctacacctattggtaaaggtcacagatctttgaatttgacattgagaaaaacatttgggttatttgccaacgttcgtcccgcaaagtctattgaaggttttaagaccacttacgaaaacgttgatttagttcttatcagagagaataccgaaggtgaatattctggtatcgaacacatagtttgccctggcgttgttcaatctattaaactgatcacaagagatgcctctgagcgagtcattagatacgcttttgaatatgcaagagccatcggcagaccaagagttattgtggtacataaatctactatccagagattagctgatggtttattcgttaatgttgccaaagaactatccaaagagtatcctgaccttactttagaaactgaacttattgataacagtgtgttaaaggtggtcaccaacccatctgcttacacagacgctgtttctgtttgtccaaatctatacggtgatatcttgtccgacttgaactctggtttgagcgccggttctttaggtttaactccatctgccaatattggtcataaaatctcgatctttgaagctgtccatggctctgcccctgatattgccggtcaagataaagcgaatccaactgccctacttttatcttcagtaatgatgttaaaccacatgggtctaacgaatcatgctgaccaaattcaaaatgcagtattgtctactatcgcatcaggtccagaaaacagaacaggtgacttggctggtactgctactacttcatcattcactgaagcagtcatcaagagattataa

SEQ ID NO: 2573 - DNA, 1113 bp, Saccharomyces cerevisiae
atgaacaattccataattactgatgatgaggttagagagttttacttaaactgctcttctcaaacaattattgaatctcttctcagcttgcacgagtcattgagattatattctcaaaaccatgagatactgctcaataggatgttcaaaaaattggatgaaaccaatgcagactctaacatatcccatatattcatgcctgttgtgagcaaggatttttcaggaataaaaattcttgtgaataacaacaacaaaaattttcaaggtgtgataaatgttattgagcctgaaacaggaaaattaatcggatgttttgaggctaaacaaattaccgctataagaactgcccttgcatcgtgtatcggtttatataagcaactctcatgttcccatgataagttgtttagatttgaaaatggcacttgctatttaacatgttttggtaccggtctccaagcattttggcacatatacatagctattaaactaatcatgtcagggattgttggcgaatctttgaagttagttgaaataaacatactatatcacaataacatgatgagtttggatcgtttgaaatcattgaaaaacttatttggaagtaatataaagatagagcttaatcagtatcaaataaacgacatcagttcagaaggtaatggcgctgtttctaacagtgatattatctttggttgtctacctactctagagcccaacttgtttttgaggcagttgctaaacagtaaagcttctgtggagcagaaacatacttatatctcattaattggaagttacaaaccagtgatgcacgaatgcgataaggagttgattgataagttcaaatctgataatgaaagcgcttgcattttggtagattcaagggaacatactttattggaatctggagaattaatcgattccaatatcgctccacataatctcatcgaaattggtgaattagatactttgaaaaacacagttttgaatttgaacgaaaagggctgcaaaagaactatcaccttgtgtaaaattgttggtctagcggttatggacgtggcgcttgctaaggaattcttaagcttgagaacaaaaaacacagaaaacaaggaataa

SEQ ID NO: 2574 - DNA, 1113 bp, Saccharomyces cerevisiae
atgaagcaaaaatttgtactaccgatcaccccaccaagtacggcggaaaagaagcctcaaacagaaaaccgttgcaatgagaatttgaagcctagaagattgctaccgcaattgaaaaaaagtgtccgtaacaggaaacctagactgtcatataggcctgagttaaactctgtgtttgatctggatgcgtacgtggattcgacacacttgtccaaatcccaacgccatcatatggaccgcgacgccggttttattagctatgctctgaattatagcaaaagaatggttgtagtcagcggggcaggtatatctgttgccgctggtataccggattttagatccagtgaagggattttctctactgtgaacggcggctctgggaaagatttgtttgactacaatcgtgtgtatggcgacgaatcaatgagtttgaaatttaatcagttaatggtgtcattgttcagattatccaagaattgccaacctacaaaatttcatgaaatgctcaatgagtttgctagggatggcaggctattgagactgtacacgcagaatattgacggtttagatacacaattacctcatttatcaactaatgtgcctctggcgaagccaatacccagtacagtacaattacacggaagcataaaacacatggaatgcaataaatgtctgaatatcaaaccttttgaccctgaactgttcaaatgcgacgacaaatttgattctcggactgaaatcataccgtcatgtccacaatgtgaagaatatgaaacagttagaaaaatggcaggcttaagatctactggtgtgggcaagttgcgtccaagagtaattttatacaatgaggtccaccctgaaggtgattttatcggtgaaattgccaataatgacttaaagaaaagaattgattgtttgattattgttggaacgagtttgaagattcccggagtgaaaaatatttgcaggcagtttgcggccaaagtccatgcaaacaggggtattgtgttatatttaaacaccagtatgccgcctaagaatgtgctagactctttgaaatttgtagacctagttgtactgggagattgtcagcatgttacctcattattatag

SEQ ID NO: 2575 - DNA, 1113 bp, Saccharomyces cerevisiae
atgaatattcaaagcaataattctccgaatctcagtaataacatagtgtcaaaacaggtttactacgcccatcctccacctacgatagacccgaatgatccggtgcagatatctttccctaccaccgaagtagttgggcatggttcgtttggtgtggtatttgccactgttattcaagaaactaatgaaaaagttgctattaagaaagtcctgcaagataaacgattcaagaacagagagctggaaataatgaaaatgctgagtcacataaatataatagatctgaagtactttttctatgaaagggactcccaagatgagatttatttaaatttgatactagaatacatgccacaatctttgtaccagaggttacgtcatttcgtccatcaacgtacgccgatgtcaagattggaaataaagtactacatgtttcaattgttcaagtcattgaattacctccatcatttcgcgaacgtctgtcatagagacattaagcctcaaaatttattagtagatcctgagacctggtccttaaaactgtgcgatttcggcagtgcaaagcaattgaaacctactgaacctaacgtttcctatatttgttcacggtactatagagcaccagagctaatcttcggcgcaacaaattataccaaccaaatcgacatatggtcctctggctgcgtaatggcggaactgctattgggccaaccaatgttccctggagaaagtggtattgatcaactagtggaaatcattaaaatcttaggtactccatcaaagcaagaaatttgctctatgaatcccaattatatggagcataagttcccgcaaattaaaccaataccattgtcacgtgttttcaagaaagaagatgatcaaactgtggaatttctagctgacgttttgaaatatgatccactagaaagatttaatgctctacaatgcctgtgtagtccatattttgatgaactaaaacttgatgacggtaaaataaatcaaataacaactgatttaaaattgctagagttcgatgaaaatgtcgaattgggccatctatctcccgatgaactatcatctgtaaaaaaaaagctatatccgaagtctaagtaa

SEQ ID NO: 2576 - DNA, 1113 bp, Saccharomyces cerevisiae
atgaatcgtgttggtatagacgtagatcatatgataggggtcctgcttctggccgtagtggtggtgttttgggttggcgcttcgtgtttgactaatgaattgctcgagacaaacgcgtacaataaacctttcttccttacttatctaaacatatcatcgtttgctctttatttgacgccagatctatggaggataatccaatcaagaaggaagagcttgcaggaacggacagaacgaacattacctattcacacacaagaatctttttcagagttcctacctttactatcttcaactccttctacttcttcaaatttgtcttcgatagcggacacgaaagtgaaggatacaatgaggttgagtctgctattttgcgtcttgtggttcgtggcaaatttggcggctaacgctgctttgtcgtataccacagtggcttcgtcaacaattctttcatcgacatcctcattttttaccttatttcttgccactagtctaggaatagaaactttttcgacaaaaaaactgctggggttatttgtgtctttgtttggaattatcttaattgtgatgcaatcctcgaagcaacaggattctgtgagtgcttcctcctttttggtaggtaacactttagcactgctggggtcattgggttacagtgtctatacaacccttttgaaatacgaaatatcatccaaaggtctcagactagacattcagatgtttcttggttatgttggtatcttcacgtttctgttgttttggccaattttaataatcctggatataacacatatggaaacttttgaactaccaagtaacttccacatttcttttcttgtcatgttaaattgtatcattatctttgttagtgactatttttggtgtaaagccctcattttgacatcacccttggtggttaccgttgccttaacttttactatcccgttagccatgttcgctgattttgtatggcgagaggcattttttacgccttggtatatcattggtgttattttcatttttgtttcattctttctagttaaccatcggggagaatctgctgttgaaaaggactgtgctgcggttgaaaaaggacctatcttggatgcctaa

SEQ ID NO: 2577 - DNA, 1113 bp, Saccharomyces cerevisiae
atgagcagtgccgcaaatgagggatgtgtttatttgttcattgtcgttttgcgattatcttcgttttcatgtgttaactcattcattcattcatttactcgttcacgcacacgcagcagttattccctcgacgagcgttcacttgtatcatatagcatagtttacgtagcaatgaataaaagcagcaaggcatttcaggtaccgaataaggtcatcaccaaggaggatattactcccttgtccagatcgcacacaaagaaagcggacactcgcgggacagcagatggtaaaaacaccacagccagtgcagtcgaggccaccccaatcatcatcaccactgctcgttcgatagatactgccggttcactatctgagaacgccaccgaggacgatggcacccaaaacggagatttacacgatgatgacgatgatgacgacctcgaaagtacgctcggctatagttctgagcctgatcctctcttctccccatgccaccagccttccttcaccaacagcacatttagttacagtgcggacaatgaactacccatggaggaaaatcacaacaagaataatttccacgatagcagcgagagcagtatctttctaccacagatacagcaatcattctttttcggcgacaatagcaagagtgacgcaaataatacggacttctggaaggaagtaaatggcactgcagaagaggccatttgcctgcaggagacaagacaaagaaaatgctccctcgtggctctgcatccaggcgacgccaccacgagttcgaacgacacattgggaatagaggacttcatcaaagatgatatcaacagtgctgaagccatggaaccctccccatcttcatcaccatcttcctcccttcttgataatttggactacaatatcaagttattgtgctacagagacaatgagggcaagttcaccttgaaaaaaaggaagtttttgaagaattccctgcgctcatcctctgcaatttctaaaaagtggaaacccttgtctaaaagagataagctgttgaagagggccataagaagaaagagtggtgtttgccagacgttatcagctggttttggtatcggtgaattcatgttgtaa

SEQ ID NO: 2578 - DNA, 1113 bp, Saccharomyces cerevisiae
atgagtgaatctccaatgttcgctgccaacggcatgccaaaggtaaatcaaggtgctgaagaagatgtcagaattttaggttacgacccattagcttctccagctctccttcaagtgcaaatcccagccacaccaacttctttggaaactgccaagagaggtagaagagaagctatagatattattaccggtaaagacgacagagttcttgtcattgtcggtccttgttccatccatgatctagaagccgctcaagaatacgctttgagattaaagaaattgtcagatgaattaaaaggtgatttatccatcattatgagagcatacttggagaagccaagaacaaccgtcggctggaaaggtctaattaatgaccctgatgttaacaacactttcaacatcaacaagggtttgcaatccgctagacaattgtttgtcaacttgacaaatatcggtttgccaattggttctgaaatgcttgataccatttctcctcaatacttggctgatttggtctccttcggtgccattggtgccagaaccaccgaatctcaactgcacagagaattggcctccggtttgtctttcccagttggtttcaagaacggtaccgatggtaccttaaatgttgctgtggatgcttgtcaagccgctgctcattctcaccatttcatgggtgttactaagcatggtgttgctgctatcaccactactaagggtaacgaacactgcttcgttattctaagaggtggtaaaaagggtaccaactacgacgctaagtccgttgcagaagctaaggctcaattgcctgccggttccaacggtctaatgattgactactctcacggtaactccaataaggatttcagaaaccaaccaaaggtcaatgacgttgtttgtgagcaaatcgctaacggtgaaaacgccattaccggtgtcatgattgaatcaaacatcaacgaaggtaaccaaggcatcccagccgaaggtaaagccggcttgaaatatggtgtttccatcactgatgcttgtataggttgggaaactactgaagacgtcttgaggaaattggctgctgctgtcagacaaagaagagaagttaacaagaaatag

SEQ ID NO: 2579 - DNA, 1113 bp, Saccharomyces cerevisiae
atgctcttaggttactgtggcagcggatactatggaatgcaatacaacccaccacacaagacgattgaaggtgagattctcaccaagctcttcgacgtaggagccatttccgaagaaaattcattggcaccgaagaaaaattcctttatggcagcggcaagaacagacaagggtgtacacgctatgttgaatctactgtcgctaaagatcacattgcgagaggacacagtagcgaagttaaacgccgcactaccgcccgaaatacgcgtgtggggtatccagcctgtcaataaaaagtttaatgctagatccgcgtgcgattctcgatggtaccaataccttatcccagaatttatactcattggtccaccccggagttctcttttgcatcgaaacgtggggggatgctaccgcgaagacggctcgcaagaggtgtgggatacgttcctggaacagacgcgtgggagatttagcggggatgagctgtgccgtttgcaggacactgcacagaaactaagcgagagcgatcctttggtacaagactacgtggggctattgagcggtacccttagcggctactgcttgtcgccctcgaagctggacgcgtttgaggcagccatgcaggagtacgtgggaacgcataattttcacaactttaccacaggaaagctttggggggatcctagtgctcagcgccatatcaaaaaggttgtagtgtcgcaggcctcaccgggatggatatgtgtgcggatccacgggcagtcgtttatgttgcatcagattcgacgaatggtagcgcttgccgtacttgcagcccgttgccaattgccgcctaatattgtacgtaactattttaacgccgggcctaggaaatacattccgagggcgcccgcacaaggcctattattagagggacctgtgtttgacgggtataacactaagttgcgcaatttgctgtattgcgaaatccgcccggacgatatcactcttgagcgcatgtgccgtttccgagaacgccagatctgtactgcgatcgcacacgaggagacacagcgtcacgtgttttgccattttgtacgacaaatgaaccgcctggccacgcctctaatctag

SEQ ID NO: 2580 - DNA, 1113 bp, Saccharomyces cerevisiae
atggctgaagcaagcatcgaaaagactcaaattttacaaaaatatctagaactggaccaaagaggtagaataattgccgaatacgtttggatcgatggtactggtaacttacgttccaaaggtagaactttgaagaagagaatcacatccattgaccaattgccagaatggaacttcgacggttcttctaccaaccaagcgccaggccacgactctgacatctatttgaaacccgttgcttactacccagatcccttcaggagaggtgacaacattgttgtcttggccgcatgttacaacaatgacggtactccaaacaagttcaaccacagacacgaagctgccaagctatttgctgctcataaggatgaagaaatctggtttggtctagaacaagaatacactctatttgacatgtatgacgatgtttacggatggccaaagggtgggtacccagctccacaaggtccttactactgtggtgttggtgccggtaaggtttatgccagagacatgatcgaagctcactacagagcttgtttgtatgccggattagaaatttctggtattaacgctgaagtcatgccatctcaatgggaattccaagtcggtccatgtaccggtattgacatgggtgaccaattatggatggccagatactttttgcacagagtggcagaagagtttggtatcaagatctcattccatccaaagccattgaagggtgactggaacggtgccggttgtcacactaacgtttccaccaaggaaatgagacaaccaggtggtatgaaatacatcgaacaagccatcgagaagttatccaagagacacgctgaacacattaagttgtacggtagcgataacgacatgagattaactggtagacatgaaaccgcttccatgactgccttttcttctggtgtcgccaacagaggtagctcaattagaatcccaagatccgtcgccaaggaaggttacggttactttgaagaccgtagaccagcttccaacatcgacccatacttggttacaggtatcatgtgtgaaactgtttgcggtgctattgacaatgctgacatgacgaaggaatttgaaagagaatcttcataa

SEQ ID NO: 2581 - DNA, 1113 bp, Saccharomyces cerevisiae
atgtcgaaacagtgggcgagtggtacaaacggagctttcaaaagacaggtttcgtccttcagagaaacaatctctaagcaacacccaatttataagccagcaaagggaagatattggttgtatgtttcacttgcatgcccatgggcccatagaacactaattacgagggctttgaagggattaacctctgttataggatgtagcgtagtccattggcaccttgacgagaaaggatggagatttttggacatggaaaagcaattggaggacagtgaagattttttggaacattggcacgatgttgcaggtggtattagaactgctaaagaggattccagcaagagcttcgccgagatcaagaatgacagtcaaagattcatggttgatgctaccaatgagcctcactatggatacaagagaatcagtgacttatattacaagagcgatcctcaatactcggcaaggttcaccgtcccagtcctgtgggacttagaaacccaaacaattgttaacaacgaaagtagcgaaattataaggattttgaactctagtgcgttcgatgaatttgtcgacgacgatcacaagaaaacggaccttgttcctgctcagttgaaaacacagatcgatgacttcaattcttgggtttacgacagcatcaacaatggtgtatacaagaccggattcgcagagaaagcagaagtttacgaaagtgaagtcaacaacgtatttgaacatttggacaaagtggagaaaatcctgagtgacaaatattccaaattgaaggccaaatacggtgaagaagatagacaaaaaatcttgggtgagttcttcactgtgggtgatcaattaacagaagctgacattagattgtatactaccgtcataagattcgatcctgtgtacgtccaacatttcaaatgcaattttacctctattagagccggatatccatttattcatttgtgggtaagaaatttatactggaattatgatgccttcaggtacacaacagattttgaccatatcaagttacactacacgcgttcccacacaaggatcaaccccttgggaattacgcccctgggacccaagccagatattcgtcctttataa

SEQ ID NO: 2582 - DNA, 1113 bp, Saccharomyces cerevisiae
atgttcattaaaaacgatcacgccggtgacaggaaacgcttggaagactggagaatcaaaggttatgatccattaacccctccagatctgcttcaacatgaatttccaatttcagccaaaggtgaggaaaacattatcaaggcaagagactccgtctgtgatattttgaatggtaaagatgatcgtttagttatcgtgatcgggccatgttccctacatgaccccaaagccgcttacgattacgctgacagattggctaaaatttcagaaaagttgtcaaaagacttattgattattatgagagcgtatttagaaaaaccaaggactactgttggctggaaagggttgattaacgaccctgatatgaataactcttttcaaatcaataaaggtctacggatttcgagagaaatgttcataaaactggttgaaaaattacccattgctggtgagatgttggataccatttctccgcagtttttgagtgattgtttctccttgggtgccatcggcgccagaactactgaatcccaactgcacagagaattagcatccggtctatctttccctattggatttaagaacggtactgatggtggtttgcaagtcgccatcgacgctatgagagccgctgcacatgaacattacttcctttctgtcacaaagccaggtgtcactgctatcgtgggcactgaaggtaacaaggataccttcctgatcttgagaggtggtaagaacggtactaactttgacaaagaaagtgttcaaaatactaagaaacagttagaaaaggccggtttgactgatgattcccagaaaagaattatgatcgattgttcccacggcaacagtaataaagatttcaagaaccaaccaaaggttgccaaatgtatttatgaccagctgacggagggtgagaatagtctctgtggtgttatgattgagtccaacataaatgaaggtagacaagatattcccaaagaaggtggcagagagggattgaagtatggttgttctgttacggatgcttgtattggctgggagtccaccgaacaggtattggagctattggcagaaggtgttagaaacagaagaaaggccttgaaaaaatag

SEQ ID NO: 2583 - DNA, 1116 bp, Saccharomyces cerevisiae
atgactagacctaaaactttttttgatatttctattggaggtaaaccccaaggccgtatagtttttgagttgtacaatgacatagtgcctaaaacggctgaaaattttttgaagttgtgtgaaggaaatgctggtatggcaaagactaaacctgatgtaccattgtcgtacaagggttccattttccacagagtgatcaaagacttcatgtgtcaatttggtgattttaccaattttaatggtactggcggtgagagcatatacgatgaaaaattcgaggatgaaaatttcactgttaaacatgataaaccattccttctatccatggccaacgccggtccaaataccaatggatctcaagctttcataacctgtgttcctacacctcatttggacgggaagcacgttgtgtttggtgaagtgattcaaggtaaaagaattgttcgtttgattgaaaaccaacaatgtgaccaagaaaacaacaagccattgcgtgatgtaaagattgatgactgtggcgtgttacctgacgattatcaagtgccagagaatgccgaagctacaccaacagatgagtacggcgataattatgaagatgttttaaaacaagacgaaaaagttgacttgaagaatttcgacaccgtcttgaaagctatcgaaacggtaaagaacattggtactgaacagttcaagaaacagaactattccgtggctttagaaaaatatgtcaaatgtgataaattcttgaaagagtatttcccagaagatttggagaaggaacaaattgaaaaaatcaatcaattgaaagtgtctattccattgaatattgccatctgtgctcttaaattaaaagattacaagcaagtattagtagcctcatcggaggtgttatatgccgaagcggctgacgaaaaagccaaggccaaagctttgtaccgtcgtggcctggcctattaccatgttaatgacacagatatggctctcaatgacctagaaatggccactactttccagccaaatgacgctgccattttgaaagctattcataatactaaattaaaaagaaagcaacaaaacgaaaaagctaaaaagtctctttcgaagatgttctcctga

SEQ ID NO: 2584 - DNA, 1116 bp, Saccharomyces cerevisiae
atgtacaagaactattattcaaacacagaagtttataaaaagcataaagactctggaagtttgaggaagaaagctttgagatcgagaagatcatcttttttttcatttttcaatgactcgtctagttcgaatggaaacgaattcataggttttagacgatttgcaaaagcatatctgtttggtcgtgagataggttcatgtggtacagattcatatacaccagttggggcaaatgtaaacaaaagacgtttaaaaaaagaagataaaaacgatcaacagctttggaaaaggcagcaccattcacagggttgtttttttcccatagatgatgacagtaataagcaaacagaagcagccgtcaacaaattttatgagaatggagaatacgttaatcaggatttaattttcaagggaaaagtatattcagaagaatcagaggttgttgatgagaaaacggcaggttctcagaatcccgctcttctcaaaacaagatcaatttcattaaacgatataccgcgcggcacaggcatctctagtgtattgtctcaagtacgcggaggttccttagaaagaattattgtctataggtacgatactccggaacgttctttgcataaagttgatcttttcttcttaaattacgagggagctcaatcttttatgagatacgcaaaaacaaatatttttaaagttaatggagttcaattaaaaccagaatggatattcctcgagagcacatatgaaaacataatgaaagagcaatctgtcaacagaataatagaagaggaaaagttcatatcaagatgtttgatagtgaaaaaaagctcgacaacagcaatgcctaacaaatcaaatctgaataaagggcaaactttagaaaacattgatattcaagaattagaaaaagattttcagaattttggagaggttctagaaattacgcctattgtatcaagaaaattatgcgtatctatattcttttacgatatttccagtgctatgagagctatggaagaatacgaacaaaagggctcatatctatataataaatattttaaaacatggacaatatggtacgggaaagatattacagaccagccttgcattgacttgtag

SEQ ID NO: 2585 - DNA, 1116 bp, Saccharomyces cerevisiae
atgtggaatcctattttactagatacttctagtttttcattccaaaaacatgtgtctggtgtgttccttcaagtgcgtaatgccaccaaaagggctgcgggctcgagaacaagtatgaaggattctgcaggaagaaggttaggaccaaaaaaatatgaaggccaggatgtttccacaggtgaaattattatgaggcaaagaggaacaaagttttatcctggagaaaacgttggtatagggaaagatcattccatattcgccttagaacctggtgttgttcgttactatcttgatccttttcatcctaaaagaaaattcattggtgttgccttgaggcgtgatttgaaactgccatctcctcattttgagcctaccgtaaggaggtttggccgttttgagttaacaaataaaagggcagcatataaggaagaaaattctatttctagaaaagactatctcgcaaaacctaatattttgaagcagttagaggtcagggaatctaaaagaaaggagttacaagacaagttgagtaaggttcttcgggatgaacttaagttagatataaaagacatcgaattggcaacgtcatacttaattcgtgtaagggcttccctgaagaatggataccccatagaagatgcaaggttcaatagtagatattatttaaaagaagaagagcgtttgaaggcaaggagagaaagctggacgaatgagaaattgtcggagagtctatccaagattgatgagtgtagtgatcttttgaactcatctacatctttcaataacaagctagagctacaccagtatatttcggaacaagaaaaacaagctttgaaggcaaaactattagaggacctagaaaaatcccaacacttagaaaccaaaaaagacaagaattatattaaggcgcttttcaaggacgcttgtaattttttgactttatctgaagaagtacatttgcgtaggaaatacttaaagtcggtcttccccgaaacagatagtacggttgaaaccaaaagcgggaagaagtcaattgtgtctagacgttttgattacaccaaaaataaagttgaagtcattgctagaagtaggcgggcttttttgagcaagctttga

SEQ ID NO: 2586 - DNA, 1116 bp, Saccharomyces cerevisiae
atgtttagatctgttgctactagattatctgcctgccgtgggttagcatctaacgctgctcgcaaatcactcactattggtcttatccccggtgacggtatcggtaaggaagtcattcctgctggtaagcaagttttggaaaaccttaactccaagcacggcctaagcttcaactttattgatctctacgccggtttccaaacattccaagaaacaggaaaggcgttgcctgatgagactgttaaagtgttgaaggaacaatgtcaaggtgctcttttcggtgcagttcagtctccaactactaaggtggaaggttactcctcaccaattgttgctctaaggagggaaatgggccttttcgctaatgttcgtcctgttaagtctgtagagggagaaaagggtaaaccaattgacatggttatcgtcagagaaaatactgaggacctgtacattaaaattgaaaaaacatacattgacaaggccacaggtacaagagttgctgatgccacaaagagaatatccgaaattgcaacaagaagaattgcaaccattgcattagatattgccttgaaaagattacaaacaagaggccaagccactttgacagtgactcataaatcaaatgttctatctcaaagtgatggtctattcagagaaatctgtaaggaagtctacgaatctaacaaggacaagtacggtcaaatcaaatataacgaacaaattgtggattccatggtttataggctgttcagagaaccacaatgttttgatgtgatagtggcaccaaacctatacggggatatattatctgacggtgctgctgctttagtcggttcattaggtgttgttccaagcgccaacgtaggtccagaaattgtcattggtgaaccatgccatggttctgcaccagatattgctggtaaaggtattgctaacccaatcgccactataagatctactgctttgatgttggaattcttgggccacaacgaagctgcccaagatatctacaaggctgttgatgctaacttaagagagggttctatcaagacaccagatttaggtggtaaggcttctactcaacaagtcgttgacgacgttttgtcgagattatag

SEQ ID NO: 2587 - DNA, 1118 bp, Saccharomyces cerevisiae
atgtctttaccagctacttttgatttgactccagaggatgcccaacttttgttggccgctaacacccatttaggtgctagaaacgttcaagtatgtacacatatcccatacgattatgttctatagatgataataggtctcgaaaagaatatgtccccgatttaatcatatttggaggtcagaggaccaaaggtaatttcagaggaattttgaacacgccgggtttagaagagttagaatttcacttcttagtgagggtaaggagaagaaactcaataagaatatacatcctcgactgtgtcaaagattatgaactccgatgaaacagtaaaacgtcaaaaaattccacgggatataattcggtactttattggatatggaagaaaacattatatatgcacaaatgaacgctcttactaacataatttatctttcctctctttttttaggtccaccaagaaccatacgttttcaatgctagaccagatggtgttcacgttatcaatgttggtaagacctgggaaaagttggttttggctgctagaattattgctgccattccaaacccagaagatgttgttgccatctcttccagaacctacggtcaaagagctgtcttgaaatttgctgctcacactggtgctactccaatcgccggtagattcactccaggttctttcactaattacatcacccgttctttcaaggaaccaagattggttattgttaccgacccaagattagacgctcaggccattaaggaagcttcttacgttaacattccagtcattgctttgactgatttggactccccatctgaatttgttgatgtcgccatcccatgtaacaacagaggtaagcactccatcggtttaatctggtacttgttggctagagaagttttgagactaagaggtgctttggtcgacagaactcaaccatggtccatcatgccagatttgtacttctacagaaacccagaagaagttgagcaagttgctgaagaagctgctgccgctgaagaaggtgaagaagaagaagttaaggaagaagtcactgaaggtcaagctgaagctactgaatgggctgaagaaaatgcagacaacgttgaatggtaa

SEQ ID NO: 2588 - DNA, 1119 bp, Saccharomyces cerevisiae
atgaaatgcagggtatggtcagaggctcgtgtttatacgaatatcaataaacaaagaaccgaggaatattgggattatgaaaatactgtaattgattggtccacaaatacaaaggactatgaaattgaaaataaagttgggcgaggaaaatactccgaggttttccaaggtgtcaaattagactctaaagttaaaattgttattaagatgttgaaaccagttaaaaagaagaagatcaagagagaaatcaaaatcttaacggatttgtctaacgaaaaagtgcctccaacgactttgccatttcaaaaagatcaatattacacaaatcaaaaggaggacgttttaaaattcatcaggccctatatctttgatcagccacacaatggtcatgcaaacataattcatctatttgatataataaaggatcccatctcaaaaactccggctttggtcttcgaatacgtagataatgtggacttccgtattctttaccctaaattaaccgatctcgaaattaggttttatatgtttgagttattaaaggccttagactattgtcattcaatgggaataatgcatagagatgttaaacctcataacgtaatgattgatcataagaataaaaaattgcgattgatagattgggggcttgctgaattttatcatgttaatatggaatacaatgttcgtgttgcgtcgaggttttttaagggtcctgaactactagttgactacagaatgtatgattattctttagacttgtggtcgtttgggacaatgttggcttctatgatctttaaaagagagccatttttccatggaacgagtaacacagaccagcttgtcaagatcgtcaaagtacttggtacaagcgattttgagaaatacctgttgaagtatgaaattaccttaccgagagaattttacgatatggaccaatacatcagaaagccttggcatagattcatcaatgatggtaataaacatttaagcggcaacgatgaaattattgaccttattgacaatcttttgagatatgatcatcaagaaagattaactgctaaggaagcgatgggacacccgtggtttgccccaataagggaacaaattgaaaaataa

SEQ ID NO: 2589 - DNA, 1119 bp, Saccharomyces cerevisiae
atgcaaacgatttctggagtcttaccaacagtattaagcccctcagagcttaggtctgatgatgaacgaaccttccagtttgacgaagaagctgaaataacaacgcatttgactgaaagcgaagatttacgaaggttaatcaatgagactgcacaattaggtgtcagagttgatcatattcacgataaaactgaccaagaaattgccaggctggaaaaagtgattaaagaagttactgaaagtgatacttttttccgatcttgttctggctggtttaaaaccaataagaatttttctgacagtgaaagcagttcaaatacgcagctgaagagtctttctcaattgcatggccgctatgatcgtgattggagacagaggttgaataagtggtttagaaaaaataagagtaaattagccctaccatctgataataatctggaagaggtaaacgatgataaagtatatggatatggagaggacttgatggaacggggcaagacaccatattttagtgatattgatgattttatgaatggattgaatattatatcacccttaacacctgacgattttgaaaatgacgatacattagttaaaattgatgaaacctgccaaattcactccgcttctgaacctgagaagacctccataagtcccacatttgggaaaaatatcaaaaaggagctagtaactgatgatacggaaagcattattagcgggcctcctttgcaagagaataaaaagactcttttgaaataccgatatgtcaggacttctcttgatatgctcggctctgaaaagagtagttctaaaaataacagcggtggtatgttccgtattttccataagagtgctaattttggcgacaaaaatcaagaaaacgtgccacgagtgtgggacacacttagaaataatttgggaagggaaatttatcttttgcaaggaagattcaaaaaatggactacaaagcatcaaaatcttaagaagggccaaccttgtaaagatgaagacgccgttaccgttcccttaccatcatctgatccgggaaaggaaacacagttggaaactaaactctgttttgtgcccgaaccaggtgatcagcctttggtacaagcataa

SEQ ID NO: 2590 - DNA, 1119 bp, Saccharomyces cerevisiae
atgctactaaatgtaacgtcttcgcaatacataagcacacctcaatccagaagtctgagtgaaattgacacgtcagaaaccgccagcttatcatcagctacagaccacatttttgcattatccactgaggttgtatcctcaattacgacgaacctcattgagggtttagaaagttcgattcaggtccccatatcaaccgcatatggtacgacttccttccgcaacaacacttcaagtccacaatatctggttagcaattgcacttcctctgttcaaagcaatatcactatcgatagaggactgttaagtacattgaagactttcactacttcacaggtgccaaccatagagccttcgacgactaaactaacaacaccattatctacaacatttacctcaacctctacatcggaaatatactccgtattcaccagcgagaactcagtttatatcatctatgaccaagaatacaaatttacagagcgatcgacaacatttaacacccactttccccaaacaactgtgcttcaagaatcaaatcctccgttaactttcaccattccatccaataccattaccggggatgctaaactttatcaatatctatctggtgcactaaacactcaagatacctcagatgccaataatagaaggaccggagttattgtcggttctacggttggagttgtcattggagttgtaatagtaatttttatcggattcataattattagaaacagacgaaacgtgaaaaatcacagcaaaaagggctttagccatgatattggcaagagggtaagttgtgatgaggtaacagaaacagaagcaccgtcaaatccgttcctaaatgtccttaattataaagtaacaaccaacggcgagggcaaacgagattcctttgaaaatggtagagatttacacagagctagttcctcagacggtatatatatagcacatccttattatgggatggcggatcacgaatccgggagattttcatacgtatcgtcatacaatgaatctgcggagtcatccattgaagaaacaagttccagtgcgtctactattactcggccaaatattcagcaaaccaatagctttttgagagaaattatttaa

SEQ ID NO: 2591 - DNA, 1119 bp, Saccharomyces cerevisiae
atgtttagaatagctaaaaacctcgtacggacttttgagcagagcgtgcaagataccctggcactctcgcaggactcgagcaatctggacgctttctttcagtctataccaccaaatttgttgtctgctcagttggaatcacccgtagatgcggtttctgaaggtgttaagcacaccaacgtcaatgaaacgctttccggtctccgcattgtttgggtggacgagatgcagttccaactgcagtcctttttcgactatatagtaggtttcaatgatgatccggtgccggtggtcagtaatcaacacggattttcgtacccagattaccgtcgtatcacatccatcttcaatgaacactgtggccgaactttgaaggtcaacatatggtcagctaaaggaggcacgttcagagacgagtatatcagcattatatcgaaggagagcgacgatttggacgatgtttctctaaaccatgacgagaggaggccatctagtggggaagcgcaccagttccaagcactcgggttcaaagtccaatggacgcctttgatagcttccactttcacataccatatcctgaacgtgaacatcccagatggacccgcccaatcggcagggctcatcccagatgaagactacattatcggctgccaagatggcctgttggccacgggaggggagacgcttttacaagatattgttagatcaagagcaaactacgatctggtcctttatgtctacaacaaagtttctgactgtgtgagaccaatcacagttcatataggtcccgacggcaggttgggttgcaacgttggatacgggtttcttcacaggattccaacagtaaagcactgtccacaacaagcacagcagcaggggcaagatgacaaccctgttcctgttcctgttccagtagaatctgagacggcttttgtgccatcagcattcacagcaccaccggtgccaacaaagaagaaatcaaaaaataaaaagggtacccagccattggcaatggatgactattttaatgaaggcagagataagtcatctaccgctgcgaagtcagcagaatctgacatcctcgccccaccaccacaaaaacagtcatcctctgattaa

SEQ ID NO: 2592 - DNA, 1119 bp, Saccharomyces cerevisiae
atgtttatttggcagagaaagagtattttactagggaggtccattctgggcagcggccgagttaccgttgctggaatcattggaagcagcagaaagagatatacgtcttcttcctcctcctcctcctccccttcctcgaaagaatcagcacctgtgtttacgtcgaaagagttggaagttgcaagaaaggaaagattggatggactgggaccgttcgtgtctcggctgcctaagaaatggataccgtatgcggagctgatgaggctagagaaacccgtgggcacgtggctgttatatttgccctgcagttggtctatacttatgggagccatgatgcaaggtgctacattgagcgcaacagctggtatgttgggtattttcggtgtaggtgcattggtaatgagaggtgctggctgcaccatcaacgattttttggatagaaagttggatcaaagagttatcaggtccgtcgagaggcctatcgcctctggtagagtgagcccccgtcgggcgttagtattcttgggggctcaaactcttgttggaatgggcgttctatctttgcttcctgcgcagtgttggtggctaggccttgcatcgttacctattgtgttcacataccctttgtttaagcggtttacgtactatcctcaagctgcattaagtgcatgtttcaattggggagcgttacttgggtttcctgccatgggtgtaatgagctggcctacaatgatacctttgtacctgagcagttacttgtggtgtatgacttacgatactatatacgcacaccaggataaaaagtttgacatcaaggctggaatcaagtctaccgctttggcttggggtccacgcacaaagtctatcatgaaggccatgtccgcgtctcaaatcgcactgttagctgtcgccggcttgaacagtgggttgttatgggggcctgggttcattggtggactaggagtcttcgcttatagactcttcagcatgataaagaaagtggatcttgacaatcctaaaaactgctggaagtattttaatgcaaatatcaacaccggactttactttacgtacgccttggcagtcgactacatcttgagactgtttggattcttgtag

SEQ ID NO: 2593 - DNA, 1122 bp, Saccharomyces cerevisiae
atgaacgtcatagatttaagtgatcctgccatcaatgtggattatgatagcttgattggcattgacaatgaggaatctcaagaaatttttgaaaatgaagtgaaggaagatggacaacaagaagagcaggaagaagcatcttcaagaaaagatgggctcatcgttgaaccagggagagatgttgagagtttgagaagggctattcgagatcagttgcttttcaagatacatagacaaaaccaatcagactgtgcagatgcgagaaagttgagtaacgatgaagaagatgaaagtcggcaacagaaattagaaagaataagagaagaattggaggagttgaaaatagaaaatttaacatctgaaatgcaaactgaaatcaaggaattgtgcgaaattcaatcaaaattggcgacggaatcatctagtagattgacaaatttgaggaagaagcttctcgaaacatatgaaggccaagataccgtcatattgccaaacataattcttgatacgagtaatatcaaaagattgcaaaagttagatcagaaaatatccctaatggaacgttttgttggcataccagaagctttggaggcagaagaagataggaaatcggttcatagtaaagtcaatgaactatatagaagtattcaacttttacaaggcgatgataaggcggaaggaaagctgcaaaagttccgggatagactcgtagaactgaacgaggaatttgaaaactcattgttaggcaagaaaatacaacaggacttgaggttgaaagatgacaccgtgagcaagcttgttatgcccgaaaacaaagtaaaggagataaatagtatgtattccatgttcaagcaatatcaagattcactaccactgttggcggagaggatgaaaagtctcaataaaatgaacaacagggtgatcgaggtgtacgaaaccacgaaagggctggattcacaaataaccagcatccaagaacaaggaaaagtttggctaaaggctttaaatgagctggataaaaaattcgatgaacaagaggttaaaattcgcgaaaatatggagcagatcaggcgtaaaattgataccctcgaagacgaagctctacagagaaatagcaaataa

SEQ ID NO: 2594 - DNA, 1122 bp, Saccharomyces cerevisiae
atgaatggcgagagactgcttgcttgtattaagcaatgtattatgcagcacttccaacctatggtgtacgatgaaagtaggtgtgtaatcgagacgacaagggggacttttccagttcctgacaattataagaaatacaaaacgttagcatttgcatttgttggacatgtactgaatacagacgacacaccggtaattgaaaaagaactggattggcctgatcctgcactagtgtacaatacaattgtcgatcgaatcataaatcacccagaattatcacagtttatatcggttgcatttattagtcagttaaaggccaccatcggagagggtttagatattaatgtaaaaggcacgctaaaccgcaggggaaagggtatcagaaggcctaaaggcgtattttttagatacatggaatctccatttgtcaatacaaaggtcactgcattcttctcttatcttcgagattataataaaattgcctcagaatatcacaataatactaaattcattctcacgttttcatgtcaagcatattgggcatctggcccaaacttctccgccttgaagaatgttattaggtgctccataattcatgaatacatttctaagtttgtggaaagagaacaggataaaggtcatataggagatcaggagctaccgcctgaagaggacccttctcgtgaactaaacaatgtacaacatgaagtcaatagtttaacggaacaagatgcggaggcggatgaaggattgtggggtgaaatagattcattatgtgaaaaatggcagtctgaagcggaagatcaaactgaggcggagataatagccgacaggataattggaaatagccagaggatggcgaacctcaaaattcgtcgtacaaagttcaaaagtgtcttgtatcatatactaaaggaactaattcaatctcagggaaccgtaaaggtttatcgcggtagtagtttttcacacgattcgataaagataagcttacattatgaagagcagcatattacagccgtatgggtctacttgacagtaaaatttgaagagcattggaagcctgttgatgtagaggtcgagtttagatgcaagttcaaggagcgaaaggtggatgggtag

SEQ ID NO: 2595 - DNA, 1122 bp, Saccharomyces cerevisiae
atgacacagactgataatcctgtccccaactgcggtttactgcccgagcagcagtattgctctgcagaccatgaagagccactgttgttgcatgaagaacaattgatattccctgatcattcctcccaactgtcctcagcagatatcatcgagcccatcaagatgaacagcagtactgagtcaattatagggacaacgctgcgaaagaaatgggtaccactatcctcaactcagatcacagctctttccggcgcatttgctggattcttatcaggtgtggcagtatgtcccctcgatgttgccaaaacgcgattgcaagcacaaggactacaaactaggttcgagaacccctactatagggggataatggggacattaagtactatagtaagagacgaaggcccgcggggcctctacaaagggctggtaccgattgtcctgggctacttcccaacctggatgatatacttctccgtgtatgaattcagcaaaaagttctttcacggcatcttcccacagtttgattttgttgctcagtcatgtgctgcaatcacggcaggcgctgcatctaccaccttgaccaacccaatctgggttgtgaagacaagacttatgctgcaatcaaacctcggtgagcaccccacacattacaaaggcactttcgatgcattcagaaagctattttatcaggaagggtttaaagcattatatgcggggctggtcccctcattattagggctatttcatgtggctatccatttccctatatacgaagatttgaaggtaagatttcactgctattctcgggagaacaacaccaactccatcaacttgcaacggttgatcatggcatcgtccgtctctaagatgattgcatcagcagtaacatatccgcacgaaattttacgaaccagaatgcaactgaaatcagatataccagattccattcaacgacgtctgttccccctcattaaagcaacttatgcacaagagggactaaagggattttattctggatttactactaacctagtacgaaccattccggcctcggcaatcactctagtgtcctttgagtatttcagaaaccgcctagaaaatattagcactatggtaatttaa

SEQ ID NO: 2596 - DNA, 1122 bp, Saccharomyces cerevisiae
atgactattgatggagacgtacatgaaatttccccatttttccaggttaggcaaactaaatggggcggtagggcttgtttcagtaatggtaatattcctaaagggacaacagtcttgcaagtcagtaattttacaggaacatctatttcctatgagttcaggaaggaagtttgtcacaattgtttcgcatacgctaatgcgaaaactatgaagtacaaactaaactacgattacctgagagatttggtttgtaatgcacactaccaaattaaccctaagaagtttctgggcgctggactgtggttctgttcagaacattgcagaacttcttatcttcaaataccaaatatcattgaattaattgaatgttatgagatattactgcatcattttccaagcatgctgaaaagatataattatacctctgaacaggaggaaaaattaaactctatcttaatttcggaaaatgtcatacagtcttcatgggatgagattgaaagtaaatggataccgcgcatcaacaacatgaaatctgcgaagagaataaatcaattaccacccacttgcgaagatgaatattgctgcattaggtttgtgtgcgagagtttgtttaatcttaaatatatggatcctcagtgcataacataccgagctttcaatatgttacaatcgaatgagcttagcaaaatatctaaatttcctgtcttactgcactttcaaaaattagtatttcaaacactctatattctattaccttcacatttgcatagaatgctctccataccgctattgagacatatattaggtactgaatatgggaatgcttttggtttatggcaagagggcgaagcctcagacagcagagaatattttggatactgggtatttccagaagcctcctatttcaaccactcttgtaaccccaatataacgaaatatcgtaaaggtaattcaatgctattcactatgaatagagatataaaaaaggatgagcagatctgtatcgattattccggggtactggacttaccaacagtaaaacgccgggcctttttggccgacagttggttttttgattgtgcttgtgaaagatgtaaatcagaattgcaatctgtccattag

SEQ ID NO: 2597 - DNA, 1122 bp, Saccharomyces cerevisiae
atgatgccagctaacgaagataaagagaataatatcgtatatacagggaatgaaagttccggcattaactttccacagacgccggctcacttgctgaaaaggtcgcactctaatattttaaaaccacctgtaagattggaccaactcaaaagggatgcgaacagcaacaatggcaacacattaaagtacatacaaggagggaaggaggtgtcacccacaaaaaggttgcatacccatgcgcaacaacaaggaagattgcctctggcagcaaaagacaacaatagatcgaaaagctttatttttcccgaaacttctaatcagagtaaagatgcagacttaccacaactacagaatacactatctatacgcaaaaacgaccaactcaggaaactttcgcaaatttctcgcagtcgtagtagggccaaccataatgatttgttaagcaattcaagaaagttacaaaagtacggttctgtccttggttataatgctttacctaaaatgaaaagtctagttttaaaagatcttgcagattcaggtaaaaatgaagagagttccgacgatgatgaaggtaatgaagattccgagagtaaacttggcaaaaaactccaaagtgcacttttaaaacaggattcctccgacggtgaaaatgaattaaatggtggcctaggactatttaatgagcaaggtggtctgcaacaactcataaagaactccacgaagaatgagcaaaaaactaaaaacgataaaagtgataaaactgatgactatgatatcgaaatagcaccacagaggcaggagccgttaccgtatgtaccagaaggctattccccatttcaacaagatgatattgaaaagctgaagacgttcaactcaccatataagcttgacttggaagacgaagatgacaccccagataaagttgatttactcccactagaacaaattgatgaagaaggcgaaaaagatgagactgagtgcatcactcggaatcaagaagaaggtgcagcgttaccactgctgtctaagaacttcaaagaagttgccgccgtcccaaccatggagttagtgtacagcgaagaaggcctcgatcctgaagaactagaggacttagttacttag

SEQ ID NO: 2598 - DNA, 1122 bp, Saccharomyces cerevisiae
atggctgccgtcacattacatctaagagctgaaactaaacccctagaggcacgtgctgccttaacacctaccacggttaaaaaactgatagctaagggcttcaaaatatatgtagaggacagtccacaatctactttcaatattaacgaatatcgtcaagcaggtgccattatagtgcctgcaggttcatggaaaaccgctccacgcgacagaatcattataggtttgaaggaaatgcctgaaaccgatactttccctctagtccacgaacacatccagtttgctcactgctacaaagaccaagctgggtggcaaaatgtccttatgagatttattaagggacacggtactctatatgatttggaatttttggaaaatgaccaaggtagaagagttgctgcctttggattttacgctgggttcgcaggtgcagcccttggtgtaagagactgggcattcaagcaaacgcattctgacgatgaagacttgcctgcagtgtcgccttaccccaatgaaaaggcattggttaaagatgttaccaaagattataaagaagccttagccaccggagccagaaagccaaccgtgttaatcattggtgcgctaggaagatgtggttccggtgccatcgatctgttgcacaaagttggtattccagatgctaacatattaaaatgggatatcaaagaaacttcccgtggtggtccctttgacgaaattccacaagctgatatttttatcaattgtatatatctatcgaagccaattgctcctttcactaacatggagaaactgaataatcctaacagaagactaaggaccgtggtggacgtatcagcagacactaccaaccctcacaaccccatcccaatatacactgtggctactgtgtttaacaaacctaccgttctggtacctaccactgccgggcctaaattatctgtcatctctattgatcacttgccttctttgctgccaagagaagcttcagaatttttctctcatgatctcttaccatctttagagctcctacctcaaagaaaaactgctcctgtctgggttagagccaagaaattgttcgatagacattgcgctcgtgttaaaagatcttcaagattgtag

SEQ ID NO: 2599 - DNA, 1122 bp, Saccharomyces cerevisiae
atggctgtcggtggtaataactggagcatgtggctgcgaatgtcacgggtccacctcaggcagatcacgaagtctctggaccgaacgctgatcagtttgagccatgggaatttttcccaccaatataatcgcaatatttttgtcacttggtggaagagcctatttgaggcttctacagcttttaggagggcaagtggtttaacggtatctcctctcacgaggagaggaatcgcaaggtttgaccatttcagacctgttcccaatgtcagtaaatttgcttcttttcccagagtgcccaaaggagccccaaggggcctttttaccaactggaatatgactacatcaaagagattattagggcagagagcttattcgacttccagtatcaaatttacccaagaagccgtgaataacatgactatatctttgaggtgttttttcaactcactaggcggattaaatcagtgctcccactctaattcctgcaaagcttatcagaatgcgtctaatgttacctctaaacaggatcacgtccaaccagttgcccttaagaagttatctcaaaaggatatcaatttcattcgtaatttagaactatttaagataatgaagacccagaatgaagtcgttgatgaaacaagcgcatattacatggaaaaaccaggttcctatattgaatttaccatttcagaatttaacgttaatgggacattctccgcacctttgtcatttttagatccttctttgttagcggatttggatgaaatgattagaaattacaaatacgaattaaaatcaatatacagtagtgttgacatgatcttgcagaattatggatcattgccgataacttttcatcgaaataagattcgaatacattttccaaactcaactgtggtggaaacagaaaaactaattgcaggtctgaatattgctacgggtgttatttacgcagatacgtctcccgatatcagtctagaaggtacaaatttgaatgctctggttaatgttgacaattcaggaagcgtatggtcttttgttaaggagccctcgtttccctctaggagcgctttttcacctattttatcagatgcatcctatgatacttatgaattggtctag

SEQ ID NO: 2600 - DNA, 1122 bp, Saccharomyces cerevisiae
atgggttatattttgacaggatattctagccgtcatgataagagaaagaaacatgcacttcctttgcatcggtatgcatcgtcttcgataaacttgcagcaccatgtgcatctcttagagacccgggtttcatccaagaggccaatatcggaagatcaaaggactatcaggcttcctgcgaagaaacttaggcatcatcaaaagctaactttgcaagatttacctgtagagattattcaacatattttcgttttcacaaagggtgaaccgtcgatggtcaccttgaacaggttcttctatagttgcttgaagccatctttttcattattatcgaagatcatgtgggaaaaatatcttttcgatcccctggagtttggcgtaagtaatataaaagcttattcaagaaatattgtgatccctacattatttgagcatgaaactttttttagactactactagatcatcatcctatcctgttgaaaaatatttctcattttcttcccagaaagcactatcaagatatgcagaatggcgattttgatacatctaaagagctagacttgtgttcaatgaacactgaagatacatcgaaagaagacttccctaaaaacttttacaacaatatgcatatttttttaacacgtagggaatgtgtgaagtctctaggtaatcattttactttgaagaatccatatgatgtgatatccccttttatagaatggttttttcaaggtattgatatgcaaggaactgacctaagccctaagtttacctttgtttctctatttgaatcaatagatttaatcctatacgtctctggatctacagtgcaaaaactagcgtctattgaaccccttacgactgtaatatttttattatatttcacgtatgctgattcactagggagtctgaactttgagttttttttgcagaatagatcaagattacagctcatagagaaatttatcctgaaatattattacaatccatcattgacagaaaacgaacttttatctgatagcactatatgggacctgttaaggcgggtgtctgatttaaaactcatagatttggtcgttaaatgcggcggaaggcctcaatacggggttatgtttgcataa

SEQ ID NO: 2601 - DNA, 1122 bp, Saccharomyces cerevisiae
atgtcgttgaatatacatatcaagtcaggacaagacaagtgggaagtaaatgtggcacctgaaagcacagtgttgcaattcaaggaggcgataaacaaagcgaacggtatcccggtggcaaatcagagattgatctactcgggtaagattttaaaggacgaccaaaccgtggagtcataccacattcaagacggtcacagcgtccatctggtcaagtcacaacccaaaccacaaaccgccagtgccgctggcgcaaataacgccaccgccaccggtgcagcagctggcactggcgccaccccgaacatgtcgtcaggtcaaagtgcaggcttcaatccgctggccgacttgaccagtgccagatacgctggatatttgaatatgccatctgcagacatgtttggcccggacggtggtgcattaaacaacgactcgaataaccaagacgagctgttgaggatgatggaaaaccccatcttccaatcgcaaatgaacgagatgttgagtaaccctcagatgttggactttatgatccagtccaacccgcaattgcaggccatgggtccacaagccaggcaaatgctacaaagtcccatgtttagacagatgctcaccaatcctgatatgattagacagagcatgcaattcgcaagaatgatggaccctaatgccggtatgggctctgcaggtggggctgcctctgccttccccgctcctggtggcgatgctccagaggaaggctccaacacgaacactacttcctcatccaacacagggaacaacgcagggactaatgcaggtaccaacgcaggcgctaacacagctgcaaacccatttgcgtctcttctgaaccctgcattaaacccctttgctaacgcgggaaacgctgcatccaccgggatgcccgccttcgatcctgcattgctagcgtctatgttccaaccccctgtacaagcatctcaagcagaagacaccagaccaccggaagaacgctatgaacatcaattaagacaactaaacgacatgggcttcttcgatttcgatagaaacgtcgcagccctcaggagaagcggtggctccgtccaaggcgctcttgattcactactgaacggcgatgtttaa

SEQ ID NO: 2602 - DNA, 1122 bp, Saccharomyces cerevisiae
atgttttccgctcaaaagccaatatatggcaatggagcaggcgtgaacatgggtggtggtggtccttcaactaataatccaggatctatgtccatgcctggggttccaacttcaatgggtccaggcatgaatcaacaaattccaagtggaggccccatgctaatgggcaatactccgaataataataatagcaatgaaaatggcgagaacaacggcaataacggcaataacggcggtaacgatgctaacgcaactcgaaacaatcccaacatggtcaataatagaggcgcagtgcatgctctagatgatcccaatgtataccactggatttgtcaattgacctacggccctcaaaaggaacaagcactgcttgaattaggtcgcaaaagagaacagtttgatgaccttgccgttgtgctttggtcttcctttggtgtaatgacctcattgctgaacgaaatcatttccgtatatcccatgctgcaacctcagatgctctctaacaatctatcaaatcgtgtatgcaacgctctagttcttctacagtgtgttgcatctcacccagagacaaaacatctctttttacaggcccatattcctctctttcttttccccttcctaaatactacctccaggcaaagaacttttgagtacttgagattgacttcattaggtgtgataggcgcattggtcaaaaatgactcacaagacgtaataacgtttttgctaagaaccgatatcgtgccgttatgcctaaggatcatggaatcttcttctgagctttccaagacagtcgccattttcattttacagaaaatcctactagatgacgttggattgcaatacatctgtgccaccttggaaaggttctacgccgtaactaatgtcttaaaagatatggttgagcacttgaccgtgagcacaccaccgggacgactactgaaacatatcattagatgctacttaagattaagcgacgatctcgaagcacgcaggctattgaaaatagtcttacctgccaaactgagagataacacttttacggaagtactaagagacgacgtcgggtccaagagatgtctggcacaattgctactgacattaaacgaagaaacctcatga

SEQ ID NO: 2603 - DNA, 1125 bp, Saccharomyces cerevisiae
atgaggatacagtcgctttttgttttatttaatgttgccatcatcgcatggtcatatccatatgagcctttaagggttttacaagtaggagagaatgaggtaatggaggttcccgaatcagaaaagctaaacttacgaagaagaggtgtcaaattctttgatgtgaccaaacacacttctttcttacctttctttaacaaggaggaagagccaacagtaccaacgtataactatcctcctgagatatcgaacaaagaagtagtggatgattcgattaagaatatagacaagggctctatgcacaagaacttggcaaagtttacaagtttttacacccgttactacaagtccgatcacggctttgaatctgccgagtggttagctgcaactatcgctaatattacaaaagatattccgcaagatacgttgactattgaacattttgatcacaaagaatggaagcaatattcaattatagtccgtgtcacgggatctactacgccagaagatattataataattggttctcatcaagattctatcaatctgctactgccatccataatggcagctccaggtgcggacgacaatgggtcaggcacggtgactaatatggaggctctcagattatatacggaaaattttttgaagagaggatttagacctaacaacactgtggaatttcacttttattccgccgaagaggggggattgttgggttctcttgatgtttttacagcttatgccaaacagaaaaagcatgtgagagcgatgcttcagcaagacatgacgggatatgtttctgatccagaagatgaacatgtggggattgtcaccgactacactactcccgcattaactgattttataaaactaattatcaactcttatctatccattccttacagggatacacaatgtggctatgcttgtagcgatcatgggagtgccaccagaaacggatttccaggctccttcgtgattgaaagtgagttcaaaaagactaacaagtatattcacagcaccatggatactttggacagattaagtctcgctcatatggcggaacacacaaaaattgtattaggggtaatcattgaactcgggtcatggtccgcttggtaa

SEQ ID NO: 2604 - DNA, 1125 bp, Saccharomyces cerevisiae
atggctctatcatggaatattcgaatcaggcgcaggtcatggtttagattcatcttaccgattatcgtgctcggtttactgtgctacggtacgtgggcttactgccataaactatgttacgagcaagtcgacaaacgacttcgtcagaaatcagtttcggttggtcttatttgtgcggtatgcttcctagacgtagtcgtgattttcatatggcttcaaatagttatcttggtcggtccaggtacccaaccgcacgtagcaccttttttgatccttcctatagcctctgaagagaagactagcaacacttctcaaaacacttcagtggaatacgatgctgtggttccgcctaagtgttatcagtctgatcctcacggatacccaatatggtgcagtgaatgtcaaagtctgaaaatggaacgaacgcatcattcttcagaactaggccactgcattcctcgctttgatcattactgcatgtggatagggactgttattggtagagacaattatagactctttgtgcagtttgctgcttatttttcaacacttttacttatcatgtgggtgtctatttgcgtttacataagaattattactcaacacaatcataattatagccccaatttaaacgcaaatataatttcaacgttagtgtttgccatccttggatggttattaaccgcaagtttgttggcatcgagtattttttacatgagtcaaaacaagacgtctttggaggctatcatagatagcaaaaggaaaaaatttggaacaaggaagatattttgttattactcggaagcaaacaagttgaggtttgtggtagagttcgatagatctgaatttcactctttctgggacaaaaagtcaatcttagctaatataaaagactttatgggttctaacatacttatgtggataattcctttaggcaagccctatacatctcgatgcaaatctgatggcaaaagcggttcaaaaacaacgctagtggaaatattgggtccctatgaagaaactcttagtgactacaccattcaggccattgaggacaagatatcaagaggagaatatctggccacattgcgggcttctggtgacgatagtgatcctgcttactaa

SEQ ID NO: 2605 - DNA, 1125 bp, Saccharomyces cerevisiae
atgggggaagagattagacttttgtcctctaaaggtcttgagacccatagtagcttttgtttgcccgaggatattttcagaaaccgtttaacatggttgtgcagtgagattcgcaactcaggattttggatctggtcgctatcatggttaccgcttgccgtttggtgggggatggccagtacttggttttatccccttctgacttcagtagttctaatcctggcgctaattgctattttgccagtagttcaaatacagtacagtaaatatactttatcaaatcaactcacccagctttctaaagaaatcatcaaaagtgcaccaggtgcatactctgctgattgggacgctgttgcaatacatttcaattcctacttgtatgaaaacaaagcatggaaaactgcacattttttttttaatggtactgactgccaagaagcattcaggaaaaccattctagagccagctgttttgaggagacaaaacgaagatcctaggttcagttcaattgagattttggtcccttacaccgaagacgcggtgcaggtttattttacaaaagtaaacgcacagtggaggttgatccatggtaagaaggaatgcaaacttactatgttggaaaatgtcaagcttcctaaggaaacctatcgctgcaagctagcatggagttgccagagaatcaggatttctttctctccactagacttccttcctgatatgtctgacttctttatttgtgcaaatttatcaccagcatgcttggtatcttattggctaatagacattttctttagaatgatagatgattttcaaaacataaggcctaaatcgatgaaagttgatgataaaatgcagtacctatcagatattataaacgagcagggtgctagccctgaaaaatgggatacaattgcaaggaaaacgaatacacgattatttgaaaagagggtctggaaaaacgaagagtttttctttgatgggactgattgtcaggcattctttgaacggaactttagtagccttttgttctcaaaaaaatctgcgtcgcctagatcattaaacgttgaactttggaaatacattcaagaagcgcaattgagctgtaactatgagccgttaccataa

SEQ ID NO: 2606 - DNA, 1125 bp, Saccharomyces cerevisiae
atgtcactaatggacaattggaagactgatatggaaagttacgatgaaggaggcctagttgctaatccgaacttcgaggttctggccactttcaggtacgaccctggttttgcacgccagtcagcgtcaaagaaagagatctttgaaactccagaccctcgattaggtttgagagacgaagatattaggcagcagataattaatgaggattactcaagttatttacgagtaagggaggttaattccggcggtgaccttctcgaaaatattcagcatcctgatgcttggaagcatgattgcaagaccattgtgtgccagcgtgtagaagatatgctacaagtcatttatgaacgattttttttattagatgaacaataccaaagaataagaatagcattatcatactttaaaattgacttcagcacgtctctgaatgatttattgaagttattggttgaaaacttgattaattgtaaagaaggaaattcagagtatcacgaaaaaattcaaaaaatgatcaacgaaaggcaatgctataaaatgcgggtacttgtctctaagacaggagatatacgaattgaggcaattccaatgcctatggagcctatcctaaaattaacaaccgattatgacagtgtttccacatacttcatcaaaacgatgctcaatggatttttaattgatagcacaataaattgggatgttgttgtttcatctgaaccattgaacgcatcagctttcaccagttttaaaaccacttcaagagatcattacgctagggcgagagttcgcatgcaaactgctataaataacttaagaggttcagaacctacttcttctgtctcgcaatgcgaaattttattttccaacaaatctggcctgctgatggaaggttcaataacaaacgtggctgtaattcaaaaagatcctaacggttctaaaaagtatgtgacaccaagattagcaactggatgtttgtgcggaacaatgcgtcattatttattgcggctcggccttattgaagagggagatatagatataggaagccttaccgttggcaacgaagttttgcttttcaatggcgtcatgggatgcataaagggaacagtgaagacaaaatattga

SEQ ID NO: 2607 - DNA, 1125 bp, Saccharomyces cerevisiae
atgtctgccaatgatttcaagcctgaaacgtggacttcaagcgccaacgaagccttaagagtttctatagttggagaaaacgctgttcagttttcaccattattcacgtatccaatttacggtgactccgaaaagatctacggctataaggatctcatcatccacctagcatttgattcagtaacattcaagccgtatgttaacgtcaagtattcagcaaaattaggagacgacaatattgtagacgtggaaaaaaaattactctcatttctaccaaaggatgatgtaattgttagggatgaagctaaatgggtagattgctttgcagaagaacgaaaaacacataatttatctgatgtttttgaaaaagtatcagagtattcgttgaatggggaagaatttgttgtatataaatcgagtttggttgacgattttgccaggagaatgcatcgtcgtgttcaaatcttttcattactttttatcgaagccgctaactatatagatgagactgacccgagttggcaaatctattggttgttgaacaagaaaacaaaagaattgattggtttcgtcactacttacaagtattggcactaccttggagcaaaatctttcgatgaggatatagataaaaaattcagagccaaaatatctcaatttctgatctttccaccttatcaaaataaaggccacggatcctgtctttatgaggctataatccaatcttggctagaagacaaaagtattactgaaattactgtagaggatccaaacgaagcatttgacgatcttcgcgacaggaatgatattcaaagactgcgaaaacttggttatgatgctgtctttcagaagcactccgacctttctgatgagtttttggagtcaagccgaaaatctttaaaactggaagaaagacagtttaatcgtcttgtggaaatgcttcttcttttaaacaattctccatcatttgaattaaaggtaaagaataggttgtacattaaaaattatgatgccctagatcaaactgatccagaaaaggcaagagaagctttacaaaattcatttattttagtcaaagatgattataggcgtattatagagtcgataaataaatctcaaggttaa

SEQ ID NO: 2608 - DNA, 1125 bp, Saccharomyces cerevisiae
atgtttgcaaacgttggatttagaactttgagggtctcgagaggtcccctttatggtatgtttattgttttattcattggtgtgctaattgctaaatttgcgggacaaatgctaatcgactcagagactaacttttctcatatcataggatcctgcagtcaaatcatcagcttttccaagaggactttttactcaagtgccaagagtgggtatcaatcgaacaacagtcatggtgatgcgtatagttcaggtagccaatcaggcccgttcacctataaaaccgcggtagctttccaaccaaaagacagagacgatctgatataccaaaaactaaaggattctattagatcacctacaggagaagacaactattttgttacatcaaacaacgttcacgatatttttgccggtgtcgcagacggtgttggaggatgggctgagcatgggtatgactccagcgccatctcaagagaattgtgtaaaaaaatggacgaaataagcactgctttagcagaaaattcatccaaagaaacgcttttaacgccaaagaaaattattggtgctgcatacgcaaaaattagggatgagaaagtagtgaaggttggtgggacaacagccattgtggctcacttcccatctaatggaaaattggaagttgccaacttgggtgattcttggtgtggagtcttcagagattctaaacttgtattccagacaaagtttcaaactgttggatttaatgctccttaccaattgtcaatcattccagaagaaatgttgaaagaggccgaaagaaggggtagcaagtatattttaaacacccccagagacgctgatgaatatagcttccaattgaaaaaaaaggatattattatattggctaccgatggtgtaaccgataatattgccacagatgatattgagctttttctgaaggataacgctgcgagaacaaacgatgagttacagctattatcccagaagtttgtggacaatgttgtcagtttaagcaaggaccccaattaccccagtgtttttgcgcaagagatttctaagctaactggcaaaaactacagcggtggtaaagaagacgatataactgttgttgtcgtgagagttgactaa

SEQ ID NO: 2609 - DNA, 1128 bp, Saccharomyces cerevisiae
atgattttcaatccggtcatatcaaatcacaagttgagccattatattcatgttttttgtacattcaccacgttctgcatattaggtactgaaacacgtcaggctataacggcgctttccacctacactccggccttcgttactgctccgaccgttctctggtctaattgttcatcctgcatgctaatggggattatgcaatctttaaatgcttacacttggatgaaagatcaccaagtcttgtttttaggtgtaactactgggtactgtggtgccctgtcttccttttctagtatgctgctagagatgttcgaacactctacaaacttaactaacggtaatatcgctaaccacacaaaactgccgaacagagcttacggtataatggagtttttatctgtcttgctcgttcatcttatggtttccatgggtagtcttattttcggtaggcaacttggtaaggaggttattgttgcttatggatctagttcgttttcgaagccatatacccctccctcagacactgtaaaggaaaatgctggtgatgttgatacacaagaaatggaaaaaaatattctagagtttaaattcaaaactccagcaccattttttaagaaattttttgatgttgtggataaactcgcgtacgcactagcttttccattaattattttgtttgtggtgctgtgtgcgtattatgagaactattcgaggggcaagtggacactaccatgtctatttggaattttcgctggtttcctaagatattggttggcagaaatgtttaataaaacaaacaaaaagtttccattgggtactttcttggcaaacgttttcgccactttattgattggcatatttaccatggtgcaacgtggtaaaaaacacttttccacggatattccaattgtgaactcgttgaattcatgccatattgtttctgcgttaatatccggattttgcggcactttgagtaccattagcacgtttatcaatgaagggtataagctatcatttattaacatgcttatttattatactgtttcgattggaatttcatattgcttattggtgataactctcggatcctatgcttggactagaggattgactaacccgatttgttag

SEQ ID NO: 2610 - DNA, 1128 bp, Saccharomyces cerevisiae
atgattttcaatccggtcatatcaaatcacaagttgagccattatattcatgttttttgtacattcaccacgttctgcatattaggtactgaaacacgtcaggctataacggcgctttccacctacactccggccttcgttactgctccgaccgttctctggtctaattgttcatcctgcatgctaatggggattatgcaatctttaaatgcttacacttggatgaaagatcaccaagtcttgtttttaggtgtaactactgggtactgtggtgccctgtcttccttttctagtatgctgctagagatgttcgaacactctacaaacttaactaacggtaatatcgctaaccacacaaaactgccgaacagagcttacggtataatggagtttttatctgtcttgctcgttcatcttatggtttccatgggtagtcttattttcggtaggcaacttggtaaggaggttattgttgcttatggatctagttcgttttcgaagccatatacccctccctcagacactgtaaaggaaaatgctggtgatgttgatacacaagaaatggaaaaaaatattctagagtttaaattcaaaactccagcaccattttttaagaaattttttgatattgtggataaactcgcgtatgcactagcttttccattaattattttgtttgtggtgctgtgtgcgtattatgagaactattcgaggggcaagtggacactaccatgtctatttggaattttcgctggtttcctaagatattggttggcagaaatgtttaataaaacaaacaaaaagtttccattgggtactttcttggcaaacgttttcgccactttattgattggcatatttaccatggtgcaacgtggtaaaaaacacttttctacggacgttccaattgtgaactcgttgaattcatgtcatattgtttctgcgttaatatccggattttgcggcactttgagtaccattagcacgtttatcaatgaagggtataagctatcatttattaacatgcttatttattatactgtttcgattgcaatttcatattgcttattggtgataactctcggatcctatgcttggactagaggattgaccaacccgatttgttag

SEQ ID NO: 2611 - DNA, 1128 bp, Saccharomyces cerevisiae
atgaatatggcagaacgtgcagaagcaacaaaaagttggtcctgtgagcccctttctggaaagacgctagaagagattgttcaaaatgcagaaaatgcagctgatttggtagcttacattcgcaaaccagaggtagatttggactttaggttgaagtttatcgcagaacatgaggagttttttaatgtacaactatcggatcgaaattcaagaataaggacgtgtcacaacttgagcgataaagggatacggggtgatactgttttcgtcttcgtgcctgggttggctggcaacttagaacaatttgaacccttactcgagcttgtggactctgatcaaaaggcatttttgacgttagatctgcccggctttggtcatagttcagaatggagcgactaccccatgctgaaagtggtggaacttattttcgttcttgtatgtgacgtcttaagaaaatggtctacagcggtgccgaataatgataacgtaaatccatttaacggtcataagatagtgcttgtagggcattctatgggttgttttctggcatgtcatctttacgagcagcacatggctgatacaaaagcggtacaaacgctagttttgttgacgccccccaaagcacatatcgagcagctttctaaggataaacatattatccagtgggctctctatggtgtgtttaaattgccatggctatttgacgtttatagaaacaaattcgatcaggtaaaaggtctacaaagttccggcatcaagcagtatttttatcaacaaggtgatgatgtcaagttgaaatacaggaagttctggcaatttaaaaacaacataagcaacaaaagtagaaccatcataggttatttactaggatgggaaactgttgattgggttaaattcaatggtgtattgacgcaaacggatatgaaacagaaaattataatatttggcgctgaaaaagatcctatagctcctattgaaaatttggaattttacaaacaaactataaataaagaatgtcttcgtaaagtgattattttacctgactgttctcataatttatgcttcgaccgtccagaattggtgtgtgaaaactttcaacgagaggtgattgataattccaaattgtag

SEQ ID NO: 2612 - DNA, 1128 bp, Saccharomyces cerevisiae
atgagtttttatcaaccatccctatctctttatgacgttttgaacgcattatccaaccaaactggccagagagggcagcaaggatatcctcgccaaccacaaaggccacagagataccatccccattatggacaagtgcacgttggcgggcatcatcctcgtcatcatccattgtatagcagatacaatggtgttcctaatacctattactaccagttccctggacaagcctattactatagtcctgaatacggttatgatgacgaggatggtgaagaagaggaccaagacgaagatatggtgggtgacagcggcactacaagacaggaagatggtggcgaggacagcaactcgagaagatatccatcatattaccattgtaatactgccaggaataataggaccaaccaacaggcaaacagtttaaacgacttattaaccgcgttaataggtgttccaccatatgaaggcactgaaccagaaattgaagcaaataccgaacaggagggcgaaaagggagaagaaaaggataagaaggataagtctgaagcacccaaagaggaagctggcgaaaccaacaaagaaaaacctttgaatcagctggaggaatcgtcgagaccaccattagccaaaaaatcttcatcgttcgctcacctacaagcgccttccccaatacctgacccgttacaagtatccaagcctgaaacgagaatggacttaccattttcaccagaagtgaatgtctatgataccgaggacacttacgtagttgttcttgcgttaccaggtgctaactctagggctttccacattgattaccatccatcttctcatgagatgctcatcaagggtaagatcgaagacagagtgggcattgatgaaaaattcttgaagatcacggaactaaaatatggtgcgtttgagagaaccgttaaattccccgtgctgccacgcattaaggacgaagaaattaaagctacttacaacaacggtctactacaaattaaggtgcctaaaattgtcaatgacactgaaaagccgaagccaaaaaagaggatcgccattgaggaaatacccgacgaagaattggagtttgaagaaaatcccaaccctacggtagaaaattga

SEQ ID NO: 2613 - DNA, 1128 bp, Saccharomyces cerevisiae
atgatgtctactatctaccgtcatttatctaccgctagaccggctttaactaaatacgcaaccaatgccgcagttaaatcgacaactgcatcctcagaagctagtactctgggtgctctacaatatgcattgtctttagatgaaccaagtcattcgtggacaaaatcgcaattaaaagaaatttatcataccccactgctcgaacttactcatgcagcacaattgcagcacagaaagtggcacgatccaaccaaagtgcaattgtgcacattgatgaacatcaaatctggtggttgttctgaggactgtaagtattgtgcgcagtcttcgagaaacgataccggtctaaaggctgagaaaatggttaaagtggatgaagtgattaaagaggcagaagaggccaaaagaaacggatctactagattctgcctaggtgctgcatggagagacatgaaaggtcgtaaatcagccatgaaaagaattcaggaaatggtgaccaaagtgaatgatatggggctagaaacgtgtgttactttaggtatggttgatcaagatcaagcaaagcaattgaaagatgcaggtttgactgcatacaaccataacatcgacacttccagagaacactatagtaaggtcatcaccacgagaacctacgacgacaggttacagaccatcaagaatgtccaagaatctggaataaaagcctgtaccggtggtattttgggtctcggtgaaagcgaagacgaccatataggattcatctacacattatccaatatgtctcctcatcctgagtccctaccaattaatagactagttgctatcaaagggactccaatggctgaggaacttgccgatccaaagagtaaaaagttgcaattcgacgaaattttgagaaccattgccacagcgagaatagttatgccaaaggccattataagacttgccgctggtcgttatacaatgaaagaaacagagcaatttgtctgtttcatggcaggttgtaacagtatcttcaccggtaagaaaatgctgacgacaatgtgtaacggttgggacgaagacaaggcaatgttggctaaatggggattgcaacctatggaggcatttaagtacgacagatcttga

SEQ ID NO: 2614 - DNA, 1128 bp, Saccharomyces cerevisiae
atgcccacgatgatcaaaaaggatgataaagcaatggagccccctaatgaaaaaccgcatagaaagatcgaaagagatgatgttccagaatcttccaatcacatcccacctccagaatctggtgttttaaagggcggtaaagttaattcaaaaaccagagctttaaaggccgttacaagtatcattgcagacgccgatgagaaccctcagaagaaagtgaacaatgagacgaatggagtccaaaagcaaaagacagaagatttgagtaaaagaataggtaaatttgaataccttttttacaagtttttacttgtgttgttatacatctgcttcgggttgtttcggtacggtcaataccaatataataaaatgaaactaagaatattcagtatcatctacaaccatgcatatacaccacagttgattagacaggacgttattcctctgaaaaaaattcctaaaaggttggccgctatcttggaagtcaagccagttggcgacgttggcggcggtgtgacaggtttattaaatgacgcgagtgaaattgtttgctggactgtttcagctggtataaaacatttgatgttgtacgattacgatggaatattacaaagaaatgttccagagctgagaatggaaattcattccaacctggctaaatattttgggccagctcatgttccaaactacgctgttaaaatacctcattctaacaagatattctacaatctagacggaattgaaaccgagactgatgtaggcaatgagatagaagctaaccaagaaaaggacaaaattgctattgaaatttctttattgtctaacagagatggtagagaaacgattgtcgatctgaccaaaactatggctgagttatgtgcggttaacgaattgagcgtttctgacatcacaatggatttagttgattcagaactgaaacaactagttggacccgaaccagatttactgttatacttcgggccttcgttggatttacaagggttcccaccttggcatattagattaaccgaattttattgggaaaaagataacaacgaagtcatatattcggttttcatccgcggcctaagacagtacgcaggatgtaaagtgaatgttggtaaatga

SEQ ID NO: 2615 - DNA, 1128 bp, Saccharomyces cerevisiae
atgctcagatatcatatgcaaggttttagtgggtacggtgtccagtattctccctttttcgataacaggctcgcggtagctgctggttcaaactttggcctggttgggaatggaaaattgttcatccttgagattgatcgttcaggtagaatagtggaagttaattcctttttaacacaggattgtttatttgatcttgcatggaacgaaagtcatgaaaaccaagtgttggttgcacagggcgatggtacattacgcttgtttgatacaacctttaaagagtttcctattgctatatttaaagagcatgaacgagaagtattcagttgtaattggaacttagtcaacaggcagaatttcttaagtagttcatgggatggatctataaaaatatggtcccctctaagaaagcaaagtttaatgacccttactccacgacctttagagattaccaaaatggtggatccattaaacgccattatattgaaaaagaaaagctttacaggtatttcaaaaaacaggaactgtgtataccaagcacagttctcgccccacgaccaaaatctcgtattatcctgttcagggaattcttatgcaagcttatttgacattagactaccttccggcaaaaatcagaataattttttagtgcattcaggactagaagcattgacttgcgatttcaacaaatacagaccttatgtagttgccacaggaggtgtagataatgccattagaatctgggacattaggatgctaaataaaaatgaatcagcgactatcaagaggactgtgcccggccaacttcacaattcatcatgcatcaatgaaatccctaatgcgcacgggctggcaatcagaaaagttacctggtcccctcatcattccaatattttaatgtcagcttcatatgatatgacctgtcgaatatggagagatctcagcaacgatggtgcaaaagaaacatataaaactaactctacggatgctactaaaggttccattttcaatttcacacagcattcagaattcgtatttggagctgactggagcttgtggggaaagccaggatatgtggcttcaactgcatgggatggaaatttatttgtatggaacggcttaggttga

SEQ ID NO: 2616 - DNA, 1128 bp, Saccharomyces cerevisiae
atgcttaaagtgaataacgttttcgggagcaaccccaatagaatgacaaaattggaggatgaacactactttatcgatgacatcgtatcgattaaaaacagacaaaagagcaaaatgtacgtcagggaagggaaacggataggccacggctcgtttggaactgtgacacagtccattctgtcgagcaatagtattgaatggctaggaccttatgccataaaaagagtagtgaaatctcccaaagtacaatctttggaattggagatcttacagaatatcagacatccaaatctggttactttagagttcttcttcgagagccactgtactaccaaggacggtgggcacttatatcagaaaaactttgttatggaatacattcctcaaaccttaagttctgaaattcatgaatattttgacaatggttctaagatgcctacaaaacatatcaagctgtacacattccaaatacttcgagcacttctgaccttacattccatgagtatatgccatggcgatctgaaaccgagcaatatattgattataccaagtagcggtattgctaaagtgtgtgactttggctcggcacagcgactggatgataatacagaattgaagacctatttttgctcgaggttttatagagcacctgaacttctcctaaattcgaaggattatacaactcaaatagatatatggtcgcttggttgtataataggcgaaatgataaaaggccagccactttttaaaggcgatagcgctaactcacaactggaggagatagctaaactattaggccgctttcctaaaagttctataaaaaattctcaagagttacaggatagcttaaatgaccaaaaattcaagaagtttatgcattggtttccctctatagaattttttgatgtggaattcttgctaaaggtgttgacgtatgatgccactgaaaggtgcgatgctagacaattgatggctcacgaattttttgacgcgttaagaaatgaaacctattttttgccaagaggttcgagtatgccggttcacctaccagacctctttaattttagtgcatcggagaaaagggctcttggagagtattacaacttgattgtgccatctctggattag

SEQ ID NO: 2617 - DNA, 1128 bp, Saccharomyces cerevisiae
atgtctacggaagagcagaatggtgttcctctgcaaaggggatctgaattcattgcagacgatgtaacctcgaataaatcgaacaacacgaggcggatgctggtgaaagagtacaggaaaatcggtagaggtgcctttgggactgttgtacaagcatatttaacccaggataagaaaaactggttgggcccctttgcaattaaaaaagtccctgctcataccgagtacaagtccagggaattacagattctgaggattgccgaccatccaaatatcgttaaattgcagtatttctttactcatttgtccccgcaagataataaagtttatcaacaccttgccatggaatgcttaccagaaactctacaaatcgagattaatcgttatgtgacaaacaagctagaaatgccattaaaacatatcaggctatacacttatcagattgcccgcgggatgctttatttacacggtcttggcgtttgtcatcgtgatatcaaaccatccaatgttcttgtagacccggaaaccggtgtcttgaaaatctgcgattttgggtctgccaaaaaattggaacataaccagccttcaattagttacatctgttcaagattttatagagcgcctgaattgatcattggttgtacccaatataccacccagatcgatatatgggggcttggttgtgtcatgggcgagatgcttatcggcaaagccatatttcaaggtcaagaaccccttctacagctaagggaaattgctaaattgttaggtcctcccgataaaagattcattttcttttcgaatccggcctacgatggccctctattttccaaaccactgttctcgggctcttcgcaacagaggtttgagaagtattttggccattccggtccagatggtatcgatcttttgatgaaaatattggtctacgaaccacaacaaagactgtctccaagaagaatccttgcccatcagttctttaatgaattaaggaatgatgacactttcttaccaagaggtttcactgaaccaatcaagctaccaaatttgtttgattttaatgattttgagttacaaattctgggtgaatttgctgataaaattaaacctacgaaagttgctgaataa

SEQ ID NO: 2618 - DNA, 1128 bp, Saccharomyces cerevisiae
atgttgagaacgtcaacattgttcaccaggcgtgtccaaccaagcctattttctagaaacattcttagattgcaatccacagctgcaatccctaagactcaaaaaggtgtcatcttttatgagaataaggggaagctgcattacaaagatatccctgtccccgagcctaagccaaatgaaattttaatcaacgttaaatattctggtgtatgtcacaccgatttacatgcttggcacggcgattggccattacctgttaaactaccattagtaggtggtcatgaaggtgctggtgtagttgtcaaactaggttccaatgtcaagggctggaaagtcggtgatttagcaggtatcaaatggctgaacggttcttgtatgacatgcgaattctgtgaatcaggtcatgaatcaaattgtccagatgctgatttatctggttacactcatgatggttctttccaacaatttgcgaccgctgatgctattcaagccgccaaaattcaacagggtaccgacttggccgaagtagccccaatattatgtgctggtgttactgtatataaagcactaaaagaggcagacttgaaagctggtgactgggttgccatctctggtgctgcaggtggcttgggttccttggccgttcaatatgcaactgcgatgggttacagagttctaggtattgatgcaggtgaggaaaaggaaaaacttttcaagaaattggggggtgaagtattcatcgactttactaaaacaaagaatatggtttctgacattcaagaagctaccaaaggtggccctcatggtgtcattaacgtttccgtttctgaagccgctatttctctatctacggaatatgttagaccatgtggtaccgtcgttttggttggtttgcccgctaacgcctacgttaaatcagaggtattctctcatgtggtgaagtccatcaatatcaagggttcttatgttggtaacagagctgatacgagagaagccttagacttctttagcagaggtttgatcaaatcaccaatcaaaattgttggattatctgaattaccaaaggtttatgacttgatggaaaagggcaagattttgggtagatacgtcgtcgatactagtaaataa

SEQ ID NO: 2619 - DNA, 1131 bp, Saccharomyces cerevisiae
atgaaacacaatcgtccaaatggtactgggaaagcagtttctggcttcaagcagataataagaaggcttctactcctcttgaacaagaagagaagaaaacaactcgtcatcatcttgaaaagaataacccaagtctatggaataaacctagtattttatgtcaaaaaatggaaattgaaaaaattacagggtgaaaatattcaaataaatgatatcatgccatggctaagagagtctactatattagtcttgctgaacatactatatccaactttgatgaagttcccatttttaaaaaatcattatattcactggtcttccattgtaggaatatcgttaatgcttaccaagggtgaggtaccttcgtggattatcgcacactttcttgtggaagctatagcctccaaattaaagatcgcaaaattaacacaatggttgaaaaaaaaaaatttttcccagggtacattaataaaattccagcaaattcttgtgtgtttagcgattattgtattatttgccaaactggacaggagttcgttaccattccgtgtgctttttgaccataggccatttttaatagatttcttcacaatcaatgccattttcacagttttggcagtatatcacagaacattaaaattcttttttacttcagggacgaaatcaaataagaatgtcggcggccacgaagtcaggaacttttctcaataccttggggtcaagaaccataatgattggcccatatcttcatcaaatttgaagcatgtaatggacagactaaatgaaatacatgaagttacaattgatgataattatgcaaatataaacgaaaagataataaattcatatttcaccaagggtttttttccaagtctaaaatggactatattaaggcagtgtatcgaatatttattcgtcacgaaaaggcgcagattaatgggcaacaaattgcggtgcatcgtgatgcttcttacattcaccttcgtggatccaacaagtaaaatgaaaatcagcccatttttcgcaaaattctttgcgaagtccttggttaatgtttacttgaaaaagtattggcattgcaactttgggaaatatatactattctttttgtttcagcttagtattatgtga

SEQ ID NO: 2620 - DNA, 1131 bp, Saccharomyces cerevisiae
atgaagaaggagttgaaaattcttataatagcgaacattgcattacttatctctataatacattacacatttgatttgttgacgttatgtatagatgatacttccaaagatgcgctaacagatgaacagctgaacccccccaatggcttcaattcaacattctatgagtctcctcctcaactcataccgaaaatcattcatcaaacctacaaaacaaacgatatcccagaacagtgggtaaaagggaggcagaagtgcattgatttacatccggattacacttacattttatggacggatgaaatgtctgatactttcattaaacaggaatacccgtggtttcttgacacctttaggagttatgaatatccaattgagagggcggatgcaatacggtatttcatcctttcgcattatggtggtatttacattgacttggatgatggttgtgaaagaaggctagaccctttgttgaaagtaccagcatttctaaggaaaacttcgcctacaggagtgtcaaatgatgtgatgggctctgttccaaggcaccccttcttcttgaaggtcatcaaatcgttgaaacactataagaaaaactggtacattccatatatgacaatcatgggctctacgggccccttattcattagtgtggtttggaagcaatataagagatggtctaatacggccgaaaatggtgcggtaagaattttacaacctgcagattataaaatgcataataattcttttttctcaatatctaaaggttcctcctggcatacgggtgatgccaattttatgaaaactctagagaatcacatcttgtcttgcgtggttaccggattcatttttggctttttcatattatacggtgaatttacattttatacttggctgtgctcgggaccatttaacaacaaacgctattacattcagtggttgagtgacaagttcaagttacacaagtggaaactaacatcgtcttacaagaataaggaaaagaggcggaatcctactcgtcacgaatataattcgaggggtaagagattaagaaaagattctaatatcccctacgacagcgttttccttgatatagaaaagaatcacgcaaaatttaccgacttaacctga

SEQ ID NO: 2621 - DNA, 1131 bp, Saccharomyces cerevisiae
atgaaggacctaaatccagaaatggggaaatttgctaccactaaaggccctcctcaagacaatagaggcatggttgatatagcgacactgcctaattttcctgccaaccgtagtgggactcctcgtgaggagatgtatctggcgcccaacaagatggaaactccaaggatacttaatatgaatatggtaccggattatttgcaaaaagagaacttctcgccagatttttcttctgctaccgtatctgccaagtcatctcctgtcaacgttactcatgatgagtcgcttcctctgggaactattgaatcgaatagcacaaaggattctaaatatgcagttcaacggcaacagcaacaagtggtagatttcatagagaataatatgcagctactgtcttcagaaacactaaattttagatcagacattatgaaaactttggagcttcccattcccaagagaagagatattaagggaaaccatctatctaaactattatttgctaaatcacctctaactatcaacacatattgccaattttatgaccgtagaaccaagcgaatttgcaatcaagaaatgatatggaaagataagaacagtagagagaagcatggttctagaaagtatcaaagacatttgagtaaagttcacgatgtccagctaacaccaaataattttaccgaattttttgatcataattctccacttttccaggaatgctatgactatcaatctagattgatgcgtgatttacttgttgaaccagatgccaaattcaaagagaagaaaaagaagaaaaaaggggacgtcaacggaaatcatcctgaaaccggatcgagcctcatcaaccaccaggtccaacagcaaaatgttcgagaacttcaatcgaaaatagccatgaacgacttgatagagattcttatcgatttaaacattccgttttctgttttagactaccaaccaatgagaaattggctcatcaaatattcaataatttcaacagatactttgccggatgaagtatacttcaaaactgatccaggcgtgaatgaactggaacacaacagtagtaatttaaacaatagcaatagcggtactcctcataatcataatcaaaaccaacataccaattaa

SEQ ID NO: 2622 - DNA, 1131 bp, Saccharomyces cerevisiae
atgacatccgatcctgttaatacgaatataagtagccccactttaacggacagaaatgcagacgaatcatgggagctcttgaaaagagagtttaacacattatttagcaacctgaaaactgacagtaaagaagaaggtaatttcacagacaacaaaggagtaatcgccaagaaaccaattgttctgcaggataatgatgattcggattttacgcagaatcagggaaaagttgctactgcaaccagtacaactagtgacagaagctttaagcgaacacttggttctattgaaatgaaaaaacgttatgttaagaaaaattgccaagcaaaatttgtttttaacacgcttgaaggtaaagaagtttgttcgaaaatactacaacataccctaggcctattaagtttattgctattgacgagaaagatacgactactaaatttttcctcaaaactgcgattggtgattcaacaattgagtttatttcggtactatttgagattcggaaactttgcgatcaatttatataaaattatcaaaagatttcgctggttgagagaaatgaaaaaactacattataaagatcaatcaattttattttattttaaaaatttccggtttttcgacattattgaagctttttataatttgacagatgagttgatactgttccataagctacaatcaatgtttggtaaaaagaacacatcacatgcaaatactaatagactaatgacattcgtcaaagaacagcactatatcttatgggaagttttaaatattcttgctatcaataaaaacattgaacaatggcgacagctaataagagatgaaatttatttaagtatctataataccagtggtaatgcaataaaggaatacgagttaaagtacaaactacctaccaatgacaaagtcaatttggagttacggaaaaataatattacattggatttttataagataatactaaacttattgtctaatctaattaatattaaaggtaaaagggacaaatataactcagagctagcttacgaaataatttcagtaggttccggtgttactgaactccttaagctatggaaccgagccaaagtcacttcggctaatgaacatacaagcgctgtttga

SEQ ID NO: 2623 - DNA, 1131 bp, Saccharomyces cerevisiae
atgaccttggcacccctagacgcctccaaagttaagataactaccacacaacatgcatctaagccaaaaccgaacagtgagttagtgtttggcaagagcttcacggaccacatgttaactgcggaatggacagctgaaaaagggtggggtaccccagagattaaaccttatcaaaatctgtctttagacccttccgcggtggttttccattatgcttttgagctattcgaagggatgaaggcttacagaacggtggacaacaaaattacaatgtttcgtccagatatgaatatgaagcgcatgaataagtctgctcagagaatctgtttgccaacgttcgacccagaagagttgattaccctaattgggaaactgatccagcaagataagtgcttagttcctgaaggaaaaggttactctttatatatcaggcctacattaatcggcactacggccggtttaggggtttccacgcctgatagagccttgctatatgtcatttgctgccctgtgggtccttattacaaaactggatttaaggcggtcagactggaagccactgattatgccacaagagcttggccaggaggctgtggtgacaagaaactaggtgcaaactacgccccctgcgtcctgccacaattgcaagctgcttcaaggggttaccaacaaaatttatggctatttggtccaaataacaacattactgaagtcggcaccatgaatgcttttttcgtgtttaaagatagtaaaacgggcaagaaggaactagttactgctccactagacggtaccattttggaaggtgttactagggattccattttaaatcttgctaaagaaagactcgaaccaagtgaatggaccattagtgaacgctacttcactataggcgaagttactgagagatccaagaacggtgaactacttgaagcctttggttctggtactgctgcgattgtttctcccattaaggaaatcggctggaaaggcgaacaaattaatattccgttgttgcccggcgaacaaaccggtccattggccaaagaagttgcacaatggattaatggaatccaatatggcgagactgagcatggcaattggtcaagggttgttactgatttgaactga

SEQ ID NO: 2624 - DNA, 1131 bp, Saccharomyces cerevisiae
atgactgacttgtttaaacctctacctgaaccacctaccgaattgggacgtctcagggttctttctaaaactgccggcataagggtttcaccgctaattctgggaggagcttcaatcggcgacgcatggtcaggctttatgggctctatgaataaggaacaggcctttgaacttcttgatgctttttatgaagctggaggtaattgtattgatactgcaaacagttaccaaaatgaagagtcagagatttggataggtgaatggatggcatcaagaaaactgcgtgaccagattgtaattgccaccaagtttaccggagattataagaagtatgaagtaggtggtggtaaaagtgccaactactgtggtaatcacaagcgtagtttacatgtgagtgtgagggattctctccgcaaattgcaaactgattggattgatatactttacattcactggtgggattatatgagttcaatcgaagaagttatggatagtttgcatattttagttcagcagggcaaggtcctatatttaggagtatctgatacacctgcttgggttgtttctgcggcaaattactacgctacatctcatggtaaaactccttttagcgtctatcaaggtaaatggaatgtattgaacagggactttgagcgtgatattattccaatggctaggcattttggtatggctctagccccatgggatgtcatgggaggtggaagatttcagagtaaaaaagcaatggaagaacggaagaagaatggagagggtctgcgtacttttgtgggtggccccgaacaaacagaattggaggttaaaatcagcgaagcattgactaaaattgctgaggaacatggaacagagtctgttactgctatcgctattgcctatgttcgctctaaagcgaaaaatgttttcccattgattggaggaaggaaaattgaacatctcaagcagaacattgaggctttgagtattaaattaacaccggaacaaatagaatacctggaaagtattgttccttttgatgttggctttcccaaaagtttaataggagatgacccagcggtaaccaagaagctttcacccctcacatcgatgtctgccaggatagcttttgacaattag

SEQ ID NO: 2625 - DNA, 1131 bp, Saccharomyces cerevisiae
atgagcaacgttactacgccgtggtggaaacaatgggacccttctgaagttacacttgccgataaaacccctgatgatgtgtggaagacctgtgttttgcaaggtgtttactttggtggaaacgagtacaatggtaacttaggtgccagaatatcttccgtctttgttattcttttcgtgagtacttttttcaccatgttcccattaatctcaacaaaagtgaaaagattgagaattcctctatatgtttaccttttcgcaaagtattttggttccggtgttattgttgcaaccgcatttatccacttaatggaccctgcttatggtgcgattggtggtaccacttgtgtaggacaaaccggtaactggggtctttattcatggtgtcctgccattatgctaacgagtttgaccttcactttccttactgatctattcagtagcgtctgggttgaaagaaagtatggtctttcccatgaccatacccacgatgaaattaaagacactgttgtgagaaacactgcagctgtttcaagtgagaatgacaatgagaatggtactgcaaatggatctcatgacaccaagaacggagtagagtattatgaagattcagacgctacatccatggatgttgttcaatcatttcaagcacaattttatgcctttttaattttagaattcggtgtgattttccactccgttatgatcggtctaaacctgggaagtgttggtgatgagttctcctccctataccctgtcttagtgttccatcaatcatttgaaggtttaggtattggtgcaagattgtcagccattgaattccctagatcaaagagatggtggccatgggccctatgtgttgcgtatgggttaaccacaccaatctgtgtggccatcggtttgggtgttcgtaccagatacgtcagcggttcttacactgcgcttgttatctctggtgttttggatgccatttctgctggtatcttattgtacactggtttggttgaactactagcaagagactttatattcaatcctcaaagaacaaaggatctaagagaattgtccttcaacgttatatgcactcttttcggtgctggtatcatggctttgatcggtaagtgggcttaa

SEQ ID NO: 2626 - DNA, 1131 bp, Saccharomyces cerevisiae
atgcaagttgcaattccagaaaccatgaaggctgtcgtcattgaagacggtaaagcggttgttaaagagggcattcccattcctgaattggaagaaggattcgtattgattaagacactcgctgttgctggtaaccccactgattgggcacacattgactacaagatcgggcctcaaggatctattctgggatgtgatgctgctggccaaattgtcaaattgggcccagctgtcaatcctaaagacttttctatcggtgattatatttatgggttcattcacggatcttccgtaaggtttccttccaatggtgcttttgctgaatattctgctatttcaactgtggttgcctacaaatcacccaatgaactcaaatttttgggtgaggatgttctacctgccggccctgtcaggtctttggaaggtgtagccactatcccagtgtcactgaccacagccggcttggtgttgacctataacttgggcttggacctgaagtgggagccatcaaccccacaaagaaaaggccccatcttattatggggcggtgcaactgcagtaggtcagtcgctcatccaattagccaataaattgaatggcttcaccaagatcattgttgtggcttctcggaagcacgaaaaacttttgaaagaatatggtgctgatgaattatttgattatcatgatattgacgtggtagaacaaattaaacacaagtacaacaatatctcgtatttagtcgactgtgtcgcgaatcaagatacgcttcaacaagtgtacaaatgtgcggccgataaacaggatgctacaattgttgaattaaaaaatttgacagaagaaaacgtcaaaaaagagaacaggagacaaaacgttactattgacataataaggctatattcaataggtggccatgaagtaccatttggaaacattactttaccagccgactcagaagctaggaaagctgcaataaaatttatcaaattcatcaatccaaagattaatgatggacaaattcgccatattccagtaagggtctataagaacgggctttgtgatgttcctcatatcctaaaagacatcaaatatggtaagaactctggtgaaaaactcgttgccgtattaaactag

SEQ ID NO: 2627 - DNA, 1131 bp, Saccharomyces cerevisiae
atggctaaaaagagtaactcaaagaaatctacgcctgtaagtacaccaagcaaagaaaagaagaaggttattgaaaagaaatcttccacagccattcctagggaaagagttattaaagctgtcaacgagcttataaaattcacttccaagccacaagatgaaaataatgaagaaggaaataacggtaagaaaaacctattggaagatgatgaagaagaattgaagaaagatctgcaattaatcgtagtaaataataaatcattcaccggtacttccaaatcattcaaattgaaattactaaatgtcaaacattcgttttacaagccttggaaagaagccagtgcaacagcggttaaggatttcaaagttttattaattttgaaggattctgatattaagaaagtttcagaagatgatttatttgatcaattagattcagaaggaatcaaggttgatgaaatcatttgcgggaaagacttaaagaccgtttacaaggcatatgaggctagaaacgcttttatatctcagttttctttgattttggctgacgacagtatagttacatctttgccaaaacttatgggaggcaaagcctacaacaaagtagaaactactcctatatcaattagaacacatgcaaataaggaattttccttgaccactttgacgaacaatatcaaaaaggtttacatgaatcagttgcccgttaaacttccaagaggtaccacgttgaatgtccatttgggtaatttagaatggttaaggccagaagagtttgtagataacgttgaattaatttctgaacagttaatcaaagcataccaaatcagatccatttttatcaagaccaataggtcgcccgtattgccattatactataaccaggacgttcttgatgaacttgaagctaaaaaggacaaaatcgaagaaacccacgaagatgacatggtcaccattgatggtgtacaagttcatttgtctaccttcaacaagggtttgatggaaatcgccaatccttccgaattgggttcaattttctctaaacaaattaacaatgcaaaaaagagatcttctagcgagcttgaaaaagaatctagcgagtcagaagctgtcaagaaggctaaaagttaa

SEQ ID NO: 2628 - DNA, 1131 bp, Saccharomyces cerevisiae
atgtcaacgtttgggaaactgttccgcgtcaccacatatggtgaatcgcattgtaagtctgtcggttgcattgtcgacggtgttcctccaggaatgtcattaaccgaagctgacattcagccacaattgaccagaagaagaccgggtcaatctaagctatcgacccctagagacgaaaaggatagagtggaaatccagtccggtaccgagttcggcaagactctaggtacacccatcgccatgatgatcaaaaacgaggaccaaagacctcacgactactccgacatggacaagttccctagaccttcccatgcggacttcacgtactcggaaaagtacggtatcaaggcctcctctggtggtggcagagcttctgctagagaaacgattggccgtgtcgcttcaggtgccattgctgagaagttcttagctcagaactctaatgtcgagatcgtagcctttgtgacacaaatcggggaaatcaagatgaacagagactctttcgatcctgaatttcagcatctgttgaacaccatcaccagggaaaaagtggactcaatgggtcctatcagatgtccagacgcctccgttgctggtttgatggtcaaggaaatcgaaaagtacagaggcaacaaggactctatcggtggtgtcgtcacttgtgtcgtgagaaacttgcctaccggtctcggtgagccatgctttgacaagttggaagccatgttggctcatgctatgttgtccattccagcatccaagggtttcgaaattggctcaggttttcagggtgtctctgttccagggtccaagcacaatgacccattttactttgaaaaagaaacaaacagattaagaacaaagaccaacaattcaggtggtgtacaaggtggtatctctaatggtgagaacatctatttctctgtcccattcaagtcagtggccactatctctcaagaacaaaaaaccgccacttacgatggtgaagaaggtatcttagccgctaagggtagacatgaccctgctgtcactccaagagctattcctattgtggaagccatgaccgctctggtgttggctgacgcgcttttgatccaaaaggcaagagatttctccagatccgtggttcattaa

SEQ ID NO: 2629 - DNA, 1131 bp, Saccharomyces cerevisiae
atgtccgatctcgttaccaagttcgaatcgcttattatttcaaagtatccagtttctttcactaaagaacaatctgctcaagctgcccaatgggaatcggttctaaaatctggtcaaatccaaccacacttagatcaattgaatttggtgttaagagacaacaccttcattgtgtccactttgtacccaacatctaccgacgttcacgtcttcgaagtcgccttaccattgattaaggatttagtggcaagctccaaggatgtcaagtcaacttataccacatacagacatattttgagatggattgattacatgcaaaacttgttggaagtgtcgagcactgacaagttagaaataaatcacgatttggacttacctcatgaagttattgagaagaagaaaaaggcacctgcgggtggcgctgctgatgccgcagccaaggcagacgaagatgttagtaagaaggctaaaaagcaagatcatccaagaggtaagcctgatgaagaaacccttaagaaattgagagaggaggcaaaggccaagaaggcagctaagaaggccgccaacgccaaacaacaacaagagcaacaaaataaggccccagaaaagccaaagccatccgcaatagatttccgtgttggttttattcaaaaagccatcaagcacccagatgccgactccctatatgtctctacaattgatgtcggtgatgaagaaggcccaagaactgtttgttctggtttggtcaagcattttcctttggacgctatgcaagaacgttatgttgttgttgtatgcaacttgaaaccagttaacatgagaggtattaaatccactgctatggtattgtgtggttctaacgacgacaaagttgaatttgtcgagccaccaaaggactctaaggccggtgacaaggtgttctttgaaggtttcggtgacgaagctccaatgaagcaattgaatccaaaaaagaagatctgggaacacttacaacctcattttactacaaatgacgggttggaagttatcttcaaagacgaagaagaaaaggaccatcctgtaagaaagttgaccaacgctaagggcgaatcattcaaggttgctagtattgctaatgctcaagtccgttaa

SEQ ID NO: 2630 - DNA, 1131 bp, Saccharomyces cerevisiae
atgtccgcctcgattccagaaaccatgaaagccgttgtcattgaaaatggcaaggctgtagtcaaacaggacattccaattcctgaattagaagaaggatttgttctaattaagactgtcgccgttgccggtaaccctaccgattggaaacatattgatttcaagattggtcctcaaggtgccctcttaggctgtgatgcagccggccaaatcgtaaagttgggcccaaatgttgatgctgcacgctttgccattggtgattacatttatggggttattcacggtgcttcagtgaggttcccctcaaacggtgcctttgctgagtactctgccatttcatccgagactgcttataaaccagccagagagtttagattgtgcggtaaagacaagctaccagaaggccccgtaaaatctttagaaggggcagtatccctcccagtctcattgaccacggctggtatgatccttacacatagttttggcttggacatgacatggaagccctccaaagcgcaaagagatcaacccatcttattttggggtggtgccactgctgttggccagatgcttattcaattggcaaaaaaactaaacggtttcagcaagatcatcgtcgttgcttctcgtaaacatgaaaaattgttgaaagagtacggtgcagatgaactttttgactaccacgatgctgacgttatcgaacagataaaaaagaagtacaacaacattccttacttggtggactgtgtctccaacacagaaactattcaacaggtgtacaaatgtgccgctgatgacttagacgctacggtcgttcaattgaccgttttaaccgaaaaagatatcaaggaggaagacaggaggcaaaacgtcagtattgaaggaacccttctatatttgataggaggtaacgacgtcccatttggcacgtttactttgccagcagaccctgaatacaaggaagccgccataaaatttattaagttcatcaatccaaaaatcaatgatggtgaaatccaccacatcccagtgaaagtttacaagaacgggttagatgatatcccacagttacttgatgatattaagcacgggaggaattctggcgaaaagttggttgccgtcttgaaataa

SEQ ID NO: 2631 - DNA, 1131 bp, Saccharomyces cerevisiae
atgtcgaagggaaaggttttgctggttctttacgaaggtggtaagcatgctgaagagcaggaaaagttattggggtgtattgaaaatgaacttggtatcagaaatttcattgaagaacagggatacgagttggttactaccattgacaaggaccctgagccaacctcaacggtagacagggagttgaaagacgctgaaattgtcattactacgccctttttccccgcctacatctcgagaaacaggattgcagaagctcctaacctgaagctctgtgtaaccgctggcgtcggttcagaccatgtcgatttagaagctgcaaatgaacggaaaatcacggtcaccgaagttactggttctaacgtcgtttctgtcgcagagcacgttatggccacaattttggttttgataagaaactataatggtggtcatcaacaagcaattaatggtgagtgggatattgccggcgtggctaaaaatgagtatgatctggaagacaaaataatttcaacggtaggtgccggtagaattggatatagggttctggaaagattggtcgcatttaatccgaagaagttactgtactacgactaccaggaactacctgcggaagcaatcaatagattgaacgaggccagcaagcttttcaatggcagaggtgatattgttcagagagtagagaaattggaggatatggttgctcagtcagatgttgttaccatcaactgtccattgcacaaggactcaaggggtttattcaataaaaagcttatttcccacatgaaagatggtgcatacttggtgaataccgctagaggtgctatttgtgtcgcagaagatgttgccgaggcagtcaagtctggtaaattggctggctatggtggtgatgtctgggataagcaaccagcaccaaaagaccatccctggaggactatggacaataaggaccacgtgggaaacgcaatgactgttcatatcagtggcacatctctggatgctcaaaagaggtacgctcagggagtaaagaacatcctaaatagttacttttccaaaaagtttgattaccgtccacaggatattattgtgcagaatggttcttatgccaccagagcttatggacagaagaaataa

SEQ ID NO: 2632 - DNA, 1131 bp, Saccharomyces cerevisiae
atgtcttataaattcggcaaacttgccattaataaaagtgagctatgtctagcaaatgtgctacaggctggccaatcctttcgatggatttgggatgaaaagttaaaccagtacagcactacaatgaagataggccagcaagaaaagtattcagtagtgattttgaggcaagatgaagagaatgagatcctggaatttgttgctgtcggcgactgtggcaatcaggacgccttaaaaactcatctaatgaaatattttagattggacgtgtcactgaagcacttattcgataatgtttggattccaagcgataaagcatttgcgaaactttctccacaaggcatccgtatcttggcccaggaaccatgggagacattgatttcctttatttgctcgagtaataataacatttcaagaattacgagaatgtgcaatagcctttgctctaatttcgggaacttaatcacaacaatagatggggtcgcctaccattcgtttcctacaagtgaggagctaacttctcgagccactgaagccaagttgcgtgagctgggctttggatatagagctaagtatattatcgaaaccgcgagaaaactggtgaatgataaagctgaagctaatattacttctgacaccacataccttcaaagtatctgtaaagatgctcaatatgaagacgttagagagcacctcatgtcctacaatggtgtaggccccaaagttgctgattgcgtttgtctaatgggacttcacatggatggcatcgtccccgtagatgtccatgttagtagaattgcgaagagggactaccaaatatctgcgaacaagaaccatctcaaagaattgaggacaaaatacaacgccttacctatctcaagaaaaaaaatcaacctagagctcgaccatattagattaatgctttttaaaaaatggggatcatacgctggttgggcccaaggtgtcctattctctaaagaaatcggagggactagtggtagcactacaactggtactataaagaagagaaaatgggatatgataaaggaaacggaagcaattgttacgaaacaaatgaaactgaaagttgaattgtctgatcttcacatcaaagaagcaaaaatagattag

SEQ ID NO: 2633 - DNA, 1131 bp, Saccharomyces cerevisiae
atgtgcgccaatatccccgaattcgactctttttacgaaaatgaaaatataaattacaacttggaatcattcgcacctttaaattgtgatgttaattcgccctttctccccattaataacaatgacatcaacgttaatgcttatggtgacgaaaatttaacgtactccaactttttactgtcttataacgataagctggctactacaactgctaaaaacaatagcattaataatagtaatagtaataataatagtaataataataaaaataataataataatcataataataataatctactcggtaatgacatcagtcagatggcctttttactcgattacccttctactctcaacgaaccgcaatttgccgtaaattgtaaagacatttacagaaaggatatatcaacgccttcgtcattagtttcgagtctgccacctgcaaagttttcgttatccctatcgaattcgccttctccgccaccaccatcgtcgtcctctttgaaacatggggaagcaataatttctaataccagcgaaagcagtgacatatttgccgatcctaattcgtttgaaaaggatactatgcccctaacgcaagaactgacgctagaaaatctaaataatcaattaaactatcccgatttcacgataaacgccatcgagcaggatcctgccccttcgtctttttcatcctcatcttcgtcttcggagtcaacggtctcttccagcaggaagaggaagccctgtcatgattcctacacacattcttcaccctcttcctcagagtctaagaaaatttccgactcgagattatccgccgaaggtttagccaaagtgcttaatttagaatcccccgaagaagctttaaaaagagaacgctttatattgggtattttccagaatgaattaaattacccgctaggttacaaaacgtggattagggatactacaaaagaatataggacaaagttaatcaatcaactgcacgaacgagtaaaggtaaagtaccccgaatacaaccagtccatactggaaacaataattagacgaggcacctactacatgatgcagagtaggttaagaagagagaggagaatgaagcttaaggaacgtaaaagaacaacctaa

SEQ ID NO: 2634 - DNA, 1131 bp, Saccharomyces cerevisiae
atgtgtcaagctaccaatggcccgagtagagttgtgactaaaaagcataggaaatttttcgaaagacatctacagttgcttccctcttcacatcagggacatgacgtgaacagaatggcgataatattctactcaatctcaggactctctatatttgatgttaacgtttctgcgaagtacggcgatcatcttggctggatgcgcaaacattatatcaaaacagtgctggatgatacagaaaatactgtgatatctggatttgttggaagcttagtcatgaatatccctcacgcaacaacgattaatctaccaaatactctctttgcattgttgtccatgattatgctgagagattacgagtattttgagactatactagacaaaagaagcctggcgagatttgtttctaagtgccaacgacctgaccgtggctcgtttgtatcttgtttagactataagacaaattgtggatcttcggttgattcagacgatttaaggttttgctacatcgcagttgccattctgtacatatgcggatgccgatccaaagaagactttgatgaatacattgatactgagaagttgcttggctatataatgtcgcaacaatgctacaacggagctttcggtgcccacaatgaaccacactcagggtacacatcttgtgcgctgtctaccttagctttactctctagtttggaaaagctatcagacaagtttaaagaagacaccataacctggctattacataggcaagtatcaagccatggatgtatgaaatttgaaagcgaattgaatgccagctatgatcaatctgatgatggcggtttccagggaagggagaacaagttcgctgatacgtgttacgcattttggtgcttaaattcactacacttactaacaaaggattggaaaatgctatgccaaactgaactagtcacaaattatttgcttgatcgaacgcaaaaaacattaactggaggctttagtaaaaatgacgaagaagatgctgatttatatcacagctgtctagggagcgctgcgttagcattaattgaggggaaatttaatggagaattatgcatacctcaagaaatatttaatgattttagtaaaaggtgctgtttttga

SEQ ID NO: 2635 - DNA, 1131 bp, Saccharomyces cerevisiae
atgttgtctttcacaaccaagaatagtttccgcttattacttttaatactgtcatgcatatcgacgatacgcgcacaatttttcgtgcaatcatcatcttcgaattcttcagcagtatctactgcacgttcttccgtaagtagagttagttcttcaagttccattttgtcatccagtatggtttcttcctcaagtgctgactcatcttcccttacttcatcgacatcaagtaggtccctcgtgtcacatacgagttcgtctaccagcattgcctccatatcgttcacatcattcagtttctcatcagattcaagcaccagcagctcttcctctgcttcttcagattcttcatcctcctcatccttttccatctcttcgacatccgcaacttctgaatcatcgacgtcttctacgcaaacgtcaacatcatcttcatcctcactgtcgtcaacgccgtcctcttcatcatccccatcaacaatcacttctgcaccttcaacctcctccacaccatccactactgcctataatcaaggaagcactatcaccagtattattaacggtaagacgattctctcaaatcattatactaccgttacgtacacaccatcagcaaccgctgattcaagcaataaatccaaaagttcgggtctttctaaaaaaaatagaaacatcgtcattggttgtgtggttggtattggtgtaccactgattctggtgatactggctttaatttacatgttttgtatccaatcatcaaggacggactttattgactcagatggtaaggtcgttacggcatatagagctaacaaatttacgaaatggtggtatatgcttttgggtaagaaagttagtgatgaataccactccgattcaccattaggtggtagtgcatcgtccgcaggtggtttagacctagatgaagcagatgatgtgatggagcaaagctcccttttcgacgtcagaataagagatagcgatagcgtattaccaaacgccaacaccgccgaccataataataccaatagcggtggagagcctataaatagtagcgttgcgtcaaatgacataatagaagaaaaattctatgatgaacaaggtaacgaattatcaccacgaaattattaa

SEQ ID NO: 2636 - DNA, 1132 bp, Saccharomyces cerevisiae
atgagcactattagtaccacaacggcacctgagtttatcagagtaaagagaagaagggatgaggattctgtgcaggcattatgtatgtgttgttattctaccgatataacaaaaatgcgtttgactaactaagttcatctgggacaattcagtaattgatgaggggaaaagagtgaagaagcagaagttcatatttaaattatcaaagactgtgagctctgaaagctatcaatccgagcaagagtcttctacgccactcttaaaactggctcatgaagatcatcgacattttgtattggaacaaagaaaaaaaagtcgtagagactcagatgatgaaaaatcacaacagcggcttgcagcagaaggaagtactgtagatgacgatgggttaccgccagagatcaatcaaatggtgaatgactatttaaagttgaataaaggtgtagaaaagacagaaagaaaaaaaccaagtaggaaatattttactggggattctgcaaaaattgcatcactacccagtttagattacgtttttgacatctaccatttggagaaaattcatgacgatgaggttgctagatataacaacgagaaaaatatagggtttgtgaaaattattgagcatatagatttggctcttgatgaagaaagtgatcccaatgaagcccgttcagacgatgaggattctaatgacgaaaactattaccaaaatgattatccggaggatgaagatgatgatagatctattctatttggtagcgaaggagaggatatagctgcattgggtgaagagattgttataggggttaataagagcaggttttcctcttggaatgacgataaaattcagggatctaatgggtaccacgatgtggaggaagagtacggggatctttttaacaggcttggaggaaaaagtgatgtcttgaaatccataaattcctcgaatttcattgacttggatggccaagaaggtgaaatagagataagtgataacgaagatgattctgatgaaggagatgatattgaataccctagaaatgaattttttccgacggatgttgatgacccattggcgcatcatagggacagaatttttcatcagctacagaaaaaaattaatagaagctaa

SEQ ID NO: 2637 - DNA, 1134 bp, Saccharomyces cerevisiae
atgattccaaaattatatatacatttgatactatctttattgttgttgccgctaattttggcgcaggattattatgcaatactagagatagacaaagatgccactgagaaggaaatcaaatcagcgtacagacaattgtctaagaagtaccatccggataaaaatgctgggagcgaagaagcccatcaaaaattcattgaagtcggcgaggcatacgatgtattgagcgatcctgaaaagaaaaagatttatgaccagtttggtgcagatgctgtaaagaatggcggtggcggtggcggtccaggaggccctggcgcaggtggattccacgatccgtttgacatattcgaacggatgtttcaaggaggtcatggaggtcctggcggcggatttggccagagacagaggcagcgtggtccaatgatcaaggtccaggaaaaactatctttaaagcagttttattccgggtcctcgatagaatttactttaaacctaaacgatgaatgtgatgcatgccatggtagtggctctgcagatggtaagctggcccaatgtcccgattgtcaaggtcgtggggttataatacaagtgctgcgcatgggtattatgacgcagcagattcaacagatgtgtggtaggtgtggtggtacgggacaaattatcaaaaatgaatgcaaaacatgtcacggcaaaaaagttaccaaaaagaacaagttcttccacgttgacgttccaccaggcgcaccaagaaactacatggacacaagagtcggcgaggctgaaaaagggcctgactttgacgccggtgacttggtcatagaattcaaggaaaaggatactgagaacatgggttacagaagaagaggcgacaatctgtacagaacagaagttctttctgctgcggaagcgctatacggcggatggcaaagaacgatagaattccttgatgagaacaagcccgttaagttatctagacccgctcatgtagttgtctccaatggcgaagttgaagtcgtgaagggattcggcatgcccaagggtagcaagggttacggtgatttgtacatagactacgtcgttgtcatgccaaagactttcaaatctgggcaaaatatgctcaaagatgagttgtag

SEQ ID NO: 2638 - DNA, 1134 bp, Saccharomyces cerevisiae
atgcctaaaaaatccattgaagaatgggaagaggatgccattgaatcagttccatatttagcaagtgatgaaaagggctctaattataaggaagctacacaaattccactaaatttgaagcaatctgaaattgaaaatcatccaacagtaaaaccatgggttcattttgttgctgggggtattggaggaatggcgggtgcagttgttacgtgtccctttgatttggtgaagacccgattacaaagtgatatatttttgaaagcatacaaatcacaagctgttaatatcagtaaaggatctactcgtccaaagagtattaattatgtcattcaagcaggaacccatttcaaggaaacactgggaatcataggcaatgtgtacaaacaagagggttttagaagcttgtttaagggtttgggccccaatttagtcggggttattccagcaagaagtattaatttttttacctatggaactactaaagatatgtatgctaaagcgttcaataatggccaagaaacacctatgattcatctgatggctgctgcaaccgcaggttgggcaacggcgacggcaaccaatcctatttggttgattaaaacaagagtacagcttgataaagctgggaaaacatcggtccgacagtacaagaactcttgggattgcttaaaaagtgttataagaaatgagggtttcactggcttgtacaaagggttgagtgcctcttatttgggttctgttgaaggtatacttcaatggctattatatgaacaaatgaagaggttaataaaggaaaggtctattgagaaatttggatatcaagccgaaggtacaaaaagcacatcagagaaagtcaaggagtggtgtcaaagatcaggaagcgctggtcttgcaaaatttgtggctagtatagcaacatatccgcacgaagttgtcaggacgagattgagacaaacgcccaaggaaaatggtaaacgaaagtatacaggtttagtacaaagtttcaaagttataattaaagaagagggactcttttcaatgtatagtgggttgaccccgcatttgatgagaacagttccgaacagtataattatgtttggtacatgggaaattgttataaggctactatcgtag

SEQ ID NO: 2639 - DNA, 1134 bp, Saccharomyces cerevisiae
atgcctcactcagttacaccatccatagaacaagattcgttaaaaattgccattttaggtgctgccggtggtatcgggcagtcgttatcgctgcttttgaaagctcagttgcaataccagttaaaggagagcaaccggagcgttacccacattcatctggctctttacgatgtcaaccaagaagccatcaacggtgttaccgccgacttgtctcatatagacacccccatttccgtgtcgagccactctcctgcaggtggcattgagaactgtttgcataacgcttctattgttgtcattcctgcaggtgttccaagaaaacctggcatgactcgtgatgacttatttaacgtgaatgctggtatcattagccagctcggtgattctattgcagaatgttgtgatctttccaaggtcttcgttcttgtcatttccaaccctgttaattctttagtcccagtgatggtttctaacattcttaagaaccatcctcagtctagaaattccggcattgaaagaaggatcatgggtgtcaccaagctcgacattgtcagagcgtccacttttctacgtgagataaacattgagtcagggctaactcctcgtgttaactccatgcctgacgtccctgtaattggcgggcattctggcgagactattattccgttgttttcacagtcaaacttcctatcgagattaaatgaggatcaattgaaatatttaatacatagagtccaatacggtggtgatgaagtggtcaaggccaagaacggtaaaggtagtgctaccttatcgatggcccatgccggttataagtgtgttgtccaatttgtttctttgttattgggtaacattgagcagatccatggaacctactatgtgccattaaaagatgcgaacaacttccccattgctcctggggcagatcaattattgcctctggtggacggtgcagactactttgccataccattaactattactacaaagggtgtttcctatgtggattatgacatcgttaataggatgaacgacatggaacgcaaccaaatgttgccaatttgcgtctcccagttaaagaaaaatatcgataagggcttggaattcgttgcatcgagatctgcatcatcttaa

SEQ ID NO: 2640 - DNA, 1134 bp, Saccharomyces cerevisiae
atggatatggaaattgatgaccctatgcatggttcagatgaagatcaattatcaccgactctcgacgaagacatgaatagtgatgacggcaaaaataatacgaaggcgcgttctaatgacgaagacacagatgaagagttggaagattttaattttaaaccggggtcctcgggtatagcagatcataaatcctccaaaccactaaaactgaccaatacaaatataaatcagcttgaccaatggattgagcatttgagtaaatgcgagccactatcagaagacgatgtagcacgactatgtaaaatggcggtggacgtgttgcagttcgaggagaatgttaaaccaattaacgtgcctgttaccatttgtggtgacgtacacggtcaattccatgacttgttagaacttttcaagattggtggtccttgtcctgacaccaattaccttttcatgggtgattacgtggatagaggatattattctgttgagaccgtatcttacctagttgccatgaaagtcagatatccacatagaattactatacttaggggcaatcacgagtctaggcagattacccaagtatatgggttttatgacgaatgtttgagaaagtacggcagtgcgaacgtgtggaaaatgtttaccgatctattcgattatttccccgttactgccttggtggataataaaatcttctgtttgcatggaggtctctcacccatgatagagacaatagatcaagttagagatttaaatagaatacaggaagtgcctcacgaaggtccaatgtgtgaccttctatggtccgatcctgatgatagaggcggatggggaatcagtccgagaggtgcaggcttcacttttggtcaagacatcagtgagcaattcaatcacactaatgacctatcactaatagcaagagctcaccaattggtaatggaaggatattcttggtctcaccagcaaaatgttgtcaccattttcagtgctccaaattattgttatagatgtggtaaccaggccgctattatggaggtggatgaaaaccataataggcaattcttacaatacgatccatctgtgagacccggtgaaccaaccgtcaccaggaagacaccggattatttcttataa

SEQ ID NO: 2641 - DNA, 1134 bp, Saccharomyces cerevisiae
atgtcattttccttcggctttacttccaatgactttgatgatgatgagcttgttgctcaacctgaaacattcgttgaaagcagcaaagaaaacgaaaataccactgcttacatcaatccattagattcggatttcttgtcgcaagctggagttgtgcagccaaatgtggaagacctaggaacaatattggaaagtcttaaggatgttagattgacatttgaagagttccaatctccgatatatagaaaaccattgatcaagagggaactattcgatgtcaaacatcagctaatgttagagacagatgcccaatccaacaacaactccacggaactggacattttactaggtgatacttctgaagatttgagaaagaacatctatgaaggtgggttgaaatcatgggagtgctcttatgatttagttgatttgttgtcagagaacgttgatagaataagcaacgatatcgacgcggttgtcgaaataggctgtggtacggcactaccctcagagtttcttttcagatctgctcttctacggaatgatagaagtaaaggtttaaagtttgttttgactgactataatgccagtgtattaagattagttaccataccgaatttggttataacatgggctaaaacggttttgacaaaggaacaatggtacgccttacagaaagacgaatgtgaagatattccaataaataatgaggaactgcttcttacctcaaagctgttagctgccttttacgacgatgtacaaagcaggaatatcagcgtcactcttatatcaggatcgtggggacgtaaatttagtaatttgatccatgaagtactctcaggtagccaaaaagtcctttcattatcctcagaaacaatttatcaacctgacaatttgcccgttatagcggaaacaatacttgacatacacaatttaccacaaaccgatgtcaaaacttacgtagccgcaaaggatatttattttggagtcggtggtagcatcactgaatttgaagcttatttggacgacaaaataaactccgaacatctaccaattcattctgaaaggtttaaagttaactctggcttaaaaaggtcgattatatgcattgaaacaaataaagctatccgatag

SEQ ID NO: 2642 - DNA, 1134 bp, Saccharomyces cerevisiae
atgtcgactagaccccaacctgattggtattaccatagacatccatatgcctctacgccactggcagaaggggaggaaccacaattactccccatccaagaccaagggaaccataagaaatcaaaaatttggatggcatacaaggctccgatagttcgatggtacaagaatgctatgcttgttaaagacaatttttggaaagacctagagtcgtcgcaccagatcatctggtatccgtataaagtatgttgatgttccaataagcagatcatgttttttaagccgtcatactaaccgcctttgaagggaattagcgaatccgtgggaaactcggattatttgcatctatttttcctaatatttggatactacctgctgaatctcctgcttattgttgcgtttacgtcaatccttgcgtggtccttgttagtgtgcatctatttgccctttctcggactctttgcgttacctctggcttatatgcaaactattctgatttccacaacgctatgtaattctatggtgaagggtaccgatttcgttcttttcacacgtatttatggagtgacgttcgcaagaaagggattaacagagttgagtgaagcctgtgaaacgataagtttcacgccctttgtctacagaaggtcacatcgtttgggtggcctcttttcgaaacggttttacctcgtctctttgccgcagtttttcatttttttcttctggtacatcttcatagcctttatgtttcttttattgttgctcgttccaatagtgggtccaattacaatcaatatgctaccatttagccccggaatgggattttactattttgagccttattttgttgacgtgctacatttggattcgcgcaaactttccaaagtttactacaagggctttgccaagtggctcctttactcgatatccagcggtttattagagtctattcccattctgggtgggttgttcattggaacaaacgcagtaggtgcttcgctttggatagttaaagagataaaagaccgggaccagccagccgtacctccttcccctcctgcggaaccagaagagcctactgtaggatcctatgcacctccaatccaacaatctatagctcacattaatccgccatga

SEQ ID NO: 2643 - DNA, 1134 bp, Saccharomyces cerevisiae
atgtctaaagggagggtcaatcagaagcgttacaagtatcctcttccaattcaccccgtagatgaccttccagagttaatccttcataatccgttatcttggctatattgggcataccgctattacaagagtacgaacgcactgaacgataaagtacatgtagattttataggagataccactcttcacatcacggttcaagatgacaagcaaatgctatatctttggaataatggattttttggcactggtcaatttagcaggagtgagcctacatggaaagctagaacagaggccagactgggtctcaatgatactcccctccacaatcggggaggaacaaagagtaatactgaaacggagatgactttagagaaggtcacacaacagaggagattacaaagattagagttcaagaaagaacgtgcgaagttagaaagagaattactagaattaagaaaaaaaggtggtcatatcgatgaggaaaacatcctccttgagaaacaacgagaatcattaagaaaatttaaactaaaacaaacagaagacgtgggcatcgttgcacaacagcaagacatttccgaatcaaatttaagagatgaagacaacaatcttcttgatgagaacggtgatcttttgccactagagtcactagaactaatgccagtggaagctatgtttttaacttttgcacttcctgttcttgacatatctcccgcgtgcctggcagggaaactgtttcaattcgatgccaaatataaagatattcactcctttgtcagatcatacgttatataccatcactacagatcacacggttggtgcgtaagatctggtataaaattcggctgcgattatttattatataagagagggccaccatttcaacacgctgaattttgtgttatgggtcttgaccacgacgtctctaaagattatacgtggtattctagcatagcccgtgttgtgggcggcgcaaagaagacgtttgtgttatgctacgtggagagactaatctcggaacaggaggcgatagcactatggaaatcaaacaactttactaaattgttcaatagttttcaagttggtgaagtattgtataagagatgggttcccggaagaaatagagactag

SEQ ID NO: 2644 - DNA, 1137 bp, Saccharomyces cerevisiae
atgacaattaacacaaagaacatagttgttgttggtgctggtgtgtttggtgtgtctgtggcaaatcacttgtacagggaactgggtgggacatacgcaataaagctcgtcacagcatctaattatgtgtattttctaccctcagctgtccgtttgacggtttcaaaggattataccaagtcgatcctgccgttaaaaaatgttcttgatagtggtattgaagttatcaaagatacggctgccagctttgatgataaggaggtagttttggggtcagacagggccataaagtttgatatcttggttcttgcaactggctcaaagtgggctgatccaattggttcaacttataccttcggggataactataaagagtattttgaaagagaggcttctcgaatctcagatgcagatcacatactttttcttggcggtggctttgttaattgtgaactagctggtgaattgttattcaagtatttggaggagatcaggtctggcaaaaagcgtatttccattattcataattccgataagctactgccggactctgggttatacaacgataccctaagaaaaaatgtgacagactatctctcaaaaaatggtattacgttgtacttgaacacagtaggggcttctttagacacctcgccgaaacgtatttttctaggtgagggctcatctaaatatatagatgctgatttgatttacagaggcgttggtatttctccaaatgtgccggtcaacagtatttcagacctttgtgacaagaaagggttcattcaagttgaaaaaaacttcagggtaaaagctgttgaggcaggaaacgtttttgccattggtgatgtaacgaattttagatatcacggattggttaaaagagataattgggttgatgttttgacccgaaatgttataagttctttacaagaaggaacagaggctagtctcgttgatgcagattgtcttgagacaggacatgccccaagtggtgtctcccttgggccaaatgcagggtttggccaatttccactaccgttacttgggacgattaatattccatcgtttttaatttctagagcaaagtcgaagaatcttttctccgacaaaatggaacctttattcaaaaaatag

SEQ ID NO: 2645 - DNA, 1137 bp, Saccharomyces cerevisiae
atgagaccgaacaaaacaagtctgcttctggcgttattatccattttatcgcaagcgaacgcctatgaatacgtgaattgttttagctcactaccctctgacttttcaaaggccgattcatataactggcagtcgagttcacactgtaacagtgagtgtagcgcaaaaggtgcaagctactttgccctttataatcattcagaatgttattgtggtgatactaatccatctggttcggaatctacttcctcttcatgtaatacgtattgctttggttacagcagtgagatgtgtggtggtgaagatgcctattctgtgtaccaacttgactctgacacaaatagcaatagcataagcagctcagattcaagtacggagtctacttctgcgtcgtcttccacaacttcttcaacaacgtcctccacaacatcaactacatcatcgactacatcatcaactacatcatcaatggcgtcttcctctacagtacagaattcccccgagtcaactcaagcagctgcctctatttcaacgtcacagagttcgagcactgtaacgtcagaaagctcgctaacttcggatactttggcaacgagcagtactagctctcaatcacaggacgccacttcgataatctattccactacttttcacactgagggcggttccacaatttttgtcacgaacaccatcacggcaagtgcacagaattcaggatcggccacaggtacagctggatctgactctacgagtggaagtaaaactcataaaaagaaagccaatgtaggggcaattgtaggcggcgttgtaggtggtgtagtgggagccgtagccattgctctttgtatcttgttgattgtcagacacattaatatgaagcgggaacaagacaggatggaaaaggaataccaagaggcgataaaaccagttgagtaccctgataaactatacgcctcttcattttcatctaatcacgggccctcttcaggtagcttcgaggaggagcacaccaaagggcaaactgatattaaccctttcgacgactcaaggagaataagtaacggaacattcataaatggcggaccaggagggaaaaacaacgttttaacagtggtcaatccagacgaagctgattga

SEQ ID NO: 2646 - DNA, 1137 bp, Saccharomyces cerevisiae
atgccagtaaagttaaggtggccttggttaggaattgctataccaacgtttctgatttcatttataggctatggtgcacactactttattttatccaatttcttgtcagttccgaaacaaataacatttgagttctgtttgtcaatgatatggctctcctattacttggccatctgcacaaatccaggaaggcctttgcccaactacaaaccaccccctgatatctggcggaatttctgtaagaagtgccaaagttataagccagaacgttcacatcattgtaaaacctgcaatcaatgcgtcctaatgatggatcatcattgtccgtggacgatgaattgcgtcggctttgcaaactatccgcatttccttagattcttattttggatcatagtgacgactagtgttttattttgcatacaagctaagcggatatattttatttggcaacaaaggcacttgcctggctacttcttcaaaaaatcagaactgattttcttaacaatatcgagtcctttaaattcttttgtcctactaacgataacaattcttttcctacgatgtttattcaatcaaatcttgaatggaagatctcaaattgagtcgtgggatatggatcggctagaatctttgttcaactccggaagattaactcagaaattaattgataatacttggagaatatatccagagtcgaggtcgtttcaaaataaaaaggatgctgaggaacacttgacaaaaaaaaggccacgttttgatgaacttgtaaatttcccttacgattttgatttgtacactaatgcattactgtaccttggtcccattcatttatggttatggccatatggtgttcctacgggagatgggaacaattttccaaaaaacggtatttcaaaatatgaggctaactcctcattggaagaccacatcctttcacttccctggccaccagatggaggtaaaacaaacaccgtcttcaatcatggcagctcaacaatagagatgcgtaatgaaagtggcgaacagctaataaggaccagacttcctcaaaatggcagacatgcttctcgtgagaagtggtacaacgactggggtgaatcactagacgattttggagtggatgttgatatggaatag

SEQ ID NO: 2647 - DNA, 1137 bp, Saccharomyces cerevisiae
atggtggacttgtcaacagctttgattcatggcgatgataaagataacagggttactgacgtggcgcccccaattaatgtctctacaaccttccgttacgacgatgacgacctaattccatggacagagcgtgaaaacttggactttatggagaagaagcccgtatattcacggctagcgcatccaaatagcaccagattagagagtatcttctcagagatcctcgatggttatgctgtcatttattcttcagggttagctgcgttctatgcggcaatggtacattacaaccctaagaagatctttatcggacagagctaccatggtgttcgagcaattgctaacatattgacccgtaattacggcattgagcaacaccccttggaagatattgaaaaatgtgcttctgaaggtgacattgtccatctggaatctcctgtaaacccatatggtacctcttctgatatcgagagtttggcccgcagagctcatgcaaaaggcgccctgcttatagtggattccacattcgcatctcctccattgcaatacgcatggaatttcggagccgatattgtcctatactctgctactaagtactttggtggtcattctgacttgttaagtggcgtccttgtagtcaaagaggaagcaacttcccgacaactaaaagacgacagaatctacttgggtacaaacgtggcaaatttggaaagtttcatgttgttgcgatccctgagaacctacgaaatgagaataaccaaacaatcagaaaatgctacgaaattagttagatttttgtcagatcaccaatctgaatttgacaaagtattgaagacgatttaccactcttctttacaaacagaagagttcgttaaaaagcaactggtaggaggatatggtcccgtttttgctatcactttgtacaccaaagagcagtgtaaacaattacccctcaagctgaaatatttccatcatgcgacctcactgggtggaattgaatcccttgtggaatggagagcaatgactgacccatatatcgaccaaactttaataagagtatctgtgggctgtgaatccgctaatgatttgattaaggatttggcttcggccttgaaagaattgcaggatgcagcctga

SEQ ID NO: 2648 - DNA, 1140 bp, Saccharomyces cerevisiae
atgaaagagaatgaacttaaaaatgagaagagtgtagatgtattatccttcaaacagctcgaatcccaaaagattgttctacctcaagatcttttcagaagcagctttacctggttttgttatgaaatttacaagtccttagcgtttcgcatctggatgctattatggctaccacttagcgtctggtggaaactttccaacaattgtatttacccacttatagtttcacttctggtcctgtttctgggaccaatatttgtccttgttatttgtggactttctcgtaagcgttccttatcgaaacaactcattcagttttgcaaagagattactgaaaacacaccaagttctgatcctcatgattgggaagttgttgcagcaaatctaaattcgtacttatatgaaaataacgtttggaatactaagtacttttttttcaatgccatggtctgtcaagaagcgttcagaacaacccttctcgaaccattttctttgaaaaaagataaagctgccaaggttaagtcatttaaggattccgtcccttacattgaagaagcattgggagtttattttacagaagttgaaaaacaatggaaattgtttaatactgaaaaatcatggagccctgttggcctggaagatgctaaacttcccaaggaagcttaccgatttaagcttacttggtttttaaagaggatttccaatatttttatgttgataccattccttaattttttgtgctgcatatatgtgtcacggggaatgtgccttctattacgcaccttgtatctcgggtggattcttttcatgttggtacaaggtttccaaaatataagggttttgattatgagcatggaacacaagatgcagttcttgtcgactattataaatgagcaagaaagtggtgcgaatggatgggacgaaattgcaaggaaaatgaataggtacttgtttgagaaaaaagcctggaagaatgaagagtttttcttcgacgggattgactgtgaatggttttttaaccacttcttctaccgcgttctatctgcgaagaaatctatgtggcctttaccattgaatgtggaactatggccatacattaaagaagcgcaattatcccgcagtgaggtgctcttagtgtag

SEQ ID NO: 2649 - DNA, 1140 bp, Saccharomyces cerevisiae
atgaaaagtttacaaacactatgtgaaatctcattgatgagaaatcattcaaacatacaatctgtgagtaatgtcccctatcacttattaaagaggatactgcagaaagtaaaaataccacaactattaaaacttgagaaaagcaacgtactattgatatttgacgatgatgaactatggttagaatttttaaggcaagatttcccgactaatgtacacgaacaatttgtctctaagagagacattatttgcaaatattactttgatttcgttaaggaaaacgatatagaactgtaccattcgaatcaggatttattgaagtcttgcgtgcgtcaatcagtcgtcaaagacatccgaaacaacaagtaccgaataccatacagaatgttatactcaaagtaccaacaagaagtggaaaagaaacaagaggaaagcgcagagagattaaggctggaaatgcagaagttgcagcaagaaagagaaaaaaagcaaaccatagtggttgaccacactgtttacttcaaaaagagaaacaccaagaagactacaaggttgcacaacgaaccccattcgcaattatacatgaaatcgttgaaagatcacgagtccagactaaagcatttcaaagacggcggattcaacattgcaaaaaggcatgcgcaacgtgtggcctttggtggccaagcgggcggacaatcgtcttcccccaagaaaggcccattgtccatcaaaccggagcctgttaaggtaaatcgtcaaatggataatgtcacagcagagaagaaagatgttacgcagcccatcacgccggtgaagaagagaagatccgaatcaccgtcaatctttctcaatcgtaaaaaacctgcgctattcaggcctactccgaagacaaacgctgcaggttctcgaccccatacaacagcgatcaccaacgatcaccgtactacttctcatccttatccccacaaagatgttgtaacttcaatatcaagtgtcaccgcaaatcccgtaacaaagggccacaagaagaagaaatccggaattttcgtacgaaatgccggatctgacggagatagttttccgcacgtgaccgcaaccggccctactacccgtccgtatatctatgagccacggaaatag

SEQ ID NO: 2650 - DNA, 1140 bp, Saccharomyces cerevisiae
atgaaagaaaatgaacttaaaaatgagaaaagtgtagatgtattatctttcaaacagctcgaatctcaaaagattgttctacctcaagatcttttcagaagcagctttacctggttttgttatgaaatttacaagtccttagcgtttcgcatctggatgctattatggctaccacttagcgtctggtggaagctttccaacaattggatttacccgcttatggtttcacttcttgtcctgttttggggaccagtatttgttcttgttatttttagactttctcgtaaacgttccttatcgaaacaactcactcagttttgcaaagagattactaaaagcacaccaagttcggatcctcatgattgggaagttgttgcagcaaatctaaattcgtacttatatgaaaataaggcttggaatattaggtactttttcttcaatgccatgggctgccaagaagcgttcagaacaacccttctcgaacccttctctttgaaaaaagacgaagctgccaaggttaagtcatttaaggattccgtcccttacattgaagaagcattgggagtttattttagagaagttgaaaaacaatggaagttgtttaattctgagaaatcatggagccctgttggcctggaagatgctaaacttcccaaggaagcttaccgatttaagcttacttggtttttaaagaggatttccaatatttttatgttgataccattccttaattttttgtgctgcatatatgtgtcacggggaatgtgccttctattacgcaccttgtatctcgggtggattcttttcatgttggtacaaggtttccaaaatataagggttttgattatgagcatggaacacaagatgcagttcttgtcgactattataaatgagcaagaaagtggtgcgaatggatgggacgaaattgcaaggaaaatgaataggtacttgtttgagaaaaaagtctggaagaatgaagagtttttctttgacgggattgactgtgaatggttttttagccacttcttctaccgcgttctatctgcgaagaaatctatgcgggctctatcattgaatgtggaactatggccatatattaaagaagcgcaattatcctgcagtgaggagtccttagcgtaa

SEQ ID NO: 2651 - DNA, 1140 bp, Saccharomyces cerevisiae
atgactgcaccacacagaagtactattcatattcttgggttgggtgccatgggtaccgttttggcagttgaccttttaagatttaccaatgccctagttgtgcccttatttagatcacaagaaagacttgcacaatttcagaagacaaatgggaacaacatttcgattcgcaaactttatttggaaggctcgccaatattttcttatccagtggagaaatgcgaatgccctgaaactttctctaaaaaacctattgacaacttagtcgtcactacaaagacttaccaaaccaaagaagcactagctccttatttgccttatattaataaaaatacaaacttaattttgattcagaatggactgggcgttttagaactattgagagaagaaatctttacagattcaaaaaacagaccacatttatttcagggtgtcatttctcatggcgtttatcaggataaagcaggagttttcaatcatgctgggtgggctggtatgaaaattgccaaattgccttggactgaggaagaaatgattcaaaaaaaatccgtagtcgaggacgatgcagccaataactcattagtaaaattattaacagaaccaaaatttgccaaggaatttggaatagaacattccacttatcaagaaatgctctttggtcaattatttaaatttttggttaatgcatgcatgaatccagttacggctattctagattgtgtcaatggtgagatgaaggccagttgcggtccagttttcacatctattattgacgagtgtttacaaatattgagagttgcttataggccattgtttcaataccacgaaaaatacagcggtaatgaagaatacccagaaatggatgtcaatgcagtactgacaaccgataacatggtctccgaagtcactagaattggctgtgacatcaattctaggaacagtagttcaatgagacaagacactttgttcttaagagacattgaaattgagtatatcaatggctatgtcgtcaaattggctgataacttaaatctagacccaaactgctgcaaggttaataaaactatcggagaattggccactatgagattagcattgaacaggtcgagaagtatcaatggtgactggagaaaggactga

SEQ ID NO: 2652 - DNA, 1140 bp, Saccharomyces cerevisiae
atgagtatttttttcaagccgccgattgatattgagatccttttcgataatgaggaatctcgcaaacacgtagacattgcaacaagatcaagtaattccagttacaaatcaatgaaggaaagcttgcccgtctatgaagatggcgaatcccttggtggaattgttactttgagagttcgggatagtaaaaaggtagaccacttgggcataaaagtgtccgttattggatccattgatatgttaaaatctcatgggagcggtaattcatcttctaaaaaagttacctctagcacatcatcttcctcttctaatggttcagtagatgtgcggaagaattcagttgatcaatttttatgccaaagctatgacctctgtcctgctggtgaattacaacattctcaaagtttcccattcctattcagagatttgagtaaaagatacgaatcttataaaggcaaaaatgtggatgtagcttactatgttaaggtaacagttatgaggaagtccacagacatctcgaaaataaaaagattttgggtctatctttataatagtgtaactactgcgccaaataccctttccgcaaatgagacaaaggcaaccactaatgacatcgctggtggtaactatgctgcagataatgcgagtgacaacacgcaaacaaagagcacccagggtgaggcggcagacgttaatcaagttttgccgatatcacattcaaataatgagcccaagcctgttagattggatataggtatagaaaattgccttcacattgagtttgaatatgccaaatcccagtacagcttaaaagaagtcattgtggggcgtatatatttccttttaacgagactaaggataaaacatatggaattaagcttgatcacaagagaatcttccggcctacaaacttctaatgtaatgacagattccactgctatccgatacgaaataatggatgggtcttcagtgaaaggtgaaaccatacccataagattattcttgagcggctatgacctgacgcccaatatgagctgcaactactttaacgtcaagaattatttgagcttggttattatcgatgaagatggcagaagatattttaaacaatcagaaataacattgtacaggacccggtag

SEQ ID NO: 2653 - DNA, 1140 bp, Saccharomyces cerevisiae
atgtcgaataagcaggcggttctgaagttaatcagtaaaaggtggataagcacagtgcaacgtgccgattttaagctgaattccgaagcgcttcatagtaatgctacggtatttagtatgattcagccaactgggtgtttccaccttggtaattatctaggtgctacacgtgtttggacagacttatgtgaattaaaacaacctggccaggaattgatatttggagttgctgatttacacgctatcactgttccaaagccagatggagaaatgtttagaaaatttcgccatgaggcagtagcaagtatactggctgtcggtgtagatccagaaaaggcttcggtgatctaccaatccgccatccctcaacacagtgaattacactggttgctttctactcttgcctcgatgggattacttaaccgcatgacgcaatggaaatcaaaatcgaatatcaaacaatcaactaatggggattatctggttaacgattctgacgtgggaaaagttagactgggcttattttcgtatcctgttttacaggcagcggatattctactttataaatctacacacgttcctgttggcgatgatcaatcgcagcatttggaactaacaagacaccttgctgaaaagtttaacaaaatgtacaagaaaaatttttttcctaaacctgtaactatgttggcacaaacgaaaaaagttttgagcttaagcacgcctgaaaagaaaatgtccaagagtgatccgaatcacgactctgtaatttttttgaatgatgagcctaaggcaattcagaaaaagattagaaaagctttaacagattccatttctgataggttctactacgaccctgtagaaagaccaggcgtatcgaatttaattaacattgtcagtggcattcaaagaaaatcgattgaagatgtcgtagaagatgtatctcgtttcaataactatagggatttcaaagattatgtttcagaagtgataattgaggaattgaaaggcccaagaacagaatttgagaaatatatcaacgaaccgacctatttgcatagtgtcgttgaatctggcatgcgcaaagcgagagaaaaagcagcaaaaaacctggccgacattcataaaataatgggcttctga

SEQ ID NO: 2654 - DNA, 1140 bp, Saccharomyces cerevisiae
atgtgcgattctcctgcaacgactggaaagcctactattcttttcatcgcagatccgtgcgaaacatcagccacacttaattccaaggcattcaaagagaagttcaggatcttgcgctatcagctggacaccaaagaagcatttcttaactttttagaaaggcatgaacaagacaaaatatgtgccatttatgctgggtttccggcattcaaaaaaatcggtgggatgactcgaagtatcatcgaacacaagtcatttccaaggaaaaatttaaaatgtatcgtgctttgctcaagaggttacgacggatgggatctggatacattacgcaagcatgaaattcgattatacaactaccaagacgatgaaaatgaaaaattgatagacgatttaaagcttcatcaagtcggtaatgatgtggcagattgtgccttgtggcacattctggagggctttagaaagttctcctattaccaaaaacttagtagagaaactggaaatacattaactgcaagggcgaaagctgcagaaaagagcggatttgcttttggccatgaactggggaatatgtttgctgaatcaccaagaggaaagaaatgcttaattcttggtttaggaagtattggaaagcaagtagcctacaagttgcaatacgggctaggaatggaaatacattattgcaaaagaagcgaagattgcacaatgagtcaaaacgaaagctggaaatttcatttgctagatgaaacaatatatgcaaaactataccagtttcatgcaatcgtggtcacattgccgggaactccacaaacagaacatttaatcaacaggaaatttttggaacactgcaatccaggcctaattttagtcaacttgggaagaggtaaaattttggacttgcgggctgtttctgacgccttggtaacgggacgaatcaaccatctcggtttagacgtctttaataaagaaccagaaatagatgaaaaaatcagatcttctgatagacttacttcaattactccgcatttgggtagtgcgacaaaggatgtttttgagcaaagttgtgaactggcattgacaagaatcttacgggtagtgtctggggaagccgcaagcgatgagcatttctcccgtgtagtttga

SEQ ID NO: 2655 - DNA, 1140 bp, Saccharomyces cerevisiae
atgtttagtaacagactaccacctccaaaacattctcaaggacgagtttcgacggctttgagctcagatcgcgttgagccggcaatattgactgaccaaatcgctaaaaacgttaagctcgatgattttattccaaagagacagtctaatttcgaactatcggttcctttgccaacgaaagcagaaatccaagaatgtacagcaagaaccaagtcatacattcagcggcttgtgaatgcgaaactagccaactcaaataacagggcatcatcaaggtacgtcaccgaaacacatcaggcacccgcgaatctattattgaacaacagccaccatattgaggtagtgtccaagcaaatggatccattgttgccaaggttcgttgggaagaaggcgagaaaggttgtagcacccacagaaaacgacgaagtcgtgcctgttctccatatggatggcagcaatgataggggagaagctgatccaaatgagtggaagatacctgcagctgtgtcaaactggaaaaatccaaatggttataccgtggccttggaaagacgtgtaggtaaagctcttgacaacgaaaataataccatcaacgatgggtttatgaagctctccgaagcgttagaaaacgctgacaagaaggcaagacaagagatcaggtccaaaatggaattgaagcggcttgctatggaacaggaaatgcttgctaaagaatctaaattgaaagaattgagccaacgagccagataccacaacgggactccgcagacgggagcaatagttaagcccaaaaagcaaacgagcacagtggccagactaaaagagctggcgtactctcaaggaagagacgtatccgaaaagataattctgggcgcagcaaagcgttcagaacaaccggatctgcagtacgattcaagatttttcacaagaggggcaaatgcctccgccaaaaggcatgaagaccaggtttatgacaacccactgttcgtccaacaagatattgaaagcatatacaagaccaactacgaaaagctggacgaagcggtcaatgttaagagtgaaggtgccagtggttctcacggccccattcagtttactaaagctgaatccgatgataaatcggataactatggcgcctag

SEQ ID NO: 2656 - DNA, 1143 bp, Saccharomyces cerevisiae
atgaattgtatccctagtccaattagtgaaaggaaaatccaaattaataatgaagattgtataggcaaggaaaatgctttccataccattccaagagaaagttcaattaacttgacacctcactctacgaatgaaaaaaaagttctatccgaggtaaacagtaacaaaatcgattctttacaactccctcgaggtaaattgcaaagagattccacccatttggaaaaaacaagaaagagacaattatcaaatgattcaaccgatcctatagagccaaaaactgtgaaaaaaataaaatgtcatcaatggaaaaatttggattcgatagagatggatgatccattcatggtagcagaatatacagattctatattttctcatctttacgagaaggaaatccaaatgctaccgacacataactatttaatggacacgcaatctccctatcatttgaaaagctccatgagggcgctgttaattgactggttggttgaagttcatgagaaatttcactgcttacctgaaacattatttttagcgatcaacctgctagatcgatttttatcacaaaatgttgttaaattgaataaattacaactactatgcatcacttgcctgttcattgcctgtaaatttgaagaagttaaattaccaaaaataacaaattttgcgtacgtgactgacggtgctgccactgtcgaaggaattaggaaggctgagctattcgttctaagttctttaggttataacatatctctaccaaaccccctaaatttcattaggagaatttcaaaagctgacaattactgcattgaaacaaggaacatggccaaattcatcatggaatattcgatttgttgtaataaattcatccacctgaagccatcatatttagctgcaatgtccatgtatatcgccagaaaaattaaaaatgaaaattccaaatgggatgaaacttttattcattatagtggcggcattgatattgaatcagatccagcgtttaaggattttatcagtgaactagttgaagatattgctgtacctgatacgaatctagattccttgagacttaaatacaaaaagcctaaacatggcatggtttatttcaaggtttttgactggtgtaaacaaaaacgttga

SEQ ID NO: 2657 - DNA, 1143 bp, Saccharomyces cerevisiae
atgagagaggaaagtaggtctaggaagagaaagcatattcctgttgatattgaagaggtagaagttcgatctaagtatttcaaaaagaatgagagaactgttgagttagtaaaagaaaataaaatcaataaagatttgcaaaattacggcggagtaaatattgactggatcaaggcactgaagccaatagagtattttgaatggatcgaatcaaggacttgtgatgatccgagaacttggggacggccaataactaaagaagaaatgattaacgattctggggcgaaagttcctgagagtttcttacccatatataatcgggtgagattaatgaggtccaaggttaaaaccccggtagatgctatgggatgtagcatgattcctgttttagtttctaataaatgtgggatacctagtgaaaaagtcgatccaaagaatttcaggcttcaatttcttattggcactatgctttctgctcaaacgagggacgaaaggatggcgcaagcggctttgaatatcaccgaatactgcttaaacacattaaaaatagcagagggtattacgctagatggactgcttaaaattgatgaacctgtattagcaaatctaattcgatgcgttagcttctataccagaaaagccaatttcatcaaaagaaccgcacaattattggtagacaatttcgattcagatataccgtatgatatagagggaattctctcgttacctggagttggacctaaaatgggatatttaacactgcaaaaaggttgggggctgattgccggcatatgcgtcgatgttcatgtccataggctgtgtaaaatgtggaattgggtagaccctattaagtgtaagactgccgagcatactagaaaggagttacaggtttggctacctcactcactgtggtacgaaataaacaccgttttggttggatttggtcaattgatctgcatggccaggggtaagaggtgtgatttatgtctagcaaacgatgtctgcaatgctcgcaatgagaagctaatcgaatcttccaaatttcatcaattggaggacaaagaagacatcgagaaagtatattcgcattggttggacacggttacaaatggaattacaacagaaagacacaagaaaaaatag

SEQ ID NO: 2658 - DNA, 1143 bp, Saccharomyces cerevisiae
atgcttcccacattcaaacgttacatgtcgtcctcagctcatcagattcccaagcacttcaaatcgctcatctattcaactcatgaagttgaggattgtaccaaggttttgtcagtgaaaaattatacgcctaaacaagacttatctcaatcaattgtgttaaaaactttggcctttcccataaacccttcggatatcaatcagttgcaaggagtatacccgtctcgtccagaaaagacatacgattactccacagatgagccagccgctatcgccggtaatgagggtgtctttgaagttgtttctttaccttcgggaagttccaagggagatttgaaattgggtgaccgagttatcccattgcaggcaaatcaagggacttggtccaattatagagttttctctagtagttctgatttaatcaaggtaaatgatttggatctgttttctgcggcaactgtatctgttaatggttgtaccggtttccaattagtatcagactatatcgactggaacagtaacggtaatgaatggattatccaaaatgccggtacatctagtgtatcaaaaatagttacgcaagtagcaaaagctaaagggatcaaaacattaagtgttatacgtgaccgtgataattttgatgaggtagcaaaagttttggaggataagtatggtgctacgaaggttatttccgaatcgcaaaacaacgacaagacttttgccaaagaagtattgtccaagattttgggtgaaaatgcaagggtgaggcttgccttgaattctgttggaggtaaatccagtgcatcaatagcacgtaagttggaaaataatgctttgatgctcacttatggaggaatgtcaaaacaacctgtaactttaccaacatctctacacattttcaaaggcttgacatccaaagggtactgggtgactgaaaagaacaaaaaaaacccccaaagcaagattgacaccatcagtgattttatcaaaatgtataattatggtcacattatttcaccaagagatgaaattgaaactcttacctggaatactaacactactactgacgaacagttactagaactagtcaaaaaaggtataactgggaaggggaagaaaaaaatggttgttttagaatggtaa

SEQ ID NO: 2659 - DNA, 1143 bp, Saccharomyces cerevisiae
atggaattcgttgcagaaagggctcagccagttggtcaaacaatccagcagcaaaatgttaatacttacgggcaaggcgtcctacaaccgcatcatgatttacagcagcgacaacaacaacaacagcagcgtcagcatcaacaactgctgacgtctcagttgccccagaaatctctcgtatccaaaggcaaatatacactacatgacttccagattatgagaacgcttggtactggatcttttggtagggttcatttggtgcgctctgttcacaatggtcggtattatgctataaaagttttaaagaaacaacaagttgtcaagatgaaacaggttgaacataccaatgacgaacgacgtatgctaaagcttgtggagcatccgtttctgattagaatgtggggtacgtttcaagatgctaggaatatctttatggtgatggattatatcgaaggtggtgaacttttctcgttactgagaaagtcacaaagatttcctaatcctgtagcaaaattttacgctgcggaagtcatactggcattagagtacttgcatgctcataatatcatctacagggatttaaagccagaaaatatcttgctggatagaaatggccacattaaaataaccgattttgggttcgccaaagaggtacaaactgtcacatggacgctttgtgggactcctgattacattgctcctgaagttattaccacaaagccatataataagtcggtggattggtggtctctaggtgttctaatctacgaaatgttagctggttatacacccttttacgatactactccaatgaagacgtatgaaaagattttacaaggtaaagtagtatatccaccatattttcatcccgacgtcgtggatctactaagcaaactgatcactgcagatttgacaagaagaatcggtaatttacaaagcggttccagggacatcaaagctcacccatggtttagtgaagttgtatgggaaagattgttagcaaaggatattgaaactccatacgagcctcctatcacatcaggtatcggtgacacgtctttattcgatcaatatcccgaggagcagctagattatggtattcaaggcgatgatccatatgctgaatactttcaagatttctaa

SEQ ID NO: 2660 - DNA, 1143 bp, Saccharomyces cerevisiae
atggatggagccaaatttgaaaatactgtagcttttttaccatctgaaatatttgattgctacaattccacgctacccaagaatgtattccgaagttttgttacctggtcctgctatgagaaattcaattccttagaattccgcacttggctattaatgtggttaccactcattattgcgtggaaaatacgtggtaaaagacactatctcgttatcgttactgctcttatgtttgaagtgctgtatttcttatggacatattcgtacatattccgagaacgcaccttaggaaagcaagtttctcaatttgctaaagagatcattacaaatactccgggtatagacactgaagactgggaacgtgttgcagtaaatttcaattcttatttatatgaaaataaactttggaatactgagtactttttttttgatggttccagctgccaagaagcgttcagaaagatgcttcttgagccattttccttgaaaaaaaatgactttgctaatgccaaggtacctgacggatctgtttgttacactgaaaaagctttgcaggtttattttacacagatagagagaaaatggcactggattaattctgaaggatttttacacaataaaaccacacagagtgttcaattttcgaaacatggttacggttccaaacttctctgggctttcaaggaagtgacaataatgaattcacgctttgcgttcttcagtattgcttacttaaacggtctccttactataccaagactaagaaattcactgcatatcctctatgtatgtgcagttctttcatctatgataattgaatatttaatagggatcgacaaattcaggttcaaatcaatgaatctgatacataaactacagttcttgtcatatattacatgtggacacgagaagtctgatgcaactaattggtctcaaattgcgaagaggacgaatacttacatgtttgagcagaaaatttggaattcgccaatactgttctcagatggtattgattgtgaaaagttttttaaatggtatttcagtacccctgtatcttcgcaagcgtctttgtcagttggttccactgattttgaactctggccatatataaaagaagcacaatcagcttgcaatgatgtgtaa

SEQ ID NO: 2661 - DNA, 1143 bp, Saccharomyces cerevisiae
atggccaagaaagttgccatctgtacattgctgtattcacgggactatttacctggcgcattgactttagcgtaccaattacaaaaactcttgaaacacgctgtagtggaagatgagataaccttatgcctgctaattgaaaaaaaattgtttggagatgagtttaaacctcaggaaatagctttaattagaagtctttttaaagagattatcattattgaaccgctaaaggatcaagagaagagcatagagaagaataaggcaaatcttgaactgttgaaaaggcctgagctatctcatactttactcaaggctagactgtgggaactggtgcagttcgatcaggttttatttttagatgctgatactttaccattaaataaagaattttttgaaatcctacgattataccctgaacaaacaagattccagattgctgcggttccagacatcggatggcctgacatgttcaacaccggtgtactactactaattcctgatttagatatggcaacaagtttacaagattttttgattaaaactgtatcgattgatggtgctgatcaaggaatcttcaatcaattttttaatcctatttgcaactacagcaaagaggttttgcataaggtgtctccactcatggaatggatacgcctccccttcacctacaacgtaaccatgcccaactacggataccagtcttcaccagccatgaattttttccaacaacacatcagacttattcacttcattggaacgtttaagccatggtcccgtaatacaactgactatgacgaccactattaccagctgtggagaagtacacagcgtgaactttatagtgaatgccacttaagtaactacttcacacacttgcaattgggcaatattgaaacagagacaaatttttaccacgaacctccttgtcttcaagacctgttgaatcatggtaaaagagaaaatcaaaagcacgttgacctggatataacctcagtagatcgaaatgcttcgcagaagagtactgcagagaaacatgatattgagaaaccgacatctaagccgcaatctgcttttaaatttgattgggagtctacggattatttagaccgcgtccaaagagcattcccaaagcctgatacctga

SEQ ID NO: 2662 - DNA, 1143 bp, Saccharomyces cerevisiae
atgtccatcaacctacattccgcacccgagtatgatccatcttataagctgatccagttgacaccagagttactggatataatacaggatccggttcaaaatcaccagttaaggtttaagtcattggacaaagacaagtctgaagttgtactgtgttcgcacgacaagacttgggtgctgaagcagcgcaaacattcaaacacagttctactaatgagagaatttgttcctgaacaacctattactttcgacgaaacgctcttgtttggactgtccaagccgtacatggacgtcgtgggattcgccaagactgaatcagaatttgagaccagagagacacatggcgaattgaacttgaattcagtaccaatatacaacggagaactggatttctccgacaaaatcatgaagaggtcatctacaaaggttatcgggaccctggaagaactacttgagaactcaccatgttctgcgctagaaggtatatcaaaatggcataagattggtggatctgtgaaagacggtgtgttgtgtattctttcacaagacttccttttcaaagcactgcatgtactactgatgagcgcaatggcagaatcactcgatctacagcatctgaatgttgaggatacacatcacgctgtggggaaggacattgaggacgagttcaatccatacacaagagaaatcattgaaacagtgctgaataaatttgctgttcaagagcaagaggctgaaaacaatacgtggcgcttgagaataccgtttatagctcagtggtacgggattcaagcgctaaggaaatatgtttctggaataagcatgccaattgatgagttcctcatcaagtggaagtcccttttcccacctttcttcccatgtgacattgacattgacatgctgcgaggctatcatttcaagcctaccgataagactgtccagtatatagcgaaaagcacactaccaatggaccccaaagaacggtttaaagtcctgtttaggctacagtcacagtgggacttggaggatatcaagcctctaattgaagaactaaattcaagaggtatgaaaatagacagtttcatcatgaagtatgcccgccgtaaaagactgggcaaaaagaccgtggtcacgagcaggtag

SEQ ID NO: 2663 - DNA, 1143 bp, Saccharomyces cerevisiae
atgtccgaggcgactttgctatcttacaccaagaaattattggcttctccgccgcaattgagtagcacagacctacacgatgcgttgctggttatattaagtcttttgcaaaaatgtgatacaaatagcgatgagagtctttccatctataccaaagtttcgagttttctcacggccttgagagttactaaacttgatcacaaggctgaatacattgcggaagctgcaaaggctgtgctcagacattccgaccttgttgatctacctttacccaagaaggacgaattacacccggaagatggaccagtaatcttagatattgtaggtactggtggtgacggacagaatacttttaatgtttccacgtctgctgctatcgttgcctccggaattcagggcctaaaaatttgtaagcacggtggtaaagcttctacatccaatagtggagctggtgacctaattggaactttaggctgtgacatgttcaaggttaattcatcgacagtgcccaaactttggcctgataatacgttcatgtttctacttgctcctttttttcatcatggaatgggccacgtttctaagatacgcaaatttcttggaattccgactgttttcaacgtactgggaccacttctacatccagttagccacgtaaacaagagaatattgggcgtttactcaaaggaacttgcgcctgaatatgccaaggcagccgctttggtatatccaggaagcgaaacttttatagtttggggacatgttgggttagacgaagtatcacctataggcaaaactactgtctggcatattgatccgacatcgtccgaacttaaattgaagaccttccaattagaaccttctatgtttggtttagaagaacacgagttgtcgaagtgtgcttcatacggccctaaagagaatgcgagaattctaaaagaagaagtcttgtccggcaagtaccaccttggcgacaataatcctatttatgactacatcttgatgaacaccgccgtgttatattgtttaagccaaggtcaccagaactggaaggaagggatcattaaggcagaagaaagcatacattctggtaatgcattacgttctttagaacactttatagatagtgtgagctccttgtag

SEQ ID NO: 2664 - DNA, 1143 bp, Saccharomyces cerevisiae
atgtctagcaaatggtttaatgctatacacctactggtgtgcccgttgacggtactggtaggatatctcatgaacgcgtatggctacggtgcggcgctgcaagcaaccctgaataaggatggtctggtaaatgctatgttggtaaagaaagggtggttttggacttccttggtcggatggtggtgtattatacgctaccgtgcggtgccgggggcaaccggcagagaccgaagacacattgtccagtcattcaaaaggtatgccatactgacagtgtggtggtacgtattcacgcaaggtatatggtttggcgtaggccccatcatggacttggtattcgtatatacgggtggccattgtcactatgacgtcttcgatgatgcaggtcacgtgaacgaagacttccagggttctgtcacccggactaatcgcgcgttggcgctcattcacaatgtcctcactttgcacggacaccaccaagaacaccgtcagcaacaactctgggaccgctccatagggtcgatccagggcgccctgcaggcgacgcaaccgaaaaccccaaaaaacgtaacggccagcgctgccgctgccatcaatacttttattcatgaccagatgcacaggtggcaaggtccgttaaccacctcggcacagtgcagacgttttggaggccattgggctggaggacacgatccatccgggcacgtgttcttggccaccttgatgtgcatgtttcttctaggtgagctacgtgtgtttgggcgtcgtgcactggctcacttgtacgcgcagaaatggcagcttgtacgattggtgacccgccttttcgacactggaccgctatggacgtggcggcggtgtggcggcggctcaatgacctgtggcgcccgtttgtggcgtgcgatagtcgagccgcctgtcacgtgcgcggccgccctgctccgtttgacgcgatgcatagcatgcgaccacccagtaatcatactgctgacgctattggtcacgtggttatggcagctgctgttgactgcggtggcgtcccgtttccacaccgtacgtgagcacatgtctggattgctagctgcgtacatagtgacaggccttgtctacgctcgcgacgcagccgcgctacgtccagtatga

SEQ ID NO: 2665 - DNA, 1146 bp, Saccharomyces cerevisiae
atgaaagagaatgaacttaaaaatgagaagagtgtagatgtattatccgtcaaacagctcgaatcccaaaagactgttctacctcaagatcttttcagaagcagctttacctggttttgttatgaaatttacaagtccttagtgtttcgcatctggatgctattatggctaccacttagcgtctggtggaaactttccaacaattggatttacccgcttatggtttcacttcttgtcctgttttggggaccagtatttgttcttgttatttttagactttctcgtaaacgttccttatcgaaacaactcactcagttttgcaaagagattactaaaaacacaccaagttcggatcctcatgattgggaagtcgttgcagcaaatctaaattcgtacttctatgaaaataaggcttggaataccaagtacttttttttcagtgccatgagctgccaagaagcattcagaacaacccttctcgaacccttctctttgaaaaaagacgaagctgccaaggttaagtcatttaaggattccgtcccttacattgaagaagcattggaagtttattttacagaagttgaaaaacaatggaagttgtttaattctgagaaatcatggagccctgttggcctggaagatgctaaacttcccaaggaagcttaccgatttaagcttacctgggttctcaaaaggattttcaaccggcggtgtttaccactcttccttttttatttgcataatgtcttcatttcacgaaatgatggcactatagcacgtcccttgtttcttgtggtgctgttttttatcatgacgagagatttccggaatatgaggatgatcgttttatccgtgaaaatggaacacaagatgcagtttttatcgactattataaatgagcaagaaagtggtgcaaatggatgggacgaaattgcaaagaaaatgaataggtacttgtttgagaaaaaagtctggaagaatgaagagtttttctttgacgggattgactgtgaatggttttttagccacttcttctaccgcgttctctctgcaaagaaatctatgcgggctctatcattgaatgtggaactatggccatatattaaagaagcgcaattatcctgcagtgaggagtccttagcgtaa

SEQ ID NO: 2666 - DNA, 1146 bp, Saccharomyces cerevisiae
atgaaagagaatgaacttaaaaatgagaagagtgtagatgtattatccttcaaacagctcgaatcccaaaagattgttctacctcaagatcttttcagaagcagctttacctggttttgttatgaaatttacaagtccttagcgtttcgcatctggatgctattatggctaccacttagcgtctggtggaaactttccaacaattgtatttacccacttatagtttcacttctggtcctgtttctgggaccaatatttgtccttgttatttgtggactttctcgtaagcgttccttatcgaaacaactcattcagttttgcaaagaggttactgaaaacacaccaagttctgatcctcatgattgggaagttgttgcagcaaatctaaattcgtacttatatgaaaataaggcttggaatactaagtactttttcttcaatgccatggtctgtcaagaagcgttcagaacaacccttctcgaaccattttctttgaaaaaagacgaagctgccaaggttaagtcatttaaggattccgtcccttacattgaagaagcattgggagtttattttagagaagttgaaaaacaatggaagttgtttaattctgagaaatcatggagccctgttggcctggaagatgctaaacttcccaaagaagcttaccgatttaagcttacttggtttttaaagaggatttccaatatttttatgttgataccattccttaattttttgtgctgcatatatgtgtcacggggaatgtgccttctattacgcaccttttatctcgggtggattcttttcatgttggtacaaggtttccaaaacatgaggatgatcgttttatccgtgaaaatggaacacaagatgcagttcttgtcgactattataaatgagcaagaaagtggtgcgaatggatgggacgaaattgcaaaaaaaatgaataggtacttgtttgagaaaaaagtctggaagaatgaagagtttttctttgacgggattgactgtgaatggttttttagccacttcttctaccgcgttctctctgcaaagaaatctatgcgggctctatcattgaatgtggaactatggccatatattaaagaagcgcaattatcctgcagtgaggagtccttagcgtaa

SEQ ID NO: 2667 - DNA, 1146 bp, Saccharomyces cerevisiae
atgaaagagaatgaagtcaaagatgagaaaagcgtagatgtgttatccttcaaacagctcgaattccaaaagaccgttctacctcaagatgttttccgaaacgaattgacctggttttgttatgaaatttacaagtctttagcgtttcgcatctggatgctgttatggctaccacttagcgtctggtggaaactttccagcaattggattcacccacttatagtttcacttcttgtcctgttcctgggaccattttttgtccttgttatttgtggactttctcgtaagcgttccttatcgaaacaactcattcagttttgcaaagagattactgaagacacaccaagttcggatcctcatgattgggaagtcgttgcagcaaatctaaattcgtacttctatgaaaataagacttggaataccaagtacttttttttcaatgccatgagctgccaaaaagcgtttaaaacaacccttctcgaacccttctctttaaaaaaagacgaatctgcaaaggttaagtcatttaaggattccgttccttatatcgaagaggccttgcaagtgtatgctgcaggatttgacaaagagtggaagctgtttaatactgagaaggaagagagtcctttcgacctggaagacattcagctccccaaagaagcttaccgatttaagcttacctggattcttaaaaggattttcaacctgcggtgtttaccactcttcctttattattttttaattgtctacacgtctggaaatgctgaccttatatcacgtttcttgtttccggtagtaatgttttttatcatgacgagagatttccaaaatatgaggatgattgttttatccgtgaaaatggaacacaagatgcagttcttgtcaactattataaatgagcaagaaagtggtgcgaatggatgggacgaaattgcaaagaaaatgaataggtatttgtttgagaaaaaagtctggaataatgaagagtttttctacgatggacttgactgcgaatggttttttaggcgctttttctatcgtctcttatctttaaaaaaacctatgtggtttgcttcgttgaacgttgagctatggccatacattaaagaagcgcaatcggcccgcaatgagaagcccctaaagtag

SEQ ID NO: 2668 - DNA, 1146 bp, Saccharomyces cerevisiae
atgaaaagcgattcagttgaaatcactaccatctgcccagatgttgaaaattctcagtttgttgtgcaaagcaactgtccagagactattccagagattctaaagtctcaaaatgccgctgtgaatggcagcggcatcgcttgccaacaacgtagcttaccaagaatcaaaatcttgggtaccggtggtactattgcatcgaaagctatagactcctctcaaactgccggctatcatgttgacctgaccatccaagatctattggatgccattccagatatatccaaggtctgtgacattgaatatgagcaactatgcaacgtggattctaaagacataaacgaggatattctttataaaatttataagggcgtctcagaatcgttgcaggcttttgacggtatagttattacccatgggactgatacgctatctgaaactgcattctttattgaaagtactattgatgctggcgacgttcctattgtttttgttggttcgatgcgtccttcaaccagcgtttctgctgatggccctatgaacctttaccaagcaatttgcattgcttcaaatccaaaatctagaggaagaggtgttcttgtttccttgaatgaccaaatttcctctggttactacattactaagacgaatgcaaatagtttggattcttttaatgttagacaaggctatttaggaaattttgtcaacaatgaaattcactactattatcctcctgtgaaaccgcaaggttgccacaaattcaaactgagagtggacggtaagcattttaaattaccagaggtttgcattttatatgctcaccaagcctttccgccagctatagtcaacttagtggcagataagtatgatggtattgttcttgctaccatgggtgctggttcattgccggaggaggtcaatgaaacctgcatgaaattgagtttgccgatcgtatattccaagagatcgatggatggtatggtgcctattgccaacgtaccaaagaaaggttcaaaggaggataatctcatcgcatctggttatctaagccctgaaaagagcagaatcttgttacaattatgtttggcaggtaactacacgttggaagaaattaaacatgttttcactggcgtctatggtgggtga

SEQ ID NO: 2669 - DNA, 1146 bp, Saccharomyces cerevisiae
atgaattataataactttgaaaattcgaagggtgatggacattctaggcttcccaaacctacatactccggaacgctatcagatggctatgatgaatcgaaaattaaaaggcaaaaaacagactctgcttttaatgcagcttactcacctcatatgtatccgaactctccgtattatgaaggttcatggaataccggttatactcctcaacttcatcatgtagcccctcataatcaatatttccatccaatacaaccgtccactcagtacaattatacgagtcctcccaattatacagaaaattacataccgccagttcatcagaatatatcttatgcaccagcgcttaatttacagaagtggccatcatcatattgtgaaaacactcaagccttaaagaatgataaagattaccaaacatcaattagttatgaagatgttgcaataccgaccgtaaaggaaatacaattgattgagaaaaacagagggaaagatacgtttatgaatgaaataagtccagtaccatcaagcaaggatcaagcatctgcggagcctacagaaatcccaagaaaggatcccgagctggcaaattctaatgccgaagatgatcataataacttagggctagaagatgatgatcgtgatgagcagttagaatcagaggggttgggtaaggtggttttggttcctggaacctccatagcattgattactgatgaagatgttaaaaagtggagagaagaaagaaaaaaaatgtggctactgaaaatatccaataacaaacagaaacatatgcaagaaatgggcataaaggaagatgaactgaagagccaacctagcattttcaaagagtcaaggaaagaaaagcaatttatacagagtattcaaaatcaagtgcagagaggaaatccgaagattgacttgaacttgaaattgatacagcgagaattcgcaaacgaaaactcccaacttttggactttataagagaattgggagatgtaggattacttgaatatgagctatctcaacaagaaaaagatgtactttttgggagctctgaagataataataaaaatcattacaaaccaaattacaaaaacaggaaacctaatctgagtagagccaactttactagaaataagtaa

SEQ ID NO: 2670 - DNA, 1146 bp, Saccharomyces cerevisiae
atgcagattttcgtcaagactttgaccggtaaaaccataacattggaagttgaatcttccgataccatcgacaacgttaagtcgaaaattcaagacaaggaaggtatccctccagatcaacaaagattgatctttgccggtaagcagctagaagacggtagaacgctgtctgattacaacattcagaaggagtccaccttacatcttgtgctaaggctaagaggtggtatgcagatctttgttaagactttgaccggtaaaaccatcactttagaggttgaatcctccgacacgatcgataacgttaagtcgaaaatccaggacaaggaaggtatccctccggatcaacagaggttgatctttgccggtaagcagctagaagatggtagaaccttgtctgactacaacatccaaaaggaatctactcttcacttggtgttgagactgagaggtggtatgcaaatttttgtcaagacactgacaggtaagactataaccctagaggttgaatcttctgacactatcgacaacgttaagtcgaaaattcaagacaaggaaggtattcctccagatcaacaaagattgatttttgctggtaagcaactggaagacggtagaacgctgtctgattataacattcagaaagagtctacgttgcatttggtgttgagattgagaggtggtatgcaaattttcgtcaaaactctaacagggaagactataaccctagaggttgaatcttccgacactattgacaacgtcaaaagtaaaattcaagataaagaaggtatccctccggatcaacagagattgatttttgctggtaagcaactagaagatggtagaaccttgtctgactacaacatccaaaaggaatctactcttcacttggtgttgagactgagaggtggtatgcaaatttttgtcaagacactgacaggtaagactataaccctagaggttgaatcttctgacactattgacaacgttaagtcgaaaattcaagacaaggaaggtattcctccagaccagcaaagattgatttttgccggtaagcaactagaagatggtagaacgctgtcggactacaatattcaaaaggagtccactcttcaccttgtcttgaggttgaggggtggtaactga

SEQ ID NO: 2671 - DNA, 1146 bp, Saccharomyces cerevisiae
atgctgctggaaagattgcacaagagattacacgccggctcttctaggcgatctcaagaaaataaggacaagaattgcaagcccgaagacgcgttgcccatccaaccagaagctcaacatcaaactcaggaccctcagccgttgttaaattgtgattacgatgacatgattgcatttgacagaaacttgtccactcccgttttcactccggtaatgactcctataaataatagcagctccaatcaggcgaaaagctcggatgcctcgtattttccaccttacctcaatgctaatagaaccagacagaatagcgcctcttcgctggcgagttccgtttccgatttcgctcagaatttcaaacaacataccttttacaacaataacgctcaattcacttcgttcacaccgcagtttgtcggccttctattagaagtttaccaaaacacgtgcagcgatcctacgataactccgtttgatactacaaaccctccctcaggaatattgaatagagttgccaaagcggctatacagcaatctgagcttcaacaattggatatcggatgtgacagaaatagctggcttttaacattggtaagacagcgcttgttgcaagaggtcagaaaagacggctatctttctcgtaacacttctttaacttctttacccccaccacccccaccacagttttctgaaatgcttagagttccctccccgtttgttaacgcagatattaccgatccaatccccttatcaaacacaaactcgaatccgaatgtaagctctactaccagcctgaccaacacgttgaactggtattccttacaaagatccaacgtctcaatgaagaatagaaatggctcgtcccagtatatttcagaattacaaccacaacctatcttagcccgcacaaattctaacaatagtgttagcaacagtaatgccttttctttactcacgccaacgcctacaacagattccgcatttaattttaacatagctctgctatcgagacaacgtagcaatatcatatcgtcccccttagctagtactcgtttacctacagcaaacgtgtccactgaagaatcctctattttaccaaatgaatcattgaagctaaaaagagatttattgcgtcttaaaaggtaa

SEQ ID NO: 2672 - DNA, 1146 bp, Saccharomyces cerevisiae
atggatgttacatttctaaccaaaaatgttcaaataaatggcactcagtttaaaatattacttcaaaatgggcaaggtgaatgcgcgctaattgcactagctaacgtattattgatatcacctgcccatgctcgctatgcccaagaaatttccagactagtgagaggcaaggaaactgttactttaaacgaacttgtgcaaactctagccgacatgggcgttcaaaatccgaatggtacagatgtggacaaacaacagctactccaaatcctaccacaattatatagcggattgaacatcaacccagaatttaacggatcttttgaggacggcgtagaaatgtcgattttcaggctctacaatgtcggcatcgttcatggatggataatagatggggacaatgatccgaactcttacgaacatgtgtccaaatattcttatatgggcgcgcaaaaagttttggtacagtcgtatgagatccaaaagaataatgcccaatttgaaaacagcgagcaaatccaatctgatgcaccttacttaaaatcgtttctggcaagatctgccacacaattgactgaatatggtctaactcatctcagagaaattttagtagaaagatcgtatgccgtgctttttagaaatgatcacttttgcacattatataaaaacaatggcgaattgtttactttggtcacggatcctacttacagaaatcgcaaggacataaactggcagtcgcttaaatccgtgaatggatcgcaggattcttactacacgggcaacttcattcccacaagtctggaaagaacagaaactactgctaccgggcaaaatgagtcctacatttctaacccattcagtgaccagaatacagggcatgtaactagcaaccaagttaatagtggagcaagcggtgttcaacaaatcgaagatgatgaggaactagctaggaggttacaggaacaagaagatatgcgtgcggcaaataacatgcaaaatggttatgctaataacggtagaaatcatcaaagggaaaggtttgaaagacctgaaaaaaattcaaagaaaaacaagttccttccctttaatgggagtaataaagaaaagaaaagagacaagttgaaaaaaaactgtgtaattatgtga

SEQ ID NO: 2673 - DNA, 1146 bp, Saccharomyces cerevisiae
atgtcacagttcttcgaagctgctactcccgttgcaattcccacaaacaataccaacggcggctccagtgatgccggcagcgccgccactggcggcgcccccgttgttggcaccaccgctcaacccaccatcaatcacaggcttttgctgtcattgaaagaggctgccaagatcattggcactaagggctccaccatctcacgcataagagctgcaaacgccgtcaagatcggtatttctgaaaaggtgcccggttgctctgacaggatcctgtcctgtgctgggaacgtaatcaatgtggccaatgccattggtgatattgttgacgtgcttaacaaacggaatcccgaaaatgaggacgcagctgagggcgaagcggaagagcactactacttccactttttgaaccatattttaccagctccctcaaaggacgagatcagagatctgcagcaactggaggacatcggttatgtgaggctcattgtggccaattcccatatctcatcgattatcgggaaagcaggcgccaccatcaagtccctgatcaataagcacggcgttaagatcgtggcttccaaggacttcttacctgctagcgacgagagaattatcgagatccagggtttcccaggatccatcaccaatgtacttatcgaaattagcgagatcatcttgagtgacgttgacgtcagattcagcacagaaagatcttatttccctcatctgaaaaagtcctccggtgagccaacttccccttctacctcatctaacactaggatcgaattgaagattccagaactgtatgtaggcgccattattggccgtggaatgaacagaattaagaatttgaaaactttcacaaaaaccaatattgtcgtggaaaggaaggatgacgatgataaagacgaaaattttagaaaattcataatcacaagtaaatttcctaagaatgtcaaacttgctgagtccatgcttttgaagaacctgaatactgaaattgagaaacgtgaaaactacaagagaaaattggaagctgccgaaggagatgccactgttgttactgaacgctctgattctgcttctttcttggaagagaaggaagaacctcaagagaatcatgataacaaagaggagcagtcgtag

SEQ ID NO: 2674 - DNA, 1146 bp, Saccharomyces cerevisiae
atgtcctctcaagcattcacttcagtacatccgaatgcggcaacatctgatgtgaatgttaccattgacactttcgttgctaagttaaaaagaagacaagtgcaaggttcatacgccatcgccttggaaactttacaactgttaatgcgatttatctctgcagctcgttggaaccatgttaatgaccttattgaacaaatcagagatttaggtaatagtctagaaaaagctcatcctactgctttcagttgcggtaacgtaattagaagaatactggctgttttgagggatgaagtagaagaagacactatgagcacaactgtcacatccacatccgttgctgaacctttgatttcctctatgtttaatttattacagaaaccggagcaacctcatcagaatagaaaaaatagttcagggagctctagtatgaaaaccaagactgattaccgtcaagtagccattcagggtatcaaggatcttatagatgagataaaaaacattgatgaaggtattcagcaaattgctattgatttgattcacgatcatgagattttattaactcccacacctgattcaaaaaccgtattaaaatttctgattactgctcgcgaacgtagtaatagaacatttacggttttagttacagaggggttccctaataacaccaagaatgcacatgagtttgccaaaaaattagcacagcacaacatagaaaccctagtagtcccagactcagctgtttttgctttaatgtcccgtgtgggtaaggttattatcggcactaaagccgtttttgtcaatggggggactatctcgtcaaattcaggtgtatcatccgtttgtgaatgcgcccgagaatttagaacccctgtatttgctgttgcaggtttgtataagctttctcctctatatccgttcgacgtagagaagtttgtcgaatttggtgggtcccaacgtatattacctagaatggatccaagaaaaagattagatacagttaatcaaattaccgattatgttccgcctgaaaatattgatatctacattacaaacgtcggtgggttcaatccaagttttatatatcgtattgcgtgggataattacaagcaaattgatgtgcatttggataaaaataaggcgtga

SEQ ID NO: 2675 - DNA, 1146 bp, Saccharomyces cerevisiae
atgtcttttagggatgtcctagaaagaggagatgaatttttagaagcctatcccagaagaagccccctttggagatttctttcatacagtacatcattactgaccttcggtgtatcaaaactgcttcttttcacatgctataatgtcaaattgaatggttttgaaaaattagaaactgccttggaacgttccaaaagggaaaatagaggccttatgacggtcatgaaccatatgagtatggtcgatgatccgttagtttgggcaacactaccatataagttatttacgtctttggacaacataagatggtctttgggtgcacataatatttgctttcaaaataaatttctggccaactttttctcacttggccaagtcctttcaacagaaagatttggggtgggcccatttcaaggttctatagatgcttcaataagattgttaagccctgacgacactttagacttggaatggacccctcactctgaggtctcttcttcgctaaaaaaagcctactccccgcccataataaggtcgaagccatcttgggtccatgtttatccagaaggatttgtactacaattatatccgccttttgaaaattcgatgaggtattttaaatggggtattaccagaatgatcctagaagcaacaaagccgcccattgtagtaccaatatttgctacagggtttgaaaaaatagcatccgaagcagtcacagattcaatgtttagacaaattctaccaagaaactttggctctgaaataaatgttaccataggggatcctttaaatgatgatttaatcgacaggtatagaaaagaatggacacatttggttgaaaaatactatgatcccaaaaatcctaacgacctctctgacgaattgaaatatggtaaagaggcgcaagatttaagaagcagattagccgctgaactgagagcccatgttgctgaaattagaaatgaagttcgcaaattaccacgcgaagaccctaggttcaaatccccctcatggtggaagcggttcaacaccacggaaggtaaatcggacccagatgttaaagtcattggcgaaaattgggcaataaggaggatgcaaaagtttctgcctccagagggtaaaccaaagggtaaggatgattga

SEQ ID NO: 2676 - DNA, 1146 bp, Saccharomyces cerevisiae
atgttgaaacgatcatctctaatatatctatcatgtgtcctaatcattaccataccaatacttttgcatgtatacaatggtccaggactgtcccatgaagccaatgaacatagggcttctcacaagcaaaaaagaacgttagcaaatccggataaacccaaaagcgaaaacgatgaagatctattttgtgcggtaaccaacccagtcaccggatcatacatagatctatcacagctatcttcaactcccaacaaattaagggagggccaaaaacagatttctggcaataacaagcatgaatcctccaagacgaagtggtcagtgagaggttggggctacgatacaaacttcacgttaggcatctgctctagtcctgtcggagaagctgagtcgcaacaactgtccaatctaacgggcgctttttacgtagaccagttgaacgaaaataatttagtatcgattggagacttcagtacaaggcctgcgttagtcggcggctctactgccaagaaattaactctcaaatacgaaaacggctctatgtgcccgaacgggaaggacaagaaggcaactttattgaattttgtctgcgataaagaaattcaatcaaaggcccagatatcatacattggaaacctacacaattgctcgtatttcttcgaagtccgcagcattcatgcgtgccccacctcaaacaaaaagaatgaagttaacgttttgggtatcttcatcggtatcttcgctatattctttttagtcgaatttgcggggagaagatggatctatgctaaactaaataggcatttgaaaaacgacgacgagttacacgacatatcgccatctttaaatgagcaaccacactgggacctcatagaggacgggtctcgctggagtaaatttttcaacgggataattaagacgacaagaaggttcacgaaatctttaatgaggtctttagtcagaggcaggaacagccgtcaagggggcataagactacggtcatccccatctgcctcttcgtccagccttgccaacagggagttcttcagagacatggaggctcaaaacgaaattattgacagcctagacatcaatagtcatacaacagaaagcgaccacccaactttggctgataatagcgtataa

SEQ ID NO: 2677 - DNA, 1149 bp, Saccharomyces cerevisiae
atgaataataacagcagaaacaacgaaaatcgaagcactattaacagaaataaaaggcaactacaacaagcaaaagaaaaaaatgaaaatattcatatccccaggtatattagaaatcaaccatggtactataaggatacccccaaagaacaagaagggaagaagcccggcaatgatgatacgagcactgcagaaggaggagaaaaaagcgactacttggtgcatcataggcaaaaagcaaaagggggtgctttagatattgacaataattcagaaccaaaaattggtatgggtataaaggatgagttcaaactaatcagaccccagaagatgtccgtccgagattctcattcgctgtcattttgtaggaattgtggggaagcagggcataaggagaaagactgcatggaaaaacctcgtaagatgcagaagcttgttcccgatttaaattcacaaaaaaataatggcacagttttagtacgagctactgatgatgactgggactccagaaaagatagatggtacggttactcagggaaagaatacaatgaactgataagtaagtgggagcgtgataaaagaaataaaataaaaggaaaagacaaatcccaaactgatgaaacactatgggatacagatgaagagatagaactaatgaagttagaactttacaaggattccgtaggttcattgaagaaagatgatgctgataattctcagttgtataggacatcaacgagattgagagaagataaggctgcttacttgaacgacataaattcaacggagagtaattatgatcctaaatcaagattgtacaaaactgaaacactgggcgcagttgatgaaaaatcaaaaatgttccgcagacatttgacaggtgaaggcctaaaattaaacgaattgaaccagtttgctagatctcacgctaaggaaatgggtatacgtgatgaaattgaggataaggaaaaagtacaacatgttttagtcgccaatcctactaaatatgaatatctgaagaaaaaacgggaacaagaagaaaccaagcagcccaagattgtcagcattggagatctggaagctaggaaagtagatggtacaaagcaatctgaggaacaacggaaccacttaaaagatttatatggttaa

SEQ ID NO: 2678 - DNA, 1149 bp, Saccharomyces cerevisiae
atgagaaaagaattaaaataccttatctgcttcaacatactcctcctgttatctataatatactacactttcgatttgctaacgttgtgtattgacgatactgttaaagatgctatacttgaggaagacttaaatccagatgcacctccaaagcctcaactaatacctaaaatcatacatcagacttataaaacggaagacatccctgagcactggaaagagggtagacaaaaatgtctcgatctacatccagattacaagtacatcctatggacggacgagatggcctatgagtttataaaggaagaatacccgtggtttctcgatacttttgagaactacaaataccccatagaacgtgccgatgccattcgttactttatcctgtcccattatggtggtgtatacatcgatttagatgacggctgcgaaaggaaactagatcctttgttagctttcccggccttcttaagaaagacttcacctttaggtgtctcaaacgatgtcatgggttctgtgcctagacatcccttctttttaaaggctttaaagtctttgaaacactatgacaagtactggtttatcccttacatgactattatggggtctactggtccgttgtttttaagtgttatttggaagcagtacaaaagatggcgcatacctaagaacgggacagtaagaatcctacaacctgcttactacaagatgcatagttattcatttttctccattactaaaggctcttcatggcatttagatgatgcaaaattgatgaaagcactagaaaaccacatcttatcctgcgtcgttaccggatttatttttggcttctttatcctatatggtgaattcacgttctattgctggttgtgttccaagaatttcagtaatctaaccaaaaattggaaacttaatgctataaaagtaagatttgtcacaattctaaattcattaggcttaagactaaagttgagtaaaagtaccagtgatactgccagtgccactttgctggcaaggcagcagaaacgattgaggaaagattccaatacaaacatagtgttactaaaatcttcaaggaaaagtgatgtttacgatttagaaaagaatgattcttctaagtactcactgggaaataacagctcgtaa

SEQ ID NO: 2679 - DNA, 1149 bp, Saccharomyces cerevisiae
atgagagctttggcatatttcaagaagggtgatattcacttcactaatgatatccctaggccagaaatccaaaccgacgatgaggttattatcgacgtctcttggtgtgggatttgtggctcggatcttcacgagtacttggatggtccaatcttcatgcctaaagatggagagtgccataaattatccaacgctgctttacctctggcaatgggccatgagatgtcaggaattgtttccaaggttggtcctaaagtgacaaaggtgaaggttggcgaccacgtggtcgttgatgctgccagcagttgtgcggacctgcattgctggccacactccaaattttacaattccaaaccatgtgatgcttgtcagaggggcagtgaaaatctatgtacccacgccggttttgtaggactaggtgtgatcagtggtggctttgctgaacaagtcgtagtctctcaacatcacattatcccggttccaaaggaaattcctctagatgtggctgctttagttgagcctctttctgtcacctggcatgctgttaagatttctggtttcaaaaaaggcagttcagccttggttcttggtgcaggtcccattgggttgtgtaccattttggtacttaagggaatgggggctagtaaaattgtagtgtctgaaattgcagagagaagaatagaaatggccaagaaactgggcgttgaggtgttcaatccctccaagcacggtcataaatctatagagatactacgtggtttgaccaagagccatgatgggtttgattacagttatgattgttctggtattcaagttactttcgaaacctctttgaaggcattaacattcaaggggacagccaccaacattgcagtttggggtccaaaacctgtcccattccaaccaatggatgtgactctccaagagaaagttatgactggttcgatcggctatgttgtcgaagacttcgaagaagttgttcgtgccatccacaacggagacatcgccatggaagattgtaagcaactaatcactggtaagcaaaggattgaggacggttgggaaaagggattccaagagttgatggatcacaaggaatccaacgttaagattctattgacgcctaacaatcacggtgaaatgaagtaa

SEQ ID NO: 2680 - DNA, 1149 bp, Saccharomyces cerevisiae
atgaggaggactttttctcagttagcaacccgactattgaagtcgaaagatgatgagctgaaatcaactctaaaatacttgaccaaaggtccagtgaagttgttggggcctttgtttgaatcttctgaagttaatgaacaaggttccttattgaatcgttcacgcactaaagaaaataatcttcaaaatcaccatatagagaacatcctgagaatactgaattcaaatctaccggaagtagagtccaagaaacaaaaagtagctgttcattacgatgtgcttttctcacatttgaactcaatagttacccaggcaacggataacaaaagttcttcttcgaaggaactacaaggttcatcgtccgaggatctatatgataggctgctgcttttgcagtatgtgggcaagttaactaatgtgcgtcaaataacagaaattttgctctcaaaaaagttcaacaaattcgataaagtatgggagcacagagccttgtttgacgaataccaaagagtagtgatatccatcctgttgtattatagaacgcacgatgtgcaaataagaaaagactacgagcctcgttggttgtccgattacagtgatctaccgtttcctctgcgacgtcttttgtggagatgtctaacttctaacgtatctgaagataatattcgtcaaaatataattcattacattaagcttttaggcgcaaattggaggaataacgatttgattttaatttatcaatctttgtatgaaaagtcacatatattgcctgatttaacggtcctgaaccacaataaagatgatggtttctctttcacccaaaatcaaatcctgcttgttcgtattttaagggctatttcgaaatgcgttgaagaggaaccaaaattggtcaaaaaatggttaattgatatcgtaaaattgagtatacaaagcaaaataatgctggagtcaccgaagaaaccgtccacaccaataatggaccaatacaaatttattagatccttagatatttctatacggagtatccatcggacgtgccaggataaactaatctttgaagatttacaggtcaaccttggaagtgtattaaagatgattaatgaagaagaacacgagttaaaaacacacttaccattgaacctcatataa

SEQ ID NO: 2681 - DNA, 1149 bp, Saccharomyces cerevisiae
atgcctaaaaagcaaacgaatttcccagtagataacgaaaacagaccttttagatgtgatacctgtcaccgtggtttccatcggttagaacataaaaagagacacttgagaacacacactggggaaaaacctcatcattgcgcatttcctggttgtgggaaaagtttcagtagaagcgatgaactgaaaaggcacatgagaacgcatacagggcaatctcaaaggagattgaagaaagctagcgtacagaaacaggagtttttgacagtaagcggaattcctaccattgcatcgggcgtgatgatacaccaaccaataccgcaagtcctaccagcaaatatggccataaatgttcaggcagtaaatggaggtaacattatacacgctcccaatgcggtgcacccaatggtgataccaatcatggcccaaccagcccccattcatgcctccgctgcatctttccagcctgcaacttctcctatgccaatttctacatacactccagttccatcgcaatcattcacctctttccagagctctattggctccatacagtcaaatagtgatgtttcatctatcttctcgaacatgaatgttcgcgtaaacactccacgctctgtgccaaactctccgaatgatggatatttacaccagcaacatatcccacagcagtatcagcatcaaactgccagcccttctgttgccaagcagcagaaaacttttgcacattctcttgcatctgcattatctaccttacaaaaaagaacgcctgtaagtgccccttccaccactatagaatcaccatcctcaccaagtgattccagtcatacctctgcatccagcagcgctatctctttgcctttcagcaatgctccttctcagctcgccgtggccaaagaacttgagtccgtctatttagattccaatagatacaccaccaagactaggagggaaagagcaaaattcgaaattcctgaagaacaagaagaagataccaataacagcagcagtggtagtaatgaggaggagcacgagtcgctagatcatgaatctagcaaaagccgaaagaaattgtcaggcgtaaaattgccgcctgtacgtaacctactgaaacaaattgatgttttcaacggtcccaaaagagtttaa

SEQ ID NO: 2682 - DNA, 1149 bp, Saccharomyces cerevisiae
atggcaagtaaccagcacataggagcttcaaacctaaatgagaatgaggctatattaaccaaccgcgttgctgagctggaaaggcgtatgtcgatgtttgagggtatatttcacgcgttaagtaaccgtctcgatcttcactttaaaaaatatgatgtagtggtaaactcccaacagcaacaaatcaacgaactgaccgcgtttttatcaacattgctgaatgaccaacaacgccacgctgaaattctcagtgaaaaattaagcggaacgttgcatggggtgtcagctacgtcaatatccttaagccaaactcttgacccacaaggcttcactgatggaactacggcaccaggagctcctaggaattatacttcagtgcctatgaataatgatcaaactgctcatccgcaaaatgaaggagctgttagtaatgaaacactttttgaggacattttgaatggaaattcacaagaaaatgataagagtcaacaacaaactaacagctcaaattctataagccaagaaaataatagcaccaacccttcagtggacactcggttcaacaagccgcaaaattataattccaatttagtcccatccttggaagagtattcagcaaatccacctaacaatgatggtggccaaagtcaaggactgtacataagcagcaactcttctcaatcacggcagtctcctaatctccagaaagtttctcctaaccatgaaaatgcggttgaatcaaatgcacaagagagcgtgccgacatttgaggaggaacagtatgagactaaaacaggattgaaacggaaacgaatagtctgcacaagacccttcgaatttatcaagtcaccacactctgtgatggaggtttggaaggagtatacagaaggtgttaacgggcagccttctataaggaaaatggaagctctttatcaaacggcatggaggcgagatccagcagtaaataaaagatattcgagaagaaaggttctttggaaagccattcaaactggccttaatcgtgggtattcattaaactatgttgttgaaatattagaaaactcaagatatgttaatgataaacagaaggttaaacaacctattggttggttatgccacagttctcatattccagagactttgaagtga

SEQ ID NO: 2683 - DNA, 1149 bp, Saccharomyces cerevisiae
atggccggtacatttttattcacttctgaatccgttggtgaaggtcacccagataagatctgtgaccaagtttccgacgccatcttggacgcttgtttagccgaggaccctcactccaaagttgcgtgtgaaaccgcggcaaagactggtatgattatggtctttggtgaaattactaccaaggcacagttggattaccaaaaaatcgtcagagacaccatcaagaagattggttacgatgattccgccaagggtttcgactataagacctgtaacgtccttgtcgccattgagcaacaatctccagatatcgcccaaggtgtccacgaggagaaggatttggaagacatcggtgccggtgaccaaggtatcatgtttggttacgccacagatgaaactccagagggtttgcctttgactattcttttggctcataaactaaacatggccatggctgacgcgagaagagatggctctttagcgtggttgagaccagacaccaagactcaagtcaccgtcgaatacaaggatgaccacggtagatgggttccacaaagaatcgacaccgtcgtcgtctccgctcaacatgctgacgaaatcacgaccgaggacttaagagcgcaactaaagtccgagatcattgaaaaagtcatcccaagagacatgttggacgaaaacaccaaatactttatccaaccttccggtagattcgtcatcggtggtcctcaaggtgacgctggtttgaccggtagaaagatcatcgtcgacgcttacggtggtgcctcatccgtcggtggtggtgccttctccggtaaggactactctaaggttgatcgttctgccgcttatgccgctagatgggttgccaagtccctagttgccgctggtttatgtaagagagttcaagttcaattttcttatgccatcggtattgcggaaccattgtccttgcacgttgacacctatggtactgcgaccaagtctgacgaagaaattatcgacattatcagcaagaactttgacttgagacctggtgtattggtcaaggagttggacttagctagaccaatctacttgccaaccgcttcttatggccatttcacaaaccaagaatacccatgggaaaagcctaagactttgaagttctaa

SEQ ID NO: 2684 - DNA, 1149 bp, Saccharomyces cerevisiae
atgggtattaaaggtttgaatgcaattatatcggaacatgttccctctgctatcaggaaaagcgatatcaagagcttttttggcagaaaggttgccatcgatgcctctatgtctctatatcagtttttaattgctgtaagacagcaagacggtgggcagttgaccaatgaagccggtgaaacaacgtcacacttgatgggtatgttttataggacactgagaatgattgataacggtatcaagccttgttatgtcttcgacggcaaacctccagatttgaaatctcatgagttgacaaagcggtcttcaagaagggtggaaacagaaaaaaaactggcagaggcaacaacagaattggaaaagatgaagcaagaaagaagattggtgaaggtctcaaaagagcataatgaagaagcccaaaaattactaggactaatgggaatcccatatataatagcgccaacggaagctgaggctcaatgtgctgagttggcaaagaagggaaaggtgtatgccgcagcaagtgaagatatggacacactctgttatagaacacccttcttgttgagacatttgactttttcagaggccaagaaggaaccgattcacgaaatagatactgaattagttttgagaggactcgacttgacaatagagcagtttgttgatctttgcataatgcttggttgtgactactgtgaaagcatcagaggtgttggtccagtgacagccttaaaattgataaaaacgcatggatccatcgaaaaaatcgtggagtttattgaatctggggagtcaaacaacactaaatggaaaatcccagaagactggccttacaaacaagcaagaatgctgtttcttgaccctgaagttatagatggtaacgaaataaacttgaaatggtcgccaccaaaggagaaggaacttatcgagtatttatgtgatgataagaaattcagtgaagaaagagttaaatctggtatatcaagattgaaaaaaggcttgaaatctggcattcagggtaggttagatgggttcttccaagtggtgcctaagacaaaggaacagctggctgctgcggcgaaaagagcacaagaaaataaaaaattgaacaaaaataagaataaagtcacaaagggaagaagatga

SEQ ID NO: 2685 - DNA, 1149 bp, Saccharomyces cerevisiae
atgtcttccgttactgggttttacattccaccaatctctttctttggtgaaggtgctttagaagaaaccgctgattacatcaaaaacaaggattacaaaaaggctttgatcgttactgatcctggtattgcagctattggtctctccggtagagtccaaaagatgttggaagaacgtgacttaaacgttgctatctatgacaaaactcaaccaaacccaaatattgccaatgtcacagctggtttgaaggttttgaaggaacaaaactctgaaattgttgtttccattggtggtggttctgctcacgacaatgctaaggccattgctttattggctactaacggtggggaaatcggagactatgaaggtgtcaatcaatctaagaaggctgctttaccactatttgccatcaacactactgctggtactgcttccgaaatgaccagattcactattatctctaatgaagaaaagaaaatcaagatggctatcattgacaacaacgtcactccagctgttgctgtcaacgatccatctaccatgtttggtttgccacctgctttgactgctgctactggtctagatgctttgactcactgtatcgaagcttatgtttccaccgcctctaacccaatcaccgatgcctgtgctttgaagggtattgatttgatcaatgaaagcttagtcgctgcatacaaagacggtaaagacaagaaggccagaactgacatgtgttacgctgaatacttggcaggtatggctttcaacaatgcttctctaggttatgttcatgcccttgctcatcaacttggtggtttctaccacttgcctcatggtgtttgtaacgctgtcttgttgcctcatgttcaagaggccaacatgcaatgtccaaaggccaagaagagattaggtgaaattgctttgcatttcggtgcttctcaagaagatccagaagaaaccatcaaggctttgcacgttttaaacagaaccatgaacattccaagaaacttgaaagaattaggtgttaaaaccgaagattttgaaattttggctgaacacgccatgcatgatgcctgccatttgactaacccagttcaattcaccaaagaacaagtggttgccattatcaagaaagcctatgaatattaa

SEQ ID NO: 2686 - DNA, 1152 bp, Saccharomyces cerevisiae
atgaaagagaatgaacttaaaaatgagaagagtgtagatgtattatccttcaaacagctcgaatcccaaaagattgttctacctcaagatcttttcagaagcagctttacctggttttgttatgaaatttacaagtccttagcgtttccgatctggatgctattatggctaccacttagcgtctggtggaaactttccaacaattgtatttacccacttatagtttcacttctggtcctgtttctgggaccaatatttgtccttgttatttgtggactttctcgtaagcgttccttatcgaaacaactcattcagttttgcaaagaggttactgaaaacacaccaagttctgatcctcatgattgggaagttgttgcagcaaatctaaattcgtacttatatgaaaataaggcttggaatactaggtactttttcttcaatgccatgggctgccaagaagcgttcagaacaacccttctcgaacccttctctttgaaaaaagacgaagctgccaaggttaagtcatttaaggattccgtcccttacattgaagaagcattgggagtttattttagagaagttgaaaaacaatggaagttgtttaatactgaaaaatcatggagccctgttggcctggaagacgttcagcttcccaaggatattcatcggtccaagcttacttggtttttaaagcggattttcactatttactctctaccattatggcttgcttttttgaactgtatctgcgtgtcacagcatttttgccttgcatttcgtatattgtgtcctggattgtttttcctcatgatggtgtggcttttccaaaatatgaggacgactgctttactcgtgaaaatggaacacaagatgcaattcttgttgactattataaatgagcaagaaagtggtgcgaatggatgggacgaaattgcaaggaaaatgaataggtacttgtttgagaaaaaagcctggaagaatgaagagtttttcttcgaggggattgactgtgaatggttttttagccacttcttctaccgccttctatctgcaaagaaatctatgtggcttttaccattgaatgtggaactatggccatatattaaagaagcgcaattgtcccgcaatgaagagtctttaatgaagaaatga

SEQ ID NO: 2687 - DNA, 1152 bp, Saccharomyces cerevisiae
atgaaagagaatgaagtcaaagatgagaaaagcgtagatgtgttatccttcaaacagctcgaatcccaaaagattgttctacctcaagatcttttcagaagcagctttacctggttttgttatgaaatttacaagtccttagcgtttcgcatctggatgctattatggctaccacttagcgtctggtggaaactttccaacaattgtatttacccacttatagtttcacttctggtcctgtttctgggaccaatatttgtccttgttatttgtggactttctcgtaagcgttccttatcgaaacaactcattcagttttgcaaagagattactgaaaacacaccaagttctgatcctcatgattgggaagtcgttgtagcaaatctaaattcgtacttatatgaaaataaggcttggaatactaagaatttctttttcaatgctacggattgtgagaaaatgttcagaacaactgttcttgaaccattttctttgaaaaaagataaagctgccaaggttaagtcatttaaggattctgtcccttatatcgaagaggctttgcaagtgtatgctacaggatttgacaaacagtggaagttgtttattactgaaaaatcatggagccctgttggcctggaagacgttcagcttcccaaggatattcatcggtccaagcttacttggtttttaaagcggattttcactatttactctctaccattatggcttgcttttttgaactgtatctgcgtgtcacagcatttttgccttgcatttcgtatcttgtgtcctggattgtttttcctcatgatggtgtggcttttccaaaatatgaggacgactgctttactcgtgaaaatggaacacaagatgcaattcttgttgactattataaatgagcaagaaagtggtgcgaatggatgggacgaaattgcaaggaaaatgaataggtacttgtttgagaaaaaagcctggaagaatgaagagtttttcttcgacgggattgactgtgaatggttttttagccacttcttctaccgccttctatctgcaaagaaatctatgtggcttttaccattgaatgtggaactatggccatatattaaagaagcgcaattgtcccgcaatgaagagtctttaatgaagaaatga

SEQ ID NO: 2688 - DNA, 1152 bp, Saccharomyces cerevisiae
atgactagtgcaagtattaccaatactggaaacgaaaccatgaaccttccacagatgcggtcgatttggctggatgaagatgaagaagctgaaaaactctacggtctgcaggcccagcaattcatgggatctgatgatgaagaaaacctaggcattactttcatcaacagcgataaacctgtgctgagtaacaagaaaaacattgagttgcctccactttcaccaaattcacatccgtcttgccaccacaggagaagtaattctaactctgcaaagtctaaagaatcatcgtcatcatcgtccagcgccaacaagacaaatcacaaaaaggttttccttaagcttaatttgttgaagaaaaagttgcttggtgcccaaccggacataagaggtaaaggtatctccacaccatttgattttcaacatatttcacatgctgacactagaaatggattccaagatgagcaattgcaggaaccttcatcgctgtccacagagattaaggacgactatacctcctcctcaagcaagcgggattcgaaatcactaaataaagcttttgtcactgaaaggatccctgctaatcgtgaaagcaaactcatttcaagatcgcacgaaaataagacatcaagactatcagtcgcgcgttcgatctcagtaacgtcctccaattactctaaaaacacacaaggaaacaatcattccattaatgggagagtcgtatctacgtcaactatggctacatctatttttgagtattccccaaacgcatctccaaaacaatttaaaaataagtcacacgctctgggtcatagatacactaattccacggattctagtgagtcttcgctggattttttgaagaactacaacttccccacactacttgaagataagcctattttagacttcttgcctcgttctcagaggtcaagcgcttatcgtagccttttagagaccccaaactcaaataaggactcagcaaaagccttctttccttcacgccaaagccctcttcccaagagaagaaactctatagctacgccttctccacaatctaaattttcctactctgactcccctgtaaaccatagaaaatctttcgatgatgttctttattctttcaaccagctcgagcccctgcaaacttaa

SEQ ID NO: 2689 - DNA, 1152 bp, Saccharomyces cerevisiae
atgagtgaaacagaattgagaaaaagacaggcccaattcactagggagttacatggtgatgatattggtaaaaagacaggtttgagtgcattgatgtcgaagaacaactctgcccaaaaggaagccgttcagaagtacttgagaaattgggatggtagaaccgataaagatgccgaagaacgtcgtcttgaggattataatgaagccacacattcctactataacgtcgttacagatttctatgaatatggttggggttcctctttccatttcagcagattttataaaggtgagagtttcgctgcctcgatagcaagacatgaacattatttagcttacaaggctggtattcaaagaggcgatttagttctcgacgttggttgtggtgttgggggcccagcaagagagattgcaagatttaccggttgtaacgtcatcggtctaaacaataacgattaccaaattgccaaggcaaaatattacgctaaaaaatacaatttgagtgaccaaatggactttgtaaagggtgatttcatgaaaatggatttcgaagaaaacactttcgacaaagtttatgcaattgaggccacatgtcacgctccaaaattagaaggtgtatacagcgaaatctacaaggttttgaaaccgggtggtacctttgctgtttacgaatgggtaatgactgataaatatgacgaaaacaatcctgaacatagaaagatcgcttatgaaattgaactaggtgatggtatcccaaagatgttccatgtcgacgtggctaggaaagcattgaagaactgtggtttcgaagtcctcgttagcgaagacctggcggacaatgatgatgaaatcccttggtattacccattaactggtgagtggaagtacgttcaaaacttagctaatttggccacatttttcagaacttcttacttgggtagacaatttactacagcaatggttactgtaatggaaaaattaggtctagccccagaaggttccaaggaagttactgctgctctagaaaatgctgcggttggtttagttgccggtggtaagtccaagttattcactccaatgatgcttttcgtcgctaggaagccagaaaacgccgaaaccccctcccaaacttcccaagaagcaactcaataa

SEQ ID NO: 2690 - DNA, 1152 bp, Saccharomyces cerevisiae
atgattgtttcatttggtgatgcaacaacaagaacttccgaagttcaattggttaggtgtactcaaggtctaaacctttggaagctgcatcaagttcatgccgtttacaaaagagttgtccatgataccttaggtgccgatgaaggtaatgctttactcgatcaaattttggctgacacgaatctatatccaccttggatgtgtgttcttttatatgcattttgttccgctatggtcactccgtatgcctttggtggcgattgggtaaacctggcaatctcattttttatggggctttgtgtggggtcattacaatttattctttcacaaaagtcatacatgtattcaaacgtcttcgaaatttctgcatctattgtcgttagcttctgcggtagagcttttggctctatccctcgttctcacatctgctttggtgcagttacacaaggctcattggcattaatcctgccaggttatattattctgtgtggtgcactagaactgcaaagtcgaagcctagttgctggcgcggtccgtatgttctacgccattatttattctttgtttttgggttttggcataacattgggctcagctttgtttggatggatgtatcacaatgccactaacgaaatttcatgtcctcaattaatttctccgtggttcaggttcctcttcgttccagcgtttaccattagtatctcgttattaaatcaagcacacatctcacaactgccagttatggtcttcatttcttgcaccggttatgtcgtaacatattgggccggtaagcattttgcgaattcgacagagtttactgccgccttagctgcatttgtcataggtgttttaggtaatctatattccagaatttggaaaggtttagcggtatcagctatgcttcccgcaatcttcgttcaagtgccatctggtattgcttcacaaaattcgttgttgtctgggttgcaaagtgcaaatacaattgttaatgctaatgaaaccattacgacaagcacctccgatccatcgtcctcaatgtcatttggtatgacaatgattcaagtttgtgtcggtatttctgtgggactatttgcttcttcactctttgtctacccctttggtaaaaagaaaactggtcttttcagtttataa

SEQ ID NO: 2691 - DNA, 1152 bp, Saccharomyces cerevisiae
atgcaaaaccctccgttgattcgtcccgatatgtataatcagggaagcagctcaatggctacttataatgcctctgagaagaatctaaatgagcatccttctccgcaaattgcacagcccagcacgtcccaaaagttaccttatagaataaatcctacaaccactaatggggacaccgacatatctgttaacagcaatcctatccagcctcctttgccaaacttgatgcatctatctggtccgtctgactatagatcgatgcatcaaagtcctatacatccatcttatatcatccctccgcattcaaatgaaagaaaacaatcagcttcttacaacagacctcaaaatgctcatgttagtattcaaccttccgtggtattcccccctaaaagttattccatatcttatgcaccttatcaaataaatccccctttaccaaatggacttccgaaccagagcatatctttgaataaggagtatattgcagaggagcaactatcaaccctcccatctcgcaataccagtgttactactgcacctccttcttttcaaaacagtgctgataccgctaaaaattcagctgataataatgataataatgataatgtaaccaaacctgttcctgataaagacacccaactcataagtagttcaggcaaaactttaagaaatactagaagagctgctcaaaatagaaccgctcaaaaggcatttagacaaaggaaagaaaaatacatcaagaatctcgaacaaaaatcaaagatatttgacgatttactagcagaaaataataacttcaaatcattaaacgattcattaagaaatgacaacaacattttaatagctcagcatgaagctataaggaatgcaattactatgttaagaagtgagtatgatgtcttatgtaacgaaaacaacatgttgaagaatgagaatagtataataaaaaatgaacacaacatgtcaagaaatgaaaatgaaaacctaaaacttgagaataaacgcttccacgctgaatatatacgaatgatcgaggatattgaaaatactaaaagaaaggaacaagaacaacgagatgaaatagagcaactaaaaaaaaaaataagatccctggaggaaatagtagggagacactcggatagtgccacgtaa

SEQ ID NO: 2692 - DNA, 1152 bp, Saccharomyces cerevisiae
atggcaggattgaagacatttgatgcgtttcgtatgttatatggatttttctgaagtagcccgcttcagcatattttatttttgcttttgctttttcactaacaatggaaatttaactttacagcaaaaactgaagaacagtacaagaagaaatccaccaagggtggcttaacatctttgttgacatatctgtttctgttgtttatagcatggaccgagtttggtgaatacttcggtggttatattgaccagcagtacgtagtggacagtcaagttagagataccgttcaaattaatatggatatatacgtcaacacgaaatgtgattggttgcaaatcaacgtcagagaccaaacaatggatcggaaacttgtattagaggaattgcaattggaagagatgccattctttattccttatgacacaaaagtcaatgatatcaatgaaattattacgccggaattggatgaaatcttaggggaagctatcccagcagaatttagagaaaaactagatactaggtcattttttgatgaaagtgatcctaacaaggcacatcttccggaattcaatgggtgccatgtatttgggtccattccggtaaatagagttagtggcgaattgcagattacagcgaagagtttaggttacgtggcttcacgcaaagcaccactggaagaattaaaatttaatcatgttattaatgagttctcttttggtgatttctatccatatattgataacccattggataacactgcacagtttaatcaggatgaacctttaactacttacgtctattacacatctgttgtgcccactcttttcaagaaattgggggcagaagtggatactaatcaatattctgttaacgattaccgctatttgtacaaagatgtcgctgctaaaggtgataaaatgccgggcatcttcttcaaatacaatttcgaaccattatccatagtagtttctgatgttcgtttaagctttatacagtttttggtcagattagtggcaatctgctcatttttggtctactgtgcttcgtggattttcacactactggatatggctcttatcaccatcatgggacctaagtggtccttgcgttatcagccagatgataaaactaagggtattttagataggtag

SEQ ID NO: 2693 - DNA, 1152 bp, Saccharomyces cerevisiae
atggctgcaagtgagataatgaacaatctgcctatgcattccctcgattcttctctaagggatttacttaacgatgacttattcattgaaagtgatgaatcgaccaagtcggtaaatgatcagaggagtgaagtatttcaagaatgtgtgaaccttttcataaaaagagatatcaaggattgcctagaaaaaatgtctgaggttggatttattgatattaccgttttcaagtccaaccctatgatattagatttatttgtcagcgcctgtgatattatgcccagctttaccaaattaggtttaacactgcagagtgagattttgaatattttcacgttagatacccctcaatgtattgagacaagaaaaattattctcggtgacctcagtaaacttttggtcatcaataaattctttcgatgctgtatcaaggttattcagtttaacttaactgatcacaccgaacaagaagaaaaaactctggagcttgaatccataatgagtgatttcattttcgtatacataacgaaaatgaggacaactatagatgtagttggcttacaagaattaatcgagatattcatctttcaggtgaaggtaaaactgcatcataaaaaaccctcaccgaatatgtattgggcgctttgcaaaacattacctaagttatctccaaccctaaagggcctttacttatctaaagatgtttccatagaggatgctattctgaactcaatagataataaaatacaaaaagataaggcgaagtctaaaggtaaacaaagaggagtgaaacagaaaatacaccattttcacgagcctatgttacacaatagtagtgaagaacaggttaaggttgaggatgcgtttaatcaacgcacctctactgatagtagactccagagtactggaacggcgccccgtaaaaaaaacaatgatattactgttctggctggttcattttgggctgtcctgaagcatcatttcacaagaagtgtgctgaacaaaaacggacttctgctcacaggtctgctgctactcttatgtttgaaaaaatataagtcattgatggcaattttcaaacatgttccagcggcctttcacactgtatacccccagattgtagggttgctaaaacttctagcgagtatatga

SEQ ID NO: 2694 - DNA, 1152 bp, Saccharomyces cerevisiae
atggtcgtgacatttttgcaggacctggaagttttgcaagatgcattattaaataatttgcaaaaattaagtgcaatctcccgcagaaaagaaagcggagaaagcaagcatgataataaggacagttttgcagccattgccaacgaacacaatgatgaagaagaagagattgaatttgaggatttggtgaatattatagagagcaaagtttcagatttcgaatcggtactgaaatgtagtattgtggaaatgacctacaaataccccgaattaaaattacagtgggaaaaaagccctagatacgatcaatgcgataagttgcatattgtgaagcttgataaacaaatgaacgaggacatatatgctcagttggtcgaagaactggatttcgtgttgcaattcgtcgattggttctattgctaccgcctgaaagtcaaagagattctacgacaacaccacaaacgtgacttagcttggaacgacgagaaaagagaccgcgctataaaatttcacgctgtggattacgacaagcttcaccaaggaacgtcgtcatcgtcaagcttaacgtccacatcgatggaaaaagccagcactagagagaagcttttgagcaaaacaaaacaactgacgaataacttggtgagaggaaatcaaattttgcagtccggaattttacaaagtgacctgaatttggatgaattgagagcccaaaccaattccttaacacaaatcgatgacaagtacactcaattcgaaaccgtcttcaagaaaactgccgatttggtcaaagtactggaaaatgcctcccatcaagagaaacgagatgtctatttatcacttgggttcctcctatgctgcgtctcgtgggttctatggcgtcgtattttcaagttacctgttaaactcggcctctggctgctattcaagtttttcaagggtatactcgtcaccctaggtctagttaaaagctatgcaggctcctcgtcctctcttcaagcacccagtcttgtgctaaatgcacccattctagccactacaactacatcctcagcaacctctgtggaaccattcgcatctgtatcagccgtcagtagtatccagcgggctgtcgatgaggccgtggacaggatcgtctcacatgatgagctatga

SEQ ID NO: 2695 - DNA, 1152 bp, Saccharomyces cerevisiae
atgtcaacaaattgtttttccggttacaaagacctcatcaaggaaggcgatttaactctaatatgggtttctagagataacatcaaaccggtaaggatgcattccgaagaggtattcaatactcgttatggttcatttcctcataaggatatcataggtaaaccttatggttctcaaattgctataagaacaaagggctcaaataagtttgcattcgtccatgttctgcaaccaactcctgaattgtggactttgtcgttaccacacagaactcaaattgtatatacgcccgactcttcctacatcatgcaaaggttgaattgtagccctcacagcagagtgatcgaggcaggtacaggctcaggatcattttcgcacgcttttgcaagatctgtaggtcatctttttagttttgaatttcatcacataagatacgaacaagcattagaggaattcaaagagcatggacttattgatgataacgttacgattacacatcgggatgtttgccaaggtggatttcttataaagaagggagacactacatcttacgaatttggcaataatgaaaccgccgcttcattgaatgcaaatgtagtgtttttagatctgccggctccctgggatgctatacctcatctggattctgttatttccgtagacgaaaaggtcggattgtgttgcttctccccatgcattgagcaagtagacaaaacattggatgtattagagaaatatggctggacggatgttgaaatggtggaaattcaaggtagacagtacgaaagtcgaagacaaatggtcagatcactcaatgatgccctggaaaggttgagagatattaagaggcacaaactccagggtgtagaaagacgcaagcggatgtttaacaatacaatagattctaacgatgaaaaagttggaaaaagaaacgaggatggcgtaccattaacagaaaaggccaaatttaatccttttggcaaaggttctcgaatcaaggaaggtgatagtaattataaatggaaggaggtcacaaagatggaagctgagatcaaatcccatacctcatatttgacttttgcatttaaagttgtgaatagatcaagagatgatgaaaaagttaacgaaattcttcgatccacggaaaaataa

SEQ ID NO: 2696 - DNA, 1155 bp, Saccharomyces cerevisiae
atgaacaaaacgaattggaaggtatctgtaactacattcaattgtggtaaggaatttcccgttgaaaattcgaaagcaatcgttaagcaattgcttttcccctacgatgacggcatctcccaattggaattgcaagatctatatgtgttggggttccaagaagtagtccccatatggcaaggctccttccctgctgttaatcgtgatttaatcgatagaattacaactactgcggttaattgtctgaatgaaaaagtgtcagctacacaaggggatgagcagtattcatgtttaggggtgaatagtcttggggcgattaccataatagtattatacaataataatgcgctaaaggtaaaagatgatattttgaaacggaatgggaaatgcggttggtttggtacacacttgaaaggtggaactttgataagttttcagatgacacgcaatggcgaggagaactgggaaagatttagctatatttgtgctcatttaaatgcaaatgaaggtgtcaacaatagaaatcaaagaatagatgattacaaacgaataatgagtgaagtgtgtgattctgaggttgcaaaaagcgaccactttttctttctaggcgatttgaattttagggttactagtacttatgatccaactaccaattattcgtccaccacaacgttaaggcgtctattagaaaatcatgaagaactaaatctgctacgtaaaggagaggatgaaccgttatgcaaaggttttcaggagctgaagataacatttccaccgacatacaaattcaagttgtttgaaaaggaaacatataatacaaaaagaatcccgtcgtggtgcgataggattctctacaaaagctatgcagtgccaactttcgcacaagaaggtacttaccattccgtccctaggtccaatgctctattatttagcgatcatcaacccgttaatcttaccgtaagattaccaaggtctacagggacgccagtgccgttatccttacatatcgaaaagtatcctttatcatggagctctggcctgattggacaaattggtgacgcagtcatcgggtactgcggttggctagttactaagaatgtacattattggatattaggttctttactattatatttactattaaaaatcctgtaa

SEQ ID NO: 2697 - DNA, 1155 bp, Saccharomyces cerevisiae
atggaccagctaagtgacagctatgctttgtacaatcaaccggtagtgatcgacaatggttctgggatcataaaagcaggatttagtggtgaggaaaggcctaaagcactggaatattgtctcgtaggaaataccaaatatgataaagttatgctcgaaggtctgcaaggagatacatttattggaaacaatgcccaaaaactgcgtggattattaaaattacgataccccataaagcacggcgtggtggaagattgggattctatggaactaatatggtcatatgtgttaaatgaagtcctacagttgcaaaatataggtgagcatcctttattaattacggaagccccgatgaatcctttgaagaatagagagcagatggctcaagtattgttcgagacctttgacgtatcggctttgtacgtttcaaaccctgctgttctgtcattatatgctagtgggagaactacaggttgtgtagttgactgtggtgaaggatactgtagcactgttcccatatatgacggctttgcattacctgcgtctatgatgaggatggatattggaggagcagatatcacagagcagttacaatttcaactacggaaatcagctggtgtttcgttgttttccagcagtgaacgagagattgttcgcacgatgaaagagaaagtttgttatttggccaagaatattaaaaaggaagaggagaaatacttacaaggtactcaagatttaatctcgacattcaaattgcccgacgggaggtgtatagaggtggggaatgatcgatatcgtgctccagaaatattattttcacctcaaatcatcggcttagggtacgatggattatctgatatgtgcatgcaatctatttggaaagtcgatctggatttaaggaaacctttactgtcatcgataatcctaagtggcggaactacaacgcttaaaggctttggagaccgaatgctatgggatttggaggcattaaccaaaggaacatccaagataaagattatagccccttcagaaagaaaatatactacatggattggtggttctattttaacggggttatctacctttcaaagactttggaccaaaaagtcagattggctagaggacagtacccgtgtttattcgaacctaatgtaa

SEQ ID NO: 2698 - DNA, 1155 bp, Saccharomyces cerevisiae
atggttacatatgctggaaaactggttctagctccaatggtaagagccggcgaactgcccacgagactgatggcgctggcccacggtgcagatctcgtctggtccccagaaatcatcgacaaaaagctaattcagtgcgtcaggaaggaaaacactgcactccaaactgtcgactacgtcgtgccgtccaaggttcaaacgaggccggagacgctcgttttcagaacatatccaaaactagaatcctctaaattgattttccagatcgggtctgcatccccggctctggccacccaggctgctttgaaagtgatcaacgacgtcagcgggatagatatcaatgcaggctgccccaaacacttctctatacactccggcatgggctctgccctcttgcgcaccccagacacactgtgtctcatcttgaaagaactggttaagaacgtgggtaaccctcacagcaaacccatcagtgtgaaaataagactcttggacaccaagcaagacactctacagctcgtcaaacgtctgtgtgccacgggcatcacaaatcttacagttcactgcaggaagactgaaatgagaaacagagagcagcccatcacagattacattgcggagatctacgagatatgccaggcaaataacgtgtcgttgattgtgaacggcgctatccgcgaccgctctcattttcatgatttacaagcgaatcattggaaaaacactaacattggtggtatgattgcagagtgtgctgaacgggaccctacagtttttgatcacacttctaagccttcagaagacggtccatcttgggtcgttgcttgtcgcgagtttattcagtgggcaacgaagtttgacaaccacatcggcaatacaaaatacatgttaagcagaattgtccccggaaaatcagtcttttttcagtactttgcccgttgcaagagcccggaagaagttagtttcgtactaaagcaattgaacgatgatggaagcgctcaaacagatccttcagagtacttggaaaactgcagagctcaagaaaaagctttgaaaaacgccaacgccatcgccaagcaaaagaggaaacagaccgatcacataggcagtgacactaaaaagcaaaaggttgtaccccttcccacagatatataa

SEQ ID NO: 2699 - DNA, 1155 bp, Saccharomyces cerevisiae
atgtcattttccaattctaaagacaagtccgttgttgccgtctacaagctggtcaaagcgccaatctactctcattgcttttctcaagataaatctattttagccgttacatgcgaaacagattgtcttgtctatagagtttcaaacaacacacctcccgttttattcgcaacgttgaaagatcatgataaaaccattactgctgtggacatttccatacatggtcgtattgtgacttgctcccaagaccgtaatgcttacgtttgggagccattgagtgatgggacatacaagcccacgttagtacttcttcgtattaacagagcagctacttcagttacatgggcaccaaatggttataagtttgctgttgggtccagtgctagaatcatcgctgtttgttattacgaacacgagaataattggtgggtatccaagcacatcaagaaacccatcaaatctaccatcaattgcctgtcttggcatgcaaatggagtcctattagctgctggtggtactgatgggtttatgcgtgtgttcagcgggtttatcaagggtttggattccaaggaatccgtcgccggatcaccctggggccagaaattcccttttggttgtttaatcagggagtggtatcagggttcttatatccatgatgtggaatggagaagtcagatggaaagaattgcttatgtagcgcatgatggtactttgaatgttgtcgattaccaatctccagtgcaatctgtcaatgctccggaaggtttaccttacaggtccttagtatggataaacgaccacgagattgtttgtggaggatactcttgtcatccggtattgttcagcgaagcctctgaaggctggaaatttgcgaagaatctagacaaatcagacaataacaagtcttctgccttaactgcatctggtaatacagacgagctgagtggtaataatgatgaaagttcaactttcggtatttccgcattgagaaagtttaaagaattagacttgaaaggtaaagttagcacagatgtccaagaaagtgcacatgaaaacgccattgtggaattaagaccttttgcggaatccaacggccaaatcacacaagtctcttcctgtgggttagacggtaagatcgtcatttatacaatttaa

SEQ ID NO: 2700 - DNA, 1155 bp, Saccharomyces cerevisiae
atgtccaagagcaaaactttcttatttacctctgaatccgtcggtgaaggtcacccagacaagatttgtgaccaagtttctgatgctattttggacgcttgtttagaacaagatccattctccaaggttgcctgtgaaacagctgccaaaactggtatgattatggttttcggtgaaattaccaccaaagctagacttgactaccaacaaatagtaagagataccatcaagaagattggttatgacgattctgccaagggtttcgactacaagacatgtaatgttttagtagctatcgaacaacaatctccagatatcgctcaaggtctgcactatgaaaagagcttagaagacttaggtgctggtgaccaaggtataatgtttggttacgctacagacgaaactccagaagggttaccattgaccattcttttggctcacaaattgaacatggctatggcagatgctagaagagatggttctctcccatggttgagaccagacacaaagactcaagtcactgtcgaatacgaagacgacaatggtagatgggttccaaagaggatagataccgttgttatttctgctcaacatgctgatgaaatttccaccgctgacttgagaactcaacttcaaaaagatattgttgaaaaggtcataccaaaggatatgttagacgaaaataccaaatatttcatccaaccatccggtagattcgtcatcggtggtcctcaaggtgacgctggtttgaccggtagaaagattattgtcgacgcttacggtggtgcctcatccgtcggtggtggtgccttctccggtaaggactattccaaggtcgatcgttccgctgcttacgctgctagatgggttgccaagtctctagttgccgctggtttgtgtaagagagtccaagtccaattttcatatgctattggtattgctgaaccattgtctttacatgtggacacctatggtacagctacaaaatcagatgacgaaatcattgaaattattaagaagaacttcgacttgagaccaggtgtgttagtaaaggaattagatttggctagaccaatttacttaccaaccgcttcttatggtcacttcactaatcaagagtactcatgggaaaaaccaaagaaattggaattttaa

SEQ ID NO: 2701 - DNA, 1155 bp, Saccharomyces cerevisiae
atgtccactgctgtgactttttttggccagcatgtcttgaacagagtttcgttcttaagatgttcgaaagagttcatcaaaaaatcattgaaccatgactctaccgtttttatcccatttatcgaaggggaagccctcatttcgcccgaaaatggtgacctagttcagctttctaattctgtaaagtcttacaagaatattttgtcagcaatagttcctttatacactactttattgaacacaactcgctcaagaagcgatgaatcaggcatcaatgtaacatttttaggtctcctggaaggcacagattctgcatttaattttgaatggtctaatatttcttacaaaggaacaccatattttggattagatatccgtgttactgagagcacactcttcaagaaagtcgactttgagcctattttttcctatccgaaggtgaccagagatcacattttcaaacaaacaaatgaggatgcttcactttattcacaaggtaagatgtatctggattggctagcaaagtacaaattctgtcccggttgtgggtctccgttattcccagtagaggcaggaactaagcttcagtgttctaatgaaaatcggaatgtatactgtaatgtgagagatgcaagaattaataacgtttgcttcccaagaactgatccaacggtcattatagccttgaccaattcggattactctaagtgttgtctggcaagatcaaaaaaaaggtacggtgattttgtattgtattcaacaatagcaggttttatggagccatcagaaaccatagaggaggcttgtatcagagaaatatgggaggaaacaggcatttcatgcaaaaatattgatatagtccggtcacagccctggccttacccttgcagtttgatgattggctgtttaggcatagttcaattcaattccaaaaatgaggttatcaacctgaatcatgacgacgaattattggatgctcaatggtttgatacaactgaaatcattcaagctttggataagtacgccggcgggtatcgtgttccattcaaaaatgatatcaatttacctggaagtactaccattgccttccaattaatcaatcatgtttgcgagaactataaaaacttacgtaagacctcatcgagccatctatag

SEQ ID NO: 2702 - DNA, 1155 bp, Saccharomyces cerevisiae
atgtcgactaatacttccaagactttggaactgttttcaaaaaagacggtacaagaacacaatactgccaatgactgctgggtcacttatcaaaacagaaagatttatgacgtgaccaggtttttgagcgaacaccctggtggtgacgagtccatcttggactatgctggtaaggacattactgagatcatgaaagactcagatgtgcatgaacacagcgactccgcgtatgaaatccttgaggacgaatatttgattggttacttggcaactgacgaagaggcagcgagattgttgactaacaagaaccataaggttgaagtgcagttgtcagctgacggtactgagtttgactccactacttttgtaaaggagttgcccgccgaggagaaactaagtattgctacggactacagtaacgactacaaaaagcataaatttttggatctgaaccgtcctttgctgatgcagattctgcgtagtgatttcaagaaagatttttacgttgaccaaatccatagaccaagacattacggtaaggggtctgccccgctatttggtaatttcttggaaccattaactaaaacagcttggtgggttgttccagttgcttggttgcctgtagttgtgtaccacatgggtgttgctttgaagaacatgaaccagctatttgcatgtttcttgttctgtgtcggtgtctttgtttggactttgattgaatacggtcttcaccgtttcctatttcatttcgatgattggttacctgaaagtaacatcgcattcgccacacattttctactacatggttgccatcattacttgcccatggacaagtaccgtttagttatgccacctactctgttcgtcatcctttgtgctccattttacaagttggtatttgctctgctgccactttattgggcttacgctggttttgctggcggtcttttcggttatgtctgttatgacgaatgtcatttcttcttgcaccactctaaattgcctcccttcatgcgtaagttgaaaaaatatcacctggaacatcattataaaaactaccaactgggatttggcgtcacatcctggttttgggacgaagtttttggcacctacttaggccccgatgccccattgtccaaaatgaaatatgaataa

SEQ ID NO: 2703 - DNA, 1158 bp, Saccharomyces cerevisiae
atgaaactaagggcagaagacgtgttggcaaacggaactagcagacataaagttcaaattgatatggaaagacaggttcaaattgcaaaagatttactcgcacagaaaaagttcttagaagctgctaaacgctgccaacaaactttggactctctcccaaaagatggtttgttgcctgatcctgaactgtttactatattcgcacaagctgtatacaacatggaagtacagaattctggtaatctgtttggggacgctcttctggcaggtgacgatggatctgggtctgagtctgagtctgagcctgagtctgatgtgagcaatggagaagaggggaacgagaacggtcaaacagaaattcctaattctaggatgttccaattcgaccaagaagaggaagacttgactggtgatgtcgacagtggtgatagtgaggacagtggcgaaggtagcgaagaagaggaagaaaacgtggagaaagaggaagaacgcttagctttgcacgaattggctaacttcagtccagcgaatgaacatgacgatgaaattgaagacgtatcgcaacttcgcaagtctggtttccacatttactttgaaaatgatctgtatgagaatgctttggacctactggcgcaggccttgatgctgttgggccgccctacagcagatggccaatctctaaccgagaacagcagattgcgcatcggtgatgtgtatatcctgatgggtgacatcgaaagggaggcggagatgttcagtagagccattcatcattacttgaaggcgcttggctattacaagaccttgaaacccgcagaacaagtaactgagaaggtgatacaagcagaatttttggtgtgtgatgctttaaggtgggttgatcaggtgccggctaaggacaaactaaaaagattcaagcatgccaaggctctgcttgaaaaacacatgactacaagacccaaggacagcgagttacagcaggcaaggctcgcacagattcaagacgatattgatgaggtgcaagaaaatcagcagcacggctccaagaggcctctttcgcagcccacgacctccatcggcttccccgccctcgaaaagccccttggtgacttcaatgatctctctcaactggtcaagaagaagcctagaaggcattga

SEQ ID NO: 2704 - DNA, 1158 bp, Saccharomyces cerevisiae
atgaatcaggaagacaacacgggcggagggggcatttttggtcttttcaaatggactaaggatgcgctgtttggtacggacatatcaccttcaatgaaatataaagatcaggaagaacgaagagaccgatctaggtatgcccaagacgacacaaatttttctatgaagtttggaaatgactccaacaggaggagtacaaacttatcgaggtcaaattcgtggtctggtctggattcaacgctccataggaagtacgagttactcccagagtacaacgagaacggctttaactcaattgttaacggtgaccaccacagcaaagagagaatacgatctttacgaagtcctgctccgatagtaccgagagaaccacttcgtaacgaacctacggatacatttggtcacagactacacacaaaaaggagaactataaatgagctttccaattcgcagataccctttataccacctcaggaagacgaccctttgctctcgaaattatttaacaaggatggagttaatgaggttagaagatcgccctataagttatcggttaaagatataccaggcaaatttccatctcccttaacaaaacgtgatgaaatagacaattactatgtccgggacgaagatgcttgccacaagaatagagagtataaaaaggcatattttgatctttttgcacaaatggacttgaacagtagagacctggaagatttgtgtgaggatgttagagagcagcgtgagcaattccacaggaatgagcaaacttataagcaagcatacgaggaaatgagagcagaactggtcaacgagttgaagaaatctaagacactctttgaaaattattattcattaggtcagaagtacaagagtttgaaaaaggtccttgatcaaacgatcagtcatgaggctgaactggccacttctagggaacggctgtatcaggaggaggatttgaaaaactttgaaatacaaacattgaagcaaagactatccgatttagagctgaaatataccaatttgcaaatagaaaaggacatgcagcgggacaattatgaatccgaaatacatgatttattattacagcttagccttcgtaataacgagagaaaagatacttctgctggttcgaatattttttcaacaggacaatag

SEQ ID NO: 2705 - DNA, 1158 bp, Saccharomyces cerevisiae
atgactaaatctgtagatacgctgctgatcccaggccccattatcctaagcggagcagtccagaaggccctggacgttccctctttgggccacacctctcctgagttcgtctctatttttcaaagggtgctaaagaacacaagagctgtcttcaaatccgctgctgcctcgaagtctcagccttttgtgcttgccggctctggtacgttggggtgggacatatttgcctcgaactttattctttcgaaggcccccaacaagaacgtgctggtcgtatccactgggacattttctgacaggtttgctgactgtctgcgtagctacggtgcgcaagtagatgttgttaggcccctcaagataggcgaatcagttcccttagaactgattactgaaaagttgtcgcaaaatagctatggggctgtcacggttacgcacgttgacacttcaacggcagtgctgtccgatctgaaagccatttcgcaagcgattaagcagacttcgccggaaacgttcttcgtagtcgatgctgtatgctcgattggatgcgaagagtttgaatttgatgaatggggggtggatttcgccttgactgcttcgcaaaaggctattggcgctccagcgggtctttctatctcgctatgcagtagcagattcatggattatgcactcaacgacagcaaaaatggtcatgtacatgggtatttttcctcgttgagaagatggacaccaataatggaaaattatgaggctggtaaaggagcttattttgcaaccccacccgtacaactaattaatagccttgatgtagccttgaaagaaattctcgaagaggggttgcataagagatgggatttgcaccgtgaaatgagtgattggtttaaagacagtttggttaatggcttgcaattgacatccgtcagtaggtatccttctaacatgtctgcgcacgggttgacagccgtatacgtagcagatcctcctgatgtcattgcttttttaaagtcacacggtgtagtcattgccggaggtattcacaaggacatcggacccaagtatatccgtattggacatatgggtgtgaccgcttgcaacaagaatttaccgtacatgaagaactgcttcgacttaataaaactagctcttcagaggaaaaagtga

SEQ ID NO: 2706 - DNA, 1158 bp, Saccharomyces cerevisiae
atgagctccgttaacgcaaatggaggatataccaaaccacaaaaatatgtgccagggccaggtgatcctgaacttccaccccaactatccgaatttaaagataaaacatcggatgaaatcttgaaagaaatgaacagaatgccttttttcatgaccaagttggatgaaacagacggtgcaggtggtgaaaacgtggagttagaagctttaaaggcattagcttatgaaggcgaaccacacgaaatcgctgaaaatttcaagaagcaaggtaacgaactatacaaagcaaaaagattcaaggatgcaagggaactttactcaaagggcttggctgtagaatgcgaagataaatcaataaatgagtcactatatgccaatagagcggcatgtgagttagagctgaaaaattacaggaggtgtatcgaggactgcagtaaagctctaactattaaccccaagaatgttaagtgctactatcgtacaagcaaggcttttttccaattaaacaagttggaggaggccaaatcagccgcaacatttgccaatcaaaggattgacccagagaacaaatcaattttgaatatgttatcagtgattgatagaaaagaacaagaattgaaagcaaaagaagaaaaacagcaaagagaagctcaggaacgtgaaaacaagaaaattatgttagagagcgcaatgacgctgagaaacataactaacatcaaaactcactctccagtagagttacttaatgagggtaaaataaggctagaagacccaatggattttgaatctcaattgatctatcccgcattaattatgtaccccacgcaagatgaatttgattttgtaggtgaagtaagtgagttaactactgtgcaagaacttgttgacctagttttggaagggccgcaagaacgcttcaaaaaagaaggtaaggaaaacttcacaccaaagaaagtgttggtgttcatggaaacaaaggcaggtggtttgattaaagctggtaagaaactgacatttcacgatatcttgaagaaagagtcgccagatgtaccattgttcgataacgctttgaaaatatatattgtgccaaaggtagaaagtgaagggtggatttccaagtgggataagcaaaaagccttagaaagaagatctgtgtga

SEQ ID NO: 2707 - DNA, 1158 bp, Saccharomyces cerevisiae
atgagtctcagcacaatcatatgtattggtatggccggatccggtaaaacaactttcatgcaaaggttaaactcccacttgcgggcagagaaaacgccaccatacgtaatcaatcttgatcctgcagtattgagagtcccctatggtgcaaacatcgatatcagagactcaatcaaatacaagaaagtgatggagaattaccagctaggtccgaacggtgccattgtcaccagtttgaatttgttcagcaccaagattgatcaagttattaggttggtggaacagaagaaggacaagttccaaaactgcatcatcgacactccaggccaaatcgaatgttttgtgtggagtgcgtcgggtgccattatcacggaatcttttgcctccagctttcccacagtgattgcatatatcgtggatacgcctagaaactcatccccaactacattcatgagtaacatgctgtacgcctgctccattctgtataagaccaaacttcccatgattgtcgttttcaacaagaccgacgtgtgcaaggcagattttgctaaggaatggatgacggattttgagagtttccaagcagcaatcaaggaagatcaagacttgaatggtgacaatgggctgggctccgggtacatgagctcattggtcaattctatgtcactgatgcttgaagaattctattcccagctagacgtcgtgggcgtttccagttttaccggagacggattcgacgaatttatgcaatgcgtagacaagaaagttgatgaatacgaccaatactataagcaagaacgtgaaaaagcattgaacctaaaaaagaaaaaggaagagatgagaaagcaaaaatcattgaatggcctgatgaaggatctagggttaaacgagaagagcagcgctgcagccagcgacaacgacagcatagatgccattagcgacctcgaagaggatgccaatgatggtcttgtggatagggatgaggacgaaggcgttgagagagaatacacgttcccaggcgaagaaagaacaaaaggtgaggtcaacgagaactctgctccagacctacaaaggagatatcaggaagctatgcaacaagtagggaaaacggccagtagcgagactgcagaaaatatcgcgaagtatattagaaactaa

SEQ ID NO: 2708 - DNA, 1158 bp, Saccharomyces cerevisiae
atggatacagggagtgcgagcataaaggactatgagaccgtgttaacggatattgaggattctattgctgtgagcagcgaagaagtgctaaataaccaagaactaaggctcaaaaatacattgcacgaaattacttccagcattctggcaataaatgaagagaacaagtttgtgaatcctcttaggaacgatgagagcttagacgtagagggaaaggaggtctttgtaaatccaaaaattctgagtgcaaaaatcaaggagttcaataaactaatggagttacttaagttgacttacttggaacaggagacattggactatttcttcaggtttactttgtcctcgacgaaacctttgcagttagattccgaaaaagacccccaatttgtaaaacttaatgaaagagttaatgatttaaaggaagaaatttcgaatgttcaagaaagcaaaatagaacaaatcaaagctgaaatccaagagaccggtcacaactttgcagaaaggcaagatttaataaatgagttgtatctggaagccactggtgatattgaaaattgttgggattcgctcaatgaactaaaaaatttaacaaacaaagaagataagaatatgatgggagaaaaagatacgatattaaattcaagtgattcagatgattttgtggaagagacatacacgaattggcaaaaactactatttttgcagaagcaaaatcaaaggttaacgaaagagctcaaggaaatgcatgaagttaaaaatcaaataatacgaaaaggagagcaatcaaaaaaagaggattctggacatttaatggccaatgaatcagaattatgtcagtcaattaatttgctaacaaaattttgggaaaagcactttttactcaaagggtcaaagacgactatattaaattttgaaatctttacccagcttggaaaagtacaatttgaaataaaggatatgcaatatataattgccatatctttaagcgatttaaaaaggccaatgataaaagacattactattttacaaaaagcgggtggcaatatagtcacagacattgaagcgagcagtaaatttaacaataagtacagaaataatactaaggtgcaaatctttgaggtaatggatgacattataagcgagctaacaaacgaataa

SEQ ID NO: 2709 - DNA, 1158 bp, Saccharomyces cerevisiae
atggcttggtctggtggtaaggatatagtggatcagatatttgatgctgggtattggctcgtctcgaaaagcgctgtcttgagcgatgagatcaagaaccacgtcgaaaaatcaattgaatccatatctggaaagatatccaacaaggagactcctcgactacaggaaaacgacagtaacagatctaaagtatataaaactttgaggatcgggctccaggatcattggaagctaggcttgggaatttctgccacctccctgtgcttataccttgggtataggaccttttttaaactgccacctaatttacctgaagcagaatctcaagtggtattaatactgggcgatatgaatgatcctatcataaggaatcaagtgatggatttatatcgcagacggtttacagtatatatttgtactgaaaatgcagacgtctataagaagcacgaagaagatcaggatttcatatattacattgatcccacctgcgaaaaagacttcgagggtttttttgttgatgtaccaaggctagcatccatattgtttatgccaaggttatcatatcatccatccggagtaatttcatgtgactcattggaatctgaaattcattcaagtatatttgtgtattatcaagcattattaagcattataccccatttgaagagaaaaacccaactaattatgttcaatccatctttgactgcggacctgaacttagtccatcatagtacagaaattataacgtctggaataatcgactcactatttaaaattttcaaggaatatcaaaggttaaatgtttccacaatcaagcttggaatcctgcagattgggtcacaaccatcgaactataaatttttgagaatggccggttcagacattcacgaggccctacattatccagtttacaaaatgataatgagtgcgaatgggtataaactaagacaactgctaagttggttaacgactttgggaggttacaatagtgtgtattattgcggccgttttagttatttagtctcatggccatttgcttcacttatattcaaccatcacacacgtctttccctgaaacgcttgagaggaagattagccaaggtatatagcagcattatttcgtttttttgccggtcatcttctaaatcatccaaataa

SEQ ID NO: 2710 - DNA, 1158 bp, Saccharomyces cerevisiae
atggtttttgatttgaaaagaattgttagaccaaaaatttataacttggaaccttatcgctgtgcaagagatgatttcaccgagggtatattgctagacgccaatgaaaatgcccatggacctactccagttgaattgagcaagaccaatttacatcgttacccggatcctcaccaattggaattcaagaccgcaatgacgaaatacaggaacaaaacaagcagttatgccaatgacccagaggtaaaacctttaactgctgacaatctgtgcctaggtgtgggatctgatgagagtattgatgctattattagagcatgctgtgttcccgggaaagaaaagattctggttcttccaccaacatattctatgtactctgtttgtgcaaacattaatgatatagaagtcgtccaatgtcctttaactgtttccgacggttcttttcaaatggataccgaagctgtattaaccattttgaaaaacgactcgctaattaagttgatgttcgttacttcaccaggtaatccaaccggagccaaaattaagaccagtttaatcgaaaaggtcttacagaattgggacaatgggttagtcgttgttgatgaagcttacgtagatttttgtggtggctctacagctccactagtcaccaagtatcctaacttggttactttgcaaactctatccaagtcattcggtttagccgggattaggttgggtatgacatatgcaacagcagagttggccagaattttaaatgcaatgaaggcgccttataatatttcctccctagcctctgaatatgcactaaaagctgttcaagacagtaatctaaagaagatggaagccacttcgaaaataatcaatgaagagaaaatgcgcctcttaaaggaattaactgctttggattacgttgatgaccaatatgttggtggattagatgctaattttcttttaatacggatcaacgggggtgacaatgtcttggcaaagaagttatattaccaattggctactcaatctggggttgtcgtcagatttagaggtaacgaattaggctgttccggatgtttgagaattaccgttggaacccatgaggagaacacacatttgataaagtacttcaaggagacgttatataagctggccaatgaataa

SEQ ID NO: 2711 - DNA, 1158 bp, Saccharomyces cerevisiae
atgtcacaagaaacaaaaatgctaccttctctatctagtcttctatcgggaaccgaaatctcgtccagccccgtatcaccaagcttcactaatccaagaacgagttttcacctcgatgatcgcggaaccataaaattaccaccgctaaacaccagtatcaatcgtccaagatctgtggaaagcgccttgagacacactgttacatccttgcatgaaaatagcagcgcttatggtgatgacatgctcaagcacacgcaatcagactcagccctctcatctcagttgaatagttctcaagaaacagttgatgaatcacacgaaaaccttctactgactcccctaaatagcaaaaagagagattattcggtttcttcaaagaaaaacgacatattaacaccactctctgcagcgaagtcgattattatcccctctgcctctaaggaaaaaagacgtgcatttgctttcatcacacactcgcaggagaccttccctaagaaggagcctaagatcgacaacgctccactagcacgccgaaagagaagaagaacctcgtcccaggaactatctattcttcaggctgaatttgaaaaatgtcctgctccatcgaaggagaaacgaattgagttagctgaatcttgccatatgactgaaaaagccgttcaaatatggttccagaataaaagacaagcggttaaaaggcagagaatcgccacttcgaagtcaaccactataatacaaacggtatctccaccatctccgcctctggacgttcatgctacgccactagcatccagagtcaaggcggacatacttcgtgatggaagctcatgttctcgttcttcctcttcttcaccgctggaaaatacgccgccaaggcctcatcattccctaaataggcgctcatccacaccaagcataaagagaagccaggctttaacattccatctaaacccacaaaagaagacgttgactcccgtgaaaacgtctcccaacagcagagtaaataaattgatcaatagcatagatcattctccatccaaagccaagcgtccggtaagcaatccctccggctcccctaaaaggaagagaaaattcggattcaagatcgtcgatcaacaaccgttgaaggatcttgatccgaacgctttccgtggttga

SEQ ID NO: 2712 - DNA, 1158 bp, Saccharomyces cerevisiae
atgtctgcaaacggcaagatctctgttcccgaggcggtggtcaattggctgttcaaagtcattcaacccatttataacgacggaagaacaactttccacgattctttagcgctgctggacaattttcacagtttaaggccaagaacaagggtatttacgcactctgacggcactccacaactactgttgtccatatatggtaccattagtactggtgaggatggttcatctcctcacagtattcctgtgatcatgtgggtacccagtatgtacccggtaaaacctccctttataagtataaacttggaaaatttcgacatgaacaccatcagtagttccttgcccattcaagaatacatcgactccaatgggtggattgcgctgcccatactccactgctgggatcctgccgcgatgaaccttataatggtcgtacaagaattaatgagtctcttacacgagccgccacaagatcaggcgcccagtctaccccctaagcccaatacgcagctccagcaggagcagaatactcccccactgcccccaaagcccaagtctccacacctaaaaccgccattgcctccacctccaccacctcaaccggcatctaacgcactcgaccttatggacatggacaacacggatatctccccaaccaaccatcatgaaatgctacaaaatctacaaaccgtagtcaatgagttatacagagaggatgtggactatgtagcggacaagatactgacgagacagaccgtcatgcaagaatcaattgccagattccatgaaataatcgccatcgacaagaaccatttacgagccgttgagcaggctattgagcagaccatgcactcgctaaacgcacagatagacgtcctgaccgcaaatagggccaaagtccaacagtttagctcaacttcgcatgtggatgacgaggacgtgaactccatagcagtggccaaaacagatggactcaatcaactatacaacctcgttgcccaggactacgctctcacggacaccattgagtgcttatctaggatgctgcaccgtggcaccattcccctcgatacttttgtcaagcaaggtcgtgaattagcacgccagcaattccttgtgcgatggcacatccaacgaatcacctcaccgttatcgtga

SEQ ID NO: 2713 - DNA, 1158 bp, Saccharomyces cerevisiae
atgttacgagtttctgaaaatggtctacggtttctgctgaaatgccattcaacgaacgtaagcatgtttaataggcttctgagtactcaaataaaggaggggagaagttccatagatgatgctggcattatccccgatggaactattaacgaaaggccgaatcactacatcgagggaattactaaaggcagtgatctggacctcttggaaaaaggtataagaaaaactgacgaaatgacttccaattttacaaattatatgtacaagtttcacagattgccccccaactatggaagtaaccagctcattactatcgataaggaacttcaaaaggaactggatggggtaatgtcatccttcaaagctccgtgccggtttgtatttggttacggctcaggagttttcgaacaagcgggatattccaaaagtcatagcaaacctcaaatcgatataatcttgggcgtcacatatccatcacattttcactctattaatatgaggcagaatccgcaacattattcaagtttgaaatacttcggttccgagttcgtgtctaaatttcaacagatcggcgcaggcgtatattttaatccatttgcaaatataaatggacacgacgtaaaatatggggtggtttctatggaaacacttttaaaggacatagctacttggaatacattctatttagcaggacgactacaaaagcctgtaaaaatattgaagaatgatttgagagtgcaatattggaaccaattaaacttaaaagctgcagctactttggccaaacattacaccttagagaaaaataacaataagtttgacgaattccaattttacaaggagatcactgccttaagttatgcaggtgatattagatacaaactgggtggagaaaatcccgacaaagttaacaacattgttaccaaaaactttgaaagatttcaagagtattacaagccgatttacaaagaagtggtcctaaatgattcattttatcttccaaaagggttcacattaaagaatactcagagacttttgctcagccgtattagtaaatcaagtgcattacaaactattaaaggtgttttcacagctggaatcacaaagtcaattaagtatgcttgggccaaaaaactaaaatcgatgaggagaagctag

SEQ ID NO: 2714 - DNA, 1161 bp, Saccharomyces cerevisiae
atgaaggttattagtctgaaaaaggattcttttaacaaaggaggagcagtgattactcttttaccggaggacaaggaagatctgtttactgtttatcaaatagtagacaaagatgacgagttgatattcaagaaaaaattcacctctaaacttgatgaagctggtaagaaaaaaagtacagatttggtcaagttgaagattaaagtaatatccgaggattttgatatgaaggatgaatatttgaaatataaaggtgttactgttacagatgaaagtggagctagtaatgttgacatacctgtcggcaaatatttgagctttacccttgactacgtgtatccctttactatcataaaacaaaactttaataaattcatgcaaaagctcttaaatgaagcctgtaatatcgagtataaatcagacaccgcggcggtcgttttacaggaagggatcgcccatgtttgtttagtgacatcctcctctactattttaaaacaaaaaattgaatatagtatgccaaaaaagaaaaggactactgatgtactgaagtttgatgaaaaaactgagaaattttataaagcaatttacagtgcaatgaagaaagatttgaattttgataaattaaagactattattctttgctctccaggtttctacgctaagatattaatggacaaaattttccagtatgccgaagaggaacacaataagaaaatactcgataacaaaggaatgttctttatagcccactgctccacgggctacttacagggcattaatgaagttttgaaaaatccactatatgcttcaaagctgcaagatactaaatactccaaagaaatcatggtgatggatgaatttttgttgcatttaaacaaggatgatgataaagcttggtatggtgaaaaagaggtagttaaagcggctgagtatggcgcaattagttatttactgttaacagataaagttttgcattcagacaatattgcacaaagagaggaatatttgaaactgatggactccgtagagagcaatggaggaaaagcattggtattaagtactttgcattctcttggagaagaacttgatcaattgacgggtatagcctgtattctaaaatacccgctccccgatcttgatgaagacgatggtgaggagtag

SEQ ID NO: 2715 - DNA, 1161 bp, Saccharomyces cerevisiae
atgcgtctctctaacctaattgcttctgcctctcttttatctgctgctactcttgctgctcccgctaaccacgaacacaaggacaagcgtgctgtggtcactaccactgttcaaaaacaaaccactatcattgttaatggtgccgcttcaactccagttgctgctttggaagaaaatgctgttgtcaactccgctccagctgccgctaccagtacaacatcgtctgctgcttctgtagctaccgctgctgcttcctcttctgagaacaactcacaagtttctgctgccgcatctccagcctccagctctgctgctacatctactcaatcttcctcttcctcccaagcttcttcctctagttcttccggcgaagacgtcagcagctttgcctctggtgtcagaggtatcacttataccccatacgagtccagcggtgcttgtaaatccgcttcggaagttgcttccgatttagctcaattgactgacttcccagtcattagattgtacggtaccgactgtaaccaagttgaaaatgttttcaaggctaaggcttcgaaccaaaaagtctttttaggtatttactacgttgaccaaatccaagacggtgtcaacaccatcaagtctgctgttgaatcttacggttcttgggacgatgtcaccactgtttccattggtaacgaattggttaacggtaaccaagctaccccatcccaagtcggtcaatacattgactctggtagatctgccttgaaggctgccggttacactggtccagttgtttctgttgatacttttattgctgtgatcaacaaccctgaattgtgtgactactccgactacatggctgttaatgcccatgcttactttgacaagaacacagttgcccaagactccggtaaatggttactagaacaaatccaaagagtctggactgcttgtgatggtaagaagaatgttgttatcactgagtctggttggccatcaaagggtgagacttacggtgttgctgttccatctaaggaaaatcaaaaggacgctgtttccgccattaccagctcctgtggtgctgataccttcttattcactgccttcaacgactactggaaggccgacggtgcttacggtgttgaaaaatactggggtattctatccaatgaataa

SEQ ID NO: 2716 - DNA, 1161 bp, Saccharomyces cerevisiae
atggtcaacttgaacactatcccacccaaaaatggcagggactactacattgcgcttggacttgaaggttctgcaaataaactgggcgttggtatagttaagcatccgcttctgcctaaacatgccaacagcgatctatcttatgattgcgaagctgagatgctttctaatattagagacacatatgtcacacctcctggggagggatttttgcctcgagacacggcaaggcatcacagaaattggtgcataagactcataaaacaagcactggccgaagctgacatcaaaagcccgacactagacattgatgtaatttgctttaccaaaggtcccggcatgggggcccctctgcattcagttgtcatcgccgccagaacgtgctccttactgtgggacgtgccactggtgggagtaaaccactgcattggtcacatcgaaatggggagagaaatcactaaagctcaaaatcctgtggtactgtatgtaagtggtggaaatacacaagttattgcatactcggaaaaaaggtaccgtatctttggtgaaacgcttgatattgctatcggtaattgtcttgatagatttgcaagaactctgaagatacctaatgagccctcgcctggctacaacatcgagcagttagctaaaaaagcccctcacaaagaaaacttggtagaacttccctatacagtaaaggggatggatctttcgatgagtggtatattggcttccatcgatttacttgccaaggatctatttaagggcaataagaaaaataagatcctattcgacaagacaacgggcgagcaaaaagtcactgtagaggatctttgctactctctgcaagagaacctattcgccatgctagttgaaataacagaaagagctatggctcacgttaactccaatcaagttttgatcgtaggcggtgttggttgtaacgtgcgattacaagaaatgatggcgcaaatgtgtaaagacagggccaatgggcaagtacatgctacagataataggttttgtatcgataacggagttatgattgcccaagcaggactactagagtatagaatgggtgggatcgtgaaggacttttctgaaactgttgttacgcagaaattcagaaccgatgaagtatacgcagcctggcgtgattaa

SEQ ID NO: 2717 - DNA, 1161 bp, Saccharomyces cerevisiae
atgtcatccacagcagtaccacgacctaaaccttgggagaccagtgcttcgttagaggagccacagcgtaatgctcagtctttaagtgcgatgatgacctcgaatcagcaggattccaggccaactgaagaaagcaataacagtaatagtgcaagtgagtctgctcccgaagttttgccgcggcctgcggcacttaactcctctggtacctacggcgaatcgaatacaataccgggaatatacggtaatagcaattatgggataccctatgataataatccgtatagtatgaactctatatacggaaacagcatagggaggtatggctatggaggatcgtactatggcaacaattatggatcgttttatggaggagggtacggtgcaggagcgggatatggaatgaataatggaagtggactaggtgagtcgacgaaggccacctttcagttaatagaaagtttgataggcgctgttactggatttgcacaaatgctggaatctacttatatggccacacacaactcgtttttcaccatgatatccgtcgcagaacagtttggtaatttgaaggaaatgctaggttcattttttggtatctttgctataatgaagtttcttaaaaaaatactctatcgtgctactaaggggagactaggaataccaccaaagaatttcgcagaatctgaaggaagcaaaaataaactaattgaagattttcaaaagtttaatgatagtggtaccataaattctaatgagaaagccacaagaaggaaaatttcatggaaaccgctactattttttttgatggcagtatttggttttccatatctactaaacaaatttattactaaactacagacctctggaaccatacgagcatcgcaaggaaatggtagcgagcctattgatccttcgaagttagaatttgcaagagcgttatatgattttgttccagaaaacccagagatggaagttgctttaaaaaagggcgacttgatggcaattttgagtaagaaagaccctcttgggagggattctgactggtggaaagtgaggacaaagaacggcaatattggctacattccgtataactatattgagatcataaaaagacggaagaaaattgagcatgttgatgatgaaacgcgtacacactag

SEQ ID NO: 2718 - DNA, 1161 bp, Saccharomyces cerevisiae
atgtccgccgctactgttggtaaacctattaagtgcattgctgctgttgcgtatgatgcgaagaaaccattaagtgttgaagaaatcacggtagacgccccaaaagcgcacgaagtacgtatcaaaattgaatatactgctgtatgccacactgatgcgtacactttatcaggctctgatccagaaggacttttcccttgcgttctgggccacgaaggagccggtatcgtagaatctgtaggcgatgatgtcataacagttaagcctggtgatcatgttattgctttgtacactgctgagtgtggcaaatgtaagttctgtacttccggtaaaaccaacttatgtggtgctgttagagctactcaagggaaaggtgtaatgcctgatgggaccacaagatttcataatgcgaaaggtgaagatatataccatttcatgggttgctctactttttccgaatatactgtggtggcagatgtctctgtggttgccatcgatccaaaagctcccttggatgctgcctgtttactgggttgtggtgttactactggttttggggcggctcttaagacagctaatgtgcaaaaaggcgataccgttgcagtatttggctgcgggactgtaggactctccgttatccaaggtgcaaagttaaggggcgcttccaagatcattgccattgacattaacaataagaaaaaacaatattgttctcaatttggtgccacggattttgttaatcccaaggaagatttggccaaagatcaaactatcgttgaaaagttaattgaaatgactgatgggggtctggattttacttttgactgtactggtaataccaaaattatgagagatgctttggaagcctgtcataaaggttggggtcaatctattatcattggtgtggctgccgctggtgaagaaatttctacaaggccgttccagctggtcactggtagagtgtggaaaggctctgcttttggtggcatcaaaggtagatctgaaatgggcggtttaattaaagactatcaaaaaggtgccttaaaagtcgaagaatttatcactcacaggagaccattcaaagaaatcaatcaagcctttgaagatttgcataacggtgattgcttaagaaccgtcttgaagtctgatgaaataaaatag

SEQ ID NO: 2719 - DNA, 1164 bp, Saccharomyces cerevisiae
atgactgaattcgaattgcctccaaaatatatcaccgctgctaacgacttgcggtcagacacattcaccactccaactgcagagatgatggaggccgctttagaggcctctatcggtgacgctgtctacggtgaagatgttgacaccgttaggctcgaacagaccgttgcccgcatggctggcaaagaagcaggtttgttctgtgtctctgggactttgtccaaccagattgccatcagaactcacttgatgcaacctccatactctattctatgtgattacagggctcacgtttacactcacgaagccgctggactggcgatcttgtctcaagcgatggtggttcctgtggttccttccaacggtgactacttgaccttggaagacatcaagtcacactacgtcccagacgacggtgatattcacggtgcccccaccagattgatttctctggaaaacactttacacggtattgtttatccattggaagaactggtccgcatcaaagcttggtgtatggaaaatggtctcaaactacattgtgacggtgccagaatctggaatgccgctgcacaatctggcgtgccattaaagcaatatggggaaatcttcgactccatctccatctgtctatccaagtctatgggtgctcctattgggtccgtcttggttgggaaccttaagtttgtcaagaaggccacccatttcagaaaacaacaaggtggtggtattagacaatctggtatgatggctagaatggctcttgtaaacatcaacaacgattggaagtcccaattgctgtactcgcactctttggctcatgaattagccgaatattgtgaggcaaagggcatcccgctagagtctccagcagacaccaactttgtctttattaacctgaaggccgctagaatggacccagatgtccttgttaagaagggtttgaagtacaacgttaagctaatgggtggtagagtctcgttccactatcaagtcaccagagatactttggaaaaagtcaaattggccatctccgaggccttcgactatgctaaagaacatcctttcgactgtaacggacctacccagatttaccgtagtgaatccaccgaggtcgacgttgatggcaacgctatccgcgaaataaaaacctacaaatactga

SEQ ID NO: 2720 - DNA, 1164 bp, Saccharomyces cerevisiae
atgagcaatgtggctggggaattgaagaatagtgaggggaaaaagaaaggcaggggaaataggtatcataacaagaacagaggaaaaagtaagaatgagacggtagatcctaaaaagaatgagaataaggttaataatgctactaatgctacccacaacaatagcaaaggcagaaggaataacaagaaaaggaacagagagtattataactataaaagaaaggctagattgggtaaatcaaccgagaatgaaggatttaagcttgttattagattgctacctccaaatttgactgcagatgaattttttgccatcttacgagataataataacgatgatggtgataagcaagatatccagggtaaactcaagtacagtgactggtgtttttttgaaggtcattattctagtaaagtattcaaaaactcgacatattctcggtgcaatttcttgttcgacaacttatcagacttggaaaaatgcgcaaatttcattaaaacttgtaaattcattgataataaggataatattacaattccagatatgaaactgtcgccctacgtaaagaaattcactcaaacatcaaaaaaggatgccgcgctagtaggaacaattgaagaagacgaaatttttaaaacatttatgaattcaatgaaacagctgaatgaaaatgacgagtactcattccaagattttagcgtattgaaatctttagaaaaagaattctcaaaaagcatagagttagaaaataaaatagcagaaagaacagaaagggtgttaacagagctggttggaactggtgataaggtcaagaataagaacaaaaagaagaaaaataaaaacgccaaaaagaaattcaaagaagaggaagcatccgctaagataccaaagaaaaaacggaacagaggcaagaagaagcgtgaaaatcgtgaaaaaagcaccatttctaagaccaagaacagtaatgtggttattattgaggaagcgggtaaagaggttttgaaacaaaggaagaagaaaatgcttttgcaagagaagttaaaaatatcaaactcctctcagcctcagtcatcatccgctcaaacccagccgtcgttccaacctaaagaaaaccttttcgtaccacgggtaaaaattttgcatcgtgatgataccaagaagtag

SEQ ID NO: 2721 - DNA, 1164 bp, Saccharomyces cerevisiae
atgagcactgcaactacaacagttactacctccgatcaggcttctcatcctaccaagatatattgctccggtttgcaatgtggtagagaaacttcgtcccaaatgaaatgccctgtttgtctaaaacaaggcatcgtttccattttctgcgacacaagctgttatgaaaacaactacaaagctcacaaagctttgcacaatgctaaggacggcttggaaggtgcttatgatcctttcccaaaattcaaatattctggtaaagtgaaggcttcatatccacttaccccaagaaggtatgtccctgaagatattcctaaaccggactgggccgctaatgggctaccagtcagtgaacaaagaaatgatagacttaacaacatccctatatacaagaaagatcaaattaagaagattagaaaggcatgtatgttgggtagagaagttcttgatattgccgctgcccatgtcagaccaggcatcactacagatgaattagatgaaatcgtccacaatgaaacaattaagagaggtgcctacccttcccctcttaattattacaactttcctaaatcgctttgtacctctgtcaatgaagttatttgtcacggtgtgcccgataaaactgtcttgaaggaaggtgatattgtcaatttagatgtttccttatactaccaaggttatcatgcagacttgaatgagacatattatgtcggcgaaaacatttctaaggaagctcttaatactactgagacctcaagagaatgtttgaaactagccattaaaatgtgtaagccaggtaccaccttccaagagttaggtgatcatattgaaaaacacgctaccgaaaataagtgcagtgtagtaagaacttattgtggacatggtgttggtgaatttttccattgttccccaaatattccccactacgccaagaatagaacacctggtgttatgaaaccaggtatggttttcaccatcgaacctatgattaatgaaggtacttggaaggatatgacctggcctgatgactggacttctaccacccaagacggtaaactgagtgctcaatttgaacatacactgttggttaccgaacatggtgttgaaatcctaacagccaggaataagaaatcaccaggtggcccaagacagagaattaaatag

SEQ ID NO: 2722 - DNA, 1164 bp, Saccharomyces cerevisiae
atgagtaacggtgcgtttgatgctatttttgagtacgcatggggccaaattgacaaacccatcagtggagactttatatatggtaaagatttgccaaagctaatcgagataattgagaatatctttcaaaaggcacagaaaagtggttcctatgagcttcgattgccattgttttcagaaatcaataaagatttgtttcgcacgttttctaatacaaaaaccttctttaaaatacacaaagaagaatttgacgatatcttcttcaatttggttaatcaccccctcagggaaatcttagaaaacgcgttcattggtgtagattctattccaagtgattttatcgtaagcatgaatttgaattcaccttccaaatttctggttgagaacaagaacaagaatacagagggggctggaatttcgacacctaggaagaagcttactgaatcacctatcaagctgttaagcaggaataatataggaaaggccttagaggtgcaggtggaggaattgaaaagagaactaactgcgaaacaaagcctccttcaggaaaatgaacgacaagtaagcgaattgaaaataaggctcgaaacttatcaagaaaagtatgcttccatacaacagcggttcagcgacttacagaaagctagacaagtggaagataatcaaaatagctccagaacatctgacccaggatcacctctggtaacgggaatcgatcaaaaagccattctggaagagtttagaagaagattacagagacaaacagacaccatatctttcctaaaggatcaaatacggcgagaaagggggctcaattgcagtaacgataaggtatcacattcaaaacgaaaacatgcaaccactgatggtgatgggactttcaagaattttatttccgcggttccctccaacatatgggtaaaagcaacaataagaattatagtctgtttcgctttactggcaggtgtcctaccatacattagaaaatacgtatatgctcatgacacaccatcccaaaactcaaggttacaattatcatggtgggaaaatagtggcatattaagcaagattgtatggttctttgaagatcagacagatttagaaactgaataccgttcaaatgccaatgtggatgacgcatatagtagagtattcggcatttaa

SEQ ID NO: 2723 - DNA, 1164 bp, Saccharomyces cerevisiae
atgagtgaacttgaagccacaattaggcaagccaaagaagccctggctgaaaataatgccaaaaaggcgctcaaaatattgaagccgttcaaaagttcactgaaaaaagaaaacgcaaacaatgtaatactgaatgaagtgtttgccgatgcatacctggataatggacaggtagagaaagcctacccaattttagcgcgtgcttgcgaattagatcctgagggacaagttggcggaccggacaaattttttaccatgggtcaaatcatgggtggacaggatggtgtatcgataataactcgcggaataatgaacatctctaatactggaggtgaaatgttaaccaacgttcaggttgaaaagattgtaggtggactgctttctgtgattgaaatttggatgacggatttatgtatggagccaaatgcagaagagcagtgtgaggagttaatacaaaaggcgatggaactcacagagggaaaatctcctgaaacatggtctaccctgggttctatcaaaatctcgcaacaaaaatttggagaagcttatgaagcattctcacaagcctggaatttctttgagttgaaaaaacaagaaattggtagcggtataaatgaaaatggtgacacaactcagaaagctggtttacagtcagagtatgtagatcttttacaacctcttttatctttaacaaagatgtgcctcgaagtgggagcttacgaagtcgcattgaaagttattgccgcagtaagagatatagatgaggataacatagagggttattatctagagggttttacttattatttaatgagtaaattagaaattttcaagttgaacaatcccgaagtaagcctgcgtccggaaaatatatacgagtttaaccaactcattcaagaagttcctttggatttatcccacgaaccaatctcccagttaatctatgactcaagattagcgctaagttttgcattgcaagcaggtgtcaatgctgacagcaaagatgaaattgtgcaagaattattgggcggtgctaatgctttactccaagaaattggtggtcctctagatccaagtgagttaacacaaatcaagaagggtgatttagtgaatgagaatgaagacttggaagagttggacatagaggaagaatattctgactaa

SEQ ID NO: 2724 - DNA, 1164 bp, Saccharomyces cerevisiae
atggaacagaacaggttcaagaaagaaacgaaaacttgtagcgctagctggccgcgcgcaccgcagtcgacgctgtgtgcgacagatcgcctcgagctcacatacgatgtgtacactagcgcagagcggcaacgccgctctcgcactgccactaggcttaaccttgtgtttttgcacggcagcggcatgagtaaggtggtatgggagtactatttgccgcgtctggtagccgccgatgcggagggcaattatgccatcgacaaggttttgttgatcgaccaggttaaccacggtgattctgcggtacgcaaccgcggcagactcggcaccaatttcaactggatcgacggggcccgcgacgtgctcaagattgccacatgcgagttgggcagtattgacagccacccggcactaaacgtagtcatcggccactcgatgggcgggttccaggctcttgcgtgtgacgtcctgcagcccaatctgtttcatttgctcatcttgatcgagcctgtagtaatcacacggaaagccatcggcgccgggaggccagggcttccgcccgattctccgcagatcccagaaaatctttataactccctacgtttaaagacgtgcgaccatttcgctaacgagtccgaatatgtaaaatatatgaggaacggttccttttttaccaatgcgcacagccaaatcctgcaaaacatcatcgattttgagaggacaaaagcctctggagacgatgaagatggtggacccgttcgcacgaagatggagcaggctcaaaatctcctctgctacatgaacatgcagacttttgcgcctttcctgatcagcaatgtgaagtttgtgaggaagcggactatccacattgtgggcgcgcgctccaactggtgtcctccgcaaaatcagctgtttttgcagaaaactctacagaactaccatctcgatgtcattcccggcggctcccacttggtcaacgttgaggctccggacctggtgatcgagaggattaatcaccacatccacgagtttgtccttacctccccgctgcagtcctcacacattccgcaattgacccttgaagaaagagcggtgatgtttgaccgggctttcgactcgttcaagaatgaagctttggttaaaacgactaaacaaaaactgtaa

SEQ ID NO: 2725 - DNA, 1164 bp, Saccharomyces cerevisiae
atggacggtagaaatgaaaaaccaaccactcctgtgtcagattttcgggtgggaagctccgagcaaagtcaagcgggagtgaatcttgaagatagtagtgaccatcgcacttccaattcagccgagagcaaaaaaggcaatttaagtggtaaaagcatcagtgatctaggtatttctaataatgataacaaaaatgtaagattcactgctgatacggatgctctagaaaatgatttgtcttcaagatctacagaaaccagcgataattctaagggcacagatggacaagatgaagaagataggcctgctcgccacaagaggaagcctaaagtttctttcacacatttaaggaacaatggtaaggatggagacgatgagacgttcatcaagaagataataaataacctgactggaaatcaagggggtttggtccctggcttggcaccaataccttcagaaaatgaaaatgggaagaatgatatagaaaaaaataaccgtaatgaagaaattcccttatccgatctagctgatgcgtctaaaatcgtagacgttcatgagggcgacgataaagaaaaactggaggctctcaaattagaaggtgacgtaaattgtacgtcggatggcgaaacgttaggctcaagttcaaaaaattcatttctggctcctgcagtggatcattttgatgattatgcagaaaacaattcatccgacgataacgaagggtttattgaaacctccacatacgtaccccctccatctcaagtgaaaagtggagtactagggtcattattgaaactttaccaaaatgaagatcaaaattcaagctcaatcttttcagattcacaagctgtaacaacagatgatgaaggtatttcttctactgctggaaacaaagacgtaccagttgccaagcgtagcagattacaaaatttaaaaggcaaggctaaaaaaggcagaatgcctagactgaagaaaagactaaaaactgaagcgaaaattacggttcacattgcagacattttacaaagacaccggttcatcctacgcatgtgtagagctcttatgatgtatggtgctccgacgcataggcttgaagaatatatggttatgacttctagagtccttgaaatagatggtcagttttgtatcttccaggttgtatga

SEQ ID NO: 2726 - DNA, 1164 bp, Saccharomyces cerevisiae
atggactctattcaagaatcagatgtactaaatgcagtgaaaacaaaactaccgccgtgttgtttgagaatattcaggaataagatcatccttgttgggacgtatgatttagataagtcaactggatacaggtcaggctcactggatgtcttcacaatggacctcaaacttttatgttcgaataatacgtatggcgcaatcctagatttgaagttatccccctttgatgatacattgatatgcacggcccattcgacaggtaatatcatgctatggaggatacggtgcacagataaggatgatttccaatcaaacgaactagatattcatgcaattgcaaatctacaactctttgaaaaagatgttctcattgcctcgtgccatttttccccacttgattgtaagaaattacttgtaacaaatacggcaggcgaagcagctaccattgatataagaacactatctgtacagttcacggcatcagcaatcgcgcaggcttactcaaaactagataaaatagattacgaagttcaaggtgcaaccgaaaaagtcattcatgttgaatcgggacaatttttgaaaccccatgaactcgagtgttggactgcggaatttggatctctacagccttttcaagacgttgtatttacaggaggtgatgattcgagaattatggcccacgacttacgttccaaagaattcatttggagtaataatcgtattcatgatgctggtgttgttagcattaagtgtagtcaacctaactttcgaaataataaacccacgtccataataactggatcctatgatgataacattcgttctctggatttaaggatgatgggtgagtccatatttcctggtgcaaatgtccccacagttaataaattggcgtgtgatcttggtggcggtgtttggagatttgttgaatcccccattgatcaggaacaatctcaccacaacggctccgatcggcttttagtttgttgcatgtacaatggtgccaaggtggtgaccatgaatgataattccgatgagtattttcaaattcaacattatctgaagaagggccatgattcgatgtgttacggtggcgactggtcaaattctttgatcgcaacatgctcattttatgataattccttgcaaacatggatagtttag

SEQ ID NO: 2727 - DNA, 1164 bp, Saccharomyces cerevisiae
atgggtgttagtgcaaatttgttcgtaaagcaaagagggtcgacaacagctctgaagcagccaaaggaaataggattctattcaagaactaaggatgaagaatatttaattagcgatgatacgaatttgaattactactatcttccagacgctgaattggacaggaagttggatctttcatcaggatttcagaaatttaaggattattacaaagattttgaagacaggtgttccctgcgtgggctattagaaaccatagaaagctctgaaagacataaaggaaaaaaaattaatgctgatataattacttttagaggaatagcacggaaattaatttcatgtgcatttgactctccatcttttaatacagttgatcttcgtatcgtttcattcaacggccaactttttatcaaggaagtgcctgaagctgtcaatgcagctaaggcttcctctgcaactgaagcagggcgtaatataaatcaagatctgaatgtatttacagggtacaagtttgaaactttggctactctttccaatccgttgcagtatacaccccgtgaagtgatagaaaaaagaactaaaaggattgtatcgcatggagatgaatacattagtgttgtgagaactggtgtaggtaactgcaagttaattcttggtgctgaggtggattgtatatttgactttaaagaaaacggtagagacaatttaaaacattatgccgaattgaaatgtacgcagcaagttgcgaacatatcggatacgcataagtttgagcgtaaactgttccggacctggctgcaatgcttcttagttgggatcccaaggatcatatatggttttaaagacgaccattatgtattaaaaactgtggaagagttttcaacggaggaagtacctgttttattaaagaacaataatccacaagttggaagtgcatgtttagaagccattaaatggtatggtctccttactgagtggcttttgaaaatgataccaagagatgaggatcctcattctcaaataagagcatttaagttggttttcgaaaataatcacctaagattatccgaaattgaagaaagtgatgaggaatattcaggtttgattgatggagaacatatattatcgaacgggtttaaggagtggagaaaatctttgaaataa

SEQ ID NO: 2728 - DNA, 1164 bp, Saccharomyces cerevisiae
atgtccgatatcaacgaaaaactcccagagttactacaagacgctgtcttgaaagcatctgttcctattccagatgacttcgttaaggttcaaggtattgattactcaaagcctgaagccactaatatgagagcaactgatttaattgaagctatgaagaccatgggtttccaagctagttctgttggtactgcctgtgagattattgatagtatgagatcatggagaggtaagcatattgacgaattggatgaccatgaaaagaaaggttgcttcgatgaggaagggtaccaaaagactactatcttcatgggttatacttctaacttgatcagttccggtgtacgtgaaactttacgttatttggtgcaacacaaaatggttgatgctgtcgttacttctgctggtggtgtggaagaagatttgatcaaatgtcttgctccaacttacttgggtgaatttgctttgaaaggtaaatctttgcgtgaccaaggtatgaatcgtattggtaacttgcttgttccaaatgataactactgtaagtttgaagaatggattgtcccaattttggataagatgttggaagaacaagatgaatacgtaaagaaacatggcgctgactgtttagaggctaaccaagacgtggattcaccaatctggaccccatctaagatgatagatcgttttggtaaggaaatcaacgacgaatcctccgtattgtactgggcccacaagaataaaattccaatcttttgtccatctttgactgatggttcaatcggtgacatgttgtttttccatacttttaaagcatctccaaaacaactaagagttgacattgtaggagatatccgcaaaatcaattcaatgtccatggccgcttacagagccggtatgatcatcttgggtggtggtttgatcaagcaccacattgccaatgcttgtttgatgagaaatggtgctgattatgccgtttacattaacactggtcaagaatacgatggttctgatgcaggtgcaagacctgacgaagctgtgtcttggggtaagatcaaggctgaagccaaatccgtcaaactttttgctgatgtcaccactgttcttccattgattgttgctgctacctttgccagtggtaaaccaatcaaaaaagttaagaattga

SEQ ID NO: 2729 - DNA, 1164 bp, Saccharomyces cerevisiae
atgtctcacagaaagtacgaagcaccacgtcacggtcatttaggtttcttgccaagaaagagagctgcctccatcagagctagagttaaggcttttccaaaggatgacagatccaagccagttgctctaacttccttcttgggttacaaggctggtatgaccaccattgtcagagatttggacagaccaggttctaagttccacaagcgtgaagttgtcgaagctgtcaccgttgttgacactccaccagttgtcgttgttggtgttgtcggttacgtcgaaaccccaagaggtttgagatctttgaccaccgtctgggctgaacatttgtctgacgaagtcaagagaagattctacaagaactggtacaagtctaagaagaaggctttcaccaaatactctgccaagtacgctcaagatggtgctggtattgaaagagaattggctagaatcaagaagtacgcttccgtcgtcagagttttggtccacactcaaatcagaaagactccattggctcaaaagaaggctcatttggctgaaatccaattgaacggtggttccatctctgaaaaggttgactgggctcgtgaacatttcgaaaagactgttgctgtcgacagcgtttttgaacaaaacgaaatgattgacgctattgctgtcaccaagggtcacggtttcgaaggtgttacccacagatggggtactaagaaattgccaagaaagactcacagaggtctaagaaaggttgcttgtattggtgcttggcatccagcccacgttatgtggagtgttgccagagctggtcaaagaggttaccattccagaacctccattaaccacaagatttacagagtcggtaagggtgatgatgaagctaacggtgctaccagcttcgacagaaccaagaagactattaccccaatgggtggtttcgtccactacggtgaaattaagaacgacttcatcatggttaaaggttgtatcccaggtaacagaaagagaattgttactttgagaaagtctttgtacaccaacacttctagaaaggctttggaagaagtcagcttgaagtggattgacactgcttctaagttcggtaagggtagattccaaaccccagctgaaaagcatgctttcatgggtactttgaagaaggacttgtaa

SEQ ID NO: 2730 - DNA, 1164 bp, Saccharomyces cerevisiae
atgtctgcaccaactccattagcagaggcctctcaaattcccactatcccggccctttctcctttgactgcgaagcaatccaaggggaatttcttctcctcaaacccaatatctagctttgttgtggatacgtacaaacaattgcattctcacagacaatctttggagctggtcaatcccggtaccgtggaaaacctgaataaggaagtctcccgtgacgtgtttttgtctcagtattttttcaccgggctaagagctgatttgaataaggcattttccatgaatcctgcttttcaaacctcacacactttctctataggttcccaagcattgcctaagtacgcattctccgcattgtttgccaacgataacctatttgctcaaggtaatatcgacaacgatttatctgtttccggtagattaaactatggttgggataagaaaaacatttctaaggtcaacctacagatatcagatggccaaccaacaatgtgtcagttagaacaagactatcaggcttccgatttttctgtgaacgtaaagacattgaacccttcgttctctgagaagggcgaattcacaggtgttgctgttgcatcttttctacaaagtgttactcctcaattagctttaggtttagaaactttatactccagaactgacggtagcgctccaggtgatgctggtgtttcatacttgactcgttatgtctccaagaagcaagattggattttttcgggccaattgcaagccaacggtgctttaattgcatcgctatggagaaaagtagcacaaaatgtcgaggcaggtatcgaaactacattacaagctggtatggttcctattactgatccattgatgggcactccaattggtattcaacctactgtcgagggttctaccactattggtgctaagtatgaatacagacaatctgtatatcgtggtacattagattccaatggtaaggttgcatgttttctagaaagaaaagttctgccaactctgtccgttttattttgcggtgaaatcgatcatttcaagaacgataccaagattggttgcggtctacaatttgaaactgctggtaatcaagaattactaatgttacaacaaggtttagacgcagatggtaacccattgcaagctcttcctcaattgtga

SEQ ID NO: 2731 - DNA, 1165 bp, Saccharomyces cerevisiae
atgggtatgtttttattatatcgcataattatggcaaatgttatgaaggattcctctatgacttagatgttttgaatcggtacattttattttcagtatccttctgcatattacaaggcaacatagcagcggacaagaaagcttttttgatgttcgtcttcgaaacgattactatcagggtcttttaaatgctatatcgggacttattgaaattgacatattacacttatgaatgacgttggctatcaaagtatgagaataagcctttcctactattttgtatcatgacaacagggttctgtcgctttgaatgcggccttttactttgccatattttgataatgaaaaaactttcgagaaatatttactaacaggatcgagaatttttttcctcatttaaacaggtagagttattcgtaaccaaagaaagggtgctggttctatcttcacctctcacaccagattaagacaaggtgctgccaagttgagaactttggactatgctgaacgtcatggttacatccgtggtatcgttaagcaaattgtccacgactccggtagaggtgctccattggccaaggttgttttccgtgacccatacaagtacagattacgtgaagaaatcttcattgctaacgaaggtgttcacactggtcaattcatttacgctggtaaaaaggcttctttgaacgtcggtaacgtcttgccattgggttctgtcccagaaggtaccattgtctccaacgttgaagaaaagccaggtgacagaggtgccctagccagagcttctggtaactacgttatcatcattggtcacaacccagatgaaaacaaaaccagagtcagattaccatccggtgccaagaaggttatctcttctgacgccagaggtgtcatcggtgtcattgccggtggtggtagagttgacaaaccattgttgaaggctggtcgtgctttccacaagtacagattgaagagaaactcttggccaaagacccgtggtgttgccatgaatccagttgatcaccctcacggtggtggtaaccatcaacatattggtaaggcttctactatctctagaggtgccgtttctggtcaaaaggctggtttgattgctgccagaagaaccggtttactacgtggttctcaaaagacccaagattaa

SEQ ID NO: 2732 - DNA, 1167 bp, Saccharomyces cerevisiae
atgaattgcacacttacagataataccagagccataaatgtggcctccaacctcggtgctcctcaacagaggacgatttttgccaaggagagaatatccatcccaggatactacgagataatccaattcctgggcaagggagcctatgggacagtgtgctcagtgaagtttaagggtcgaagcccagctgctaggatagcggtaaagaagatcagcaacatctttaataaggagatccttttgaaaagggccatccgtgagctaaaattcatgaacttcttcaagggccataaaaatattgtaaatctaatcgatctagagatagtgaccagctcgccctatgacggactgtattgctaccaggaactgattgattatgatttggcaaaagtcatacattcgtccgtgcagctctcggagtttcatatcaaatactttctttaccaaatcctgtgtgggctaaagtacatacacagtgcagatgtcatccaccgagatttgaagcctgggaacatattgtgcacattgaatggctgtttgaagatctgcgattttggtctcgctaggggtattcatgccggatttttcaagtgtcattccactgtgcagccccatataaccaactacgttgctacaagatggtatagggcgcctgagctgcttctttccaaccaaccgtatagtaagtccgtagacatatgggctgtagggtgcattcttgcagaattctatgctcgaaagcctgttttcatggggcgtgactccatgcaccagatatttgaaatcatcaaagtcttgggtactcctgataaagatattctgatcaagtttggcaccattaaagcttggaatctaggcaaaaacagtaataaccctgtatataaaaaaatcccatggtccaacattttcccctttgcctcgcatgaagcaatcaatctcatagagtcattacttcattgggactcaacacataggttaaacgtggaacaagctatatcacatccgttcctaaacgaggtgcggaagccagacgacgagcctgtttgccttcagggtcctttcgacttcacctatgaatccgagttgaattcaatgtccaaattaagagactacttggttgaagaagtgaaaaatttcaaaaccgatttgtcctcctcgtctttatag

SEQ ID NO: 2733 - DNA, 1167 bp, Saccharomyces cerevisiae
atggcaaattcgccgaaaaagccatctgatggcactggagtatcagcgtcagacacgcctaaatatcaacataccgtcccagaaacgaaaccagcatttaatttgtcaccaggtaaagctagtgagctatcacatagccttccgtcgcctagccagataaaatcaaccgcacatgtatcttcaactcacaatgatgcggcaggtaatacggatgattctgttcttcctaaaaatgtatcacccacaactaatttgagagttgaaagtaatggagatacaaacaatatgttctctagccctgctggactagctctaccaaaaaaggatgataaaaaaaaaaacaagggtacgagtaaagcagattctaaagatggcaaagcatccaactcctcaggacagaatgcacaacaacaatcagacccaaataaaatgcaagatgtccttttttccgcaggtatcgatgttagggaggaggaggctcttctaaattcatctattaatgcctcaaaatcccaagttcaaacaaataacgttaagatccccaaccatttaccattccttcacccggaacaagtttccaattatatgaggaaagtcggaaaagagcaaaacttcaacctgacccctacaaagaatcctgaaattttggacatgatgtcaagtgcctgcgaaaactatatgagagatatcctaacaaatgccattgtcatctcccgacatagaagaaaagcagtcaagataaattctggtagaagaagtgaagtttctgcggctttaagagccattgcactaattcaaaaaaaagaagaagaaaggcgtgtgaaaaaaagaattgcgttgggactcgagaaggaagattatgaaaataagattgattccgaagagacgttacacagagcatcgaacgttacggctggccttagagcaggtagtaaaaaacagtatggttggctaacttcatcagtaaataagccgacgtccttgggagcaaaatcttcaggcaaagtcgcctccgacatcacggctagaggagaaagtgggctaaagtttagagaagctagagaggagcctggtatagtaatgagggatttactctttgctctcgaaaataggcgcaacagcgttcagactattatttcaaagggttatgccaagatcagagattaa

SEQ ID NO: 2734 - DNA, 1170 bp, Saccharomyces cerevisiae
atgcgtttttcaaatttcctaactgtatctgcattattaaccggagctctaggagctcctgctgttcgccataaacatgaaaagcgtgacgttgttactgccacagtccatgcgcaggttactgttgtcgtttccggtaacagcggcgaaactattgttccagtgaacgagaatgctgttgtagctactaccagcagtactgcagttgcttctcaagcaactacatccactttagaaccaacaacttccgctaatgtcgtcacttctcaacaacaaaccagcactcttcaatcttccgaggcagcatctacggttggttcttcgacttcatcctcaccctcatcctcatcctcaacttcatcttcagcttcatcctccgcttcatctagtatctcagcctccggtgctaagggtattacttacagtccttacaatgatgatgggtcctgtaaatctactgctcaagtcgcctcagatttagaacagttgactggttttgacaacatcagattatatggcgttgactgtagtcaggttgagaatgtcttgcaagctaaaacttcaagccagaaattattcttaggcatatattacgttgacaaaattcaagacgccgttgatactattaaatctgcagttgagtcttatggctcctgggatgatattaccactgtttctgtcggtaacgaactggtcaatggcggttctgccactacgacgcaagtcggtgaatacgtttccacggccaagtcagctttaacctctgctggttatacaggctcagtcgtttccgttgataccttcattgctgttataaataaccctgacctgtgtaattattctgactatatggctgtcaacgcccatgcatacttcgatgaaaatactgcggcccaagatgcaggaccatgggtactagaacaaatcgaaagggtttacactgcttgtggtgggaaaaaggacgtcgttattaccgaaactggttggccatctaagggtgatacttacggcgaagctgtcccatctaaagcaaaccaagaagccgccatttcttctatcaaaagctcctgcggctcttcagcttacttatttaccgccttcaatgatctatggaaagatgatgggcaatacggtgttgaaaaatactggggtattctatcaagtgattaa

SEQ ID NO: 2735 - DNA, 1170 bp, Saccharomyces cerevisiae
atggctagttattctttagttgaatcgaattctttcgggtcagaaaattggtgtcttaagttacagcctagttataaacatggtcttttaactggattaagtaatggcgaaatacgtttgctagactggagtactggtaaatcagtacaaaagattaaggcgagcgaaactgcaatcaatgatatgaaggtcatcggtagcgacttctctgctggtcatctagttagtagcgcctctatcgacgcggtgaaagttttcgatataaggacgaatgaccgcattgctcaaattcaaaacgaggccaactccccctttatttccttagattctcgtcatggtctattggcctgtggtaccgaattgcagggaattgacgctgctgtatacatatatgatattcgcaaatgggacactccattgagatcattaattgactctcaccatgatgacgttacctgtattaaatttcatccttctgacgtcaatattttgctcagtggttcaactgatggttacacgaacatttatgacttgaaacaagatgaggaggaggacgctttacaccaagttattaattatgcgtcaatacattcctgtggatggttgtccccaaagaggatatttacactatcacatatggaaacatttgcaattcacgaattgaacgacaaatctgacgaattgaaagagccacaacccttggactttggtgatgtaagagaaatatggaactgtgactacgtggtagatatttaccctggactcattgcaaccggtaaaacccaagaaaattgtggagagttgtgcctcctaccatttaaagatgagaaggtggatactgaaaacggtattgttatcccacacgcccatggagacgaggtcgtcagagatatttttataccagcacaacatagcaacatgttatactcctgtggtgaagatggttgcgttaaaatttgggaaaacaaacaggggccgttagatattccagaaaatttttgggattactctaaaaaaatgaacgtcttaggagatgacgacagagaaggttccattaatttagacgaacctcttattattcaaaaagaatcggtttccacgaggccaaggaaggagaaacacaagaaagccaagaaacattccatgaaaagtcgtttcaaaccatactag

SEQ ID NO: 2736 - DNA, 1170 bp, Saccharomyces cerevisiae
atgtcaagctcaatacctagagtttactctctagggaactcagccatgacgtacttactagcattgagaattgcacaactcccgagtcaaccaaaggttccatcagttgttcttcttttaaacgaccagaagaaactgaatagattcctcaataatgactctaaaattattgttaaatcgagtaacaacaataaagaaacttatcatagacagtttatggcatcttgtgtcccgcccattctaagcaatggtgaaattgcaccaattgaaaatttaattgtctcagatccctcttcgaaatttatcactgcccaactttctaaatacaataaatctttgagacccgaaaccaacattctgtttttgaatccaagcttaaatctattggaacatttgcatagatatcgatggcgctttgatgaggcaagaccaaacttgttcatgggctttacaacaccagttgacgttgggaccatacatcaagaatttcaactgtctctcaaagtgaaaggaaggatacaatttcatattgcaaagattgatggttttcctcgaatgagtagtactggtaaaagtgcgagtctttctctaagaggtgacaggcagaaaaatgaaaaagaaaataatgcgttttataagttgtttagagaaatttccaggctacgatctggaataggttccgatctagttagttttgatctgcatgttcatggtttccaggatttgttcttcactgaactggagaaattgatattggagagttgtaccgagccattattggcagtatatgattgcgtatataaaaaggaacttttgaaaatccccggagcacaagatataataaaaaagttgattagtgagcagctgtcaattatcgatcgatcctacccgtcactaaacaccaacccaaactattctgtaatctttgacaaggagagaatatttagcttggtgatgagagatctagaagttaatgggcacaagcgcgctaagttggcccaatctttaaatcaattgaatcaaacgaacattaatgaacttaacggattttttgtttctcttggtaagtacaaaaaatgtaactgcaagtggaatgatatacttctgactttaataaaagggaaacagtttattactaagcaaaaagcactagattatcattacctgtga

SEQ ID NO: 2737 - DNA, 1170 bp, Saccharomyces cerevisiae
atgtctctactaggcgccaggtccacttaccgttggttttcaatcgctgcatcaattccgactaagaatgctattggcaaatccacgtacctcttagcttcaagaaatcaacagtaccgaggcatcataacgtcaactgtagactggaaaccaatcaagacaggtaagagcccaaatgatgattctcgaagagaaagatcctttggcaagaaaattgttctgggtctgatgttcgcgatgccaataatatccttctatttgggaacttggcaagtaaggagattgaagtggaaaaccaagctgattgcggcatgcgaaactaaacttacttatgaaccaataccacttcctaagtcatttacacctgacatgtgcgaggattgggaataccgtaaagttatacttaccggacacttccttcacaatgaagagatgtttgttggtccaagaaagaaaaatggagaaaagggttattttctgtttacaccgttcattagagatgacaccggtgagaaagttctgatagaaagagggtggataagtgaagaaaaagttgctcctgactcaagaaatttacaccatttgtcgttgcctcaagaagaacacttgaaagtggtttgcttagtaagacctccaaagaaaagaggctcgctacaatgggcgaaaaaggatccaaattctagattgtggcaggtgccagacatatatgacatggcaagatcatcagggtgcacgcccattcaatttcaagccttgtatgacatgaaggaccatccaataatcgaggaacacacaagaaacgaggcttcacaaaacaattccacctctagcctgtggaagttctggaaacgagaacctacgactgctgtaaacggaacgcaagctgttgataataatacatcgaagcctcgttctaggcaggaaatgccgacagaccaaacaattgaattcgatgaacgacagtttatcaaagcaggtgttcccataggccggaagcccactattgatttaaagaataaccatctacaatatttggtaacgtggtatggcctttcgtttttgagcacaatcttcctcattgtggctcttaggaaggcgaaaagagggggcgttgtgtcccaagaccaactaatgaaagagaaactgaagcattcaaggaaatatatgtaa

SEQ ID NO: 2738 - DNA, 1173 bp, Saccharomyces cerevisiae
atgggcatagttttgaaaagagcaatagcagcaggtatgaaaccttttccaaacagtacgtggcattggagccgaaccataagacctttctcacagcatttgtctagcacatgctttctgcagcaatcctcgagatttacttcaaaacgatacctacacctttcaacattaacacaacaagaaaagcgcttcctacccgaatctgaacttgctaaatataaggaatactaccagggtttgaagagcactgtaaatgaaatacctgaatcagtggcctctaagtcaccttcgttaagaacgcttcataagagattacaattacctaatgagttgacctattcaacactttccagatgcttaacgtgtccctctgcaaaactacccgacaagataaataatcctacaaaaggtgcagctttcgttaatactgtacctactaataaatacttggacaaccacggtttaaacatcatgggaaagaacttgctctcttaccacgttacaaaatccattatacagaaatatccgagactacccactgtggttttgaatgctgcggttaacgcatatatatcagaggcggtactggcgcacattgctaaatactggggtattgaagtagaaactacgtctgttttatcacgctatttgaaaatggaaccattcgaattcactttgggaagactcaaattctttaataattcattgaactctaaggacggtattgagctaatcaccggaaagaacttttcagaaacaagcgctcttgcaatgagcgtgaggagtataatagctgccatctgggcagtaacggagcaaaaagattctcaagctgtttacagatttattgatgatcatataatgagcaggaaattggatatcacgaaaatgttccagtttgaacaacctacaagagaattggctatgctatgtcgtagagaggggctggagaaacctgtatcgaaactggtcgctgagtctggtagactatcgaaatcacctgtctttattgtgcatgtattttcaggcgaagagacattaggtgaaggttatggttcctcattaaaggaggcaaaagcaagagccgctactgatgctttgatgaaatggtattgctacgagcctcttgctcaacaggaaccagttattgatcctggcactgttgttgtttag

SEQ ID NO: 2739 - DNA, 1173 bp, Saccharomyces cerevisiae
atgttaggactgaaagggtgtctaactattcttattggatacgttattgctgtctgtgctttgttttccagtaggggaagaaatccttcattaactgattgggaaaagttaaaggaccagaaaatatcgaatattgataactttgggttgaccggtcaacatcttttagaatttttccaggaaaacttgccatttctaagtttttcagaggaaaagtatcgtcacaaacacgtttctttatattatgatgtattcaaagaatatatcttacgtcgtgccagttcaaaaaagtgtttaccagtagactctgctatcgcaaagttgaacaaagatgttaacccaatgccagttcactcccataatgactactggaggaaacttccgctttttgaaggtctggcctatggtgctagtagtactgaagccgacgtgtggaatatagatgaaaagatcctagctgtgggtcataatgaagcgtatttggacccagttgaattgacattagacaagctatacactggccccctcttggagattttagacgaggtgaattgccaagattcagacgccgatcgcaaaaatggtgtatttttcaactctccagaaacttcactcttcttttatattgatttcaagtcggatgataacgaactaacttataaactgctgatggagcaatatttcaaatctctgattgattctggatatttgacatattacgatatgaagaaggatgaaattatttggagacctgttactgtgatactaacgggcaactacccgacgtcattggatattttagacaatggaaatgataacggctattttgagtcaagtcaaaggtttgcatttctagatgcgccgttgttaagtttggagcccaaatactcaaagctatctgtagctgcgacggtttcgttcagccaattaatgaaacattgtggttctgatcattggaaagtatcgctaagaggtcgtatggattcgaatgagatcagttgtgctaaaagcataattgatggtgctcacgcattgaaacttaaaacaagaatttggggagccccaacctggccagctaacctggtggaaactatttctcgccaaattattcatgacttgggttccgatttacttaacctggacaatttattcatggcatcgtcattgatataa

SEQ ID NO: 2740 - DNA, 1176 bp, Saccharomyces cerevisiae
atggaaaataccacgaatcgtaatactgcaggcgttcttacgagcagcaatggtaactttgccaccaatagtgtagcggcatcaactccgaagaggtccaaaagtgctcgaaggaaaacgttcaaatgcaccggatatgacggttgtacgatgtccttcactagagcggaacatcttgcacgtcatataagaaagcacactggtgaaaagccgttccagtgtcctgcatgtttgaaattcttcagtagagttgataatttgaaacagcatcgggaatcggtccatgcacataaaaaccaccattctaccagctcgcaccagcgtaagccttcctcttcatctttatcctcctcttcttctgcatcttcttcgtcttctgcttcatcatctacatcatatagtgatccttacaggaaaactaatattaatagcgggaacatgccgatgatggcagaaaacgaaaaagcgccccaaataatacattcttcgccggagttcattactagcacgagaagcatcccacccatctctccaaggtccatttataatacccaacgacagcaacaacaccaacaacaacagcatcaacaggctccctattattttccttcccatccaatcactgatagttactaccagtatcctcttcccagtaataataacaccatcaattatttaccatcagtagatgtgcagtatcctttgaatgtgagcccctcctcaacgagccatccggcctctgaggtaatcatatcgtcctttcctccgaggtccatgccaagtacttccttcaaatataaagattctgccgactttcaagcacggacaactatgaacaaatacaatattagaccaagcaatatcaatgtcaatactagtaatatcaataaccatcttgattcattctccccgccgttttctccgtcaacgacagttgctgaagcaaaaccaattattttaccacagtatcagcaggcatttagccaaccaccaaatggaaataaaaacaataatatgtcttcctcgaagaatggcggcaaagggggagaaaatttcaagaatactgatgatcgcaatgataataataacaaaaagaggtcggaaactttatcagagtctgatatttcggtcaacaccaataagaaaaggcttagtgttgattacatattgacttga

SEQ ID NO: 2741 - DNA, 1176 bp, Saccharomyces cerevisiae
atggtaaaggagacggagtattatgatattttgggcatcaagcctgaggccacgcccactgaaatcaaaaaggcctatcgtagaaaggctatggaaacacatccggacaagcatcctgatgacccagatgctcaagcaaagtttcaagccgtaggcgaggcctaccaagtcttaagtgatccagggcttcgttccaagtatgaccagtttggtaaggaggatgctgttcctcagcaaggatttgaagatgcttctgaatactttacagcaatattcggtggtgatggcttcaaagattggattggagaattttctttgttcaaagagctaaacgaggcaacagaaatgtttggaaaggaagatgaggagggtacagcagccactgaaaccgaaaaagcagatgagagcactgatggtggaatggttaagcatgacactaataaagctgaatctttgaaaaaagataaattatcgaaggagcaaagagagaagctaatggaaatggagaaaaaaagacgggaagatatgatgaaacaagtcgacgagttggcagaaaaactgaacgaaaaaatctctaggtacttaattgctgtgaagtccaataacttggaggaatttacgcgaaaactagatcaagaaatcgaggatttgaaattagaaagttttggtctagagttattgtatttattggccagggtttacaagacaaaagcgaataattttatcatgtccaagaagacttacggaatttctaaaatattcactggtacacgcgacaatgctagatctgttaaatcagcatacaatttattgtctacaggcttagaagctcaaaaagccatggaaaaaatgagtgaagtcaatactgacgaactagaccaatatgaacgtgccaaatttgagtccacaatggctggtaaggcacttggtgtcatgtgggctatgtcgaaatttgaactggaaagaaaactaaaagacgtttgcaataagattctaaacgataaaaaggtcccttccaaggaacgtattgcaaaggcaaaagcaatgctgtttattgcccacaagtttgccagtgctagaaggtcaccagaagaagctgaagaagctagagtttttgaagagctaatcctaggtgagcaggagaaggaacacaaaaaacatactgtggccagataa

SEQ ID NO: 2742 - DNA, 1176 bp, Saccharomyces cerevisiae
atggtttcattgttcaaaagaggtaaggctccaccgctcacgaaagaaggccccacttctaaaaagcctcctaacacagcgtttagacaacaaaggcttaaggcatggcaaccaatactgtctcctcaaagtgtgcttccgttgttaatattcgttgcatgtatatttactcctattggtattggactcattgtaagcgctactaaggtacaagatctaacaattgattatagtcattgtgatacaaaagcatctacaactgcttttgaagatataccaaagaagtacattaaatatcactttaaaagtaaagttgaaaataaaccacaatggaggctaaccgaaaatgaaaatggcgaacaatcatgcgaactgcagttcgaaatcccaaacgatatcaagaaatccatttttatatattataaaataaccaatttttatcaaaatcatcgcagatatgtccaatcgtttgacacaaagcaaatattaggggagcctatcaaaaaagatgatctggatacaagctgtagtccaataagaagtagggaagacaaaataatatatccctgtgggttgatcgctaattccatgtttaatgatacattttctcaggtgttgagtggtatagatgacacagaagactataatttaactaacaagcatatatcatggagtattgatcgtcacagatttaaaaccaccaagtataatgctagcgatattgttccaccgccaaactggatgaagaagtatcccgatgggtatacagatgaaaatcttcctgatatccatacttgggaagagttccaggtatggatgaggactgcagcctttcccaagttttacaagttgacgttgaaaaatgaatctgcttctttaccgaagggtaaatatcaaatgaacattgagttgaattatccgatttcactctttggtggcacaaaatcatttgtactgactacaaatggagctattggtggtagaaatatgtcactaggcgtactgtacctcatcgttgcagggctttgcgccttatttggcatcatttttttggttaaattaatcttccaaccaagagcgatgggtgatcacacttatttgaattttgatgatgaagaaaacgaggattatgaggatgtacacgcagagaatacaacattgagggaaattttatag

SEQ ID NO: 2743 - DNA, 1176 bp, Saccharomyces cerevisiae
atgtctgctgctgctgatagattaaacttaacttccggccacttgaatgctggtagaaagagaagttcctcttctgtttctttgaaggctgccgaaaagcctttcaaggttactgtgattggatctggtaactggggtactactattgccaaggtggttgccgaaaattgtaagggatacccagaagttttcgctccaatagtacaaatgtgggtgttcgaagaagagatcaatggtgaaaaattgactgaaatcataaatactagacatcaaaacgtgaaatacttgcctggcatcactctacccgacaatttggttgctaatccagacttgattgattcagtcaaggatgtcgacatcatcgttttcaacattccacatcaatttttgccccgtatctgtagccaattgaaaggtcatgttgattcacacgtcagagctatctcctgtctaaagggttttgaagttggtgctaaaggtgtccaattgctatcctcttacatcactgaggaactaggtattcaatgtggtgctctatctggtgctaacattgccaccgaagtcgctcaagaacactggtctgaaacaacagttgcttaccacattccaaaggatttcagaggcgagggcaaggacgtcgaccataaggttctaaaggccttgttccacagaccttacttccacgttagtgtcatcgaagatgttgctggtatctccatctgtggtgctttgaagaacgttgttgccttaggttgtggtttcgtcgaaggtctaggctggggtaacaacgcttctgctgccatccaaagagtcggtttgggtgagatcatcagattcggtcaaatgtttttcccagaatctagagaagaaacatactaccaagagtctgctggtgttgctgatttgatcaccacctgcgctggtggtagaaacgtcaaggttgctaggctaatggctacttctggtaaggacgcctgggaatgtgaaaaggagttgttgaatggccaatccgctcaaggtttaattacctgcaaagaagttcacgaatggttggaaacatgtggctctgtcgaagacttcccattatttgaagccgtataccaaatcgtttacaacaactacccaatgaagaacctgccggacatgattgaagaattagatctacatgaagattag

SEQ ID NO: 2744 - DNA, 1179 bp, Saccharomyces cerevisiae
atgagatttcacgatagtatacttatcttcttttctttggcatcgctttatcaacatgttcatggtgcaagacaagtcgttcgtccaaaggagaaaatgactacttcagaagaagttaaaccttggttacgtacggtttatggaagtcaaaaagaattagtcactcctacggtcattgccggtgtcactttttctgaaaaaccagaagaaacaccaaatccattgaaaccttgggtatctttagagcatgatggtaggccaaaaaccattaaaccagaaatcaacaaaggtcgaaccaagaagggaagacctgattactcaacttacttcaaaacggtaagttcccacacatattcttatgaagaattgaaggctcacaatatgggccctaatgaagtttttgtagaagaagagtatattgatgaagatgacacctacgtctccctgaatcctattgtcagatgtactcctaatctttacttcaataaaggtctagcaaaggatatccgcagtgagccattttgtaccccttatgagaattctagatggaaggttgacaagacttacttcgttacttggtatacaagattttttacagatgagaattccggtaaagttgctgataaggttcgtgttcatttgtcctatgttaaagaaaaccccgtagagaagggcaattataaaagagatatccctgcaacttttttctcttccgaatggattgataatgacaacggtctaatgccggttgaggtcagagatgaatggctgcaggaccaatttgatcgtaggatcgttgtatcagttcagccaatatacatatcagatgaagatttcgatccactacaatacggtattttattatacatcactaagggttcaaaagtgtttaagcctactaaggagcaactggctttagacgatgcaggtataacaaatgatcagtggtattatgttgcattatctatccctactgtcgtggtggtatttttcgtcttcatgtactttttcttatatgtcaacgggaaaaacagagatttcacagatgttactagaaaagctttaaacaagaaacgccgtgttttgggtaagttctcggagatgaagaaattcaaaaacatgaaaaatcacaagtacaccgaattgccatcttataagaaaaccagtaaacaaaattag

SEQ ID NO: 2745 - DNA, 1179 bp, Saccharomyces cerevisiae
atgcctctgtcacaaaaacaaatagaccaagttagaaccaaagtgcactacagtgaagtagatactccattcaataaatatttagacatcttaggaaaagtaaccaagctgacaggaagcattataaatggcacattatccaatgatgatagcaagattgaaaaacttactgagcaaaatatctcccaactaaaagaaagtgctcatcttcgatttttggatctgcagtcatcaattgacacaaagaaagtagcagacgaaaattgggaaacatgccaacaggagacattggccaagctggaaaatctcaaagataaattgcctgatataaagagcatccatagcaagttgcttttacgtattggaaaactacaaggtctttacgattctgtccaagtaattaacagagaggtggaaggcttgtcagaaggccgtaccagccttgtggtgacacgtgcggaatgggagaaagaacttggcactgatctggtcaagtttttaattgaaaagaattatctcaaactagttgatccgggcctgaaaaaggatagttcagaggagagatatcgtatttatgacgatttctctaagggcccaaaagagttagaaagtatcaacgcctcaatgaaatcggatatagaaaacgtaaggcaggaggtatcgtcttacaaagagaagtggctaagagatgcagaaatatttggcaagatcacatcaatattcaaagaagaacttctgaagagagatggcctgctcaatgaggcagaaggagataacattgatgaagattatgaatcggatgaagatgaggaaagaaaagagaggtttaaaaggcagagatcaatggtggaagtgaatactatagaaaatgtggacgaaaaagaggaaagcgatcatgaatatgacgatcaggaggatgaagaaaatgaagaggaagatgatatggaagtagacgttgaggatataaaagaggataatgaagttgatggggaaagcagtcaacaagaagataatagtcgccagggtaataatgaggaaacagacaaagaaactggagtgatagaagagccagatgcggttaatgacgcagaggaggcagatagcgatcactcaagcaggaaacttggaggcactacaagcgattttagtgcgtcttcctctgttgaagaagtaaaatga

SEQ ID NO: 2746 - DNA, 1179 bp, Saccharomyces cerevisiae
atggcagacacaccctctgtggcagtacaggccccaccgggctatggtaagacggagttatttcatctccccttgatagcactggcgtctaagggcgacgtgaaatatgtgtcgtttctgtttgtaccgtacacagtgttgcttgctaattgcatgatcaggttgggccgacgcggttgcttgaatgtggcccctgtaagaaactttattgaagaaggttacgatggcgttactgatttatacgtggggatctacgatgatcttgctagcactaatttcacagacaggatagctgcgtgggagaatattgttgagtgcacctttaggaccaacaacgtaaaattgggttacctcattgtagatgagtttcacaactttgaaacggaggtctaccggcagtcgcaatttgggggcataactaaccttgattttgacgcttttgagaaagcaatctttttgagcggcacagcccctgaggctgtagctgatgctgcgttgcagcgtattgggcttacgggactggccaagaagtcgatggacatcaacgagctcaaacggtcggaagatctcagcagaggtctatccagctatccaacacggatgtttaatctaatcaaggagaaatccgaggtgcctttagggcatgttcataaaatttggaagaaagtggaatcacagcccgaagaagcactgaagcttcttttagccctctttgaaattgaaccagagtcgaaggccattgtagttgcaagcacaaccaacgaagtggaagaattggcctgctcttggagaaagtattttagggtggtatggatacacgggaagctgggtgctgcagaaaaggtgtctcgcacaaaggagtttgtcactgacggtagcatgcaagttctcatcggaacgaaattagtgactgaaggaattgacattaagcaattgatgatggtgatcatgcttgataatagacttaatattattgagctcattcaaggtgtagggagactaagagatgggggcctctgttatctattatctagaaaaaacagttgggcggcaaggaatcgtaagggtgaattaccaccaattaaggaaggctgtataaccgaacaggtacgcgagttctatggacttgaatcaaagaaaggaaaaaagggccagcatgttggatgctgtgtctgctga

SEQ ID NO: 2747 - DNA, 1179 bp, Saccharomyces cerevisiae
atggccttatttaacgtagaaggttggtctattaagacaaaaaccgtcgcttttgataacaagactaataagtcttcaaaagataaaaaaaaaaataatagaaaaaatggcaaacttacaagagaacagaagttgaaagaagagacagaggctgagttgaaggaacaagtggaagacattccttccgaaggatcagtagccaaagacatcccaaaaaaaaaccaagagaaaagtgatcaaaatgaaacgagcaagaaacgcaagcacgatgaagaagcccctctgatgcaagtaaaagaaaatattgaaaaacctacaaagaagcaactaacccctttacaacaaaagatgatggctaaactgactggttctagatttagatggatcaatgaacaactgtatacaattagctctgatgaagctttgaaattaataaaagaacaaccacaattatttgacgaatatcatgatggttttagatcacaagtgcaagcatggccggaaaatccagttgatgtttttgttgaccaaattcgttatagatgcatgaaacctgtgaatgctccaggtgggttaccaggtcttaaggatagtaaagaaatagttattgctgatatggggtgtggtgaagctcaattagcattagaaatcaacaattttttcaaaaattacaataagaaagcgaagaaatatttgaaaagacgccataaagtccacagttttgatttgaagaaagctaacgaaagaataactgtggcagatattagaaatgtgccgctaccagatgagtcctgtactatagtggtcttctgcctggctctaatgggtacaaatttcctcgatttcataaaagaagcttataggattttagcgccaaggggtgaattatggatcgcagaaattaaatcaaggtttagtgacggcaaaggtaatgaatttgtagacgctttgaagctgatgggattttttcacaaaaagaccttcgacgagaataagatgtttacaagattcgaatttttcaagccacctgcggagattattgaagagagaaggcagaaattggaaagaagacaaaagtttattgaagttgaaactgagaaggaagaattagaaaagaaaagacggaaaattgccgaaggaaaatggctcttgaagccctgtatttataaaagaagataa

SEQ ID NO: 2748 - DNA, 1179 bp, Saccharomyces cerevisiae
atggctactgcgttatatactgcaaacgatttcatattaatctcgttgcctcaaaatgctcaacctgttaccgcccctggctccaaaactgattcatggttcaatgagaccttaatcgggggtagggcatttgtttctgatttcaaaattcccgaattcaaaattggctctttagacacattgatagttgaatcggaagaactgtctaaagtagataaccaaattggggcttctattggcaaaatcattgaaattcttcaaggcctcaacgagaccagcaccaatgcttacaggactttacctatcaataatatgccagttcctgaatacttggaaaattttcaatggcaaaccagaaagttcaagttagataagtctatcaaagatttgataacattgatttctaatgaatcttctcaattagacgccgacgtcagagctacttatgcaaattacaacagcgctaaaactaacttggctgctgctgagagaaagaagacgggtgacctttctgtcagatccttgcatgatattgtcaagcccgaagacttcgttcttaattctgaacatttaactactgttctagtagcagttcccaaaagtttaaaatccgatttcgaaaaatcgtacgaaactttatccaagaacgttgtaccagcatctgccagcgtgattgcagaggatgctgagtatgttttgttcaatgttcatttgttcaagaaaaacgttcaagaattcacaacagctgctagagagaagaaattcattcctcgtgaatttaactactcggaggaattaattgaccagttgaaaaaagagcatgactctgctgccagtttagaacaatctttgcgcgtccagttggtaagattggccaagacagcttatgtcgatgtttttataaattggttccacatcaaggccttgagagtttacgtggaatctgttttgcgttacgggttgccacctcactttaacatcaagattatagctgtcccaccaaagaatctctctaaatgcaagtctgaattaattgatgcttttggatttcttggtggcaatgccttcatgaaggataaaaaagggaaaattaacaagcaagatacttctcttcaccaatatgcttctcttgtcgacacagagtatgaaccatttgtgatgtatataatcaatttataa

SEQ ID NO: 2749 - DNA, 1179 bp, Saccharomyces cerevisiae
atgtccaactttaagaattttactttaaattcctttgaagattattacggaaagccctctgaaacgccaaaaatggaggaagagaaattggaagtaacaaatgtgaatgcgtcctcttcaaaaaaagtacataaaagcaaaaagagcacttcaaaatatgaccaaaagaatgtatttagaaactcaatgacaggaattgcacaaatactgccaacaaaacctgtgaaaattatagagcagaatattgattttgccaatccgaagagcttcgacctcctgcaatctacacatactatttgctttaataaaagaattaacactactaataccaagttgaatgtggaaactcatacttctagtgatattgacaacgacatattgcacgttggagcccccacagacttggggggaaacagtaatgacgaagcggaaacaaggcaactaaggaagtttcgatggtccaataataaagaaaaaagtctttgtgaaaagttaacagtcatatattgggccctcttgctccacacaacaaagagagcaagtaaaaggagacctatattatgtcatcaaatgatagctgagttttttaacagagtttataaggagaaatcaagagtacctataacttcaagatatattagagataacctcgtcgcttgggtcactcaaggaaaggaattgcatgaaaaaggttgggtaggggatgccaaaactggcgatttgcaagaacagttcaatatagccactgtcaaattatatgaaagcgcagaagacgggcgtctttccattggtaaagacaaaccctttcgagaggaaaacaccggcagtgatagtttggttcgagcggaagaggactctaccgctgtcactaatgaaaatggacatatttcttcagaaaaaaacttgaaaaaagatcgtagagagtctataaggaaccaaatcctgactttagacctaaatgacgaagattttttccaaaatgtaatgaaagttttatcagccattgatgaaccagaactgagacaatatgtaatcgtaatctcagaattagttagcatggaaatggatgatggtaaaacggtacgagaaaagctccgagacgttgaattgaatattaataggttgcaggttgatataaaagaaataaaggaaatgcttgttacactgataaacaaatga

SEQ ID NO: 2750 - DNA, 1179 bp, Saccharomyces cerevisiae
atgtctgatatgcttccattggctacgtatagcctgaatgttgaaccatactccccaaccccagctctgaacttcaaaattccggttaccattagaatcacaatggcggccatcgaccctgagccctttgacgatgacaaaaagccatctactttaagaataatcaaaaggaatcctgaactcactcgcggtgagtactacaaccaagataacaatgacggcctcgaagaggatgaaagtgaaagtgaacaagaagcagatgtaccaaaaaggagtgtcaaatcaaaaaaaggtaaggcagtcgagcaaagtgaatcagaagactctgaagatgaaaacgaaatcgacgatgaattcgaagaatgcgttcttttaaccttatctccaaaaggccaatatcaacaagctttggatattaccattgcaccagaggaagacgttcaattcgtcgttaccggttcatacactatctctctaaccggtaactacgtcaaacatccattcgacaattcttcagattcagacgaagatgaagaagactattacagtgacgaagaatcttccaatggagaagaagaagaagaagaagaagaagaggacgatgaggaactaagttccggtgatgacgatcttgatgatttagtagatgctagtgacatcgaaagtcgtcttgatgaattagtcaaaaaggacgaaaagaagaaaaacaacaagaaggacagtaaaaggaaacatgaggaagatgaggaagaaagtgctaaacctgccgagaaaaaacaaacgaccaagaaagacaagaaagcagagaaagttaaagactcggaagagagcaaaccaaagccaaagacgaagctactggaaggcggtattatcattgaagaccgcgtcacaggaaaaggcccacatgccaaaaagggtaccagagttggaatgagatatgttggtaagttgaagaacgggaaagtttttgacaagaatacaaagggtaagccttttgtttttaagttgggccaaggcgaagtaattaaaggatgggacatcggtgttgctggtatggcggtcggtggtgagcgtagaattgtcattcctgctccatatgcctacggtaaacaagctttgcccggtattcctgctaactctgaattgacatttgatgttaaattggtctccatgaaatag

SEQ ID NO: 2751 - DNA, 1182 bp, Saccharomyces cerevisiae
atgaataggaatacgactaccaataagaacgcgaatttgaataacagtagaaatgctaacgctcccggtgaagcaggtcatcagaacaagacgggattgatatactggactaaccctagcaagtcgggtgcgagctttgctgcgactctggtgagtttgctgatcctcagaaatgtcaatgttatttctgttttacttaagatcggatacatggtgttgttcacgagttttgcggtggagctttctacaaaggtgctatttgataaaggagtagtgtctaggtttggcatgcaagagtctccggaccttgttggcgtcttaaagcctcatatcgaccgcgaattggatcgtctgcctgcgttagaggacagaatcagaaagttagtgtttgcacacagaacaagaaacaattttaccattggtgtttccctctatttcttgcacggcctatttgctatattctctatgaacactgttttgataatgaccaccatctttttgtacactgtgcctttaatctacgatagaaagcaggctagaattgaccgtgctatcgacaggatgaaggatctagttattcataggtttcacaaaaattacaacaaggtggttgaaaagactgaaccatacattgacaagattatcccaccccaaaccgatgaaggcagctactcaacctctatcagtaacgaaaacaaatcttctacttctcaacgtaacaagagcggcctttcctcttctgagtttgacaacatgaacgacacgtcagcctccaaaagtggcaaagacagctattctacctctcaatataaccgagccgaatatccagtttctcagaatgagaatattggcaccttaaaatctgggaagcaggaaataccaacagagaaggatttcaacaacaggcatgaaaacttcagtaaaccagatgtcaagacatatgatccaagaacagttgatattgaagaagaattagcagctcatcagcgtgaactggagcaaaacctaaaagatggtgattacaatctggtaggaagcaaggaaatcccagatccaatcaccgttccagctccaactagacacaccactaaacccgccgaaagccaatcgattcccatcaagaataatgaaaccttacacaaaaccacgcacggcctaaagcaaaaattgcaacacgcataa

SEQ ID NO: 2752 - DNA, 1182 bp, Saccharomyces cerevisiae
atgacggatattcaactaaatggaaagagtacattagatactccttctgctaccatgtcagcaaaagaaaaagaggcaaaattaaaatcggctgatgagaataacaagccaccgaactacaaaagaatttctgacgatgatttatataggcactcttctcagtatagaatgtggtcatacactaaagatcaacttcaggagaaaagggtagataccaatgcccgagcgattgcttacattgaggaaaatttattaaaatttagagaagcacacaatttaacagaagaagaaataaaagtactagaagcaaaggctatccctttgacaatggaagaagaactcgatttggtgaatttctacgcaaaaaaagttcaggtaatagcacagcatctaaatttgccaaccgaagtagtggccactgcgatatccttttttaggcgttttttcttagaaaattctgttatgcaaatagatcctaaaagtattgtacatactactatctttctagcctgcaaatcggagaactattttattagcgtggactcgtttgctcaaaaggccaaatctactagagatagtgttctcaaattcgagtttaagttgttagaatcattgaaattttcactgttgaaccatcatccttacaaaccgcttcatgggtttttcttagatatccagaacgtcctttatggtaaggttgatttaaattacatgggccaaatatacgataggtgtaagaagagaataactgccgcattattaaccgatgtcgtatatttctacactccaccccaaataacactagcaacattattgattgaggatgaagccttggtcacaaggtatttagaaacaaaatttcccagcagagaaggtagccaggaatcagtaccgggaaacgaaaaagaagaaccacaaaatgatgccagtacaactgagaaaaacaaagagaagtccacagagagcgaagaatattcgatagactccgcgaagttactaaccataatacgcgagtgtaaaagtattattgaagattgtaaacctccgagtactgaagaggccaagaaaattgcggcaaaaaactattattgtcaaaatccatcaacactgattcagaaattaaaaaggaagttgaatggagaagatacttcgtccaccgttgagaaaaagcaaaaaacatga

SEQ ID NO: 2753 - DNA, 1182 bp, Saccharomyces cerevisiae
atgagtagcagtggtgtttatacgtgtaattcatgtgtcctgacctttgattcaagcgacgagcagcgggcccacatgaagtccgattggcatcgctacaatttgaaaagacgtgttgcacaattgccaccaatatcatttgagacatttgactccaaagtgtctgcagctgctgccagtactagtaagtctgctgaaaaggagaaacctgttaccaaaaaggagttgaaaagaagggaaaagcaagcattgctcgaaaagaaaaagaaactgttggaaattgccagggctaatatgcttgaaaacatgcaaaagagccaagagggaaatactcccgacctaagcaagctctctttgcaagaaaatgaggagaacaaggaaaaggaagaacctaagaaggaggagcctgaacagttgaccgaggaagaaatggcggaaagagtaatgcaagaaaagctacgcaacagagtcgatattccactggaacaatgtctattttgtgagcacaataagcacttcaaagatgttgaagaaaacctggaacacatgtttaggacccacgggttttatatcccagaacagaaatatctagtcgacaagatcggcttggtaaaatacatgtcggagaagattggtcttgggaacatttgtattgtttgtaattaccaggggagaacgttgaccgctgtaagacagcacatgttggcaaagagacactgtaaaattccctacgaaagcgaggatgaaaggttggagatatctgaattctacgattttacaagctcatacgcaaactttaatagcaacacaacaccagacaacgaagatgactgggaagacgtgggcagcgacgaagccggaagcgacgacgaagatctgccacaagagtacttatataacgatggtatagagctgcatctaccgacaggcatcaaagttggccacaggtccttgcaaagatactacaagcaagacttaaagcccgaggtgatactgaccgaaggccaaggtaccctggtcgctgcagagacgagatcgttcttacctgccttcgacaaaaagggcgtgcagactcaacagcgtgtttggcaaactgagaggttcgacaagaaaaggctcgataagagaagtgccaagttcgtcaataaccaaccacactacagagaccaacttctgcagtaa

SEQ ID NO: 2754 - DNA, 1182 bp, Saccharomyces cerevisiae
atgattcaagatccccttgtatatttagacatctccattgataaaaaaccaattggtcgtattgtctgcaaactttttcgtgagaaggctcctaaaacaacagagaatttttataagttatgcgctggtgatgttaagagtcctttgaaggatcaacagtacctgagctataagggaaatggttttcatagagtcgttaagaattttatgatccaggcaggtgacattgtctttgggacacaaaaggattcctcttcatcgtctgttggaaaaggtggatgttcaatttacgctgataaagaggaagtgaaaaccgatgatgaatctttctgttacgggaattttgaagacgaaaacttgggagagtttgtagaaccctttaccttaggtatggccaatttaggttctccaaatacgaacaattcccagtttttcataactacatacgccgcacctcatttgaacggcaagcattctatttttgggcaggtggttcatggaaaatcagtggttcgcactatagaaaactgcagggtagattctgatggagtccctgaatcagacgttagaatcagcgactgtggagtgtgggaaaaaactatgggtgtcccgctttacaacgcttctaatgaccaaattggcggtgacgtatacgaagaatatccagacgatgatacacatttcggtgacgatgattttggtaaggctcttgaggctgctaatataatcaaagaatctgggacgctcttatttaagaaaaaggattactctaatgcctttttcaaatacagaaaatctttaaattatatcaatgaatacatgcctgaacccgacgtagacaaagaaagaaacatccaatttattaacctaaagatgaaaatttacctaaatttatctttggtgctctttaatctggaaagatacgatgatgctatcatgtatgctacgtatttattggagatggataacgttcctaacagagatcaagcaaaggcttattatagaagaggtaacagttacttaaaaaaaaagagactagacgaagctttacaagattatattttttgtaaagagaaaaatcccgatgacgaagttatagaacaaagaatagaatatgtcaataggctcatagaagagaataaggaaaagacaagaaagaatatatcaaagtttttctcctaa

SEQ ID NO: 2755 - DNA, 1182 bp, Saccharomyces cerevisiae
atgctttccagaacaatccgtacacaaggttccttcctaagaagatcacaactgaccattacaagatcattttcggttacattcaacatgcagaatgcacaaaagagatcacccacaggaattgttttgatgaacatgggtggcccctctaaagttgaggaaacatatgattttttgtatcaattatttgccgataatgacctaattcccattagtgctaagtatcagaagacaattgctaaatatattgctaagtttcgtacccccaagatagagaagcaatatagggaaattggtgggggctccccaatccggaaatggtctgagtatcaagccactgaggtctgtaaaatcttagataaaacctgtccagaaacggcgcctcataagccttacgtggcgtttcgttacgcaaagccgctaaccgcagaaacttataaacaaatgctaaaagatggcgtgaagaaggcagtggccttttctcaatatcctcatttctcttattccactaccgggtcatccatcaacgaattgtggagacagattaaggcattggactccgagagatctatatcttggtcggttattgatcgttggcctacaaatgaaggtctaatcaaggccttctccgaaaatatcaccaaaaaactacaagagtttccgcaacctgtcagagacaaggttgttttattgttttccgcacattctctacccatggatgttgttaacaccggtgatgcctacccagctgaggtagctgcgacggtttacaacatcatgcaaaaattaaagtttaaaaacccttataggttggtttggcaatcccaagttggaccaaaaccatggttgggagcgcagacagctgaaattgcggaatttttaggccccaaagttgatggcctaatgtttattcctatcgcctttacctctgatcatattgaaacattgcatgaaattgacttaggcgtcattggggaatcggaatataaggataaatttaagagatgcgaatctttaaatggcaaccagacctttattgaaggcatggcagatctcgtcaaaagccacttacagagtaaccaactctattctaatcaactacctcttgattttgcacttggcaagtccaatgatcctgtaaaggacctttcattggtatttggcaatcacgaatctacttga

SEQ ID NO: 2756 - DNA, 1182 bp, Saccharomyces cerevisiae
atggcgaactcattagacagactgagagaacacttaaagaacggcgataaactggttctaaaaaataatgagggacagtctactgatgatattacgaaagcaaccatggtagaaactctatccagtgatggtagtacccaagatagttttccattgaatgaagaaacggaaattgagattgatggttcattggtacagttacgaataattgttcattgttggatgaataaggactcaagtgccgcagactatctagcagactgtcagaataaacaattgactaatgtttcatttttacaaagaactgatttaataaattggttgtctggcaatacggaatcatcccaatatctgaaagcacccggtcagaaaggcgagacatccgataaagtagatatagaaaataaaactttggctggtgaattgtcgactgtaaaatcaaccacttcagcatctcttgaaaatgatagtgaagtttccgatccagttgtggtggaaacaatgaaacatgaacgtatattggtggaccacaactctgcattgcgtggtgctaagccgatcaactttggttatctaataaaagatgcagaactaaaattagtacagtcgatcaaaggatctttacgaggatctaaattgcctcccggtcataagggcgcgcacggtcgtatttccaaaacaaatggttcatcaggtggccctcgcaaagatccaattattttgattccttcggctgcgtcatcaattttaactgttgcaaatataaaacagttcctgctggagtcaaaatacgtgaatcctcgtaacttaccgtcagtgccaaacggattagttaacatagagaaaaacttcgaacgtatatcaagaccaattagatttattatagtcgataacactaggatgtttactaagccagaatattgggacagagttgtcgctatcttcactactggtcatacgtggcagtttaataactatcagtggaattcgccacaggaattatttcaacgctgcaaaggctactatttccactttgccggtgattctgtaccacaacacgtgcagcaatggaatgtagaaaaggtcgaacttgacaaaaataaaagatttaaggatgtggaagtcgtgcgttatttctggcatagtttagaaaaggaacttatttcaagaggataccgttga

SEQ ID NO: 2757 - DNA, 1182 bp, Saccharomyces cerevisiae
atggcgaagattatgatcccagctagcaagcagcctgtttacaaaaaattaggacttcttctggtcgccgtgtttactgtgtatgtgttctttcatggagctcagtatgcgagaggctctgccccaagcccaaagtacagtaccgtgctatcttccggctcgggctataaatactcgaaagtggaactaccaaagtataccggtcctcgggaaaaggccacttttgtcactctagtgcgtaatagagatctatattcgttggctgagtctattaaatccgtggaagatagatttaactccaagttcaactatgattgggtgtttttgaatgatgaagagttcactgatgaattcaaaaacgttacgtcagctttagttagtggtacaacaaaatacggtgtcatcccaaaggaacattggtccttccctgagtggattgatgaagaaaaggccgctcaagtcaggaaggagatgggtgagaagagaatcatctacggtgattctatctcttacagacacatgtgtcgttttgaatcaggcttcttttacagacatcctttgatggatgactacgattggtattggcgtgtggaacctgatatcaagttgcactgtgatatcgactacgatgtcttcaaattcatgaaagacaataagaaaaagtatgcctttgccatttccattaaggagtatgaagctactatccccactttatgggagactactcgtaaattcatggaagcccatcctgagcttatccatgaaaataatatgttagactttgttagcgacgatcagggactttcatacaatttgtgccatttttggtctaattttgaaattgctgctttggatttgtggagatctccagcatactccgcatattttgattatttagatcgtgaaggtggattcttttatgaaagatggggtgatgctccagttcattctattggtgctgcgctgttcttggaccgctctgaaatccatcacttcggtgatattggttattaccatgttccatttcactcctgtccaatagacacaagtatcagactggctaacaaatgtgactgtgatccaagcaaagatttcacatggcacagttattcatgtactactaaattctacaatataaacaagttgccaaagcctgctggttggcaaaaccatatcggttga

SEQ ID NO: 2758 - DNA, 1182 bp, Saccharomyces cerevisiae
atgggactgatattaaggtggaaagagaaaaaacagttgtctagtaagcaaaatgctcaaaaatccaggaaaccggcaaacacatcgtttagacaacagcgcctcaaagcctggcagcccatcttgtcgccacagagcgtactgccgttgcttattttgatggcatgcgtcttcgcacccattggtatagggctggtggtcagcacgataagtgtccaaagactagtggtaaactacacagaatgtgatgcattggcaccggcgaagcattttgaaacgattccctccgagtacgtggactaccacttcagtaagaaagtcgcagtccaacctcaatggatggtacttacggatcctgaattaggcaatcaaacttgtcgaatacagttcgaagttccaaatcatatcaagaaatctacttatgtttattaccgcctaacaaatttcaatcaaaactatagagaatatgtgcaatctcttgacctagaccaattaaaaggaaaagcattgatcggaaatgatctggatccaaactgtgaccctttaaggacggtagaaaataagaccatattcccctgtggattgatagcaaattcgatgttcaatgatacattcggcacaacacttactggtgtaaacgatactgcagattatttgcttaccacaaaaggtattgcgtgggacaccgacagccacagatatggaaagaccgaatacaatgcatccgatatcgtaccgcccccaaattgggccaagttatttcccaatggctacactgacgataacattccagacctacaaaactgggaacagttcaaaatatggatgagaactgctgcattgcccaacttctataagctagcaatgaaaaatgagaccaatgggttaggtaagggtatttacattgctgatatagaactcaactacccagtaagatctttctatggaacaaaatcttttgtattaaccacaaacagtattatcggtgctggaaacgaggcattagggattgtttatttgattgttgccgggattgcaactcttttcgccatactattcctgataaaagtcatcttcaaaccaagacctatgcatgatcatagctacctaaattttgagaacagcgataccccattcgatgagagtagtgtcgttagtattccattgagagaaattttatga

SEQ ID NO: 2759 - DNA, 1182 bp, Saccharomyces cerevisiae
atgggtcaattgctttcccatccgttgacggagaagaccatagaatataatgaatataaaaacaaccaggcgtcaactggtattgttccacgattttacaattgtgtggggtccatgcaaggctatcgtttgactcaggaagatgcacatctaattagaaatgaaaactctgttgtgtacgtacgatttttcaacccattcatagacaaatacgaaaccctgtcattgaacgtcttcgcagtattcgatggtcatggtggagatgattgttcgaaatttctaagcggcggccgccaccatcgcgatggtaacggcagtagcaacggtaatggtgaacccaacgctggcctgatcaaatggattgcgtatagtttcgaaaaccaccattacacatctacaactaataacgactcatcaaaatttaaaagatccttcaatacgttggaaggacttgtttctcaaatttttaaagacgctttcatattgcaagatgaagagttatatcgacattttgccaacagttcgtgtggatctacagcagtagtagcatgcatcataaacgaggaatcactgtatgtggctaactgtggtgattcgcgatgtattctttcctccaaatcgaatggcataaagacgatgtctttcgatcataagccacaacacataggagaattgatacgtataaacgataatggtggtactgtctctcttggaagagtgggtggagtactggctctcagtagggcatttagtgatttccaattcaagagaggtgtcacttatccacatagaaggacaaaactaacaaatattacccagaatttaacttatggaaccccaccacaagaagcacaagttaccgttgaaccagacgtattgatgcacaagattgactattctaaagatgagtttttagtactggcttgcgacggtatatgggatatttataacaacaaacagttaattcactttataaagtatcacctggtatcagggacgaagttggatacaataataacaaaattgttggaccacgggatagcgcaggcaaatagcaatactggtgtcggctttgacaatatgactgccatcattgtagtgctaaaccggaaaggcgaaacattgcaagactggtttaataaaatgaagacccgtttggaaagagaaaggggcctagtgtaa

SEQ ID NO: 2760 - DNA, 1182 bp, Saccharomyces cerevisiae
atggtgtcgaaggatcaaacgtcctttaataagaggtggaccttgggtcttctgatgttgggtctagtcattattttgtgggttttatcgtccttcctgataaatttgatcttcgaggatgactcgtatagaaaaccattctttatcacgtacaccaatactgccgcctttatcttttatctttttccaactgcaaaggccgttgtggtgaattacaaggacacaggccgtgcaaacgttcaccgcgaactaattatggaggaagaaggtactggtagtgatagcaatcgctcggttgatatgactagcccactgcttacaaaccttgaagcaggcacgcatgccaaccaaaagaagaggctaacgttatatgaaacaatcaagttaagtgctgagttctgcatactttggttcacagctaaccttgtgaccaatgcctcgctggcattcacatcggtggcatcgcagacaatcctctccactacttcttcctttttcaccttgttcataggtgctatttgtcatgttgaatcgttgagcaagtccaaagtactcgggtcgttcatttcctttgtaggcataatcatggtcaccaaatcagattctcatcagcgctaccaacgccatatcgcggacgttagtggtgatgataacgatgccgtgcaagttctgataggcaacttgttggcacttgcaggtgctgtactttacggtgtctacagtactttattgaagagagaagtcggagatgagactcgtgttaacatgaagattttttttggctttgttggtctctttaatttactttttctatggccatcactgattgtattggacttttttggctgggaaccattctctctgcccaaagatcctaaagttgtggtaataatcttcgtcaattgtctcatcacatttgttagcgacttttgttgggcaaaggctatgttactaacgagtcctttaaccgtcaccgtaggattgagcataacgatacccctagcaatgtttggtgatgtaatctttaagcacaaaaccatgtctgcgctctatttatttggtgctaccctcatcttaggctcatttttcatcattaacaaaagctctgaggaggaacattttgagaactcaataacggctagcaattacgaatcagtggaggtgccagcagcaaacaactga

SEQ ID NO: 2761 - DNA, 1182 bp, Saccharomyces cerevisiae
atgtcatcaagaataattgtcggcagtgcagcattggcagctgccatcacagctagcatcatggtcagagaacagaaggccaagggtcagagaagagagggcaacgtctccgcttactacaacggccaggagtacggcagttcagcacccccacagttgggaaagctacataacataaagcaaggcataaaggaagatgccttgtcgttaaaagacgcgcttctgggcgtatctcaaaaggctagggaagaggctccaaaggtaactaagcgtgtgatatcaccggaagaggatgctcagacacgcaagcagctaggccaaaaagccaaggattcttcctcgcaaagcatcttcaattgggggtttagtgaggctgaaagaaggaaagccatagccatcggggaatttgatactgctaagaagcgtttcgaagaggcagtggatcgtaatgagaaggagctcttgtccacggtgatgagagagaagaaggccgctctggacagagcatccattgagtacgaaaggtacgggagagccagagactttaatgagctttcggacaagctagaccaacaggaaaggaacagtaatcctttgaaacgcctgttgaagaataacacgggtgacgctaatactgaagaagccgctgcaagaagtgtccaaggctggggtgatacggcacaggagtttggtagagaagagttggaggaagccaagagaaatgcttcttcagagccaagcgaggcgcaaaaacgtcttgacgagctgaagaagatcaaggaaaagggctggtttggttacaacaaaggggagcaaagcgagcaacagattgctgaacgggtagccagaggtttagaaggatggggtgaaacagccgctcaactttccaaggacgaaatggacgatttaagatggaattatgagaattcaaagaaacaactggataagaacgtgtccgatgccatggactcgttatctaaggcgaaggaggacttgaaacagtacggcagccactggtggtctggatggacttccaaggtcgacaatgacaagcaggctttaaaagatgaggcccaaaagaagtacgatgaagcgttgaaaaagtacgatgaagccaagaacaaattcaaagaatggaatgataagggtgatggtaaattctggagctcgaaaaaggactag

SEQ ID NO: 2762 - DNA, 1182 bp, Saccharomyces cerevisiae
atgtcctgttctcaaaataagacttctgtcagtctggcctggcgtgaatgcatatccatcgcttccgtcctaattggcgcgtatgcatcatacaaatactataagctgttcaaaacacgcgatattccacgtccaaaagaaggcgttgaagaactcataggaaacactcctctggttaagatcagatctcttaccaaggctactggagttaacatttacgctaagttggagttatgcaacccagcaggaagtgctaaggatagagtggctttaaacatcataaagacggctgaggaattaggcgagctcgtcagaggtgaacctggctgggtatttgaaggaacaagtgggtcgactggtatctctatagcagtggtctgtaatgcgttgggttatagggcacacatttctttgcccgatgacacatcgctagaaaaattggcattactagaaagcctcggtgctactgttaataaggttaagcccgctagtattgtcgatccaaaccaatacgtaaatgccgccaaaaaggcatgtaatgaactaaagaagagtggtaatggaataagagcagtttttgccgatcagttcgaaaacgaagccaactggaaagtacattaccagaccacaggcccagaaattgcccatcaaactaagggaaatattgacgcattcattgctggctgcggtactggtggcaccataactggtgtggcaaaattcttaaaggaaagagcaaagataccttgccatgtcgttctagcggatccacaaggatctggcttttataatagagtcaactatggcgtgatgtatgactatgtagagaaggaaggtactagaagaaggcatcaagttgacactatcgtagaagggattgggttaaacagaatcactcataattttcatatgggcgaaaagtttattgatgaatcaatacgagtcaacgataatcaagccattagaatggcaaaatacctatcggtaaacgacgggctattcgtggggagtagtacagctattaatgcggtagccgctattcaggttgcaaaaacgcttcctcacggctcaaacattgtgattattgcatgcgacagcggttcaagacacctaagtaaattctggaaagaagctaaagaaatcgatcacgacgtgtcattagaagaagtaataaatatctaa

SEQ ID NO: 2763 - DNA, 1182 bp, Saccharomyces cerevisiae
atgtctagtgtaccttataattcccaacttcctatatccaaccatctagagtacgatgaagatgaaaagaagagcagaggctcaaaactaggcctgaaatataaaatgatatactggaggaaaactttatgcagttcgctagcgagatggagaaagctaatactattaatatctttagctttgtttttattcatatggataagcgattccaccataagcagaaatccatctaccacaagttttcaaggccaaaatagtaacgataataagttgagtaatactggttctagcatcaactccaaaagatatgtaccaccatattctaagagatcaagatggtcgttttggaatcaagatcctaggattgtcattatattagcggcaaacgaaggtggtggtgtattgaggtggaaaaatgagcaagaatgggctatcgaaggcatatcaatagaaaataagaaggcctatgcgaagagacatggatatgcgttgactatcaaggatttgacaacgtccaaaagatactctcacgaatacagagagggttggcaaaaagtagatatattgagacagacgttcagggagtttcctaatgcagaatggttctggtggttggacctggatactatgataatggagccttctaaatcattagaagaacatattttcgacagattggaaactctggctgacagagaattgaaaagttttaatcccctaaacctaagagacgacataccctatgtcgattattcagaggaaatggagtttctaataacacaagattgtggaggcttcaatttgggctcatttctgataaaaaatagcgaatggtctaagctgcttctagatatgtggtgggaccccgttctgtatgaacaaaaacatatggtttgggaacatagagaacaagatgcgttagaggcattatatgaaaacgaaccgtggattcgttcgagaataggatttttgcccttaagaacgatcaatgcattcccaccgggagcatgctctgaatacagtggtgactcaagatacttttacagtgagaaagaccatgattttgttgtgaatatggccggatgcaattttggcagagattgctggggcgagatgcagtactacaccactttaatggaaaaactgaataggaaatggtacacgagatttttcttcccataa

SEQ ID NO: 2764 - DNA, 1182 bp, Saccharomyces cerevisiae
atgtctctggatcgtgtagattggccgcacgccaccttctctacgccggtgaagcgtatcttcgatacgcagacaacgctggacttccaatcgtcactagccattcacagaatcaagtatcatcttcacaagtacactacgttgatatcgcactgttctgaccccgacccgcacgctactgcgtcgtcgatcgccatggttaacgggctgatgggagtgttggacaagctggcacacctgatcgacgagacaccgcctcttccaggtcctagaaggtatggtaacctagcatgccgcgagtggcatcacaagctggatgaacgtttgcctcagtggctgcaggaaatgcttccctcggaataccatgaggtggtgcctgaattgcagtattacctgggcaacagctttggttcgtcgacaagattggactacggcacgggccacgaactttcgttcatggccacggtcgcagcactggacatgctggggatgtttccgcacatgaggggggcagacgtttttctgctgttcaacaagtactacacgatcatgaggaggctgatcctgacgtatacgctggagcccgctgggtcacatggcgtgtgggggcttgatgaccatttccacttggtgtacatcttgggctcgtctcaatggcagctgcttgatgcgcaagcacccttgcaaccaagagaaatactggataagtctctggtgcgcgagtataaggacaccaacttctactgccaaggcataaactttattaatgaggtgaaaatggggccctttgaagagcattcccccatcctatacgatattgccgtcaccgttccacgctggtccaaagtgtgtaaggggcttctaaaaatgtattctgtagaggttctgaagaagttccccgtggtgcaacatttctggttcggcacaggcttctttccctgggtcaacattcaaaacggcactgatcttccagtctttgaagaaaaggaggaagagagtatagaacaggctaacgcaggatcgcccggtcgagaacagacttcaacacgattcccaacgtccacgtcaatgcctcccccaggcgttccgccgtcaggtaacaatatcaactatttactaagccatcaaaaccagtcgcaccggaaccagacttctttttcaagagatagactacgtagataa

SEQ ID NO: 2765 - DNA, 1182 bp, Saccharomyces cerevisiae
atgttgcagagacattccttgaagttggggaaattctccatcagaacactcgctactggtgccccattagatgcatccaaactaaaaattactagaaacccaaatccatccaagccaagaccaaatgaagaattagtgttcggccagacattcaccgatcatatgttgaccattccttggtcagccaaagaagggtggggcactccacacatcaagccttacggtaatctttctcttgacccatctgcttgtgtattccattatgcatttgaattatttgaaggtttgaaagcctacagaactcctcaaaatactatcaccatgttccgtccggataagaacatggcccgtatgaacaagtctgccgctagaatttgtttgccaactttcgaatctgaagaattgatcaaacttaccgggaaattgatcgaacaagataaacacttggttcctcaaggtaatggttactcattatacatcagaccaacaatgattggtacatccaagggtttaggtgttggcactccctccgaggctcttctttatgttattacttctccagtcggtccttattataagactggtttcaaagccgtacgtcttgaagcaacagactatgctacaagagcttggccaggtggtgttggcgacaaaaaattgggtgctaactatgccccatgcatcttacctcaactacaagctgccaaaagagggtaccaacaaaatctatggttgttcggcccagaaaagaacatcactgaggttggtactatgaacgtgttcttcgttttcctcaacaaagtcactggcaagaaggaattggttaccgctccattagatggtaccattttagaaggtgttaccagagactctgttttaacattggctcgtgacaaactagatcctcaagaatgggacatcaacgagcgttattacactattactgaagtcgccactagagcaaaacaaggtgaactattagaagccttcggttctggtactgctgctgtcgtttcacctatcaaggaaattggctggaacaacgaagatattcatgttccactattgcctggtgaacaatgtggtgcattgaccaagcaagttgctcaatggattgctgatatccaatacggtagagtcaattatggtaactggtcaaaaactgttgccgacttgaactaa

SEQ ID NO: 2766 - DNA, 1182 bp, Saccharomyces cerevisiae
atgttggtgctagggtctcttagatcggcgctgtcgtgcagttccacagcatcgcttattagtaagagaaacccttgttatccatacggtatactctgtcgaactctatctcagagtgttaaattgtggcaagagaatacttcaaaagatgactccagtttgaacattactccacgattactaaagattatacctaacgatactgatatcgtgactcttgagaagcaggatgaattgattaaaagacgtcgtaaactttcgaaagaagtgacccagatgaagaggctaaaacccgtctcacctggtttgagatggtaccgttcccccatttatccatatttgtacaaaggtcgtccggttagagccctaactgttgttcgaaagaagcacggtggtagaaataattcaggaaaaatcactgtccgtcaccaaggtggtggccatagaaatagaacgaggctgatagactttaacagatgggaaggtggtgcacaaacggtgcaaaggattgagtacgatccgggtagatcctctcatatcgccctattgaagcataatactaccggcgaattgtcttatattattgcttgtgatgggttacgcccaggcgatgtggtcgaatccttcagaagaggtattcctcaaactttactgaatgaaatgggcgggaaagtagaccctgctatcttgagtgttaagactacccaaagaggcaactgtctacctatttccatgatccccataggtactattattcacaacgttggcataacacccgttggacctggaaaattttgtcgctctgctggtacatatgccagagtccttgcgaaattacctgaaaaaaagaaagctattgttagattacaaagcggtgaacatcgttatgtgtctttagaggctgtcgctaccattggcgtggtctccaatattgaccatcaaaacagatctcttggtaaagccggcagatcaagatggttagggataagacccactgttagaggtgttgccatgaataaatgtgaccatcctcacggtggtggccgtggtaaatccaagtctaataaattatcaatgtctccatggggacaactggcaaaggggtacaagactagaaggggtaaaaatcaaaatagaatgaaagtaaaagacagaccaagaggcaaagatgcaagattataa

SEQ ID NO: 2767 - DNA, 1182 bp, Saccharomyces cerevisiae
atgtttaataatcatgaaattgacaccatattaagcactctccgcatggaggcagatccctctttgcatcctttattcgaacaatttgagaaattttatgaagagaaattgtggttccaattgtccgaatccttgactaaattttttgatgatgctaaatctacaccattgaggctcagattatatgataacttcgtttctaaattttatgataaaatcaaccaattgtcagtagtaaagtatctacttgcctctttgaaggattctaaggatttcgatgagtctttaaaatatttggatgatttgaaggctcaatttcaagaattggactctaaaaaacaaagaaataatggatcaaaagaccatggtgatggtattttgttgatagatagcgaaattgctagaacttacctgttaaagaacgacctcgttaaggcaagagatttattagatgatttggaaaagacattggataaaaaggattccattccattaaggataacaaacagcttctattctacaaattcccagtattttaaatttaaaaatgatttcaattctttctactacacaagtctattatacctttctaccttagaaccatctacaagcattactttagccgaacgtcaacaattggcctatgatttgagtatctcagcattgttaggtgacaaaatctataattttggcgaactattacaccatccaataatggaaactatagtcaacgattccaattacgattggcttttccaattattaaatgctctaaccgttggtgattttgataaattcgactcattgataaaagttcaaatatcaaagattcctatattggctcaacatgaatcatttttacgacaaaaaatttgcctaatgacattaattgaaacagtttttgtcaaaaatattaggatgctttcatttgaagatatttcaaaggctacacacctaccaaaggataatgtcgaacacctggtcatgagagccataagtttgggtctattaaagggttctattgaccaagtaaatgaactcgttaccatctcctgggtccaaccaagaatcataagtggtgaccaaattacaaagatgaaggacagactggttgaatggaacgatcaagtagaaaaactgggcaaaaaaatggaagctcgtggccaatccatctgggtttag

SEQ ID NO: 2768 - DNA, 1185 bp, Saccharomyces cerevisiae
atgaattacctgcgagatagatttcctccggataatgaccaaagaccctttagatgtgaaatttgttcacgaggtttccacagacttgaacataaaaaaaggcacggaagaacgcacactggcgagaagcctcacaaatgtaccgttcagggctgtccgaaaagcttcagccgaagcgatgaactaaaaagacatttgaggacacatactaaaggcgtccaaaggcgcagaataaaatccaagggctcgcgaaaaaccgttgtgaatactgctaccgccgcccctaccaccttcaatgaaaacactggtgtttcgctcacggggataggtcaatctaaagtgccacctattcttatctccgttgctcagaattgcgatgacgtgaatatacgaaatactggaaataataatggcattgtggagacacaggcacctgcaattttagtgcctgtgataaatattccaaatgaccctcatccgattccaagtagcctctccactacttctatcacctccattgcatcagtatatccctctacttctccattccagtacctgaaaagcgggtttcctgaagatcctgcatctacaccgtatgtacattcgtccggaagttctttagccctgggtgaattgtcttcaaactcctctatattttcgaaatctaggaggaatttggccgccatgagtggtcctgattctttgagtagttctaaaaaccaatccagtgcttcgcttctttctcaaacttcacatccatcaaagagcttttcaagaccgccaacagacttaagtcctctgcgaagaatcatgccttctgtaaacacaggagacatggaaatttcaaggacagtatccgtttcgagcagttcatcatcactcacttctgttacgtatgatgacaccgcggctaaagacatgggcatgggaatattttttgataggccacctgtaacacagaaagcttgcaggagcaatcataagtacaaggttaatgctgttagcagagggagacaacatgaaagggcacaatttcatatatctggagatgatgaggacagtaacgttcaccgccaagaatcaagagcatccaacacaagtcccaatgtatcattgcctccgataaagagcattttgcgacaaattgataatttcaacagtgctccttcttacttcagtaaataa

SEQ ID NO: 2769 - DNA, 1185 bp, Saccharomyces cerevisiae
atgactctacaagaatctgataaatttgctaccaaggccattcatgccggtgaacatgtggacgttcacggttccgtgatcgaacccatttctttgtccaccactttcaaacaatcttctccagctaaccctatcggtacttacgaatactccagatctcaaaatcctaacagagagaacttggaaagagcagttgccgctttagagaacgctcaatacgggttggctttctcctctggttctgccaccaccgccacaatcttgcaatcgcttcctcagggctcccatgcggtctctatcggtgatgtgtacggtggtacccacagatacttcaccaaagtcgccaacgctcacggtgtggaaacctccttcactaacgatttgttgaacgatctacctcaattgataaaggaaaacaccaaattggtctggatcgaaaccccaaccaacccaactttgaaggtcaccgacatccaaaaggtggcagaccttatcaagaagcacgctgccggccaagacgtgatcttggttgtcgacaacaccttcttgtccccatatatctccaatccattgaacttcggtgcagacatcgttgtccactccgctacaaagtacatcaacggtcactcagacgttgtgctcggtgtcctggccactaataacaagccattgtacgagcgtctgcagttcttacaaaacgccattggtgctatcccatctcctttcgatgcttggttgacccacagaggtttgaagactttgcatctacgtgtcagacaagctgccctcagcgccaacaaaatcgctgaattcttggcagcagacaaggaaaacgttgtcgcagtcaactacccaggtttgaagacacaccctaactacgacgtagtgttaaagcaacaccgtgatgcccttggtggtggtatgatctccttcagaatcaagggtggtgctgaagctgcttccaagttcgcctcctccacaagactgttcacattggccgaatcccttggtggtatcgaatctctattggaagtgcccgctgtgatgacccacggtggtatcccaaaggaggccagagaggcctctggtgtttttgacgacttggttagaatctctgtcggtattgaagacactgacgatcttttggaagacatcaagcaagccttgaaacaagccaccaactaa

SEQ ID NO: 2770 - DNA, 1185 bp, Saccharomyces cerevisiae
atgacttcacaattgaatgaattagtggaatttctgcattcaccacaacctgccgtaagacagattgccattgataatctagttggatttagtgctggtcccacttcaaaagttttcaaaaatgatagctacagacccattaaggatataataaaaatgatcatggatccagaacacggcacccgtgttattattcagcaaggtgtcactatattggtcaatttatctgaagacaagttagtaagaaatattatattgagcgatgacaagaagttcttaaaatttttggtttggaaaattgtcgatttaaccaatccaaatgccgatataatgtgtatcttattaagcaacttagccaaggatgacggcattcttgctgttctgaatatcaaaaggaattcaagcggtgaggaggtcgatgatggtttgaagttagcagctttaaataaagaagttttcaaaagtttgagagccatggattgtttaatggattgctttgttaagggttatgataaaaaattaacaaaatatgccagtttcaattatttagcctttttttttgcggatatctcgaggtttaaattgggcaggatgtattttattgaagagcaggaatacgatggggttgttcctatttcaaaattgctagtatttaccgaaaaatatgatgcaaaggtaagaagagaaggtgtcgcttccacaattaaaaattccctatttgattctgaaactcatgaaaggttactcaaagatgaaaaaataaacttgttgccttacatcctgctacctattgctagtgctaaagattctgaaattgatgaggaagatatgttcaatttaccagatgaacttcaattattaccagaggacaaggaaagagacccgattcctgcaattatatgctgtcatttagaaagtattcttttgctatgtacaacgcatgctggaagagaatacttaagagacaagtccgtttatccactagtgagggagctgcataaaaacgttgagaatgaagatattggtgaattatgttacagaattgttaatatgttaatgagaggcgagccaggtgcgggagcagtggaagagatgccatcaaagaatgcggaagaggaagaagaggaggagagtgaagaagaagaagatgacgacgaagaagatgaaattgtcgaagtggcctag

SEQ ID NO: 2771 - DNA, 1185 bp, Saccharomyces cerevisiae
atgagtcagtttggcacgacagatatcgtttccggttcagaaacaccaccttattctggggcaagttaccaggacgcccaggatgacaatacccatccacattcatcagacgccggtgcagagaagttcagtgcaggcagtggaagcgagtcgcatactgaatcctcgagaagtgatgatgaggattctcaagcaaaaacaaagatggtggataatattaccatcttaaaatatatattggattctctatctggtagagacaaattagccaaaattatcaaatacgctctggatatattaaaactgtttatcgaaaagtctaagcgaaatttaactgttttggacccttccgtattaacgtactataccaagattttgaaaaatctgactgtaaaagtcgcactaaggcatccaatcacggtaattaaagtacttctcctgtctcttttgagaaattttgacaagaaaattgattttatcagtcaacaattaagtacttttagatatattttaaggtttggcggcacaccattccgagtgtgcagtttcttggggaaattcaataaaaccagaaagtgcaactttcaaattgaccaaattaagaaaatatggtttaatgaagcttcattgagagaatttttggacttgtattatggtatctttgatgaattagacttgctatacaaattgaaaatatggacaaataaatcattctattcctttgtcagtagacaagagtctcttgcatggcaatacgacattcttttaagcttgaaggaccattggctcaacctgcaaagcttacagaagagacaattagaattggaagtgcaactaaaagttcaaaataacgcgttactactctcacccatactgatgcatcaggcccataaagacgatggctcacaatcgccaattaggaaacagttgttaaatgacctaaatgttaataacgacgcagaggtgttaatacacaaacaactaaaggccatcaaggatgaaaagacacttgtttatttagatattgcaagattatcgtttgattgcatggctaatacatcagatattctaaatttaaaaactccaaagggaacgtatgccgttctgtccctgggatccggcttaactggactggttaaactttggataacaacaaagaggtcactttgctcttcaaaagattga

SEQ ID NO: 2772 - DNA, 1185 bp, Saccharomyces cerevisiae
atgataagcccaagggtgaatactcgagtttggcagagatcaatttctcttttgagcccacaagcggccaagacggagagtaatgtcgtaactaaagaaaggacatatatcgagaacttaagcaaggatattgcgacttcccgtttcaggctagtagacgaaaatggtaaaattgcatctatcactgttcaaccagatattccaatttgtatcaaaaaggattgcctagtttccattcacaatttgaaccatttatccctttcctataaatggctgaatttttggtcaaacctgattaaatttcgttcattcaaatcttcattgtttcatagaattattggatcctccgttttagaaattctggctgccccaaactttcaaacatcgagaagacctttcgattcttcaagaagcttgtccgtactgaatttgaccgggacaaaggattggaatgtatttggcaaggattcaattatcgcatttgaacagaactccagtctggaaatcaaatcgcctatctttccctctgcaaggtctttagtctcgaactcatcaaaatcacaactaccacggaaatttcaaattctgaatgggagaggaaatgtgttagtatgtggaggtgggttggtatattcaattgagttaattgatgaaagcgacaaaattctggttaattccagaaacattttggccatcaacggccaaagtcaattggatattgcaaattcagtggagagacaagagttacacgtggaaggcgcgtacgtcggagattcaagtaatgatacggtggcacctaaattcattaagaaccaaacgctaaaatctgcttacggacatactgttcaatttttcaaaagaatgcgcagttggatccgtaaccagtacgaaaaaagatacatttatggtgtcgactcgtactttatgaagattaaaggtccaagaacaatattgattcaaacgcatgaaatgacaacatccaaagataatattctaactaaactaacgtccaagggccacgttaagaagagcaacgtgaatgataacggtgtcaatttagagaaacaagtggctaacgatgtaaattcaaagatcattgagcttgccaacagaccctcactgtttattgcgaccgtctcgcaagatgggagggttgattttcaaagtacttcgaagttcacataa

SEQ ID NO: 2773 - DNA, 1185 bp, Saccharomyces cerevisiae
atgcagagacacgtttttgcgaggaatttcagacgtctttccttattgaggaacccttcccttaccaaaaggtttcagtcgtcagcatccggtgcggccaacacccctaacaataacgatgaggtgatgctgttgcaacagaaacttttgtatgatgaaattagatcagaattgaagtctctatctcaggtaccagaagatgaaatattacctgagttgaaaaagtcattagagcaagacaaactctctgacaaagaacagcagctggaggctgaattgagtgactttttcagaaattatgctctgttgaacaagttgtttgacagcaagacattagatggacaatcttctacaacgacagcagcagccacgccaaccaagccttaccctaaccttataccttcggccaatgacaaaccatattcctctcaagaacttttcttgcgtcaactaaaccattccatgcgtaccgctaaattgggtgccactatttcgaaggtttactatcctcataaggacattttctatccgcccctcccagaaaacattactgttgagagcttaatgtctgctggtgttcacttgggccagtctacctcactttggaggtcttccacacaatcctacatatacggtgaatataaaggtattcacataatagatctaaaccaaactttgtcctatttgaagagagccgccaaggtagtagagggcgtttcggaatccggtggcattatcctatttctgggtacaagacaaggccagaaaagagggctcgaggaagctgctaagaagacacatggttattatgtgtctaccagatggatcccgggtactttgacgaattctacagaaatttcaggtatctgggagaagcaggaaatcgactctaatgacaatcccaccgaaagagcgttatcaccgaatgaaacatcaaagcaggttaagcctgacttgctggtcgtattaaatcccacagaaaatagaaacgctttgttagaagcaattaaatcaagggtcccaactatcgcaatcatcgatactgactccgaaccttctttggtgacctaccctatcccaggtaacgatgattcattgagatctgtcaatttcttactaggagtcttggcgagagctggccaaagaggcttgcaaaatcgcttggccagaaataacgaaaaatga

SEQ ID NO: 2774 - DNA, 1185 bp, Saccharomyces cerevisiae
atgcctccaaagaagcaagtcgaagaaaaaaaggtcttattgggtcgtccaggtaataacttgaaagccggtattgtcggtttggccaatgttggtaagtctacctttttccaagccatcactagatgtccattgggtaacccagctaactatccattcgctaccattgatccagaagaagcccgtgttattgtcccatctccaagatttgataagttgtgtgaaatctacaagaagacagcttcggaagttccagctcatttgaccgtttacgatattgctggtttgactaagggtgcctctgctggtgaaggtttgggtaatgctttcttgtctcacatcagatcagtcgattctatctaccaagtcgttcgttgtttcgatgatgctgaaattatccacgttgagggtgacgttgatccagttcgtgatttagaaattattaaccaagaactaagattgaaagatattgaattcgcacaaaaggctttggaaggtgctgaaaagattgccaaaagaggtggtcaatctttggaagtcaaacaaaagaaggaagaaatggatttgattacgaaaatcattaaattgctagagagtggtcaaagagttgctaatcactcctggacttcaaaagaagttgaaattatcaactccatgttcttgttgactgctaagccatgtatctatttgattaatttatctgaaagagattacatcagaaagaaaaacaagcatctgctaagaatcaaggaatgggtagacaagtactctccaggtgacttgatcattccattcagtgtttctctagaagaaagactatctcatatgtccccagaagatgctgaagaagaattgaagaaactgcagacaatatctgccttgccaaagattatcactaccatgagacaaaagttagatttgatttcctttttcacctgcggtccagatgaagttcgtgaatggaccatcagaagaggtactaaagctccacaagctgctggtgttattcataacgatttaatgaatacctttattttggctcaagttatgaaatgtgaagatgtcttcgaatataaggacgattctgccatcaaggccgctggtaagttgatgcaaaagggtaaagactatgtcgttgaagacggtgatatcatttacttcagagctggtgctggtaagaattga

SEQ ID NO: 2775 - DNA, 1185 bp, Saccharomyces cerevisiae
atggattccacagcacttaaggtagctctaggctgtattgcaattcgtttggctgtgaacagcctttttccctctctacaacaacaactggaccagtctgtagaattctcaactcccgtaacttcatttaggtcactacaggaaggtatatacctactgcggaacaacatccaagtatataatcatggggttgttcaccatcctccaattttgattttttttctttccctctttaattccgacaggttaatttccctcatatacgctttaattgatggattaattgcgtatcagctgacagaggtaacaaaggctttcaaaaacttgaaactgaaagtttggctacctggacttctttatgccgtgaatcctttgacccttttatcgtgcattagtcggtcatcaatcatattcacaaattttgctatttcatcgtcattgtattgcatattagctgaaggaaacgttcttttgtcctctgttatgatttctatatctggatatttgtcagtataccctattctcctcttaattccgctattaggtatgctgaaaagttggaggcaaagaatattatctgccattgtttccatactatctttattaattctgctattattcagctacagtatattaggcagccaaagttggtcatttttgacacaggtttatggatctattataacctttgagaaggtttttccaaatctgggtttgtggtggtacttcttcattgaaatgtttgacaccttcataccgttcttcaaggctgtattcaacatttttattgcagtattcattacaccatttactttgcgctatcataagcagccattctacgcattcattttatgcattgggtggattgtccttacaaagccatatccctcactaggtgacgctggttttttcttcagcttcctacctttcttcacgccactatttggatatttaagataccccatcatatcagcattactgtttttacacgcaattgttttggcgccaattttctatcatctttgggttgttttaggttcagggaatagtaattttttctatgctatttccctagtttatgctctggctatagcatctatattagttgacttgaactgggcgatgctgagaattgaatacgataacggtatcccaaatttcaaattgaaggtaacacaaatttaa

SEQ ID NO: 2776 - DNA, 1185 bp, Saccharomyces cerevisiae
atggctgaaagtaccacgttagaaactattgagatacacccaattacttttccacctgaagttcttgcgagaatatctccagaattgtctttacaaagacacttatccctaggaatcaggccatgtctaagaaaatatgaagaatttagagatgttgctatagaaaataatactttatcgcgttatgcggatgctggtaatatagacactaaaaacaacattttaggctcaaatgttttgaaaagtgggaaaaccatagtcataacttctattacgggtggaataatagaagaaactagcgccgcgattaaagatttggatgatttcggtgaggaagaattgttcgaagtgaccaaagaggaggacataattgcaaattatgcttctgtctatccggtggtggaagttgaaagaggtagagtgggcgcttgcaccgatgaagaaatgactatatcacaaaaactacacgattccatattgcactctaggatattgcctaaaaaagccttgaaggtaaaagctggtgttcgtagtgcgaatgaagacggtacgttttccgtcttgtatcccgatgaattagaagatgatacgctgaatgaaacaaacctgaaaatgaaaagaaaatggtcatacgttttgtatgcgaaaattgtagtcttgagtcgcactggtccagtcttcgatttgtgttggaattctttgatgtacgctttacagagcgtaaagttacctagagcatttatagatgagcgtgcgtccgatttaagaatgactataagaacaagaggaagaagtgccaccataagagaaacgtatgaaattatttgcgaccaaactaagtcagtaccgttaatgataaacgcaaagaatattgcatttgcttcaaattatgggatagtggagttagaccccgaatgccaattacaaaactctgataactctgaagaagaggaagtggacattgatatggataaattgaacactgtgctaatagcagacctagatactgaagcggaagaaacaagtatacacagtacgatctccatcctcgctgctccttcaggtaactataagcaattaacattagtgggaggaggcgctaaaataacgccagaaatgataaaaagatcattgttgttatctagggttagagcggacgatttgtcaacaagatttaacatataa

SEQ ID NO: 2777 - DNA, 1185 bp, Saccharomyces cerevisiae
atgtcctctgctgccacggttgaccctaatgaggcgttcggtctcattaccaagaacttgcaagaagtcttgaacccacaaatcatcaaagatgttctcgaagtacaaaagagacatttgaaattatactggggtaccgcgcccactggaagacctcattgtggttattttgttcctatgaccaagcttgctgatttcttgaaagcaggttgtgaagtgactgttcttttagcagacttgcacgcctttttggacaacatgaaggcgccattggaagtggtgaactatagggccaaatactatgaattgaccatcaaagctatcttgagaagcatcaatgttccaattgaaaagctaaaatttgttgttggctcttcttaccagctaactccagactataccatggatatctttagattatccaacattgtttcacaaaacgatgctaaaagggcaggcgctgatgttgtcaagcaagtcgccaatccattattgagtgggcttatctatcctttaatgcaagcgttggacgaacaattcttagatgttgattgccaatttggtggtgtcgaccagagaaaaatttttgtcttagcggaagaaaatttaccaagtttgggctacaagaaaagagcacatttaatgaaccctatggttccaggtttggctcaaggtggtaaaatgtctgcctctgatccgaattcaaaaatcgaccttttggaagaaccaaagcaagttaagaaaaagatcaatagtgcattttgtagccccggtaacgtcgaagagaatggtttactgtcatttgtccaatatgtcattgcaccaatccaagaattgaagtttggtacaaatcacttcgaattcttcattgatagaccagaaaagttcggtggtccaattacctacaaatccttcgaagaaatgaaattggcttttaaagaagaaaaattgtccccacctgatctaaaaattggtgttgctgacgctatcaacgagctattggagccaatcagacaagaatttgccaacaacaaggaatttcaagaggcctccgaaaagggttatccagttgccacaccacaaaagtcgaaaaaggctaagaaaccaaagaataagggtactaagtacccaggcgctactaagaccaacgagattgccacgaaactagaggaaaccaaattgtaa

SEQ ID NO: 2778 - DNA, 1185 bp, Saccharomyces cerevisiae
atgtggaagattatgcgttcatggaaatgtgggggaatgcgctgggcacatcgccagcgaccctcacacgagctgctgtcgcaactgtcgttcgaccagcattacaagattaggtcgaacattgagctgctgatacaggactacgctagtaaaccaattgcgcccctaaactacgagtatttcctgcaatacaggccgccgctgaccaagaaggaggagtacatgctgacgatcaagacaatcaacctgttgctttcattgacgtgtaaacggcttaatgccattcagaggctaccgtataatgcggtaatcaaccctcatattgagagaaccaactctttgtatttgaaaagcttgcaaacgttgctatcaatcgcatacccgtacgagttgcacaatcctcccaagatacaggccaagttcacagaactgctggacgaccacgaggacgccattgtggtattggcaaaaggtcttcaggaaatccaatcgtgttacccaaagtttcaaatttcgcagttcttgaacttccacctgaaggagagaatcacgatgaagctgcttgtgacgcactatttgtcgttgatggcacagaacaaaggtgacacgaacaaaaggatgattggaatcttgcaccgggacctccccatagcacaattgatcaagcacgtttctgattatgtcaatgatatatgctttgtgaagttcaacactcagcggaccccggtcctaattcacccgccatcacaagacatcacattcacgtgcattccgcccattctggagtatattatgacagaggtattcaagaacgcttttgaagctcagatagctcttggaaaggaacatatgcccatagagatcaatcttttaaagccagacgatgacgagctgtacttacggatacgggaccatggtggtgggatcacgcccgaggtagaggccctcatgttcaactactcttactctacacatacccaacaatcagctgactctgagtctacagatctgcccggcgagcaaatcaacaacgtctccggcatgggctttggtctaccaatgtgcaagacgtacctagaactgtttgggggcaagattgacgttcaaagtttacttggctggggcacggacgtgtacatcaagctcaaaggcccttctaagactgcactactctccaaaaagtaa

SEQ ID NO: 2779 - DNA, 1185 bp, Saccharomyces cerevisiae
atgtggacaaacactttcaaatggtgcagcaaaactgagaaggagaccactactgcagacgccaaggtgtgtgctagcgtgcagggcctgaaggccctgcagcagcaaattatggatagcaccactgtgcgtgggtccgttaataacacgatgactccaggcgggattaaccagtggcatttccacaataagcgtgcgaacaaagtgtgcacgcctacagtactaatccatggatacgctgcctcgtcgatggcgttctacaggacgtttgagaacctgtcagacaacattaaagatctatatgccatcgacttgccagccaatggtgcctcagaggcgccagcattgcaagtgaacaaaaccaagaagatcaagtctctcaggtttaagcatatagaagatgacgtagtaatccctgtgatagagaagcgccccccagcagaggacatcaagtcacacctggagcagtacgaaagctacttcgtagacaggatagagcaatggcggaaggataacaagcttcgcaaaataaacgtggtgggccattcattcggaggatatatttcattcaaatacgccctcaagtaccctgattccattgagaaactgtgtctcatatctcctcttggtgtggaaaacagtatacatgctatcacccacaaatgggagcccaacaccacctatccacttacgtttaccgacccatcgtcccgatattatacaagaaagctgaacgtaccgcggtttatctttgaaaaccagctaaacgttttgaagtggatgggacccataggctccaaattgtgctcgaactacatctccaccgcatacgtaaaagttccggatcagatatataaggactatcttttgcactcatttgtcgggaagaaccagacggtgcaaccacagacaatcaaggtgttcacccatttgtttgaaaggaatctgatcgctagagatccgataataaacaacgttcgttttttgaacccagcaacgcctgtcatgttcatgtatggcgagcacgattggatggataaatatgcgggctacttgactactgaatcaatgctaaaaaacaaggcaaaggctagctacgttgaagtccctgatgctggccataatcttttcctggacaacccgcagcactttgcctcttctttagtctcgttcctgtcaaagtaa

SEQ ID NO: 2780 - DNA, 1188 bp, Saccharomyces cerevisiae
atgtctgaaggtattactgatattgaagaatcccaaattcaaaccaactatgacaaggtcgtctacaagttcgatgatatggaattggacgaaaacttgttaagaggtgttttcggttacggtttcgaagaaccatctgccattcaacaacgtgccatcatgcctattattgaaggtcacgatgtcttggctcaagctcaatctggtactggtaagaccggtactttctccattgctgctttgcaaagaattgacacctctgtcaaggctcctcaagctttgatgttggctccaactagagaattggctttgcaaatccaaaaggttgtcatggctttggctttccacatggacatcaaggtccacgcttgtatcggtggtacttcctttgttgaagacgctgaaggtttgagagatgctcaaatcgtcgttggtactccaggtcgtgtttttgacaacatccaaagacgtagattcagaactgacaagatcaagatgttcatcttagatgaagctgatgaaatgttgtcttctggtttcaaggaacaaatctaccaaattttcaccttacttccaccaaccactcaagttgttctattgtccgccaccatgccaaatgacgtcttggaagttaccaccaaatttatgagaaacccagttagaattttggttaagaaggatgaattgactttggaaggtatcaaacaattctacgttaatgttgaagaagaagaatacaaatacgagtgtttgaccgatttatacgactctatctccgttactcaagctgtcatcttctgtaacaccagaagaaaggtcgaagaattgaccactaagttaagaaacgacaaatttaccgtttctgccatctattctgatttaccacaacaagaaagagacaccatcatgaaggaattcagaagtggttcttccagaattttgatctccactgatttgttggctagaggtatcgatgtccaacaagtttctttggttattaactacgacttaccagctaacaaagaaaactatattcacagaatcggtagaggtggtcgtttcggtagaaagggtgttgccatcaactttgttactaacgaagacgttggcgctatgagagaactagaaaagttctactccactcaaattgaagaattgccatccgacattgctaccttgttgaactaa

SEQ ID NO: 2781 - DNA, 1188 bp, Saccharomyces cerevisiae
atgtctgaaggtattactgatattgaagaatcccaaattcaaaccaactatgacaaggttgtctacaagttcgatgatatggaattggacgaaaacttgttaagaggtgttttcggttacggtttcgaagaaccatctgccattcaacaacgtgccatcatgcctattattgaaggtcacgatgtcttggctcaagctcaatctggtactggtaagaccggtaccttttccattgctgctttgcaaagaattgacacctctgtcaaggctcctcaagctttgatgttggctccaactagagaattggctttgcaaatccaaaaggttgtcatggctttggctttccacatggacatcaaggtccacgcttgtatcggtggtacttcctttgttgaagacgctgaaggtttgagagatgctcaaatcgtcgttggtactccaggtcgtgtttttgacaacatccaaagacgtagattcagaactgacaagatcaagatgttcatcttagatgaagctgatgaaatgttgtcttctggtttcaaggaacaaatctaccaaattttcaccttacttccaccaaccactcaagttgttctattgtccgccaccatgccaaatgacgtcttggaagttaccaccaaatttatgagaaacccagttagaattttggttaagaaggatgaattgactttggaaggtatcaaacaattctacgttaatgttgaagaagaagaatacaaatacgagtgtttgaccgatttatacgactctatctccgttactcaagctgtcatcttctgtaacaccagaagaaaggtcgaagaattgaccactaagttaagaaacgacaaatttaccgtttctgccatctactctgatttaccacaacaagaaagagacaccatcatgaaggaattcagaagtggttcttccagaattttgatctccactgatttgttggctagaggtatcgatgtccaacaagtttctttggttattaactacgacttaccagctaacaaagaaaactatattcacagaatcggtagaggtggtcgtttcggtagaaagggtgttgccatcaactttgttactaacgaagacgttggcgctatgagagaactagaaaagttctactccactcaaattgaagaattgccatccgacatcgctactttgttgaactaa

SEQ ID NO: 2782 - DNA, 1188 bp, Saccharomyces cerevisiae
atgcctgttgaaaaagatttaaaaactgcctacaaagctttgtatgatgagaaggaaccactgaaggccctccatctttatgatgaaattctcaaaggctcacccacaaatttaacggctctcatttttaaggcagcatgtcttgaaaagctatactttgggttttctgattggcacagcgatgcaactatggaaaacgcaaaggaacttcttgacaaggctctaatgacagctgagggtaggggcgatagatcgaagattggtcttgttaactttcgttattttgttcatttcttcaatatcaaagattatgaactggcccaatcttattttaaaaaagccaagaatcttggttacgttgatgacactttgcctttatgggaagatcgtctggagacaaaattgaataaaaaaaataaaaagcagaaggattcaactaataagcatacaattaaaccagtggaaagtattgaaaacagaggagataataattcttctcatagtcccatttcacctctcaaaattgaaaccgctcctcaagaatcccctaaatttaaaatcgattggtatcaatccagcacctctgtcactatatcattatttactgttaatcttcctgagtctaaggaacaagtcaatatatatatttctccaaacgatagaagaactttatcgatatcgtaccaagtaccgaaatctggatctgaatttcaatacaacgctaagctttcgcatgaggtggatccaaaagcagtgtcattaaaaattttcccaaaaaagctggaaattaccttgagcaaaattgatagcacgcaatggaagaagttggaagaagatattttaacggaatcctcaaggttatcagatgagggtaaaaattctgattctgcaacccgcttattatcagcagaaacggcatcaaaagagagattgtcttatccatcgtcctctaaaaaaaaaatagattggtctaaacttgacattgatgaagaagctgatgaagaagcgggatcggctgatagtttctttcaaaagctttacgctggagcggatccagataccaaaagggctatgatgaaatcctttatagaaagtaatggtactgcattgagtacagactgggaagacgtatctaagggaacggttaaaacttcaccaccagaaggcatggaacctaaacattggtaa

SEQ ID NO: 2783 - DNA, 1188 bp, Saccharomyces cerevisiae
atggagcatgtagattccgattttgcacctataaggagatcgaaaaaggttgttgacagtgacaagattgtgaaagcaataagcgatgatttggagcaaaaaaattttactgtactgagaaagttgaaccttgttccaattaaaaaaagtgttagcagcccaaaggtgtgtaagccgagtccagttaaggagcgagtggaccatgttttctaccagaagttcaaatcaatggccttgcaagagctaggcaccaattatttgtcaataagctacgttccgagcttaagtaagtttctttcaaaaaatcttaggagtatgaaaaattgtatcgttttcttcgacaaagttgaacatatacaccaatatgctggtatcgaccgtgcagtttcagaaacactgtctttagtcgatataaatgtcgtaattatagaaatgaatgactacttaatgaaagagggtattcaatcaagcaaatcaaaagaatgtatcgagtcaatggggcaggcttcatatagcggacaactagatttcgaagctagtgaaaaaccttcaaatcacacgtctgacctaatgatgatggttatgaggaaaataaataatgacgaaagtatcgatcatattgtctacttcaaattcgaacaattagataaattatctacttcaactataatagaaccttcgaagcttaccgaatttatcaatgttttatcggtacttgaaaaaagtaataacattgcatttaaggtcctcatttattcaaataacgttagcatttcgtctctcctatcgacatccctcaaaaagaaactcaacacaaaatatactgtgtttgagatgccgatattaacatgcgctcaagaacaagaatatttgaaaaaaatgataaagtttacctttgattccggaagcaagttattacagtcttacaactcgcttgtcacatgccagttgaataataaagaatccaacttagcaatctttttcgaatttttgaaggtctttccgcacccttttacctatttgtttaacgcttacactgagattatagtccagagtagaacttttgatgaattgttggataagatcagaaacagactgacaataaaaaattacccacatagtgcttataactttaagaaaaaccagcgtcttccacttaagttaactcgaaaagtacatgatagataa

SEQ ID NO: 2784 - DNA, 1188 bp, Saccharomyces cerevisiae
atggatcccaccaaagcacccgattttaaaccgccacagccaaatgaagaactacaaccaccgccagatccaacacatacgataccaaaatctggacccatagttccatatgttttagctgattataattcttcgatcgatgctcctttcaatctcgacatttacaaaaccctgtcgtcaaggaaaaaaaacgccaactcaagcaaccgaatggaccatattccattaaatactagtgacttccagccactatctcgggatgtatcatcggaggaggaaagtgaagggcaatcgaatggaattgacgctactctacaggatgttacgatgactgggaatttgggggtactgaagagccaaattgctgatttggaagaagttcctcacacaattgtaagacaagccagaactattgaagattacgaatttcctgtacacagattgacgaaaaagttacaagatcctgaaaaactgcctctgatcatcgttgcttgtggatcattttctcccataacatacctacatttgagaatgtttgaaatggctttagatgatatcaatgagcaaacgcgttttgaagtggttggtggttatttttctccagtaagtgataactatcaaaagcgagggttagccccagcttatcatcgtgtccgcatgtgcgaattagcatgcgagcggacatcatcttggttaatggttgatgcctgggaatctttacaatcaagttatacaaggacagcaaaagtcttggaccatttcaatcatgaaataaatatcaagagaggtggaatcatgactgtagatggtgaaaaaatgggcgtaaaaatcatgttattggcaggcggtgatcttatcgaatccatgggcgagcctcatgtgtgggctgattcagacctgcaccatattttgggtaattatggatgtttgatcgtggaaaggactggttctgatgttaggtccttcttgctttcccatgatatcatgtatgaacacagaagaaatatccttattatcaaacaacttatttacaatgatatttcctctacgaaagtgcggcttttcatcagacgtggaatgtcagttcaatatcttcttccaaactctgtcatccgttacatccaagagtataatctatacattaatcaaagtgaaccggtcaagcaggtcttggatagcaaagagtga

SEQ ID NO: 2785 - DNA, 1188 bp, Saccharomyces cerevisiae
atgtcactttctcttgtatcgtaccgcctaagaaagaacccgtgggttaacatttttctacctgttttggccatatttctaatatatataatttttttccagagagatcaatctctgttgggacttaatggccagtccatttcccaacacaaatgggcacacgaaaaggaaaacacattttattttcccttcaccaagaaatacaaaatgccaaagtactcttataagaaaaaaagcggctggttgttcaacgatcacgtggaagatattatcccagaaggtcatattgcacattatgatttgaacaaattgcactctacgtcagaagcagctgtcaataaggagcatattttgatattgactccaatgcaaacatttcatcaacaatactgggacaatttgctgcagctaaattaccctcgggaattgattgaattggggttcattacaccaagaacagccactggtgacttggccttaaagaaattggagaatgctattaaaaaggttcaaacggacaagaaaactcaaagatttagtaaaattactattttgcgacagaattcccagagttttgataagttgatggagaaggaaagacacgctttagatgttcaaaaggaaagacgtgcagcaatggctttggcgcgcaatgaattactattctccaccataggacctcacacttcttgggtgctgtggctagatgccgatattatagagacaccaccatctttaattcaagacatgaccaaacacaacaaagctatcttagctgcaaacatttatcaaagattttacgatgaagagaagaagcaaccatcaatcagaccatacgatttcaacaactggcaagaaagtgacaccggtttagaaatagcctctcagatgggtgatgacgagattattgtcgagggttatgcagaaattgccacttataggccattaatggctcatttctacgatgctaatggcgtaccaggtgaagagatggcgctggatggtgttggtggaggctgtactttggtcaaagcagaagttcacagagacggtgccatgttccctaatttcccattttatcacttgattgaaacagaaggttttgctaagatggcgaagagattaaactacgatgtatttggcttaccaaactatttggtttatcacatagaggaagagaaccattga

SEQ ID NO: 2786 - DNA, 1188 bp, Saccharomyces cerevisiae
atgtctgctacatcttcaagtggtgacgtgaaaaaatttcaagctgtaccaaaaccaacgagcaatgcatcaccaccaccagcatcgagtgggtttaacgcaaggaccctatggccggatttgatagaaacaccagaaaaccagtgggtttttgagtgcaaagatattattgaaaagataggcactaatggaccgatagcagtggaaataaaaaaaaatatggaaaaatgcttaatgtacttttacacacttaaaaaaaaattaaatctttttgatcacacctatacggcatcatgcattctattttacaggtattggttcatatatggaatacctacagccataactgaatgtattcatatatcacagggaattctggtcaccgcttgcaaaacaatggagaataataggcctatagaggcctatattaaggcgacttgtgagtttttgatgcaaaatataccgtctttaaaaagtcgaacaaatattgataaacttaaatgggaatttagagataagttagtgacgaatgaaaaaaaaatactatgtttatttggctttgacttaaatatcagtaatccaaaagaattgattgaagaagtgttcagtggctattatagattcaacagggatcacaatctgccagaaaactttaaaaaagcttttccaaaaattcttcaagaatcaagaaattttatggtccaagctgtcacccagccagtttctttattgtgcgacggttatacgttcattgtactatctctcatatactgtggtttagagtataaaaagcttgtagacaaagatttcagatatccgaaaaacttcttcaaggatagattccctatcgaagtaacgccggaaaattttgccaatatctttaccgattacaagttactggaagagaattttttcaacttaaaaagtaataaaggtgctaaattacaaattgattcaagcatgattgattcggtgattgacgaaagtggcgatgtggaaaatgaagtttcagaaatctctgatccgtttaactacgagttgattaaatccggtgaggtgaaggaagagtttttgaatcatattgaaacaagggttaaagatttactagataaggctaaacaagaaagtatgaagagaaaggctaaagatcctataagaaccccagatgccaaaaaacctaaaatataa

SEQ ID NO: 2787 - DNA, 1188 bp, Saccharomyces cerevisiae
atgtctttggaaagagaggaaccacaacatttcggagcagggccagctcaaatgcctacaccagttttgcaacaagctgctaaagacttaatcaatttcaatgacataggtttgggtatcggtgaaatttctcaccgttcgaaggatgccaccaaagtgattgaagactctaagaagcacttaatcgaactgctaaatattcctgacactcatgaagtgttctacttgcaaggtggtggcactactggtttttcttccgttgctactaatttggcagctgcatatgtgggtaagcatgggaagattgcacctgccggttatttagtcaccggtagttggtctcagaaatcttttgaagaggcaaagagattgcacgttcctgctgaagttatcttcaacgctaaagattataacaatggcaaatttggtaaaattccggatgaatccctttgggaagataaaatcaaaggtaaggctttctcatacgtgtacctatgtgagaatgaaactgttcatggtgttgaatggccagaattaccaaaatgtttagtaaacgaccccaacatcgaaattgttgctgacttatccagcgacattttgtctcgtaagattgacgtttctcaatacggtgtcatcatggcaggcgcccaaaaaaacattggtttagcaggcttaaccctatacattatcaagaaatccatccttaagaatatttctggcgcttctgatgaaacattacatgaattgggagtaccaatcacccctattgcattcgactatccaacggtggtgaagaacaactcagcctataatacaattccaattttcactttacatgttatggatctcgtgttccaacatattttgaagaagggtggtgttgaagcgcaacaggctgaaaatgaagaaaaggccaagatattatatgaggcattggatgcaaattcagatttttacaacgttccagtggatccaaagtgtagatcaaaaatgaatgtcgttttcacccttaaaaaggacggccttgatgaccagtttctaaaagaggcagctgctcgtcatttaaccggtttgaaaggacatcgttcagttggtgggttcagagcctccatctataacgcgctttcagtgaaagctgtacaaaacttggtagattttatcaaggaatttgctgagaaaaacgcttaa

SEQ ID NO: 2788 - DNA, 1188 bp, Saccharomyces cerevisiae
atgtgggggttatgcaagaagcattttccgagcaataaaattcaagtgcaggagagaaacaaagcattaaaaccaaagaagagtggcagcgaacataagacaaagcaactgtttcctgtattcaattgcaagaagaaggaaaaaggggtaatgatacggtttgcgattctacgtaatgctaacacatctctactgtccgcgagaagtatatgcttatttacccaggcgcctacctattgtcatgtaaggttgaataccttgaataaaagcattacaactaaaagaaattcattgacagagtcgaaaaggcatgtccatgatggcaagcatttttttacgacgccacatcaacagcaacagacgaagttgggggaaattgaagagggacacagtcctaacataaaaggagaggacttgagaagcattggtcaagcaataacacatcagcgaaacaagcgccgaaagcaaatatggtccgccatatttggtggtatattcggtgtgatattaggatactcactaatctatagagtgatatatttaaaggaacaaagtttcttaccattgtttccatcatccaagatacgtaaactgagtaccagagatttgaaaaaggttgacgtaaaccaagtacagaagctttctaaattaagggttttagagatattatccggtcatgacatgatcaaggaacaatacggagtaccattgcttgataaagatggcaattcacccacgttaaatgaattcagcatgtggtgcgaagatcaagatccatgtgtaactggtattgtaatggagccagacgataaaagggatagttcgcacacttggtatagaataccctttgtttgcaaatggaggataacgcatcggccaataagtatacggggaaccatcgacgatttactgaaccgcattggtttggaaacagccgatttatttgagattatatcgccggagagggtatacgggtcgttcaagtacgaatacccactgcagggggactcacatgcattacacctttggtttcatggcgaaatcgaactggacgatgattctttgattgtatataatggaaaataccacgttgatgttaaattgcaagaaatcgacctcttcagacgtgaaaagaacggacaactaatacagtacgttctatacaaaaacgaagcgggcgacaagtaa

SEQ ID NO: 2789 - DNA, 1188 bp, Saccharomyces cerevisiae
atgttgagaactcaagccgccagattgatctgcaactcccgtgtcatcactgctaagagaacctttgctttggccacccgtgctgctgcttacagcagaccagctgcccgtttcgttaagccaatgatcactacccgtggtttgaagcaaatcaacttcggtggtactgttgaaaccgtctacgaaagagctgactggccaagagaaaagttgttggactacttcaagaacgacacttttgctttgatcggttacggttcccaaggttacggtcaaggtttgaacttgagagacaacggtttgaacgttatcattggtgtccgtaaagatggtgcttcttggaaggctgccatcgaagacggttgggttccaggcaagaacttgttcactgttgaagatgctatcaagagaggtagttacgttatgaacttgttgtccgatgccgctcaatcagaaacctggcctgctatcaagccattgttgaccaagggtaagactttgtacttctcccacggtttctccccagtcttcaaggacttgactcacgttgaaccaccaaaggacttagatgttatcttggttgctccaaagggttccggtagaactgtcagatctttgttcaaggaaggtcgtggtattaactcttcttacgccgtctggaacgatgtcaccggtaaggctcacgaaaaggcccaagctttggccgttgccattggttccggttacgtttaccaaaccactttcgaaagagaagtcaactctgacttgtacggtgaaagaggttgtttaatgggtggtatccacggtatgttcttggctcaatacgacgtcttgagagaaaacggtcactccccatctgaagctttcaacgaaaccgtcgaagaagctacccaatctctatacccattgatcggtaagtacggtatggattacatgtacgatgcttgttccaccaccgccagaagaggtgctttggactggtacccaatcttcaagaatgctttgaagcctgttttccaagacttgtacgaatctaccaagaacggtaccgaaaccaagagatctttggaattcaactctcaacctgactacagagaaaagctagaaaaggaattagacaccatcagaaacatggaaatctggaaggttggtaaggaagtcagaaagttgagaccagaaaaccaataa

SEQ ID NO: 2790 - DNA, 1190 bp, Saccharomyces cerevisiae
atgagtagaatcgatgatttacagcaggacattgaatctttactcagtgaaagtatgtgattttgaggctgtaacaattttctttcttttaaaaaaatgattaagttgaacactaacatagtagaatcttcacagtcaattcattagaagaaagtcgtgagaagctcaaagcgaagataaaagataaaagaaaaaatgaggagagcgctaatcctatagtacaagaatttgaagatctattcgatcaattcccacagttgaataattttttatttaatgagcatccagaattggaagagacagatgacaaggacatatcaagggcgcaagcggatataccagcaacgccaataccgtatgaaccaaagaaaagagctaagctggagaatgaggaaattttaccagaacaagaatgggttttaaagacccagccaatggttcagcatcaaatgtttgatcctggggtggcagatttattggatacagacattctaacgtcaccttcaaaaagaaagcgaaaactaaaaatagacgatattagtacaagtgatagaagtgagttggaagattatattgtcctggaaaatgtttatagaatgtttggtataacatttttccctcttgtggaccctattgaccttaagataaaagatgctagcggtgaaatatttgttgatagagaaatgctgggaatacgactggaagtcttcagcgaacggacatcccaatttgaaaaacctcactatgtattgttgaaaaagaggatcaaatcgaatagttggttcctgttcaagcatacaatcccgagtttcattgatgtccaaggtatatttgatgacaccaatgggggactagtgatatctcatgatgacgcctatttatttgctaaaagagtcttcctgcaacttgtggaagtacagaaaagacgacagatttttaaggacttagaagctaagaagataatccacgacttagatttagatttagaatcttcaatggtttcgttttttgtgaaggatattaaagtcgagttgtttgtaaaacaaaatgaaatagtttcatgttcaatattggacgatattcatgattttagtcaaaataataaaagtaaatgggaaattgcattgctcggttctttggatgatttggaattaaaattaaaccattctttcgcgacaatattcaagtga

SEQ ID NO: 2791 - DNA, 1191 bp, Saccharomyces cerevisiae
atgaagcattcccaaaaataccgtaggtatggaatttatgaaaagactggtaatccctttataaaagggttgcaaaggctgcttatcgcttgcttgttcatttcaggctcgctgagtattgtcgtttttcagatctgtctacaggtgcttctcccttggagcaagattagatttcaaaatggtataaatcaaagtaagaaggcttttatcgttttattatgcatgatcttgaacatggtggctccctcttctttgaatgtcacttttgaaacatcgcggccattgaagaactcttctaacgccaagccatgctttagatttaaagacagggctataataattgcaaatcatcaaatgtatgcagactggatttatctctggtggctttcctttgtttcaaatttgggtggtaacgtttatatcatcctgaagaaagctctgcagtacataccattactgggatttggcatgcgaaattttaagtttatatttttaagtaggaactggcaaaaggatgagaaagctttaacaaatagtttggtttctatggacttaaacgcgaggtgcaaggggccccttacaaattataagagttgttattccaagacaaatgaatccattgccgcttataatttaatcatgttccctgagggtacaaatctaagcctcaagacaagagaaaaaagcgaggcattctgtcaaagagcacatttggaccatgtccaattaagacatttgttattaccgcactctaaaggcttgaagtttgcagtagaaaaactagctcctagtttagatgctatctacgatgtcactattggatattctcccgccttgagaacggaatacgtcggcaccaaattcaccttgaagaaaatattcttaatgggtgtctatccggagaaagtagatttttatattagggaatttagagttaatgagatccctttgcaagatgacgaagtttttttcaattggttactgggcgtgtggaaagaaaaagatcaactgctagaagactactacaacacaggccaatttaaaagtaatgctaaaaatgacaaccaatccatcgttgttacgacacaaacgactggatttcagcacgaaacattgacaccccgtatcctttcatattacgggttcttcgcttttcttattcttgtatttgtgatgaaaaaaaatcattga

SEQ ID NO: 2792 - DNA, 1191 bp, Saccharomyces cerevisiae
atgaccgtttacacagcatccgttaccgcacccgtcaacatcgcaacccttaagtattgggggaaaagggacacgaagttgaatctgcccaccaattcgtccatatcagtgactttatcgcaagatgacctcagaacgttgacctctgcggctactgcacctgagtttgaacgcgacactttgtggttaaatggagaaccacacagcatcgacaatgaaagaactcaaaattgtctgcgcgacctacgccaattaagaaaggaaatggaatcgaaggacgcctcattgcccacattatctcaatggaaactccacattgtctccgaaaataactttcctacagcagctggtttagcttcctccgctgctggctttgctgcattggtctctgcaattgctaagttataccaattaccacagtcaacttcagaaatatctagaatagcaagaaaggggtctggttcagcttgtagatcgttgtttggcggatacgtggcctgggaaatgggaaaagctgaagatggtcatgattccatggcagtacaaatcgcagacagctctgactggcctcagatgaaagcttgtgtcctagttgtcagcgatattaaaaaggatgtgagttccactcagggtatgcaattgaccgtggcaacctccgaactatttaaagaaagaattgaacatgtcgtaccaaagagatttgaagtcatgcgtaaagccattgttgaaaaagatttcgccacctttgcaaaggaaacaatgatggattccaactctttccatgccacatgtttggactctttccctccaatattctacatgaatgacacttccaagcgtatcatcagttggtgccacaccattaatcagttttacggagaaacaatcgttgcatacacgtttgatgcaggtccaaatgctgtgttgtactacttagctgaaaatgagtcgaaactctttgcatttatctataaattgtttggctctgttcctggatgggacaagaaatttactactgagcagcttgaggctttcaaccatcaatttgaatcatctaactttactgcacgtgaattggatcttgagttgcaaaaggatgttgccagagtgattttaactcaagtcggttcaggcccacaagaaacaaacgaatctttgattgacgcaaagactggtctaccaaaggaataa

SEQ ID NO: 2793 - DNA, 1191 bp, Saccharomyces cerevisiae
atgactgtcaccataaaagaattgactaaccacaactacattgaccacgaactatcagccactttagactcaacggatgcgttcgagggtcccgagaagttgctggaaatctggttcttccctcacaagaagtccatcacgaccgaaaagacattaagaaatattggcatggatagatggatcgagattttgaaattagtgaaatgcgaagttctttccatgaagaagactaaagaactggatgcctttttgttgagtgagtcttccctcttcgtcttcgatcacaaattgacgatgaagacgtgcggtactacaaccacattgttctgtctcgaaaagcttttccagatcgttgagcaagagttatcgtgggctttccgcacaacacaagggggcaagtacaaaccatttaaagtgttttattctagacgatgtttccttttcccctgtaagcaagccgctatccatcaaaactgggctgacgaagtcgactatttgaacaaatttttcgacaatggtaaaagttattccgtgggaagaaatgacaagagcaaccactggaacctgtacgtcaccgagacggaccgctccacacctaagggaaaggagtacatcgaggatgacgacgaaactttcgaagtactgatgacggagctggacccagaatgcgctagtaagtttgtttgcgggcctgaggcatccacaaccgctctcgtggagccaaacgaagataagggccacaacctcggctaccaaatgactaaaaatacaaggcttgacgaaatatatgtcaactcggcccaagactccgatttatcatttcaccacgatgcatttgcgttcacgccatgtggatactcatccaatatgattctcgctgaaaaatactattacaccctgcacgtgactccggaaaagggttggtcttacgcctctttcgaaagtaacatacccgtatttgacatttcccaagggaagcaagacaacttggacgttcttctacatattctgaacgtttttcaaccaagagagttctcgatgaccttttttaccaaaaattatcagaaccaatccttccaaaaactactaagcatcaacgagtcactgcccgactacatcaagttagacaaaattgtttatgatctggacgactaccaccttttctatatgaaattgcagaagaaaatatga

SEQ ID NO: 2794 - DNA, 1191 bp, Saccharomyces cerevisiae
atgaggtttaggagttcttcccatagcttaaaacatgttgacagagaattaaaggagttgattaattcgtccgagaatgccaataaatgcggtgaatgtggtaatttctacccaacttggtgctcagttaatttgggggttttcctttgtggtaggtgtgcctctgttcatagaaaagttttcggtagcagagacgacgatgccttttctaacgttaaatcactatcaatggatagatggacaagagaggatatcgatgaattagtgagtcttggaggcaataaggggaatgctcggttctggaatcctaaaaatgtcccttttccttttgatggagatgatgacaaagccatcgtggagcattacattagagacaagtatattttgggtaaattcaggtatgatgaaataaagcctgaagactttggatccagaatggatgattttgatggggaatcggacaggtttgatgaaagaaatagaagtaggagcaggagcagatctcattctttctataaagggggccataataggtctgactacggcggttccagggactcattccaaagcagtggaagcagatattctaggcaactggcagaactcaaggacatgggtttcggtgatacaaacaaaaatttagatgcattatcgtccgctcacggaaatatcaatagagcaatcgattatctagaaaaaagttcaagttcaagaaatagtgtatcggcagcagcgacaacatcaactccgcccctgcccaggagacgtgcgacaacaagtggcccacagccagctatttttgatggtacaaatgtaatcacgccagattttacttcaaattcagcatcttttgtacaagcaaagccagcagttttcgatggtacccttcaacagtattacgatcctgctaccggaatgatatatgtagatcagcagcaatacgccatggctatgcaacagcagcaacagcaacagcaacagcttgctgtcgcacaggctcaggctcaggcacaggcacaggcacaggctcaagttcaggctcaggctcaggctcaggcccaggctcaggctcaagcacagcagatccagatgcaacagcttcagatgcagcaacagcaacaggcgccattatcttttcagcaaatgtcgcaaggaggaaacctgccacaaggttatttctacacacaataa

SEQ ID NO: 2795 - DNA, 1191 bp, Saccharomyces cerevisiae
atgagtactttcaacagttacagccagccaaaggaaagcaatgataatagtcataataatgtcaacaagagcaaatcgctgttagatataatatttggtactaatgtatcggaatgggctttttctgagaatgctttaatgaaagctatggatttgaaaatagaacaagaaaagactaagcagcaatattataaacttgaaaacttgaatcgttcgatagagttgtttaagcttgcttccagttcaggtctgcccataaatcaaatacataaactattcaacaccgaccatggcgtaccggcgtcttcgccgatgaaggcagggggcaatcaaccacataacaatacagaaggcacgcaatcttcagaaaatctgcccagattgaatggttctatgaagtcattaaaacctctaaatatgaacacagtgtcaccaactccaatgagtcgacagccctctccatataagtttccagcatcatcctctaccggcggtatatcacactccacagttacaaatgtacaacgaagagctaattctcctgcaagaataggtgcatccgcagttgctgcgttgaatgacaatatttccattaaggaggaagatgtggctaggcgaattccctctggtacaaaatctcaagaatcgcctttaaacaagaagccgacttctcttcacagccgtaacttgtcacttccaataggaaagttcaccaatcctaatattccttctacaatgacatccatactaagtttcaatagagaccaacagcagccgctatctcaaccactgcctcctcctccacaacagcaacaggatctccacacgcacaatttacatactataccaaggaaacctggaatggttcaaaaaaagcataggcgtgcaagatccacatcctcctttggagtgatcgatttaagtattatcgatgaagcaaaagaaaaacaagtacagagatcaccatcccctatacattctaacgtgtccgtagcacttacctcacatgacaaaccaattgaatccaatatgaaggaacaaccaaatatgctgcaatcggttcgtgaaggacgtcaagtacacgatgacttggatgacagaacatgcagtgaaagcagtagtagaaacgaaagccccgtaagaaccatcacaaaggataattctgtaggcaagattttaaatagtacttga

SEQ ID NO: 2796 - DNA, 1191 bp, Saccharomyces cerevisiae
atgattacttcaattgacatagcagatgtaacttattctgccaaaccaagaattttggtgccttataaaacccaatgggaagtcgccagtcatcttcctgaatatcgcaaactggcagaaagggtagaattctataaatatgagatgtccacaaaggatgattttgttaaatttttggaaactcatagaataaacggcttttggctcactgaggagtttttcactgtgttaggaaacccttcgagttatattgaattcttccccgcatctttaaaagtaatccttgtaccatgggtcggctgtgactttattgacggtaagttattaagatcgaaaggtatcactttatgcaacattggaccacatgctgctgaccatgtcacagaattggctattttcctagcaattagctgctttagaatgacttcattttgggaatattgttttaaatacgtggaaaatggtaatgttgaacagtgtaagaaatatatctctagtgactcgtatgaaattgttacagatagttaccacggtcaggaaatgaaatttccctctcgaacagacaaatgcaagcctaacaaggataggaaagtggtacatttagcagaaaagtacacggttggcgggaaaaaaatggaatctccaatgaataaaaaagttctaatattggggtttggctccatcggacaaaatatagggtctaacttgcacaaagtgttcaacatgagcattgaatactacaaaaggaccggtcccgtccaaaagagtctacttgattacaacgctaagtaccattctgatctagatgatccaaatacttggaagaatgcggatttgatcattttggccttgcccagtacggcctctacaaacaatattatcaatcgtaaaagtttggcctggtgtaaagatggtgtcaggatagttaacgttgggagaggcacatgcatagatgaagatgtgctactagacgctcttgaatctggaaaagtggcaagctgtggtctcgatgtgtttaaaaatgaggaaacacgcgttaagcaagagttacttcgcagatgggatgttacagctttgccacatatcggcagcacagttgccgacatggtcataaagcagacactcatcacactcgagaatgtgcaggacatatttgtcgagggaggtgatggtaagtatgtgctcaactga

SEQ ID NO: 2797 - DNA, 1191 bp, Saccharomyces cerevisiae
atggccaaaacaacaaaaagagcctccagtttcaggaggttgatgatattcgccataatagccctcatctcattagcatttggagttagatacctatttcacaattctaatgctactgatttacaaaaaattctgcagaacttgcccaaagagatttcccaaagcattaatagtgccaacaatattcagagttcggattctgatctagttcaacattttgagagtttggctcaggagatcagacaccaacaggaagttcaagcaaagcaatttgataaacaacgtaagatcctggaaaaaaaaatccaagacttgaaacaaacacctccggaggccaccctaagagaacgcatagctatgactttcccctacgattcccatgtcaagttcccagcatttatttggcaaacttggtccaatgatgaaggtcccgagcgtgttcaagatataaagggcatgtgggaaagcaagaatccgggctttgcgcacgaagtgttgaaccatgacgtgataaacgcactagtacaccactacttctactccataccggaaatcctagagacttacgaagctctgccctccatcatcctaaagatagattttttcaaatacttaatactgttagttcatggaggtgtttatgctgacatcgacacgttccctgttcagccaattccaaactggattcctgaagagttgtcgccatccgacattgggttgatagttggagttgaggaagacgctcaaagagctgactggagaaccaagtatatcagaagacttcagtttggtacttggattatacaagcaaaacctggtcaccctgttttgagggaaatcatttctcgaattattgagaccactttacagagaaagagggacgaccaactaaacgtcaatctaaggaatgatctgaatattatgagttggacgggttctgggttgtggactgacactattttcacgtatttcaatgactttatgagaagtggtgtcagggagaaggttacatggaaattattccataacctaaatcaaccaaaattgctaagtgatgttctggtctttccaaaattctcctttaactgtccaaaccaaatcgataatgacgatccacacaagaaattctatttcattactcatttggcatcacaattttggaaaaatactccaaaggtggagcagaaataa

SEQ ID NO: 2798 - DNA, 1191 bp, Saccharomyces cerevisiae
atgtacgagatgtcaggtatagacagcctctttcatgatcgagttgttcatgattactctcatactagtgagcaggttatcgtcgtttacattagttcagcagccggggacaattcttggcttcatcagtggttcaaaccaggaaatcttagtgacgaggagcgcgaaaacatactgtgggtaaggttagtaaatggtactaaagagtgcttgcttttcaagagcattttcccctcctcatcggcgccaagcattaacatattacagaacggtctactcgaatgttctatccaaggtaatagcctttctcgtgagcaggatccttgggaaacctttatcaatgggttacaatcagtctttaagggtcaagtaacaaagaggaagttattttccaagagcaatgaagaatatcaaagagtcaaaagaatgattcagaacgacaagttggagaggaagtatgtttttcaaaatactaatgacccgcaaagaaagccacagaagtggaagcagttgacagttactgataatgttagttacaagagtcaaaaggggtttctcgcccagaactactgtactctacaattgaaactgcccaatggttacacaatctctaatactttccctcctcaaacaaaattacacaaagtaaggatgtggttagactataattgctacgatgatggaacaccttaccttttccacagaaatataccaagagtgactcttacgcgaaatgacgaactcaaaagtttgcaagagttggatctgttgcccagatcgactctcatcttagaaccgctggaagccaataacaaaacattcgactacatggaacaatcttctcttctacacaaggtttactcaggtttgacatctttttgggcgaaagaaccggaagtagatgcttcctcctcccgtcttggttaccagaggttgggcacaaatgtgtcaaacagcgccaactactctttacaaaaattatctagcttagacatggtgtcggacgggggaggaggaggtggtggtgattcaatgactccttcagcatatactaccccaaggatgtatccttctaatggtacttctcaattgcgacaaaacgtgtctgaactaaacttgtcttccaataattctgcatctaataccaaagttcgtacattaggttactctaataataacggcaacaattaa

SEQ ID NO: 2799 - DNA, 1191 bp, Saccharomyces cerevisiae
atgttacagagtatagtcctttccgtgtgcatgtttatgttgcacacagtcgctgccagtggacctcagtcgtaccaaaagttggatttcactaatgttggttttacaggctcctacgtagatgtgaataagtttaaagatatcaccaacaatgaatcgtgtacttgcgaagtgggtgacagagtatggtttagtggtaagaacgctccactagcagactatttatccgttcatttccgtggaccattgaagttgaaacaatttgctttttacacatcccctggatttaccgtcaacaacagcagaagttcttctgattggaaccgtcttgcctactatgagtccagttccaaaaccgctgataacgttacctttctaaatcatggaggtgaagcttccccttgtttaggaaatgctttgtcctacgctagttctaacggtactggcagcgccagtgaagctaccgttttggcagatggcactttgatttcttcagatcaagaatacataatctattcgaatgtctcatgtccaaaatcaggttatgataagggttgtggggtttaccgtagtggcattccagcttactatgggtacggaggtacaacaaagatgtttttgtttgaattcgaaatgcctactgaaactgagaaaaatagcagctctattgggtactatgacttgcctgctatttggttgctaaacgatcacattgcaaggacttctcaatatccaaccaatgccaactgttcatgttgggctagtggatgtggggaatacgatatttttgaagctatgaatggtacggagaaaaaccatctctattctactttccacactttccaaggtatcgaggatttgggtactggtatccaatcttacggatacataacaagaaatactactggaacgatgaaaggtggtgttgttttcgattctagtggaaatgtcgtttctttcatatctgatgccactccattcaatggaactgtttctgctgatactgttaacgatttattggctgcaattccagaaaacgaaacctattcttctcaattgatgagcatttctgctactgcgccttcgaccacctcgaagtcgaatggtgttgctttaacgaagatgcaaaacggtgtatggtattatattttggccatattcactgcctttacgcaagtggttttgatttga

SEQ ID NO: 2800 - DNA, 1194 bp, Saccharomyces cerevisiae
atgctgcatcaaaaaatagctcataaagttcgaaaagtcgtcgtcccaggtatttccttattgattttcttccagggatgccttattcttttgtttctccaactcacctataagactctttactgtagaaatgatataaggaaacaaattggtctcaataaaaccaaaagattatttattgtcttggtatcatccattttgcatgttgtcgcaccatctgcagtgagaattaccactgaaaattccagtgttcctaaaggtactttttttttagacttgaagaagaaaaggattctttctcatctaaagtccaattcggtggccatttgcaatcaccaaatatacacggattggatatttttatggtggttggcttacacatcgaacttaggggctaatgtcttcattattttaaaaaaatcgttggcttccattcctatcctcggtttcggtatgagaaactataatttcatttttatgagtagaaagtgggcacaagacaaaataaccctaagcaacagccttgctggccttgattcgaatgcaaggggcgccggctcacttgctggaaagtcacctgagcgcataactgaggaaggagagagcatatggaatccggaggttattgatccaaaacaaatccattggccatacaatcttatcctattccctgaaggtacaaatctcagtgctgatactaggcaaaaaagtgctaaatatgctgccaaaataggcaaaaagccattcaagaatgtgctactgcctcattctacaggcctaagatactcgttacaaaagttgaagccaagtattgaaagtctttatgatattacgatcggctactccggtgtaaaacaggaggaatatggtgagcttatatatgggctgaagagcatatttttagaaggaaaatacccgaagttagtcgatattcacatcagagcatttgatgttaaagatattccattagaggacgagaatgaattttcagaatggctgtataaaatttggagtgagaaggatgctctaatggaaaggtactattccactggatcattcgtaagtgatcctgaaacaaaccattcagttaccgatagtttcaagatcaatcgtattgagttaactgaagtgctaatattaccaactctaacaataatttggttagtttataaactttattgttttattttttga

SEQ ID NO: 2801 - DNA, 1194 bp, Saccharomyces cerevisiae
atggactcgattataccggcaggcgtcaagctagatgatttacaagtgatattggctaagaacgagaatgaaaccagggacaaagtgtgtaagcagatcaacgaagcacgcgatgaaattctgccgttgcgattgcagttcaatgaattcatacagataatggcaaacatagaccaagaaggatccaagcaggctgaccgtatggccaaatacctacatatcagagacaagattttgcaactgaacgatagattccagactttgtcttcgcatttagaagcactgcaacctttattcagcactgtaccagaatacttgaagactgcagataacagggacagaagtttccagcttttggaaccgttgagtacttataacaaaaatggcaacgccgtttgctcgacagcaactgttgtaagcaccaaccactctgcggccgcttcgacacccaccacaactgccacccctcatgcaaatcccatcacacatgcgcactcgctttcgaatccaaatagcaccgctacaatgcaacataatcccctggccggcaagagaggtccaaaaagcggtagtactatgggaactccaaccgtacataatagcactgcagctgcaccgattgcggcacctaaaaagccaagaaaaccaagacaaaccaagaaggcaaaggctcaagctcaggctcaagcgcaggctcaagcgcaggtctacgcacagcagtcgactgtccagacgccaataacagcatcgatggcagccgcgctacccaacccaactcctagcatgattaacagcgtttcgcccacaaatgttatgggcacgccgctgaccaacatgatgtctcccatggggaacgcatactcaatgggagctcaaaaccaagggggacaagtatctatgtcacaattcaatggcagcggcaatggatccaatccaaatacaaatacaaactccaataacaccccgctacagtcacaattaaacctaaacaatctaacccctgctaatatcctaaatatgagcatgaataacgatttccagcagcagcagcaacagcaacagcagcagcagcagcctcaaccacagtacaatatgaatatgggcatgaataacatgaataacggggggaaagaactggattctctagacctgaacaatctggaattaggtggtctgaacatggatttcttgtga

SEQ ID NO: 2802 - DNA, 1194 bp, Saccharomyces cerevisiae
atgggatttatagcaaatatactgtgctgttcttcagatacttccaaaacacatcgtcaacgccaaccaccagaaactaatcacaaccgcaaccgcaaccgtaagcacagttcaaacaaagctcaaactcagggtcgtaagcagaaggctactccaaacggcgacaagatgcaatattccacaccggagatccttttgtctagttccgattcaggcagcaatgcgggttccaagacaatgcaggagaatgggaatagcggcaatggaaaactagcacctttatcaagagatcactccaacaactcgtacgatgaggagaaagaatatgaagattataatgaaggagacgtagaaatgacggaggttaacaatgccggagaagaagaagaagaagatgacgaagcaaaagaaaagcaagaccatgtcgttcatgaatataacgttgacgcagatagaaattccagtattaatgacgaggcgccaccacaacagggtctgtatcaggtgggtcaagaagatatgaatccacaatatgtcgccagcagtcctgataatgatttaaacttgatacctacaacggaggaggacttctctgacctgacgcatttgcaaccagaccagtaccatgcccccggatacgacactctgctaccacccaagttgcaagaatttcaacagaaaaaatgtctgatattggatctagacgaaactttggtacattcttcctttaaatatatgcattcagctgatttcgttttgcccgtcgaaatcgatgatcaagttcacaatgtctatgttattaagaggccaggcgtcgatgagttcttgaacagggtgagtcaactatacgaagttgttgtgttcacggcaagtgtttcgaggtatgcaaacccccttttagatacgttggaccctaatggaaccatccatcatcgattattcagagaagcttgttataactacgaaggtaactacatcaagaacttatcgcagatcggaagaccattgtccgaaacaatcatcttagataattcgccggcctcttacatctttcatccgcaacatgctgttccgatatcttcttggttctctgatactcatgataatgagttactagatattatcccacttttggaggacctttcatcaggaaacgtgttggatgtggggagcgtgttggatgtgacgatatag

SEQ ID NO: 2803 - DNA, 1194 bp, Saccharomyces cerevisiae
atggggttcagaaaaatacttgctagcaaatcgcatcacagtcgccaccataatcagcaccataagaacctgaagttgcaaaatcatcgctatgtacttatttccaatattacaggatcccatgaaacaaaatatttatcacccttcaggatggacaattgttcaggaagcagaagacgtgataggctacatgtgaagcttaaatccttgaggaataaaatccacaaacaacttcacccaaactgtcggttcgatgacgccactaagactagtgatgataaatgcgtctcttatgaggtgcccgaaagggatggccttgctactatttcgttagaagaggtttttccaaagtccaacaggtgccaaatacctgaagaaaacttgggagaaacagatagcgttattcacagagatttgggaaattttgcaaatgagaatgactatccacagtggagaaaagttgaaagtcaatataacttagagaatgtccagcctgaggaggatgaaatagttgatagactcaggtccgagattagaagcactaaattaaaatctgtaaaaacgacaagcagaacacttgaaaaagctatagaggctcgatgtactggaaagagagttcttcaacaactaagttgtcagagcaaccaactcaccaagatcgagagcaattgtgacatgcttaaaattcaatctaacgtagccgaccgaaagattgacgaacttgcccatgaaaatagaagcctgcttgcattaaaatcacccaaccccttcaggaagaaaagggagagagaaaagcgagaccagatctacaatttgaagttaaagcatcgtcacttacagcaagaaactatgaaaagagcccaagattctgacaaaaatttagccataaatctaagttctgaatatggacggtatggccaaggggtggaaagacagcgtattcttagagatgcccagaagtatcagtttgaagccgatgaagaagataaccaaatggaaatcgacttgtacggaaacctagaacaaataaaagcggtgagtggtgacttgaaaattatggctcacgcttttggcagagagtttgaagcacaaaacactagaatgtttgacatcgagaacaatgtacagcaggcagataatgctttacaggccaagcgatatagattggagaaagtgatcgggaaaagatggtga

SEQ ID NO: 2804 - DNA, 1194 bp, Saccharomyces cerevisiae
atgggtggttcttccgattcagactctcacgatggatatttgacttccgaatataattcctcgaattctcttttttcacttaacaccggtaacagctattcaagcgcatctctcgacagagccactttagattgtcaagattctgtttttttcgataatcacaaaagttcactgctgtctacagaggtcccaaggtttatttctaacgacccgttacacttacccattacactgaattacaaaagagacaatgcagaccctacgtatacaaatggaaaagttaacaagtttatgattgttttgattgggctaccagctactgggaagtctaccatttcttctcatttaattcaatgtttgaagaacaatccgctaactaattcattacgctgtaaagtttttaatgctggtaagataagaaggcaaatcagttgtgctaccatttcaaagcctttgcttttgtcgaatacatcttcggaagacttatttaatccgaaaaataacgataaaaaggaaacgtatgccaggatcactttgcaaaagttgtttcacgaaatcaacaacgatgaatgtgacgtgggaatcttcgacgccacaaattcgaccatcgaaagaagaagatttatatttgaggaggtttgttcgttcaatacagatgagctttctagtttcaatttggtgcccataatcttacaggtgtcatgttttaacagaagctttatcaaatacaatatccacaataaatcgtttaatgaagactacttagacaaaccttatgaacttgccatcaaagattttgcaaagagattaaaacattactattcgcagtttacacctttctcccttgatgagttcaatcaaatccatcgatatatcagccaacatgaagaaatcgatacgagcttatttttcttcaatgttattaatgcgggcgtcgttgagccacattctttaaatcaaagtcattacccttcaacctgcggcaagcaaattagggacaccattatggttattgaaaatttcatcaatcactattctcagatgtttggttttgaatacatcgaagctgttaaattgttttttgaaagttttggaaatagctcagaggaaactttaactacactagactctgttgttaatgataaattttttgatgatttgcagagcctaattgaaagcaacggatttgcttga

SEQ ID NO: 2805 - DNA, 1194 bp, Saccharomyces cerevisiae
atgtccaaagtgtttattgccacagcaaatgcaggtaaagctcatgacgctgatattttctcggtttctgcttgcaattcatttacggtaagttgttcaggtgacggttacttaaaggtgtgggataataagctgttagataatgaaaatccaaaagataagtcatattctcactttgtccataagtccggattgcaccatgtcgatgtcttgcaagctattgagagagatgcatttgaattatgccttgttgctaccacttcattttctggcgatttactcttctatcgtatcactagagaagatgagactaaaaaagttatattcgagaaattggatcttctagactcagacatgaaaaagcattccttttgggcattaaaatggggtgcctcaaatgacagactactttcccataggctggttgctacagacgtcaaagggaccacttacatttggaagtttcacccgtttgcagatgagtcaaattctttaacactaaattggagccccacgttagaattacaaggcactgtcgaatcgcctatgactccaagtcaatttgccacttctgtggatatctctgaacgaggactaattgccacaggttttaataatggaacagtacaaatttcagaactatctacattacgcccgttgtacaattttgaatctcagcattctatgattaataattcgaattccatcagatcggtgaaattttctcctcaaggatccttattagccattgctcacgattcaaattcatttggttgcatcactctatatgaaactgaatttggtgaaagaataggctccttatccgtaccaacccatagctcgcaggcaagtctgggtgaatttgcacattctagctgggtcatgagtctatcgtttaatgattctggtgaaacattatgcagtgccggatgggatggtaaattgagattttgggatgtaaaaacaaaggaaagaatcactacattgaatatgcattgtgatgatattgaaattgaagaggatatcttagctgttgatgaacatggagattctttagctgaacctggtgtctttgacgtgaagtttttgaaaaaaggttggagatctggtatgggagctgatttaaatgaaagtttatgctgtgtttgtttagatagaagcatcaggtggtttagagaagctggcggtaaataa

SEQ ID NO: 2806 - DNA, 1194 bp, Saccharomyces cerevisiae
atgtcgactgaagaacaaaatggaggtggtcaaaagtctctagatgatagacaaggtgaggaatcacaaaaaggtgagactagtgaaagggaaacaacagccacagagagcggtaacgaaagtaagtctgtagaaaaagagggtggagaaacccaagaaaaaccgaagcagccacatgtcacttattacaatgaggagcagtataaacagtttattgcccaagcgagagttacaagtgggaagtatagtttacaagactttcagatattaaggacactgggtacgggttcttttggtagggtccatttgattagatcaagacataatggcagatactacgccatgaaagttttgaaaaaggaaatcgtggtaagattgaaacaggtggagcataccaacgacgagcgattgatgctttctatcgtaacacatccgtttattattagaatgtgggggactttccaagatgctcagcaaattttcatgattatggattatattgaaggtggagaattgttttctttgttaaggaaatcccaaagatttcccaacccagttgctaaattttacgcagcggaagtttgtttagctttggagtacttgcatagcaaggacattatttatagggatttgaaaccggaaaatatcttgcttgataaaaacgggcatataaagataacagatttcgggtttgccaaatacgttcctgacgtcacatatacattatgcggtactcccgactacatagcacccgaggtcgttagtactaaaccatataataaatctatcgattggtggagtttcggtattctgatttacgaaatgctagcaggatacacgccattttacgactctaacacgatgaaaacctatgagaaaatcttgaatgccgaattgagatttccaccatttttcaacgaagatgtaaaggacctgttgagtagattgatcacaagagacttaagtcaaagactaggtaatttacaaaatggtacagaagatgtcaaaaaccacccctggttcaaagaagttgtctgggaaaaattattatctagaaacatagaaacgccgtatgaaccgcccattcaacagggacaaggtgacacctcacagttcgataagtacccggaagaagacatcaactacggtgttcaaggtgaagacccatatgctgatcttttccgggacttctaa

SEQ ID NO: 2807 - DNA, 1194 bp, Saccharomyces cerevisiae
atgtcgcctttgagaaagacggttcctgaatttttggcacacttaaaatcactgccaatttcaaaaattgcaagcaacgatgtgttaacaatatgtgttggtaacgagtcagcagatatggactcaattgctagtgcaatcacttattcgtactgccaatacatatataatgaaggtacttactcggaggagaaaaagaaaggaagctttattgtcccaattatcgacattcctagagaagacctcagtttaagaagagacgtaatgtatgtcctagaaaaactgaaaattaaggaggaggaattattcttcattgaagatttaaagagcttgaagcaaaatgtctcccagggtactgaattaaactcttacttggtagataataacgatacaccaaagaatttgaaaaattatatagataacgtcgttggcattatagaccaccattttgacttgcaaaaacatttggatgctgaacctcggattgtaaaagtgtccggcagttgctcatcgctggtttttaactactggtatgaaaaattgcaaggtgaccgtgaagtggtgatgaacattgcaccacttttgatgggggccatcttaatagacacttcaaatatgaggcgcaaagtcgaggaaagtgataaattagctatcgagagatgccaagctgttcttagtggtgcggttaatgaagtgtctgcgcaaggtttagaggacagcagtgagttttataaagagataaaatcaagaaagaacgatattaaaggattttcggtaagcgatattctaaagaaggactacaaacaattcaatttccaaggaaagggacacaaagggttagagattggtctttcatcaatagtaaaaagaatgtcttggctattcaatgaacacggtggtgaagcagatttcgtcaaccaatgcagaagatttcaggcggagagggggctcgatgtattggttctgttgacttcatggaggaaagctggtgattcacacagagaattggtcatattgggagactctaacgtggtacgtgaactcattgaaagggttagcgacaagctccaacttcaattatttgggggcaatcttgatggaggtgtggcgatgtttaagcaactgaacgtcgaggccaccagaaagcaagtcgtcccctatttagaggaagcgtactcaaacctggaagagtga

SEQ ID NO: 2808 - DNA, 1194 bp, Saccharomyces cerevisiae
atgtttagagatagaactaatttatttttatcataccgtaggactttccctcataacataactttctcatctgggaaagcacccttgggcgatgatcaagatattgaaatgggtacatacccgatgatgaatatgtctcacgatatatcggccagattgacagatgaacgaaaaaacaagcatgagaatcacagtgatgcgttaccacccatatttattgatatagcgcaggatgttgatgattatcttctggaggtgagacggttaagtgagcagttggcgaaggtttataggaagaattcgttacctggctttgaagacaagagtcatgatgaggcgctgattgaagatctaagtttcaaagtaattcagatgctgcagaaatgttacgctgttatgaaacgattaaagaccatatacaactctcaatttgtggatggtaagcaattaagtcgagaagagctgattatactagataatctacagaagatctatgcagaaaagatacaaactgaaagtaataagttcagagtattacaaaataattacttgaaattcttgaacaaggatgatttgaaacctatccgcaataaggccagtgcagagaacacgctattattagatgatgaggaagaggaggcagcaagagagaagagagagggcctcgatattgaagactattcaaaaaggacgttgcagagacagcaacagcttcatgacacttctgcagaagcatatttgagagaacgtgacgaagaaattactcagttggcaaggggtgtattagaagtgagcactattttcagggaaatgcaagatttggttgttgaccaggggactattgtggacaggattgattataatctggaaaatacagtggtagagctaaaaagtgcagataaagagttgaataaagcaacacactaccagaagagaactcaaaaatgtaaagtcattttattactaacattgtgcgtaatagcgctctttttctttgttatgttgaaaccacatggcggtggcagtggtggtcgtaataatggtagcaacaagtacaacaatgatgataataaaacagttaataacagtcatgatgacggcagtaatacccatattaatgacgaagagagcaacttgccgagtatcgttgaagtaacagaatctgagaatgatgctttggatgacctactttga

SEQ ID NO: 2809 - DNA, 1197 bp, Saccharomyces cerevisiae
atgaaattaaaattattaaatataattttatcaataataaataaacttaataataataataatattattattaataatctattagattcattaataaataagaaattattattaaagaatatattattagatataaataataaaaaaataaataatataaaaagaatattaaataataataatataaaccccgcgggcgccaatccggttgttcaccggattggtcccgcggggaatattaataataaattacaacatttaaataatataaataattgaaatctacaaatttataattataataaaaatatagaaattataaatactataaatgataaattaattaataaattattatataaaataataactttaaaattaaataatataaatattaataaaattattataagtaaacttattaatcaacatagtttaaataaattaaatattaaattttattattataataatgatattaataataataataataataataataataattattatataaatataataaataaattaataaatattataaataataatataaataataatttatgtaatattttaagttattattataaaaaaaaagtaactattgaacctattaaattatcatatatttatttaaatagtgatatttttagtaaatatattagtttaaatgatatagataaatataataatggtatcttaactaattatcaacgtatattaaataatattatgcctaaattaaatgatcataatatttctataaattatattaataatattaataatattaataataataaatataataatataattaatttattaaataataataataatattaataataataataattataataataataataataattatattggtaatattaataatatttataataatataactattgataatattcctatagatattttaatatataaatatttagttggttgatctattaaatttaaaggtagattaagtaataataatggtagaactagtacacttaatttattaaatggtacttttaataataaaaaatatttatgaagtaatattaataataattataaattaaattatatcccttctaatcataatttatataataattctaatattaataaaaatggtaaatataatattaaagttaaattaaactttatttaa

SEQ ID NO: 2810 - DNA, 1197 bp, Saccharomyces cerevisiae
atggctttggagggattgcggaaaaaatataaaacaaggcaggaattggtcaaagcactcactcctaaaagacggtccattcacttgaactccaatggtcactccaacggaactccctgttcaaacgcagatgttttggctcatattaagcatttcctgtcattggcggctaattcattagagcaacatcaacagcctatttcaatcgtctttcaaaacaaaaaaaaaaaaggcgatacaagcagtcctgacattcacacaacattggacttccctttgaatggcccgcatctatgcactcatcagttcaagttgaaaagatgcgcaatccttttaaacttattgaaagtcgttatggaaaaattaccgctaggtaaaaacactacagtgagagatatcttctactccaacgtggaattgtttcaaagacaagcaaacgtagtccagtggctggacgttatacgctttaatttcaagctctctccaagaaaatccttaaacattataccagctcaaaagggtttagtttattcgcctttccccattgatatttatgacaatattctgacatgtgaaaatgaaccaaagatgcaaaagcaaacaattttccctggtaagccctgtctaattccatttttccaagatgatgcggtcatcaagttagggacaacaagtatgtgtaatattgtaatagtggaaaaagaagctgtcttcaccaaattagtaaataattatcacaagttgagtacaaataccatgctcattacaggtaagggatttccagatttcttgacaaggttattcctaaaaaaactagaacaatattgctccaaattgatatcggactgttctatatttaccgatgcggacccctatgggattagcatagccctaaattatactcactcgaatgaacgcaacgcttatatttgcacgatggcaaactataaaggaattcgtattacgcaagttttggcacaaaataatgaagtgcataacaaatccattcaattattgagtttgaatcagcgcgactactccttagccaagaatttgatagcatctctgactgccaacagctgggatattgcaacttcaccattaaagaacgtcatcatagaatgtcagcgggaaatttttttccaaaagaaagctgaaatgaacgagattgatgccagaatttttgaatacaaatga

SEQ ID NO: 2811 - DNA, 1197 bp, Saccharomyces cerevisiae
atggttagcttaacctttaaaaatttcaagaaggaaaaagttcctttagatctggaaccttcaaacacaattttagagaccaagaccaagcttgctcaatccatttcttgtgaagaatctcaaataaaactgatctactcgggtaaagtgctacaagattccaaaaccgtatcggaatgcgggctaaaagatggggaccaagttgtcttcatggtttctcaaaaaaagtccacgaagaccaaagtaacagaacctccaattgctcctgagagcgccactacccccggaagagaaaattctacagaagcatcccccagtacggatgcttctgcagctcctgcagccactgctcccgaaggctcacaaccgcaagaagaacaaaccgccactacagaacgtactgaatctgcctctacaccgggattcgtggtgggaaccgagaggaacgagaccatcgagagaatcatggaaatgggctaccaaagagaggaagtcgaacgagccttgagagcagcctttaataatccagatagagcggtggaatatctactgatgggtattccagaaaatctgcgtcaaccggaaccacagcaacaaacagccgccgcagcggaacaaccatcgacagccgccaccactgcggaacaaccggctgaagacgacttatttgcacaagctgcccaaggcggtaatgcttcatccggtgcgcttggcacaactggaggagctacagatgctgcgcaaggtggacctccaggttccattggcctcactgtagaagatttactatcgttgagacaggtcgtttcaggtaacccagaagctttagccccattgttggaaaacataagtgctagatatcctcaattacgtgaacatatcatggcaaacccagaagtgtttgtgtccatgttgctagaagccgtgggtgacaatatgcaagatgttatggaaggtgcggatgatatggtggaaggagaggatatagaagttacaggagaggctgctgctgcaggactgggacaaggtgaaggtgaaggttctttccaagttgactatacccccgaagacgatcaagctatttcgcgcctctgtgaattgggctttgaaagagatcttgttatccaggtgtattttgcgtgcgataaaaacgaagaagctgcagcaaatattctattcagcgatcatgccgactga

SEQ ID NO: 2812 - DNA, 1197 bp, Saccharomyces cerevisiae
atgtatgttgatccgatgaacaacaatgaaatcaggaaattaagcattactgccaagacagaaacaactccagataacgttggacaagacattcctgtaaacgcacattcggtgcatgaggaatgttcttccaacacacccgtggagataaatggaagaaacagcggaaagttgaaagaagaagcgtctgcaggtatttgtttggttaaaaaaccaatgctacaatatagagatacctcaggaaagtattccctaagtgactttcagattttaagaactttgggaactggctcatttgggagagttcacctaattcgttccaatcacaatgggaggttttacgctttgaagacattgaaaaagcacactatagtgaagctgaagcaggttgaacacaccaatgacgaacgccgaatgctttcaattgtttcacatccattcatcattcgaatgtggggaacgttccaagattctcagcaagttttcatggtaatggactacattgaaggtggtgaattattttctttactacgtaaatctcaaagatttcccaacccagtagccaaattttatgccgcagaggtatgcttagcgttggaatatttgcacagtaaggatataatatatagagacttgaaaccagaaaatatccttctagataaaaacggccatatcaagataaccgactttggcttcgcaaaatacgttcccgatgtcacatacacattatgtggcacaccagattacatagcgccggaagtggtcagtacaaaaccgtataataaatcagtggattggtggagttttggtgtgctaatctatgaaatgcttgccggatacactccattttacaattcgaacaccatgaaaacttacgaaaatatactgaacgccgaattgaagttcccaccatttttccatccagacgcgcaggacttattgaagaagctaattaccagagacttaagtgaaaggttgggtaacttacaaaatggaagtgaagatgtcaagaaccatccgtggtttaacgaagtgatatgggagaaattgttagcaagatacatagaaacgccgtacgaaccaccaatccaacagggccaaggtgacacttctcaatttgacagataccctgaagaggaattcaactatggaattcaaggggaggatccatatatggatttaatgaaagaattttaa

SEQ ID NO: 2813 - DNA, 1197 bp, Saccharomyces cerevisiae
atgtcagaagaagacgatcattggaatttagttagattacgtagattacgtaaagggagagaaggggaagaacagtcatcgaagtcagaaatatctttggatagtttgcatgaaagctcctttgcaggagaggacgacgaggacttcgatgcagatgtcctatcgaacactagcagtgaagagtctgcacagatgaatcgtatttacgattttagaacatctaatgaatttagtaatgctggagttaatattgatcaaactggagttcccactatttcagagtcatttgatactttgtccggctcaaatgttggcggaacggtattgccaagtatggaggggtcgaaactgaaggatagtacgataaggaattctagcacactatcggatcatatcatagataaaagtgagggtaaatctgctaaattgaagatgtggcatgttatcatgctatcttcattgctttccatgaccttttcatacctcgccctcgaatattccctgactggtgatgtgttggcaggttttaaatcacaacagtcattacgtaataatgaaaggaagctgttgtacggcaatatcgattttgttgataaaaaatcttacgattcatcaagtgactctttaagtcagtgggctccttcaggaaaatactacgtcgacttcgacaatcatattgcatacccattaaaggatgatgacctaatgggctggagacgatacaaaacagacttagttattttatggtatacaacaaaagctcgaatgaaagacggttggcacaagagaattaacaaaataaacggaggaagaataaagttacacctatttctcaagaattcttttaaatccgctcaagaaagtttaagggtattgcataaagaacagaaacgccgctggaaaaggctctttgtgctacttcataataaatacaggcaattttctccacatattaaaaggtatttcgatcattcttgccaaaaagcaaaacaatgttggtcgggatccagattgcagttgcgcaagcttcgtttcaagtcaatgaaaccattccgagtttttcagtttaaggttcgcaaagataccaactggtttgtaaagcagctgaaacggttcggattgaaattacagcattcgaggatgtataaagcgatgtcagaatgcaggaaaaaaaattattttaagtgcaaacactag

SEQ ID NO: 2814 - DNA, 1197 bp, Saccharomyces cerevisiae
atgtctcagaacgtttacattgtatcgactgccagaaccccaattggttcattccagggttctctatcctccaagacagcagtggaattgggtgctgttgctttaaaaggcgccttggctaaggttccagaattggatgcatccaaggattttgacgaaattatttttggtaacgttctttctgccaatttgggccaagctccggccagacaagttgctttggctgccggtttgagtaatcatatcgttgcaagcacagttaacaaggtctgtgcatccgctatgaaggcaatcattttgggtgctcaatccatcaaatgtggtaatgctgatgttgtcgtagctggtggttgtgaatctatgactaacgcaccatactacatgccagcagcccgtgcgggtgccaaatttggccaaactgttcttgttgatggtgtcgaaagagatgggttgaacgatgcgtacgatggtctagccatgggtgtacacgcagaaaagtgtgcccgtgattgggatattactagagaacaacaagacaattttgccatcgaatcctaccaaaaatctcaaaaatctcaaaaggaaggtaaattcgacaatgaaattgtacctgttaccattaagggatttagaggtaagcctgatactcaagtcacgaaggacgaggaacctgctagattacacgttgaaaaattgagatctgcaaggactgttttccaaaaagaaaacggtactgttactgccgctaacgcttctccaatcaacgatggtgctgcagccgtcatcttggtttccgaaaaagttttgaaggaaaagaatttgaagcctttggctattatcaaaggttggggtgaggccgctcatcaaccagctgattttacatgggctccatctcttgcagttccaaaggctttgaaacatgctggcatcgaagacatcaattctgttgattactttgaattcaatgaagccttttcggttgtcggtttggtgaacactaagattttgaagctagacccatctaaggttaatgtatatggtggtgctgttgctctaggtcacccattgggttgttctggtgctagagtggttgttacactgctatccatcttacagcaagaaggaggtaagatcggtgttgccgccatttgtaatggtggtggtggtgcttcctctattgtcattgaaaagatatga

SEQ ID NO: 2815 - DNA, 1200 bp, Saccharomyces cerevisiae
atgactcccgaacaaaaggccaaactagtatgtgtgaaaatgattctgtgtttgtattttaaccgtgggtttctttttactaacaatttaacgatgagatgagctgtgcaggaggctaacaggaaattagcaatagaacggttaagaaaaaggggaatactgagtagcgaccaattgaatcgaatagaaagtaggaatgaacctttaaaaacccggcctctcgcagttactagtggcagcaatcgggatgataatgcagcagccgcagtacatgtgccaaatcataatggacaaccgtctgcgcttgctaacactaacactaacactacttcactttatggtagcggagtagttgatggaagtaaaagggatgcgtcggtactcgacaaaaggccaacggatagaatcagacctagcataaggaaacaagattacattgagtacgattttgccaccatgcagaacttgaatggtggttatatcaaccctaaggacaagcttccaaattctgactttaccgatgaccaagaatttgaatctgagtttggatctaaaaagcagaagacactacaggactggaaaaaggaacaacttgaacggaaaatgctgtacgaaaatgcacctcctccagagcatatttcaaaggcgccgaaatgtattgaatgtcatattaatattgagatggatcctgtgctacatgatgtgttcaagttacaagtttgtaaacagtgttctaaggagcatccagaaaagtatgcactactgacgaaaacagaatgtaaggaagattactttttaacagaccccgaattgaatgatgaggatctctttcatagactagaaaagccgaaccctcattcggggacatttgcaagaatgcaactatttgttagatgtgaagtggaagcctttgcgttcaagaaatggggtggagaagaaggtttagatgaggaatggcaacgtcgtgaagaaggaaaggctcacagaagggagaaaaaatacgaaaagaaaatcaaggaaatgcgactgaaaacaagagctcaagaatatactaatagattaagagaaaagaagcatgggaaagcccatattcatcattttagtgatccagttgatggaggtattgatgaagacggttatcaaattcaaagaagaagatgtacagactgcgggctagaaactgaagaaattgacatttaa

SEQ ID NO: 2816 - DNA, 1200 bp, Saccharomyces cerevisiae
atgagcttttattcaaacctaccgtctgcaggacaatctagtcgagggtcttcaacaagcggtcgaaatggggtgggattagaaccattgtatccgactatctttgagataatgtcatcacaagaaatcgattcgttactgcccgcatccatccgttatctactggcaaatcatttagtggcgaacttccctaacaggtatactttgcggctgaacaagtacttttttgagtggtttcaagcgataaaagggtttgttgaatggtatcatctaaagacatacaattctacgtttattgatcggttttatggattgcaactatttagttcgagggacagaaatcttgccttaacacaatgtttaaatccaaagggccagagtgaatggccccaaggtttgcagctgaatcaacagcaaaagagtgttatttttttggaaaaaattattctcccctatatcacagcgaagttggatgaaatattagagaaaatatcaatgaataatatattcagcagcgatgaaactgaaaataaatggcccaagagagcgtttctaagaatttatccatttattaagaaattattagcgttatccaatttactcgttaaattattatttttaactaaaagaacagggtcggtttccttgttgcaatacttattcaagatagagtacacaacggtaagaccactatcgtcagaactctctggtctcaaagagacgaaagggatggataataggctaaggaaaacaaatatatcgtcaattttcgcgctaatgcaaggacaattatcgattatacccagatttttaacatttatgggttcgcaattcttccccacttttatatttgtcctaagagtgtaccaatggtggaccacacaagacatgactactaaattgcagaaaagggtcaatgacttggatgaagatattccaaggccgcctttctcctcacatagtgacaaaacggaagataaagagggagtttctgaggcctgtcccgtttgcgaaaaaactgtacaaaacccctgtgtattggaaacaggatacgtggcatgctacccgtgtgccataagctatttggttaataatgaaggccattgtcccgttaccaataaaaagctgctgggttgtacatacaacaaacacacgaataaatgggaagttgtgacaggtattaggaagctactaatctga

SEQ ID NO: 2817 - DNA, 1200 bp, Saccharomyces cerevisiae
atgcaaaagatcagtaaatactcatctatggcaattctgaggaaaagaccgctggtaaagactgaaactgggccagaatcagaactcctaccggagaaaaggaccaaaatcaaacaagaagaggttgtccctcaacccgtggatatcgactgggttaaatcgctgccaaataagcagtacttcgaatggattgtggttagaaacggcaatgtgcccaacaggtgggccacaccattggacccctcgatccttgtcactccggcctcgacgaaagtcccttacaagtttcaagaaacatacgctagaatgcgagtactgagatctaagattctagcccccgtcgatataattggtggatcatccattcctgtaacggttgcctctaagtgtggtatctcgaaagagcagatatcaccgagggactacagattacaggtccttcttggggtgatgctatcatcgcaaacaaaagatgaagttaccgcaatggcaatgcttaacataatgcggtattgtatagacgaactgcacagcgaagaaggtatgacattagaggccgttttacaaatcaatgagaccaaattagacgaattgattcattcagttgggttccacacaaggaaggccaagtatattttgtcaacctgcaaaatccttcaagatcagttttcgagtgatgttccagctacgattaatgagctattgggcctgcccggtgtagggcccaaaatggcttatctaacattacaaaaggcatggggcaagattgaaggtatctgcgttgacgttcacgtggatagattgaccaagctttggaaatgggtagatgcgcagaaatgcaagactccagatcagacaagaactcaattacaaaattggctgcctaaggggctttggacagaaataaatgggttgctggttggatttggacaaataatcactaaatcgaggaaccttggtgacatgttacaattcttgccaccggatgatcccagaagctccttagattgggatttgcagtctcaattgtacaaggaaatccagcaaaatatcatgagttatccaaagtgggtgaaatacctggaaggaaaacgtgaactgaacgtggaggcggaaatcaatgttaaacacgaggagaaaacagttgaagaaactatggtcaaactggaaaatgatatttctgttaaagtagaggactaa

SEQ ID NO: 2818 - DNA, 1200 bp, Saccharomyces cerevisiae
atgcctaaagagaccccttccaaagctgctgccgatgcattgtccgacttggaaatcaaagattccaagtccaaccttaacaaggaattggagacattgagagaggaaaacagagtaaagtcagacatgcttaaggagaaattgagcaaggacgctgaaaatcacaaggcttacttgaaatctcatcaagttcaccgtcacaaacttaaggaaatggaaaaggaggaacctttgttgaatgaagacaaggagagaactgttcttttccctatcaagtaccatgaaatctggcaagcctacaagcgtgccgaagcttctttctggaccgctgaagaaattgatttgtctaaggatatccatgactggaacaacagaatgaacgaaaacgagagatttttcatttccagagttcttgcctttttcgccgcttctgacggtattgttaatgaaaacttggttgaaaacttctccaccgaagtccaaattccagaggcaaagagtttctacggtttccaaatcatgattgaaaatattcactctgaaacttactccttgttgatcgatacttacatcaaggaccctaaagaaagtgaattcttgttcaatgccattcacaccatcccagaaatcggtgagaaggccgaatgggctttaagatggattcaagacgctgacgccttgtttggtgaaagactagttgcctttgcctccattgaaggtgtctttttctccggttcctttgcctccattttctggttgaaaaagagaggtatgatgcccggtttaaccttttccaacgaattgatctgtagagacgaaggtttgcacaccgactttgcatgcttgttgttcgcccatttgaagaacaaaccagacccagccattgttgaaaaaattgtcaccgaggctgtggaaattgaacaaagatacttcttggacgccttaccagttgctttgctaggtatgaacgctgacttaatgaaccaatacgttgagttcgtcgccgacagactgttggttgctttcggtaacaagaaatactacaaggtcgaaaaccccttcgatttcatggaaaacatctccttggccggtaagaccaacttcttcgaaaagagagtttctgactaccaaaaggctggtgttatgtccaagtcgactaagcaagaagccggtgctttcaccttcaacgaagacttttaa

SEQ ID NO: 2819 - DNA, 1200 bp, Saccharomyces cerevisiae
atgctagccgaaaaaacccgttccataatcaaagcaaccgttcctgttttggaacagcagggcactgtcatcacgcgtacattctacaaaaatatgcttactgaacacaccgaattacttaatatttttaacagaactaatcaaaaggttggcgcacaaccaaatgccttggccactactgttttggcagcggctaagaacattgacgatttgtctgtgcttatggaccatgtcaagcaaattggccacaagcatcgtgccttgcaaattaaacctgagcattatccaatcgttggtgagtacttgttaaaagcaatcaaggaagttttaggcgatgctgcgactccagagataattaatgcatggggcgaggcttaccaagcaattgctgacatcttcatcactgttgaaaaaaaaatgtacgaagaagctttatggccaggttggaaaccatttgacattactgccaaagagtacgttgcttcagatattgttgaatttactgttaagccaaagttcggttctggtattgaattggaaagcttgccaatcactccaggtcagtatattacggtaaacactcacccaattagacaggaaaaccaatacgacgctttaagacactactctctttgttctgcttcaactaaaaatggtttacgatttgcagtaaagatggaagctgccagagaaaattttcctgcaggattagtctctgaatatttacacaaggacgctaaagttggtgatgaaattaagcttagtgctccggctggtgatttcgcaataaataaagagttgatacaccaaaacgaagttccattggtgttactatcgtctggtgttggtgttacaccacttttagctatgttagaagaacaagtcaaatgcaacccaaataggccaatttactggattcaatcttcctatgatgaaaagactcaagcattcaaaaaacatgtagatgaactattagctgaatgtgcgaatgtcgacaaaataattgttcatactgatactgaaccactgattaatgctgcattcttgaaggaaaagtcacctgcgcatgccgatgtctacacttgcggctctttagcttttatgcaagctatgattggtcatctaaaagaactagagcatcgtgatgatatgattcactatgaaccatttggtccaaagatgtcaaccgtgcaagtttag

SEQ ID NO: 2820 - DNA, 1200 bp, Saccharomyces cerevisiae
atgtcgtttgacagagaagaagaccaaaaattgaagtttaaaacatcgaaaaaattaaaggtgtcttctacttttgaaagcatgaatctaaaagatgacttacttcgaggaatatactcatacggttttgaagcaccatcctctatccaatcaagggctattacacagattatttcgggcaaggacgttatagcacaagcacaatcaggtacaggtaagacagcaacttttacaatcggccttttacaagctattgatttaaggaagaaagatttacaagctctaatactatctccaacacgtgaattagcaagccaaattgggcaagtagtaaaaaatctaggggattatatgaatgtcaatgcatttgccattacaggtggtaaaactttgaaagacgacctgaagaaaatgcaaaagcatggttgccaggccgttagcggaacaccaggaagagtattagacatgattaagaaacaaatgttgcaaacaagaaatgttcaaatgttagttttagatgaggctgatgaattattgagtgagacactaggtttcaagcaacaaatatacgatatttttgcaaaattgcctaaaaattgccaagttgttgttgtcagcgcaacaatgaataaggacattttagaagtaaccagaaaatttatgaatgatccagttaaaatcctagtgaagagggatgaaatatcacttgaaggtatcaaacaatatgtcgttaatgttgacaaagaagagtggaaattcgatactctgtgtgatatatacgattctttgaccattacacaatgtgtgatattctgtaacaccaagaaaaaagtagattggttatctcagcggctaatccaatcaaactttgctgtagtctccatgcatggtgatatgaaacaagaagaaagagataaagtaatgaatgattttagaacaggtcattctcgtgtactgatatcgacggatgtttgggcgcgcggtattgatgtccaacaagtttctttagtcattaactatgacctaccagaaataatagaaaattacatccatcgtatcggtagaagtggtcgatttggtagaaagggtgtggctataaacttcattaccaaagctgatttagcaaaacttagagaaattgaaaaattctattctatcaaaataaatccgatgccagcaaattttgcagaattatcataa

SEQ ID NO: 2821 - DNA, 1200 bp, Saccharomyces cerevisiae
atgtttaagaaatacaaaaatcaagacttggacatggcattttggtggaagaaaaaccccaagaccccttccgattatgccaggttgatcatcgaacaactaaataaattcagctcaccctcgctgactcaggataacaaacgaaaggtacaagaagagtgcacaaaatatctaattggcactaaacattttattgtcggtgatacggatcctcacccaactccggaagccattgacgagctttatactgccatgcatcgtgccgacgtgttctatgaactgctacttcattttgtggatttggaattcgaagcaaggagagaatgcatgcttatattctctatatgccttggatactctaaggataataaattcgtcacagtagattatttagtctcgcaaccaaagaccatatctttaatgttgaggactgcggaagttgctctacaacaaaagggttgccaagatatctttttaacggtagggaatatgattattgaatgtatcaaatacgaacaactttgtaggattatattaaaggaccctcaactatggaaattctttgagtttgcgaaactgggtaatttcgaaatcagtacggaatctttacaaatattaagtgccgcatttactgcacatcctaaattagtgtctaaggaattcttcagtaatgagattaatatcataagattcattaaatgtattaacaagttaatggctcatggaagctacgtaacgaaaaggcagagcactaaactgttggcctcattaattgtgataagatctaacaacgcgttgatgaatatatatatcaactccccagaaaacttaaagctcataatgactttaatgactgacaaatctaaaaacttacaacttgaagctttcaacgtattcaaggtgatggtagcaaacccaaggaagtcaaaacctgtttttgacattcttgttaaaaacagagataaactattgacgtattttaaaactttcggtttagattctcaggattctacttttcttgatgaaagagaattcatcgttcaagaaattgattccttgccgcgtataatttcgtccacaacagaagtttctaataataatgcatcctcaagtaacgtcgccagtataacttctccatcatcagtaatgaacaatcaatcatccatcttaacacattcaacttcacctgattcaagataa

SEQ ID NO: 2822 - DNA, 1203 bp, Saccharomyces cerevisiae
atgacagcctcatcaaatgacgatgacctaatattcgaatgttatagcgatcctgagttaaaaagatggacacaccttgctaatgcaaaagcttggaaaggtattctgaccgtgcagcagtacgctgatagggaacaattgctagggtcttcagagatttctcaaaagaataaatcaaatgaaatgatgacaaaatacccaaaaagttaccagtggcttgggcagaagtactttgttttaaaggatcgatctttgccagataatggaaaatttagtcaagttgtttccagttgcgaaactttaaacaggattggatattgtattcatccgggttctaatggaaaaatcgagccagctttgattgtatgcattgggggcgtctttacctttgaaaaccatcgcggcaagggctacgccaagaagatgattatcaaactgaatgaattttatgacaagattcgtgatgacgctaacaccgtactagaattgaaaaatttggtgattaacctttacagcgaagtcggagaatattattccgcattaggatacgagagtatgcatgttcccttgcaccgcatttctaaattagatgaacttactgagagatactgtggagaagatgatgaccatgatggtaagtacttgggatttgatgattacaggggtttagtaggactacatgagacacagttcaaagaaagcttattaagtttacacaaagaaaacccagagaagtttgtttttaccgttgcgccagactttgacattttcacatggtttcagtatcgtgatctttttatcatgaataaatcaggaagaaaagcccagcaaaatctgttttttggatacgcgttgagtgataacagccacatcatatggcatcacaattggaacggtgattctctgattattgtcaaaatccatatacctgaagaaacatttcaaaggaaagaattgaagctcaaaaaattactaaggaaggccatagaagagacaaagcttcatggattgcaagaattagaattttgggacgaagaaattcccatcaaaaagtacccacaattgtttcagttattaacagagcttgaaaatgaatctaaagttttctcagaaaacggttccatcagtgctgttcgtccccccaaaggatatacagccgagcaggtaatttgggataacaataccaaattctgttggttttaa

SEQ ID NO: 2823 - DNA, 1203 bp, Saccharomyces cerevisiae
atgagcagtggttcagcaggggcaccagcactttctaataattccacgaactctgtcgcgaaggagaaatcaggtaacatttccggtgatgagtatctttcgcaagaggaggaagtttttgacggtaatgatattgagaataatgaaaccaaagtttatgaagaatccttagatttggacttggaacgtagtaatagacaagtctggttagttagattgcccatgtttctagcagagaaatggagggacagaaacaacttgcatggccaagaactgggtaaaattaggataaacaaggatgggagtaaaatcacacttctattgaatgaaaatgataacgattctataccgcacgaatatgatttagaacttacaaagaaagtagtagaaaatgaatatgttttcacagaacaaaatttaaagaaatatcaacaacgtaaaaaggagttggaagcagatcctgaaaagcaaaggcaagcttacctgaagaagcaagaacgtgaagaggaacttaagaagaagcagcagcagcaaaaacgtagaaataatagaaaaaagtttaatcacagagttatgacagatagggatggtagagatagatatataccatatgtgaagacgattcccaaaaaaaccgccattgtgggtacagtttgccacgaatgtcaggttatgccatcaatgaatgatcctaattatcacaagattgttgaacagagaagaaatattgtcaagcttaataataaggaaaggatcacaactttggatgaaaccgttggtgttacgatgagccacacaggtatgtccatgaggtcagacaactcgaatttcttgaaagtggggcgtgagaaggccaagagcaatattaaatctattcgtatgccaaagaaggaaatcttggattacttgttcaagttatttgatgagtatgactactggtccttgaaggggttgaaggaacgtactaggcaacctgaagcacatttaaaggagtgtttggataaagttgccactctagtgaagaagggcccatatgcattcaaatacactttaaggccagagtataaaaagttgaaagaggaggagagaaaggcaaccttaggtgaactagctgatgagcaaacaggttccgctggagacaatgcgcaaggagacgcggaggctgacttggaagatgaaatagaaatggaagatgtcgtttag

SEQ ID NO: 2824 - DNA, 1203 bp, Saccharomyces cerevisiae
atgccatttgtaaaaggttttgagccgatctccctaagagacacaaacctttttgaaccaattaagattggtaacactcagcttgcacatcgtgcggttatgcccccattgaccagaatgagggccactcaccccggaaatattccaaataaggagtgggctgctgtgtattatggtcagcgtgctcaaagacctggtaccatgatcatcacggaaggtacgtttatttcccctcaagccggcggctatgacaacgcccctgggatttggtctgatgagcaggtcgctgagtggaagaatatctttttagccatccatgattgtcagtcgttcgcgtgggtacaactttggtctttaggctgggcatccttcccagacgtattggcaagagacgggttacgctatgactgtgcatctgacagagtgtatatgaatgctacgttacaagaaaaggccaaagatgcgaataatctcgaacatagtttgactaaagacgacattaaacagtatatcaaggattacatccatgcggctaagaattctatcgcggctggcgccgatggtgtagaaattcatagcgccaatgggtacttgttgaatcagttcttggatccacattctaataagaggaccgacgaatacggcggaacgatcgaaaacagggcccgctttacactggaggttgtcgatgctcttatcgaaactatcggtcctgaacgggtgggtttgaggttgtcgccgtacggcacttttaacagtatgtctgggggtgctgaaccaggtattatcgctcaatattcgtatgttttgggtgaattagagaagagggcaaaggctggtaagcgtttggcctttgtgcacctcgttgaaccacgtgtcacggacccatcgttggtggagggcgaaggagaatattccgagggtactaacgattttgcctactctatatggaagggtccaatcatcagagctggtaattacgctcttcatccagaagtggttagagaacaagtaaaggatcccagaaccttgataggctatggtagattcttcatctctaacccagatttagtctaccgtttagaagagggcctgccattgaacaagtatgacagaagtaccttctacaccatgtccgcggaaggttataccgactacccaacatatgaagaggcagtagatttaggttggaacaagaactga

SEQ ID NO: 2825 - DNA, 1203 bp, Saccharomyces cerevisiae
atgccatttgttaaggactttaagccacaagctttgggtgacaccaacttattcaaaccaatcaaaattggtaacaatgaacttctacaccgtgctgtcattcctccattgactagaatgagagcccaacatccaggtaatattccaaacagagactgggccgttgaatactacgctcaacgtgctcaaagaccaggaaccttgattatcactgaaggtacctttccctctccacaatctgggggttacgacaatgctccaggtatctggtccgaagaacaaattaaagaatggaccaagattttcaaggctattcatgagaataaatcgttcgcatgggtccaattatgggttctaggttgggctgctttcccagacacccttgctagggatggtttgcgttacgactccgcttctgacaacgtgtatatgaatgcagaacaagaagaaaaggctaagaaggctaacaacccacaacacagtataacaaaggatgaaattaagcaatacgtcaaagaatacgtccaagctgccaaaaactccattgctgctggtgccgatggtgttgaaatccacagcgctaacggttacttgttgaaccagttcttggacccacactccaataacagaaccgatgagtatggtggatccatcgaaaacagagcccgtttcaccttggaagtggttgatgcagttgtcgatgctattggccctgaaaaagtcggtttgagattgtctccatatggtgtcttcaacagtatgtctggtggtgctgaaaccggtattgttgctcaatatgcttatgtcttaggtgaactagaaagaagagctaaagctggcaagcgtttggctttcgtccatctagttgaacctcgtgtcaccaacccatttttaactgaaggtgaaggtgaatacaatggaggtagcaacaaatttgcttattctatctggaagggcccaattattagagctggtaactttgctctgcacccagaagttgtcagagaagaggtgaaggatcctagaacattgatcggttacggtagattttttatctctaatccagatttggttgatcgtttggaaaaagggttaccattaaacaaatatgacagagacactttctacaaaatgtcagctgagggatacattgactaccctacgtacgaagaagctctaaaactcggttgggacaaaaattaa

SEQ ID NO: 2826 - DNA, 1203 bp, Saccharomyces cerevisiae
atggacgagaatgaatttgataatcaaagggagaataaagctgtagctcgagtgatcatatcatttcttaagtatgaagagtatgccctaaaggaaatctacaatttgagagtgaaaaaatgggcatcgatctcagatcgtcaaaaagacatggtaccaaactatacaaaatatttagctaatctgaaagccgcaattatagaaaatggcaagttctttagaagtgtcgccgaatatgccctgcaatcaataagttttgagccaggagaaatcgtacaaccaaacgatttagatatgagtaaaacatgctctttacttacgcaagtttatagggagtggtccgcagaggccatttctgaacgtaattgcttaaattcgaggcttgtaccgtttttgaagaccctatcacccccaaaagccgacattttgataccgggttgcggcacaggacgccttctcgtggatcttagcagaatgggctataattgtgaaggtaacgaattttcatatcacatgctgcttgtatctcaatacatgttgaatgcaggattactccaaaaccaaattattatctatcccttcatacactgtttctcccactggaaaaaaattgaagatcagttgtctcccattaaggtgccggacatagaagcgtggtcttcaaataaaggtatggggtccatgtcgatatgtgctggctcgtttgttgattgttatggtcgtaatcaaggcacaaaaatctcgtcacattatacattttcgcgaaggatgcaactaagtagagcaaaagctgaaaactccaaagacgttgtagtaacaaacttttttatagatacgggatccaacatcttggattatttggatactattggccacgtcttgaagccaggcggaatctggtgcaatttcggcccattgctttatcattttgaaaatgaccatggggttgaaactacctacgaagttaacccttactctgggtttcaagataaaatcaatgactatacaccactgatgggtttagagctttctagcgatgatatcataagcattgccacaaatcatctggactttgaattaatacggagagagtcaggaatactttgtgggtatggccgctacgcgggtccagaaagttgcgccatgcctggatacatgtgccactattggatcctgaagtcgaaccccaccaatgaatcataa

SEQ ID NO: 2827 - DNA, 1203 bp, Saccharomyces cerevisiae
atggtttcgtgccaaggaacaaggccatgcatagtaaaccttctcactatgccaagtgaggataaattgggtgaagagatatcaacgagggtgattaatgagtattcaaaactaaaatctgcctgcagaccaataattaggccttcaggtatcagagagtggacaatattggcaggtgttgcagctattaacagagatggcggtgcgaataagatagagatactttccatagctactggtgtgaaggctttgccagattcagaactacaaagaagtgaggggaagattctgcatgactgtcatgcagaaatactggcattacgaggtgctaatacagttttattaaaccgtattcaaaactataatccatcaagtggtgataaattcattcaacataatgacgagatacctgccagattcaatttaaaggaaaactgggagttggcattgtacatctcgagattgccctgtggtgatgccagcatgagtttcctgaatgataattgcaaaaatgatgatttcatcaaaatagaagatagcgacgaatttcaatacgtcgaccgtagtgtgaaaacaatattgaggggacgcttgaatttcaatagaagaaatgtcgttaggactaaaccaggaagatatgattccaatatcactttatctaaatcctgttctgataaattattaatgaaacaacggtcgtcggtactgaattgtttaaattatgaactctttgaaaaacctgtatttttaaagtacattgtgattcctaatttagaagatgaaacgaaacatcatctagagcaatcatttcacactcgtctaccgaatctagataatgaaattaaattcctgaattgcctcaaaccattttatgatgataaattggatgaggaggatgttcctggtctaatgtgtagtgtcaagctctttatggatgactttagcaccgaagaagcgattcttaatggcgtgaggaatggattttataccaaatcatcgaaaccactgaggaaacactgtcaatcgcaagtaagccggtttgcacaatgggaactattcaaaaaaataagaccagagtatgaaggaataagctatttggaatttaaatctcgtcaaaaaaagagaagccagttaattatcgcaataaagaacattttatctcccgatggttggatacccaccagaacggatgatgtgaagtaa

SEQ ID NO: 2828 - DNA, 1203 bp, Saccharomyces cerevisiae
atgtctataatcaaaaaaattgtgtttaagagattcaactcaactttgaaaaaaactgctcttcatgaccttcatgtgtcattaggcggtacaatggtaccatacgcaggatattccatgcccgtactatacaagggacagactcatattgaatcacataattggaccaggacaaacgctggtttatttgatgtttctcatatgttacaaagtaagttatctggtcctcattctgttaagtttctgcaacgtgtaacgcccacagatttcaatgccttgcctgttgggtcagggaccttaagtgttctattaaatccacagggaggcgtggtagacgataccatcatcactaaagaaaacgatgacaatgagttctatattgtgaccaatgctggctgtgcggaaagagacaccgagttctttcacgatgagctacaaaatggttctactttagattgtcaatggaaaatcattgaaggtagatcactattggcattgcagggtcctaaagcaaaagatgtgttggaaccacttttatcaaaaacagctcctggaaaggatctaaaagagttattttttggacaaagacatgaatttgcgttaaaggacggttctttggttcaaattgctagaggcgggtacactggtgaagatggatttgagataagcattgcaaatgagaaagcggttgagtttgcggagcaactcttggccaatccagtaatgaagcctatcggactggctgctagagacagtttaaggttggaagctggtatgtgtttgtatggtcatgaattggacgaaagtatcacaccagtagaagctgcgttaaactgggtgatttcaaagtcaagaagggacctagtagatcaaaagtactggttcaatggctatgccaagataatggaccagctaaacaataaaacgtatagcaaggtacgagtcggattcaaatacttgaaaaaggggccagctgccagaaatggtgtcaagatcttcttgcccgatgccgaaacagaggtcggccttgttacatcaggtagtgcatctccaactttaaacaacatcaatattggacaagcttatgtacagaaaggttaccacaagaagggaacgaagttgcttgttcaagtaaggaacaagttctacccgattgaacttgctaaaatgcctcttgtgcccacacattactacaagcagtaa

SEQ ID NO: 2829 - DNA, 1203 bp, Saccharomyces cerevisiae
atgtctcaagttcaagaacaacatatatcagagtcacagcttcagtacgggaacggttcgttgatgtccactgtaccagcagacctttcacagtcagtcgttgatggaaacggcaacggtagcagcgaagatattgaggccaccaacggctccggcgatggtggcggattgcaggagcaagcggaagcgcaaggtgaaatggaggatgaagcatacgatgaagctgccttaggttcgtttgtgccaatagaaaaactgcaagtgaacgggattactatggcggatgtgaaaaaactaagggagagtgggcttcacactgctgaagcggtagcatatgctcccagaaaggatttattggaaatcaaaggtatatcggaagctaaggcagataagttgctaaacgaagcggcaaggctagtgcctatgggatttgtcacggctgctgattttcatatgagaagatcggagctgatttgtttgacaacgggttctaagaatttggacactcttttgggtggtggtgtggaaactggttctattactgagcttttcggtgaattcaggacaggtaagtcccagctatgtcacactttggccgtgacatgccaaattccattggatattggtggcggtgaaggtaagtgtttgtatatcgataccgaaggtactttcaggccggtaagattggtatccatagctcagcggttcggattagacccggatgatgctttgaacaacgttgcgtatgcaagagcctataacgccgatcatcagttaagacttctggatgctgctgcccaaatgatgagcgagtctcggttttccttgattgtggtcgattctgttatggctctataccgtacggatttttctggtcgtggtgaactaagcgcaaggcaaatgcatttagccaaatttatgcgtgctttgcaaaggctggccgaccaatttggtgttgcagtcgtcgttactaaccaagtggtcgcccaagttgatggtggtatggcttttaatccagatccaaagaagcctatcggtggtaatattatggcacattcttccaccacgcgattaggtttcaaaaagggtaagggatgtcaaagattatgcaaagttgttgactcaccttgcttaccagaggctgaatgtgtgttcgcgatctatgaagatggtgttggtgaccccagagaagaagacgagtag

SEQ ID NO: 2830 - DNA, 1203 bp, Saccharomyces cerevisiae
atgtctgacgatttgagaagaaaaattgctttatcccagtttgagagagccaagaatgttctagatgcgacattccaagaagcatacgaggatgatgaaaacgatggtgatgcattaggttccctgccatcatttaatggacaatcaaataggaacagaaaatatacgggcaaaaccggtagtactactgatagaatttcaagtaaggaaaagagtagtttacccacttggagtgatttttttgataataaggagttggtaagtcttcctgatagagatctggacgtaaatacatactatacattacctacttcattgttatcaaataccacttcaattcccatctttattttccaccatggggcgggctcctcaggtttatcatttgcaaacttggccaaggaattaaatactaaactagaaggaagatgcggatgctttgcatttgatgctagggggcatgcagaaacaaagtttaagaaggctgatgcgcctatatgctttgacagggactcttttatcaaagattttgtaagcctgctaaattattggtttaagtctaaaataagccaagagccacttcagaaggtatctgttatactaattggtcattcccttggtggaagtatatgtacttttgcgtaccctaaattatcaacagaactacaaaagaaaattcttggtattactatgttagatattgtagaagaggctgccattatggccttaaataaagttgaacattttttgcagaatacacccaatgtatttgaatcaattaatgacgctgtcgattggcacgttcaacacgcgttatcgagattgaggtcaagcgccgaaattgctataccagctttatttgctccgctcaagtcagggaaagttgtcaggataacaaaccttaagacctttagccctttctgggacacatggtttaccgatctgtcgcactcctttgttggcttacctgttagtaaattattaatattggcgggaaacgaaaatctcgataaagaattaattgtggggcaaatgcaaggtaaatatcagttggtagttttccaagattccgggcatttcattcaagaagattcgcctataaaaacagcaatcactttaattgatttctggaagcggaacgattctaggaatgtagtaatcaagactaattggggtcaacacaaaaccgtgcaaaatacataa

SEQ ID NO: 2831 - DNA, 1206 bp, Saccharomyces cerevisiae
atgcgaatcaacagtgagctagcgaacaagttttctgcctcaacggtgcacttagaacatatcacaactgctttaagttgtttaacaccttttggttctaaagacgatgtgcttatattcattgatgctgatgggctgtcatttgtcagggagaataatcatgtgataaaaatccaactactgttatctcgggagctatttatgtcttattcgtatagaaatgaaactgaggatcacatgaaactttgtgtaaaaataaatcatatcttagatagcgttagcgtgatgaacaggaattcggatgacattgttgagtgtactttatcttatgatggacatggatcaccatttgtactaatatttgaagactcgttcatttctgagagagtggagtactctacctacttaattaaggattttgatactaatggactagaactcgatagagaaaggataagctttgaggcaattattaagggcgaagcccttcattcagccttaaaggatctaaaagaaatcggatgcaaagagtgctatgtatatgcaaagaccgaggcgaatgatgagaatgtatttgccctgatatctaaatctcagctaggattttctaaaataaaattacccagtaacagatccatactagagaagttacaagtatttgacggagattccacaacagtaatagatggttttgctgtaattgggttcttcgatttcacctcgtttgataaaatcagaaagagtactaaaattgcaagcaaagtccttttcaggatggatgttcatggcgtattgagtgtaaatattctaagtcaaacagacgatgtcattatcactgatactacaagaccttcaaataatcgaccaggtagtattcgccaactgcagctacccaaggattatcccggtatagtaattgaggtttgcatgctagaaaaagaatccatagatgaggcagcacagacagaaatagaactcctgatggagactaatgaacttggcaatcgtaatagttttaaaaaatcaactataagaaaaagatatggtacagataaaggcaatgaaacttcaaatgacaacttgctgcaattgaatgggaaaaaaattaaactaccatctgaagaagaaaacaataaaaacagggaaagtgaggatgaagagaatcactgcaagtatccaacaaaggatattcctatatttttttaa

SEQ ID NO: 2832 - DNA, 1206 bp, Saccharomyces cerevisiae
atggaaaaccaagagaaaccgctttctgtagacgaggagtacgatttatggaaatccaatgttccattaatgtatgactttgttagcgagacacgtttaacatggccatctttaaccgtccaatggctccctactcctgttcaagaattagatggtggctttattaaacaagaattaatcatcggtacgcacacttctggtgaagaagaaaactatttgaaattcgcagaaattaatctaccaaaggaaattcttagtaatgaagacccacaagaagaagcaggagaggagtatcagtcctctctacctgctcctaggtcaaatataaggattaccgctaaatatgagcacgaagaagaaatcactagagcccgatatatgcctcaagaccctaatattgtcgccacaataaatgggcaaggcacagttttcctctattctcgctcagaaggtcttcagtcaacactaaaatttcataaggataacggttatgctttatcatttagcactttggtcaaagggcgattgctttccggctcagatgatcatacagtcgctctctgggaagtggggagtggcggtgaccctacaaaaccagtacgaacttggaatgatttacattctgatattattaatgataataaatggcacaacttcaataaagatctattcggcactgtttcagaagattctctcttaaaaataaatgacgtcagggcaaacaatactacgatcgatactgtgaaatgcccgcaacctttcaacacattagcatttagtcatcattcctcaaacctccttgcggccgcaggtatggactcgtatgtttatctatatgatctaagaaacatgaaggaaccattacaccatatgtcgggtcatgaagatgcagtgaacaatttggaattttcaacccatgttgacggtgtagttgtatccagcgggtcagacaatagattgatgatgtgggatttgaaacaaattggagcagaacaaacacctgatgacgcggaagacggcgttcctgaattgatcatggtccacgcaggtcacagaagttcagtgaatgattttgatttgaaccctcaaataccttggttggtagcaagtgctgaagaagaaaatattttacaagtttggaagtgttcccatagtctacccatcgtgggaggtccaccaaaggtgaacaaggatataataagctaa

SEQ ID NO: 2833 - DNA, 1206 bp, Saccharomyces cerevisiae
atggatcccacaagagctccggatttcaaaccgccatctgcagacgaggaattgattcctccacccgacccggaatctaaaattcccaaatctattccaattattccatacgtcttagccgatgcgaattcctctatagatgcaccttttaatattaagaggaagaaaaagcatcctaagcatcatcatcaccatcatcacagtcgtaaagaaggcaatgataaaaaacatcagcatattccattgaaccaagacgactttcaaccactttccgcagaagtgtcttccgaagatgatgacgcggattttagatccaaggagagatacggttcagattcaaccacagaatcagaaactagaggtgttcagaaatatcagattgctgatttagaagaagttccacatggaatcgttcgtcaagcaagaaccttggaagactacgaattcccctcacacagattatcgaaaaaattactggatccaaataaactgccgttagtaatagtagcatgtgggtctttttcaccaatcacctacttgcatctaagaatgtttgaaatggctttagatgcaatctctgaacaaacaaggtttgaagtcataggtggatattactcccctgttagtgataactatcaaaagcaaggcttggccccatcctaccatagagtacgtatgtgtgaattggcctgcgaaagaacctcatcttggttgatggtggatgcatgggagtcattgcaaccttcatacacaagaactgccaaggtcttggatcatttcaatcacgaaatcaatattaagagaggtggtgtagctactgttactggagaaaaaattggtgtgaaaataatgttgctggctggtggtgacctaatagagtcaatgggtgaaccaaacgtttgggcggacgccgatttacatcacattctcggtaattacggttgtttgattgtcgaacgtactggttctgatgtaaggtcttttttgttatcccatgatattatgtatgaacatagaaggaatattcttatcatcaagcaactcatctataatgatatttcttccacgaaagttcgtctatttatcagacgcgccatgtctgtacaatatttgttacctaattcggtcatcaggtatatccaagaacatagactatatgtggaccaaaccgaacctgttaagcaagttcttggaaacaaagaatga

SEQ ID NO: 2834 - DNA, 1206 bp, Saccharomyces cerevisiae
atggcaaaccctttttcgagatggtttctatcagagagacctccaaactgccatgtagccgatttagaaacaagtttagatccccatcaaacgttgttgaaggtgcaaaaatacaaacccgctttaagcgactgggtgcattacatcttcttgggatccatcatgctgtttgtgttcattactaatcccgcaccttggatcttcaagatccttttttattgtttcttgggcactttattcatcattccagctacgtcacagtttttcttcaatgccttgcccatcctaacatgggtggcgctgtatttcacttcatcgtactttccagatgaccgcaggcctcctattactgtcaaagtgttaccagcggtggaaacaattttatacggcgacaatttaagtgatattcttgcaacatcgacgaattcctttttggacattttagcatggttaccgtacggactatttcattttggggccccatttgtcgttgctgccatcttattcgtatttggtccaccaactgttttgcaaggttatgcttttgcatttggttatatgaacctgtttggtgttatcatgcaaaatgtctttccagccgctcccccatggtataaaattctctatggattgcaatcagccaactatgatatgcatggctcgcctggtggattagctagaattgataagctactcggtattaatatgtatactacagctttttcaaattcctccgtcattttcggtgcttttccttcactgcattccgggtgtgctactatggaagccctgtttttctgttattgttttccaaaattgaagcccttgtttattgcttatgtttgctggttatggtggtcaactatgtatctgacacaccattattttgtagaccttatggcaggttctgtgctgtcatacgttattttccagtacacaaagtacacacatttaccaattgtagatacatctcttttttgcagatggtcatacacttcaattgagaaatacgatatatcaaagagtgatccattggctgcagattcaaacgatatcgaaagtgtccctttgtccaacttggaacttgactttgatcttaatatgactgatgaacccagtgtaagcccttcgttatttgatggatctacttctgtttctcgttcgtccgccacgtctataacgtcactaggtgtaaagagggcttaa

SEQ ID NO: 2835 - DNA, 1206 bp, Saccharomyces cerevisiae
atggttaaaatgagaagaataacacctacacgcctcctattcacatgcagatatatttcaaacaatgcttctccaccagtgcagcccttgaatgtgcttttctttggtagcgacactttcagtaatttctcattgcaagcactcaatgagttgcgtcaaaataatggaagctgtggtatagtggacaatattcaagtagtaactaggtcgccgaagtggtgcggtagacagaagtctattttgaaatacccgccgatcttcgatatggcagagaagcttcaattgccacgcccaattacatgcgacaccaagcaggaaatgttggcgctaagcaaactgacacccagtcgccaaggaaatccggagaacgacggctccggtgctccgttcaacgcgatcattgcggtttcttttgggaagctcattccgggtgacttgatccgcgcggtgccattggcgctaaacgtccatccttcgctacttcccagacataaaggcagtgcacctatccagcgagctctgctcgagggtgacacttacaccggtgtaactatacagacactgcatccggatcggtttgaccatggtgcaattgtagcgcagacggagccactggcgatcgcaacaatgctgtcaaaagggagagtcaatgattcgacggcagattttaattctgagggcctgcctcggaggactgccatactgatggaccagttgggcgcccttggcgcccaacttttgggccaaacgcttcgtgagaggttatatctaccacagaaccgtgtgcaagcgccaacagcttacaaacccagttacgcccaccgtataacaacagaagataaacgcattcattgggcgcgcgattctgccgccgaactacttaacaaactcgaaacgctcggtcctctgcacgcgttcaaagaagcgacagcggcaagaaaggacgctcaaaattcagtattaaaacgaatattgtttcatgagtgtaaagtgatgagagacgcacgtctagataatggcagtaaaccgggcatgttcaaatatgatgatattaaagactgtattttggtcacctgtcgcggcaacttactactatgtgtgagccgcctccagttcgaaggtttcgccgtagaacgtgctggccagttcatggcgcgcctgcggaaaagatgcggcgccctgagtgaaaagttagttttcctgtaa

SEQ ID NO: 2836 - DNA, 1206 bp, Saccharomyces cerevisiae
atggttgatttggagcaggaatttgcgctcggtgggcggtgtctggcattccatggtcctcttatgtatgaagcaaagatcttgaaaatatgggatccatcttcgaaaatgtataccagcattcctaatgacaagccaggtggtagttcacaagcaactaaggaaataaagccacaaaagctgggagaagatgaaagcattccagaagagatcattaatgggaagtgttttttcatacattaccaaggctggaagtcgagttgggatgagtgggttggatatgataggatacgggcctacaatgaagagaatattgccatgaaaaaaagactggcgaacgaggcgaaagaagctaagaaatcgttactggaacagcagaaaaaaaagaagctctccactagtctgggagggcctagtaatggtggaaaaagaaagggagacagccgctcgaatgctagtataagtaagagcacttcacagagttttttaacatcttcagtgagcggcaggaaaagcggaagaagttccgctaattccctccatcctggcagctctttgcgctcgtcatccgaccaaaatgggaatgatgaccgcagaagatcttcttcgctatcgccaaatatgctacatcatattgccggctatccaacccccaagatttcccttcaaattcccataaaattgaagagcgtgttagtcgacgattgggaatacgtaacgaaggacaaaaaaatttgcagactacccgctgatgtgacggtagagatggtactgaataaatacgaacatgaagtgagtcaagaattggaatcgccagggtcccagtcacagttgagcgaatactgtgccggtctcaagttgtattttgacaagtgcctgggtaatatgcttttatataggttggaacggctgcaatatgacgaacttctgaaaaaatcatcgaaggatcaaaagccactagtaccaattagaatttatggggctatccatctgttaaggttgataagtgttttaccagagctgatctcgtctactacaatggatctacaaagctgtcagcttttaatcaaacaaaccgaagacttcttggtttggttgttgatgcatgtggacgaatacttcaatgacaaggatccaaatagaagtgacgatgctctgtatgtaaatacgtctagccaatacgaaggagtggctttaggtatgtga

SEQ ID NO: 2837 - DNA, 1206 bp, Saccharomyces cerevisiae
atggttgggcctggtctgggaattaatcgagtgaggagaaaaggtgtttattccacaaaaaagggaagtggtgataacttactgttaatgaaaagacaaggaaaacatgacatacatgatagagaaagtgacgacttatcaggccatgatgccttttccccctcaaaaaagcgcggcaaaatagacagtatcacagaagatgagattgaagtaaaaaagctttccactgtggccacatttgataaactttcgaggtcatttccaaattcagaagtacaagccgcaaagaatgcagcactcagaggaaaagaaaaagaagaagagaaggtcgtttctatcccactaatacagaatttgaaaaatgaagatatcgagtctatcaaatgcaggaacaataatcttttagacggtaaaaaattactcttggaggcagaactatcggcagttgaagataaccaaatcttctcctcttcatttcccgaggataaaaagctatcgttacaaagttgtttgagttctaaagagcagataatcaaaaaacttcaagtaagggaagaatacatgagcaagttcaaactaccacccatgttgttttcggatgagctactcactgaagtagaacccttcatgcccattgtaatggacatattggagggaaagatatcgtctgtatactattttgaagcaaaaaatgcattcaaaaactcacaaaaggcttacttgtccgtagatgagtttagaaagttgaatttaaacaaatttactgctggattttacggcctgaaaaggcaattgagggttggcgaagaaatcgctaagagatataaaagggcactcacgcacaatcagcccgcaaccttaaaatggtgggggataacagatttctgtaactacgttttggctccagaaacccttacgtctttttgtatttaccaattaaatctctcgaataaatcttgctcgtcgaagacaccgaataaacatccaaagcaacaattaaacgagaaggaatattactacgatcccgaattaaggatgctagcctatgacttactcgaggatacagttgaatacggtatcatagtagccgactctgatccaattgagcaatgggaagctgccatagaggaagaccgtctgcgggaactgaaactcgatgttcataactattccagcaggagatggcgactggatacgcacgattaa

SEQ ID NO: 2838 - DNA, 1209 bp, Saccharomyces cerevisiae
atgatgaaaagattacaccccttgagaattcaagttcatctgaaatctgattacccactgtttactttcgagcaattactctctacaaatgggataagaagaggccaaactgcgagaatttctttgaaagattacatagagtggcaaaatttcccaaacataatgaaaagagaaaatttttttacgcaaaggaagcctgtaactacaaccgcaaaagaagaacccttttcatttgataacattcttgactgtgagccacaatttagcaaatgccttgccaaatggctactggttaattacaaattaaatgactatccttattacgatcttaacattgtgaatatttacacggatttaccccaagcaattcagatttgcaaaaatttaatgtcatatctcaagtctactttatctgataacatgttccagaaaataaaatatttcatggtacctctatacaagtgtgacaaaataccttcgaagctcttagacggaatacctggatcagtcagtttggtacaagattatccggtttccccatattttttacagaaaaaatttcacatagaggatccaatccaaattttgatgcttaatgatgttataaaatacacaacccacgatttagtaaggtactcttcagatgacaaagggtggcaacagtgctttgtggatatcaataagaatggacaaaaatccaagagctttgatagcgccattgactactcatgtgaacttgcattagaacaaatgttcaatgatcgatcccatgtaagtcctggtaaagaactttatatccccactaaattaattgagatattgatgacaatcaagaataatattccagaacatagacttttcattgtagacaccccgcaaagatcgagcccaacaataatatcgttattaaagagtttaataagcccacggccgacgggatctagccagatagtacagccatattcggattcaatattttcagacaaacggagtggaagaatatgcttcatgacggacttcttacagttacagaacatttataatggtattaacagttcttctagtagctgcgaagtcgaagacgttgctgattttgttgaaaaatggattagcccaagtgagagaagcacactttcgtcgcagaatggaaataggcctcaactagaagacataaaaaatagctctttggcggtgctacactccacgtga

SEQ ID NO: 2839 - DNA, 1209 bp, Saccharomyces cerevisiae
atgcgtgagaatgcaatgtctacaaagaaacttccctataaattatctggcagcagcaaaataacaacttccatacctaatgatttaatcatactgcgaaataattgcataaattcactgaacagttcctcgtccaaagctgacagcattacatgtatagatacgtggctaaaatacacagagggtttgttaacccacaggtacgaagctaataatgacgccgctctcattgaagaggagatagcgattgcgttaatcaatgttgccgtattttatcaagacatcggtattgaaacattgtacagagcttatgaatcttcacaagcgtcaaataacttatggacaacaagcgggacctatctaaagagaggtctaggcttaatctgctttcttggaaagaattttcaaataaacacagctaatgattgccaaaagatgcaggttctcaacgtccttaatcagctatcattagagtttcaattgctgcaacaactagggattgtcgttttagcactgtctaaactaagatcaaaaatcagcaaggatgctgttgcggaccttgagcctcaagaattggaagagctaggcaagtccagtgtcttttacgctaagctttgtattggatcttatagcactgcttcgcaatgccaaggaggccgtatagtggacgcattatttatgaattatttacagagtttgacctatctcttcctatcaatcaaccaatacaacaatgatgagtgcggaattgccattgggatgctccaagaatcgatcaaaaaactgttaaatatagtacccaattcgcaactaaaagagttggacattttatcctcaaccgatattacaaagaagagggatcttataaagatgtcgtttaaaaggaaaatacatgggtctactttaaaaaaccaacggatatttgagaagaaggtgccattttcatccaaagcgtacatgatgccgttattgaaatcttcattagacgattttgttatcccactaacgatactgttaaggtacagataccagacaaccaatgagaattattccttcaaaacggttgaaaccgacgtttctaaattgaaggagcttttccccaggggaaaatcgtcagatattgaaggcactgtatggagtttccaagatggacatcttacatttgcagactcaaataatgcaacccacaattgcggtaattatttttga

SEQ ID NO: 2840 - DNA, 1209 bp, Saccharomyces cerevisiae
atgtctagtacagtaatatctagaaagaggagaaacagcactgttactgagcctgacagtagcggagaaacaagaaaacaaaagaagtcgagaagtgatgaaaagagctcatcttctaaggatggtgacccccagctagaatttaaagttttacagggatatagggacctggaaagtgaaatgcacaaaggcagagctcaggtgaccagaacaggagatataggtgttgctatggacaatctgaacgctgtggattccctattcaataaggttattggtataaagaataatggattgtttgctcatgatgctagagcaatggttagtataagtgaattggctcaaatttctgtgagaaatttgaagtttgatgattcgaggagtatggtcaatttagaaaacatagtaaattccttgaaaagatacatgctaaaagagcatttcaagcttaataatatcgccgaaaataggaatgatttgacgcttgccgctgatgaacaatccgcagcagaccagcaagaggaaagtgatggagatatcgataggacgcctgatgataatcatacagataaagctacttcctctttcaaagcgacatctatgaggcatagttatctacagcagttttctcactataatgagttttctcaatttaattggtttagaataggtgctctctacaatactataagtaaaaatgccccaattaccgaccatttaatgggacctttatccatagaaaagaagccacgagtgttaactcaacgaagaaggaataatgaccaagttggtgaaaagatcaccgctgagaaaatcactcagcattctttaaactccacacagcaagaaactacccctgaacaggtcaagaaatgtttcaaaaagctttcaaaaaaattaggcccagaaggttccattaatctttttaaatttattatagacccaaattcattctcgcgatccatcgaaaatcttttctataccagttttttgatcaaagagggaaaactattgatggaacacgatgaagaaggtttacccacaattaagataaaacaaagcataagtcacacagattcaagaagtaaagaaattgagagacaaaggcgtcgtgccgctcatcagaatcacattatttttcaaatggacatgcctacttggcgaaaactaataaagaaatacaacatcacttcaccattcttagactaa

SEQ ID NO: 2841 - DNA, 1209 bp, Saccharomyces cerevisiae
atgttcaaactcacctctcgactcgtcacgtcaaggtttgctgcctcttccagactggccaccgctcgaaccatagtattgccccggccccatccgtcatggatctcttttcaggccaaaagatttaattcgacgggcccaaatgccaacgatgtctcggaaatccaaacccagttgccttccatcgatgaattaacctcttcagctccttctctttccgcttctacttcggaccttatcgctaacacgacccaaacagtgggcgagttgtcctcccatatagggtacttaaatagcattggcctggcccaaacctggtactggccctcggacattatccaacacgtcttggaggccgttcatgtttactctgggttgccttggtggggaactatcgcggccaccaccatcctcattcgatgcctgatgtttcccctctatgtcaagtcctctgatactgttgctagaaattcccatatcaagcccgagctggacgccttgaataataagctaatgtccactacagatttgcaacaaggtcagctagtcgccatgcaaaggaaaaaactgctctcctcgcacggcattaagaacagatggctggccgcacccatgctacaaattccaatcgcccttgggtttttcaacgcattgagacacatggctaactacccagtagatgggttcgctaatcaaggtgtcgcttggtttacagacttgactcaagcagacccttacttaggtttgcaagtaatcactgccgctgtgttcatctcatttacaaggctggggggtgagactggtgctcaacaattcagttctcccatgaagcgtcttttcactattctaccgatcatttctataccggccacaatgaacttatcgtccgctgtggtcctctactttgcctttaatggtgccttctccgtcctacagacaatgattttgagaaacaaatgggttcgttcgaaactgaagataacagaagtagctaaaccaaggactcctatcgctggcgcttcccccacagagaacatgggcatcttccaatcattaaaacataacattcaaaaggcaagagatcaggcggaaagaaggcaattgatgcaagataatgagaagaagttacaagaaagcttcaaggagaagaggcagaattccaaaatcaaaattgttcacaaatcaaacttcattaataacaaaaaatga

SEQ ID NO: 2842 - DNA, 1209 bp, Saccharomyces cerevisiae
atgtttcaacagctgtcggcatccattaggcacaatgcacacataatttttttatgcataagttggtattttatttcatcgttggcatctcaggtaacgaagcaggtactaacggtttgcccattaccactttttttgggtgagtttcagttcatttatactgctgtgctagcatggtttacgtgttatattgcatatagtttcccaggattctatcgcatatttcctaatggtacttttccggaatattatatcgacgacagagaaactagccgtgcagctaggaaagaatcaaaactatcctccctcattataccgccctctaaaccaatcctgcaaacagttctacctttaggtcttttccaatttgtagggaaatattttgggcatacagctacctctttggtgcctgtttccacggttgcaagtataaaaacgctatcccccatgtttatccttttgctccaaaagattttgaaaatatccactttgaaaattactttaactcttatctttagtttatgcactttagttcttggagtttggattatagttcaagaagataatcgttcaccggcctcttccaatgagctgagagaattctctaaatacggcgtaatatgcgctatgatatcaatgttcatttttgtcttgcaaaatatatatggcaagaccgtgttcacgtacagatctcaaacagatgaatctcaaagtaattctggattctcacggcaagaatcacctttacccttatatgaaaagttggatgagaaacttgttgcgaaaaagaaacctaaatcatatgacaaattgactttaatgatttatatttcccttgttggattttgtttatcgtttggctggtttatcactctagaatttcctgtactatttaggtatttttttcaaattaacagctcttctacagtaataaaagcttttccagtctctttatttttactgaacgggacattccacttcattcaggcaatgattacatttcatttactgggtgaggtctcaactttaacatattcaatagcgaatctgatgaagcgctttgccattattgcggttagttgggtctttattggaagaagaattacttggctgcaagtgttcggtttggttctgaacacattagggttattcctttatgaaagatgcacatcacaatcgaaaataaaagcgaaaatacgtcctgagtag

SEQ ID NO: 2843 - DNA, 1212 bp, Saccharomyces cerevisiae
atgaatggaatatttgctattgagaagcctagcggtattacatccaatcagtttatgctaaagttgcaacatgctttaactaaaagtcaagtattctcgaaggaaattcaaagggcaacagcggaaagaaagcagcaatatgaaaaacagacaggtaagaaggccagcaagaggaaacttcgtaaagtctcaaaggtaaagatgggacacggaggcactttggatccgttggcctctggtgtcctggtaattgggattggagcgggcaccaaaaaacttgcaaattatctttcaggcaccgttaaagtctatgaaagtgaagccctgtttggtgtttccactacttcaggagatgtagaaggtgagattttgtcccagaactccgttaaacatttaaatttcgatgatttaaagactgtggaggaaaaatttgttggacaattaaagcagacgccgccaatatacgcagctttgaagatggatggcaaacccctgcatgaatatgctcgagaaggaaagcctttacctagagccattgagcccagacaagttactatttatgacttgaaggtgttttcagactctcttaaacgtgatcatgactatcccttattgaggcccactacagaagaagctgttgataccgtgaaaaatttgaatgcaaacatgctaaacgatgttttatacttttcaaaagaatatacagagaagcacggccttgattctgaggtggcaaaggtagaagaaccatttccgctgagtgaacaagaagagcaagaaatccaaaaagaaggagattcttatagggctccaaaattgcacttcaaagctaatgtgtcttctggaacatacataaggtccttagtgagcgacatcggtaaatctatgaggagctcatgttatatggtgaaattgatacgtttgcaacagcaggactggtctcttgaaaaaaataatgtgttccaattaacggattttactgaaagagacgagaaggtgtggagtaaggtactggagaaggttctagacgagggagcaactgttgatgttatagaagagctaaagaaagcagaaaaggaaataccagcggacgtgaaggaatgtatagtttcgagtgatcaacctggtgatgaggctacggctgaaacaattgaaactgctaacgccgaagaacattctaatacactaaaaagaaaaatcgaacaggtgtaa

SEQ ID NO: 2844 - DNA, 1212 bp, Saccharomyces cerevisiae
atgacaatagcgccaatggcaaacgatttagaagattttgagtctctgctggagcctgattttgatgctaaacaatttggtaatgacttactgaaggctactaataacaatgacacaaccattttagaccttaacacgcctcttaaaaagctaaactatgatctacatgagattgactctagaatagaccaattgatgaatagcaacccattggagataatagagttaatttacaaaaatgaacacgtcaattcaaccatagttggtgagttgaaaccaagtttgggatatatgaatatgtcgtacgatagactaaagaatcaagttctagatccttatgaaagagcgaggaaagtccaactagcgttgagtaaagtttaccaaacatcttttctcttgcgcggagcattgctttatattcatttatcaaacaaattaaacgcactgtctaaaacagcccaactaagcacatcaacagctattaatttagcctccttacactaccaacttgaaattactttggaagaaaataaaaatctaaaatccttgcggaaaattaaacaattagatcaggacattgtttcccccaacaaaagagagttaataacatttttgtctttacaaatgtgtaaagagtgcttgaactctattaaaatcaaatcgaacaaagaaataatatctcagctggcctactccttatatctactttcatctcaagaattcgagtctgcaataaacaagattgtactatctaatgttacaatgagctcacaaatcctatcaaaaattttaaattctatcaggatgtttcctgatgcgttcaatgaagttgttgaaaaaggttataacatctacattttagaaacactactacagaacatcaaaacggataatgttacgaattcctcgagatctattgctgctaataaatcacgccttggcaatcttttatcagaatatacctcaatgaagagtaaagcaggttctggtacaccgagagatctgttttggagcaaagtttcatctgccttcaaaaaggactttgatatatctgttaatagaggaggccctgtgggcaagtcgctgttaaaaaataaagattttattataaacactatgaagcaaagtatgaaaaaatcttctgataatagtgattaccaaagctacttggatgtaatgctaaactcagtatctatttctctaaataagtga

SEQ ID NO: 2845 - DNA, 1212 bp, Saccharomyces cerevisiae
atgactggcgaagaatggggcttgactgtactgtcattcttggtaagagtcggattttttctttttggcatttaccaggacgctaatttcaaagtgaggtacactgatatcgactattttgtgtttcatgatgctgctaaatatgtatacgaaggcaaatcaccttatgcaagggatacatatcgttacacaccgctactaagttggctgctagtgcctaatcattattttggatggtttcatttggggaaggtcatatttgttattttcgatttggttactgggctcattataatgaagcttttgaaccaggccatctccagaaaaagagctttaatattggaaagcatttggctattgaatccgatggttatcaccatcagtacaaggggaaacgctgaaagcgtgctttgctgtttgatcatgttcacgcttttttttctacaaaagagtagatacaccctagctggaatcttatatggtctttctatccatttcaaaatatatccaatcatatattgtatcccaatagcaatttttatatactacaataaaagaaaccagggtccacgaacacaacttacatcgctactcaatatcggtttgagtactctaacaactttgcttggatgtggttgggcaatgtacaagatatacggatacgagtttctggatcaggcatacttgtaccacttatacagaacggatcacagacacaatttttcagtgtggaacatgctattgtatttagattctgcaaataaggaaaatggtgagtccaatctctcaaggtacgcatttgtgcctcaattgctgcttgttttagtaactggatgtcttgaatggtggaatcccacattcgataacctattgagggttttatttgtgcagacgttcgcatttgtgacatataataaagtgtgcacatcgcaatattttgtttggtacctgatctttctaccattttacctctcaagaacgcacattggttggaagaaggggcttttaatggccacgctttgggtaggaacgcagggaatttggttaagccaaggttactatttggaattcgaaggcaagaatgtattctatcctggactatttattgcaagcgtgttatttttcgtcaccaatgtgtggctactgggtcaatttattactgatattaagataccgacgcaacccacagtttccaacaaaaagaacaactga

SEQ ID NO: 2846 - DNA, 1212 bp, Saccharomyces cerevisiae
atgcttcgcaacttagtcgtcaggaatgcgtgcagaaacaggccgtcaattcaagtggcaagggggttatgccgacaccaaacaagacgtctcatggcgtcctcccctcagttcggtaggaactccaatcaggaaaaaacagcgggctttataatggggattctttctatggctggtgctttatattttattgctcctaataggaagcctcttttcgcctcaaggaaggtagaatccgataaaaccgcagaggaagagctttccagtggtggtgagcaatcaccagaaaatgaagatgacaacaacagcaaaagcgatgaaaatggagatgacaacgacagcaaaaacgatgaaactgaagctggccctcaattagggggtgataaaattggtgcttcaaaagtagctgaagatggtgaattggttgttctagcagaagaagacaacaagtcttccgaagataaagatactgatgaatcaaaggtatcaaccaaagatgatgagcaatccaatgaagacaatgccaccgctaacaatcaaaaggatgaaaacataagttctgagaactcggaagaaaatactagtgacaaaacactagacaacaatgctggatcttctgaaaaaaaagatccagaacattcagatgatgaaaaatcgcaacagggacaatctgatgacaagacaactactgaagataataatggagaagaagaatcctcaaaaaaaactgtaagtgactcggaaaattcagctaagcaatctgaatctagcgatgaagagaaagaagaactaagaaaacaagaggaaaagcaaatgggtcctactgaagaagaggttcaacacgaaggtgcttataacccagacactggtgagataaattgggactgtccttgcttgggaggtatggcccatggaccctgtggtgaagagttcaaatctgcattttcttgcttcgtctattctgaagctgaaccaaaaggtatcgactgtgttgaaaagtttcaacatatgcaagactgtttcagaaaataccccgagcattatgcagaacaactaaaggaaacatctgatgatgaggaacctcaagacaaagtaaaggtcaacacaatagaatcagcgccaaatgtttcaagcgcaaaggaaaatgctgcgaaaaaagcagagcaatcagatgtgaaaaaagaaccattgaatgaggaatccaaaccttaa

SEQ ID NO: 2847 - DNA, 1212 bp, Saccharomyces cerevisiae
atggagatttacattagacttaacgcagatgtcgagcacgactatgcgtttcaggtgtcaaatgaagacaccataaataacaaaattaagaagattttcccttccaagacgggtttggcggacttaatggtgctgagaccatcaattttccatgagaaggagcccgtaaagttctataagtctatccatccagggtacctgtccgaaggtggttgtttgatgttccattatgaagctgataacgaagaaaatctcgaggagttgaatgactccaagccgcttattgaccagttgtggcctggtcagctagttgttccggagtggaagctatccaagaaaaacatatgggtatacaccattattatgttggcctggctatataccgatttgcccgacgccatttctccaaccccaggtatttgtttgactaatcaattgtctagactattgattcctgtagccaagcacatggatttacctgaaattgccgctaaactcgaacaagaagttcaggcaaactattctagtctcgtagctcaatggcttttctttgtcatgcacattttcaaagtgggcataattactttattcctcaaattaggcattgccaaccccatcagcttcaatccttacaagttatggagtttgagagatttaacttctccttctgctaacggcgctaagaattctggcggcaataacaacactactgacttaaagacacgtttgcgctctctgggctggattggtgctaagagagctacttacgacgattaccagactaactattacaactatgtcatagataagatgggtggtgcagttgctgcttatagagcgggcgcgattaggaaagctgcagcaccaggtatccaacttgtggctggagagggtttccaaagtcctctagaagataggttcactgcttccactttcacggctattaaaaccgaacggaaattcattttaagtgaagaatactttgtggagctggaaaacaatctaaagaagatcttggaagagtatgacggggatattggtaagatgaatgctgaaattaggaggtttagaaggtttggtatttatgaaccagatgaaaaactggcctcgctagttaagctcagaagagaaattgctgatgagaaagagaaagcatcaaacaatgatgctacttttggtataaaaaagaatgatttgaaaaaatctaattaa

SEQ ID NO: 2848 - DNA, 1212 bp, Saccharomyces cerevisiae
atgtcagaaacagaactgtcgaaagaagatgctgttacaaaaaaggataacgaggaacaagtcaagaaggctttactcgatccaacaaaaaagagaaaagctgaagatgaaattgagattgacctgaaaagctccattcccctatcaaaaaaacagaaacgtctcttgagaagaggtaaagttactctagaggagttgaatgcgaagtacaatatcgaccctaagtcaatcgaggaatacaaagaagatgctgaaaagaaaaagtctggtgcttctgagaaagacgcccagggtgaagaatctacaatcaacactccaacaggagatgaatctggcgaggttgtaaaaaagaagaagaaagatgaaaataaatatggtgtttggattggtaacttatccttcgacaccacaaaggacgatttagtaagattttttattgctaaaacaaaagacaacgaagatgaaaagagcagagtcaccgaacaagacataaccaggttatccatgcctcgtgttgctgccaagaactctaacgccatgaaaaataagggattttgctacatgtttttcaagaacgtcgagcagatgaaagcggtcttagaattatctgaatctcatttaaacggaaggaatatgctaatcaaggactccgaaaattattcaggtaggccagacaaggacgatttagttgccatgtccaaaaatccaccgtcaaggattctatttgtcggtaatttgtcattcgatgtcacagatgatctgttaagaaaacacttccaacattgtggtgatatcgtgaaaatccgcatggcaacattcgaagatagtggtaaatgtaaaggattcgcatttatcgacttcaagaatgaagaaggatctactaatgcattaaaggataaaagttgtagaaaaattgccggaaggccattgcgaatggaatacggtgaagatagaagtaaaagacaagttcgtaagaaggttgaaaatgtatccagaaacaattcctcatcatttgatatctctaacaacaaaggatacgatcgtgcgggacaggataacggcagcaaacccgaatacaagcggtccaacgccaacagacgtccacctgtagattccaataaccgaactaagagcagtgtagctttagccactgctcagagaggttctgcagctattgtcccatcacaaggtaagaaagtgaagtttgactaa

SEQ ID NO: 2849 - DNA, 1214 bp, Saccharomyces cerevisiae
atgtccttaccagctacttttgacttgactccagaagatgcccaacttttgttggctgctaacactcacttaggtgctagaaacgttcaagtatgttatactcattcccgattatataatagagtaatgtgtgattgaaaacagttcgagtgaaagaatagccacaaccaggtttcccgccaaccaaacggaatgctgggatagcatttttcaggctgaataagaagagaaatatatgaacaatcattaaaacagtttgaaactccagctaattatcagcgaatattttgccaatagactttctaattgtattatgttattaaattttaaatcgctaatgaaaaaaaaaaacaaacctttggtattaaacctctttcaatgaaatcaattaattccggtacctattcttccgacgctgttagccaactataaatgccattttttcatagtacattaatttgaatcagttgatcattcacagcatataccaagtgtacgtttttgaatcttttatactaactttttcttctttaattttgtttcaggttcaccaagaaccatatgttttcaacgcaagaccagatggtgtccacgttatcaacgttggtaagacctgggaaaaattggttttggctgccagaatcatcgctgccattccaaacccagaagacgttgttgccatctcttccagaactttcggtcaaagggctgttttgaagttcgctgcccacaccggtgctaccccaatcgccggtagattcactccaggttctttcaccaattatatcacccgttctttcaaggaaccaagattagttattgtcaccgacccaagatcagatgctcaagccatcaaggaagcttcttacgttaacatccctgtcattgctctaactgatcttgactctccatcagaattcgtcgatgtcgctatcccatgtaacaacagaggtaagcactccattggtttaatctggtacttattggctagagaagttttgagactaagaggtgctttagttgacagaactcaaccatggtccatcatgccagatttgtacttctacagagaccctgaagaagttgaacaacaagttgctgaagaagctaccaccgaagaagctggtgaagaagaagccaaggaagaggttaccgaagagcaagctgaagctactgaatgggctgaagaaaatgctgacaacgtcgagtggtaa

SEQ ID NO: 2850 - DNA, 1215 bp, Saccharomyces cerevisiae
atgaccattattcagacggttactgaattgggtgttaccgaggacaccattaaggttcagatggctccttccggcggcaaacacctattggcagatcccggtaatcatccagcggagcattttgagagccagatgtcgtggctaaggtttcaaacaaggcagtatctaactagattcacagacaaccaatcagatttcgtacattctttacaaaaaaagcacagaacgccttttagagacgtttatttcaaatacacttcgcttatgggttcccacatgttttatgttatcgtgcttcccatgcctgtgtggcttggataccgcgatttaacacgggacatgatctacgttcttggttattcaatttatttgagtggctacttaaaggattattggtgcctaccaaggccaaaatcaccgccagttgacagaatcacactaagtgaatacactacgaaagaatatggtgcacccagttcacattctgctaacgctactgcggtaagtctattattcttttggagaatatgtttatctgacacactggtatggccaacaaagcttcttttactgagtctggtgatattttactacttaaccctggtttttggtagagtttactgcggtatgcatggtatgctggatttatttagcggcgccgcagttggagctatctgtttttttataagaatctgggtggtgcatgctttacgaaatttccagattggtgaacatctctggtttccccttttgagtgtagcatggggcttgtttattctgtttaaccacgtcaggcccattgatgaatgtccttgtttcgaagatagcgtagcgttcattggcgtagtcagtgggctggattgcagcgactggttaaccgaaagatacggatggaaccttgtatgtagtaggtacgcatcatgtggttctaaggtgttcttgaggcctctggtaggtgtcgcttctgtgattgtttggaaagacgtcattagcaagacagctgtctacacgctgttaattaaactactcagatttcacgatgatagaagcgaaaaggttcatttccataacgagacaagtgaagaagaagagtgtttattgtacagcggtgtttccaaagtggaaatcgtcggaaggtttctcatatacgcaggtatacctacaaccgtctttttgctatgcccagtttttttcacttggacaaacttaaggtag

SEQ ID NO: 2851 - DNA, 1215 bp, Saccharomyces cerevisiae
atgcctaacaaagtgtttaacgtggccgttttcttcgttgtgttcagagagtgcttggaagcagtgattgttatttccgtgctgctatcgtttttgaaacaggcaatcggggaacatgaccgggcgctgtaccgtaaattaaggattcaggtttgggtcggtgtgttactcgggttcatcatttgtctggccatcggtgcaggtttcatcggtgcgtactattcgctgcagaaggatattttcggaagcgcggaagacttgtgggaaggtatcttttgtatgattgcgacgataatgatctcgatgatgggtattcctatgttgagaatgaataagatgcagagtaagtggagagtgaagattgcgcggtcgttggtggagattcctcaccgtaagagagactatttcaagattgggttcttgagtagaagatatgctatgttccttttgccgtttattactgtcttgagagaaggtttggaagctgttgtgttcgttgccggtgcaggtattaccacacagggctcgcacgcctctgcttacccattgcccgttgtggttggtttgatatgtggtggtcttgttgggtatttgttgtactatggtgcttcgaaatcctcgctgcagattttcttgattttgtctacttcgatcttgtacctgatctccgccggtcttttctctcgtggtgcgtggtactttgaaaattacagattcaaccttgccagtggtggtgatgcttccgaaggcggtgatggtaatgggtcttataacatcagaaaggccgtttaccatgtcaattgttgcaacccagaactggacaatgggtgggatatcttcaatgctttgcttggatggcagaacaccggctacttgtcatccatgctttgttacaacatctattggttggttcttatcattgtgttgagtttaatgatattcgaagaaaggcgtggtcacttgcctttcaccaaaaacttacaattgaaacacttgaacccaggatactggatcaagaacaagaaaaagcaggagttgacggaagagcaaaagagacaactgtttgccaagatggagaacatcaacttcaatgaagatggtgagatcaatgtgcaagagaactacgaacttcccgagcaaactaccagtcattcctcgtctcaaaacgtcgccacagacaaggaagtcctccacgttaaagccgactctctttga

SEQ ID NO: 2852 - DNA, 1215 bp, Saccharomyces cerevisiae
atggaggaactaggtttaaaaagcacttttccatatgaatatggctcagactttacaatgataagaacggaaatgttaaatactacgaagagcgaaacaactattttattttccaatataaagagcattttggccattatttggaaatactcatttacatttttaagatctttttccgattccatcaaacttattattgacgatgttgtcactattggctcccgaaattttgcagagagattacagattgaagcgaaaaaaaacaatgaccaagaagatatctgggcatccacaataattttgggtgtgattatcgggtatttaatctcttctattaagagaaagaacacttttccaataatgcctacgagctcacctaaaatagatgattgtaggttcaagactggtgataccatatccattgtaataaactttaatgaagactgcctcaataatcgaagtgacgttaccgaagagagaaattatgaggaatccacagttttacattcaaaggagtcagttctcagcattggtaggcaaaatatggtaactttgaaccaaagcgatgaaaatttcacctatggcaattttgatgagtacgacttattaactaaagattatacaacagaggtcttaacgcgatcacctggctcgaatcccgagtttaaagcagtggtaaataatacattacttgatagcgcgaatgaaacgccgtttaaaggtattgaaaaaagtattaacgaaacaatggttaaagttcctatgggatgcgatgtatctctctcccattatggcagacaatacgcgcctggaaatatttcaattatgagaagcttcactgctcgagataatactaaatctgtgagtagagaaattcgtgatatctgtaaatcgtttttgattataaaaagccaatttggtgacgaacttttcctgactatgttcatggaaaaaccagttttctttgataacaacatcccaattgaaataactggagcataccgagaaaaacgagagcgattagatgaagtgattcataaggatcttatccgctatgatgaagttcaaaatttgacaaggattcgcaatttgctccgggttaaaagtcaaaagatttgttccaggagacataatagttcggttcccacaaaaaaattgttagttaatgataaaggcgcaacttcgattctactgtggtactctaactattcatag

SEQ ID NO: 2853 - DNA, 1215 bp, Saccharomyces cerevisiae
atgggaagtttgttgagaccggttgatctggtaaatcaaccgcttggattccaagaaagatataaaattttgcagaaattattcaagcagctacaaaaggcatatgcacacacaaaaggaactaatattgaccttgaaagacttgccactcgcttagaagtccatgttgctaaaaacagcttgtctggtcagagttacaagtttaacatgagcattttactgcgggatgtgcttaaatataaaggagatctctcgaagatcaaaattaatgggcgcccccttaaaggagctaagcctcatttatcctcaattggtaatgcaaactctatcactacaaaatcaaaagcgatggaagctttaaaggctctgattttggattcgaaggtcttagagaaaaatgggtatattgttaaggaaatgcaaaataaaactaatgatgacaatagtacgcaactgtatgcaccttgtttgcgttgcagctcaaatttcaaaaaaacagacatcatggaaaagactctatgtaggtatcaccctttgaaaagaatatacaacagagataccaagaaccatcagtatccatgctgtggtgaaactactgattccgtttcttttctaaggctaggatgcaagacgttttttcaccatgtgtttagaggagaatcatatgacgagttatgcaaaatttcgaagttttctagtacagatgacattgatggtgttgagaatgttctttctcttgactgtgaaatggcttttacatcattgggctatgagatgatacgtttaacaattgtggattttttcaccggcaagacactatttgatcatgtaattcagccaataggggatattgtcgatctgaattcagacttcagtggtgtccatgagattgaccgaaccaattgcccgacgtacaaggaggcacttgatgtttttttatccgaaaacttaataaataaaaatagtattcttatagggcacggactagagaacgatctgaacgtcatgaggctatttcataataaggttatagatactgcaatactttattcaagaacaaagtttaaggtttctttgaagaacttagcgtttgaagttttgagtagaaaaatccaaaatggcgagcatgatagttctcaagatgcaatagcaacgatggacgttgttaaagtcaaaataggtatttctccaagtcaaaacaagtgggaaaaataa

SEQ ID NO: 2854 - DNA, 1215 bp, Saccharomyces cerevisiae
atgtactttttaaaccaactaatatttcaagacgtttccgtaatgtcggtggataaaagagaagatatgagcagatctttccaaaaatgtttaaacttgagataccctatcatccaggcccctatggcgggggtcacgactattgaaatggccgctaaggcttgtattgcgggcgccatagcttcactacccctatcccacttagacttcagaaaggtcaatgatattgaaaagcttaaactgatggtttcacaattcagagatcaagtagccgatgaatctttagagggcaatctcaacctaaactttttttgccatgatatcgttgataaaccgaccgatcttcaaacagctaactgggcgaagctatacagaaagtctatgaatgtgccgattgatatgaatgagattaaattcgataatggtaatgtatcttttaaggcatttgaaaaagaaaatgctcttcaagattttttccagtacctatcagatggctttaggcctaaaatcattagtttccattttggccatccgtcgaaatctacaatagaatatttacaaaaaattggaattctaatttttgtgactgccacctctgtaagagaagttcgattgttagcacgtctcggcattaatggcatagtgtgtcaaggctatgaagcgggaggacatagaggaaatttcttagtaaatgaccccaaagatgatgaaaacttatcaactgtacaattggtgaaaagaacagttgatgaacttgctgaaatgaaaaataaaggtcttatacatgctactccctttgtcattgcagcaggtggtataatggattccaaagatatatcatacatgttatcacagcaagcagacgctgttcaagtggggactgcttttcttggttgcagtgaatccaatgcatcaaaaaacttttcaagccccttcactcgagaaacaacaactaaaatggttaatataatatcaggaaagcctgcaaggaccatctctactccttttatcgaaaaagtcattgctaattttcaaggtgaggagcttcctccatatggctacatgtatagtgctttcaagcaagtaagaaaaaagtatccagaattggctaactttattttagctggacaaggatttcagaatgtccaatcaggaatcacaacagacaagaaaattgaaactatgggcgcaagattgaaaattgacggaaaataa

SEQ ID NO: 2855 - DNA, 1215 bp, Saccharomyces cerevisiae
atgtcaactatcaaagttattgaggtatatacacagaatggactgagaaaggtacggccctattataacagaagatcagcgttcgtgaaggggcgctggttgggtaagttactaatagacgttctcgttagtgaatttaaacttcgcccaagagcttattatttggaccaaataaggaaaggcacatataggttgatccgagatggtgtgccgctggtaccagatcatctcatgactaccataatcaagaatcatgatgttttagaaacaactacgcataagcacgaaccgccggtaaaacaatggtgtagccaggaagttgaagcggaggatttacctggcagaatagcgggattcaatattgtttttgaagatgagagtatcctcgtcattgataaacccagtggtataccagtgcatccaaccggtcagttttaccagaacacaattactgaattactgaagttacatggtgtagatgctcttccttgttatcggttagacaagatcacatcaggcttgttgatattggccaagaacagtcagagtgcgggggaaatccagaagagtattcgttcaagagatatgattaagatctacttggcaagggtcaagggaagatttcctcactccgaattgatattggacaatgaaaatgcggcggaaacgacttttgaggacacttccaaagttacagtggaaatgacacccatatattctatcgatccaaagagacagtttccagttggtttatcgacatcgaaggatgctattaccaagttctacccaataagatacttctctcatgctgatgaaactgtcgtcgcttgtaagccaataactggaagaacacaccaaattcgaatccatttagctaggctcggtcatcccatcgtcaacgatagtgtttattgttcgcatattacaaaataccccgaaaggcttaagtttataactcagtttcctagatgggagaatcagcaggatttagatgctgaggaattgaaagtgaggtttcaaaaatttgtcgatgagacaaaaaataattgtcggacaatggaaacattttgtcctgaatgtcatactgttgatttaaaggatcctgtgctatcagacctagaattatggttgcatgcttggaagtatgaggagattaatggcaaattcaagttcaaaacagatttaccaaaatgggcacaattggacaatagttaa

SEQ ID NO: 2856 - DNA, 1215 bp, Saccharomyces cerevisiae
atgtcagaagatcaaaaaagtgaaaattcggtaccttctaaggttaatatggtgaatcgcaccgatatactgactacgatcaagtcattgtcatggcttgacttgatgttgccatttactataattctctccataatcattgcagtaataatttctgtctatgtgccttcttcccgtcacacttttgacgctgaaggtcatcccaatctaatgggagtgtccattcctttgactgttggtatgattgtaatgatgattcccccgatctgcaaagtttcctgggagtctattcacaagtacttctacaggagctatataaggaagcaactagccctctcgttatttttgaattgggtcatcggtcctttgttgatgacagcattggcgtggatggcgctattcgattataaggaataccgtcaaggcattattatgatcggagtagctagatgcattgccatggtgctaatttggaatcagattgctggaggagacaatgatctctgcgtcgtgcttgttattacaaactcgcttttacagatggtattatatgcaccattgcagatattttactgttatgttatttctcatgaccacctgaatacttcaaatagggtattattcgaagaggttgcaaagtctgtcggagtttttctcggcataccactgggaattggcattatcatacgtttgggaagtcttaccatagctggtaaaagtaattatgaaaaatacattttgagatttatttctccatgggcaatgatcggatttcattacactttatttgttatttttattagtagaggttatcaatttatccacgaaattggttctgcaatattgtgctttgtcccattggtgctttacttctttattgcatggtttttgaccttcgcattaatgaggtacttatcaatatctaggagtgatacacaaagagaatgtagctgtgaccaagaactacttttaaagagggtctggggaagaaagtcttgtgaagctagcttttctattacgatgacgcaatgtttcactatggcttcaaataattttgaactatccctggcaattgctatttccttatatggtaacaatagcaagcaagcaatagctgcaacatttgggccgttgctagaagttccaattttattgattttggcaatagtcgcgaggatccttaaaccatattatatatggaacaatagaaattaa

SEQ ID NO: 2857 - DNA, 1215 bp, Saccharomyces cerevisiae
atgtctagttcaatatttggcccacttacgggttttttggagcgtgtcaattcactcaatgcgccctaccaagcattatcatatgacgaacaaaaggccatgactatttggcaaagagtcaaattctacaactggacttttgaattgtgtgctctaggtgtgttgttcttggtttatgctttctacaaatttggtaactccgttaatttgaagcgcggaaatcagattttccaatctttgcattcatttttggccaacgacttaaagttctcccgtgtagggttcaatatcaatgattccaaaatctttacagtggaacaccaaaatacatggttctcttcttttgctaccggtagatccgccatcaagagcatcaacctaaaccttcatctggtagcccgtagcaaccctttctctatgtgtctagagtacctgcttggatttttttttgcaagtttgaaaagtaagcaattggaagaatttatggagatcgtgatcaggccaaatggtattttagttactagtgaatctgctcatcctaacaagaatgcgcatgaaattttgaccaaatttagatttgtcacttctattgttaacaaagaattcatgaatcaagctagaactgaaaactatttcctgtctattgcacacactagtgaaaacgataaactaccaaataacttcgtctacatgtccgatgttaatcaattatcagggttcatgtttcattactccaagccctatgaggttttgtcccaagctggtaatcttttgaaatatataagtttcaccgatttgcctgtcaacccgccacgcgatgataaagaatgggaatcttcaattgaaccaaaggctatcattcgttgcgctgttccccaaaatgagaatgaattgaagttgttaaaccaaattatttccttagtcgtagaaatctacgatgggttcactcaagatttagtccaacagtctccaaacttattcattaccaacgacatcttgaaaagaactaccaacttgcgtcagcaagaactgaacaagatcaaaaagtttatgaaagaaactgaattggaattggcaaaggagaagaaattagaattggaaaaagccaaaagacgtcaattgaaggcctctggtcaacaagaaaaggtagatcaaaaaatgaaagagaaaagagaaagacgtctcaaaaacaagcaaagaacaagatttcagtaa

SEQ ID NO: 2858 - DNA, 1215 bp, Saccharomyces cerevisiae
atgtctgaaaatcaacgtttaggattatcagaggaagaggtagaagcggctgaagtacttggggtgttgaaacaatcatgcagacagaagtcgcagccttcagaggacgtctcacaagctgacaaaatgccggcaagtgagtcgtctacgacgccgctaaacattttggatcgcgtaagtaacaaaattatcagtaacgtagtgacattctacgatgaaataaacaccaacaagaggccactgaaatcaatagggaggctgctagacgatgacgatgacgagcatgatgattacgactacaacgacgatgagttcttcaccaacaagagacagaagctgtcgcgggcgattgccaaggggaaggacaacttgaaagagtacaagctgaacatgtccatcgagtctaagaagaggcttgtaacgtgcttgcatcttttaaagctggccaataagcagctttccgataaaatctcgtgtttacaggaccttgttgaaaaggagcaggtgcatcctttgcacaagcaagatggaaatgctaggacgaccactggagctggcgaggacgagacatcgtcagacgaagacgacgacgatgaggagttttttgatgcctcagagcaggtcaacgccagcgagcagtctattgtggtgaaaatggaggtggtcggcacagtcaagaaagtctactcgctgatatcgaagttcacagcaaattcgctgccggagcccgcaagatctcaggttcgggaaagtcttctaaacttacccacaaattggttcgacagcgtccacagtacatcactgccgcatcatgcttcgtttcattatgccaactgtgaagaacaaaaagtggagcaacagcaacagcaacagcaacagcagcagcagcagcaacttttgcagcagcaactcctgcaacagcaacagcaaaaaaggaacaaggatggcgacgactcagcctcgccgtcctcctccgtaactgcgaatgggaaagtactcattctcgccaaagaatccctggaaatggtgagaaatgtcatgggcgtagtcgactccacgttgggcaaggctgaagaatgggtgaagcagaaacaggaggtaaaagaaatgatcagggagcgtttcttgcaacagcagcaacagtacaggcagcaacagcagaaggatggcaattacgtaaagccctctcaggacaacgtggatagcaaggactaa

SEQ ID NO: 2859 - DNA, 1215 bp, Saccharomyces cerevisiae
atgtctgtgcaccacaaaaagaagctaatgcccaaatcggcattgctgattagaaaataccaaaagggaatcagatcatcattcattgggctcatcatagtgttatcctttttatttttcatgagtggctcaaggtccccagaggtaccaatagctcagggcaccagtgtcagtcgtgtagccagtaaggattatttgatgccgtttactgacaagtcacaaggagtaatccatcccgtggacgatggaaagaaggaaaagggtgttatggtcacattggccaggaattcagatttatggaacttggtaaaatctattagacatgttgaagacaggttcaataacagatatcactacgattgggtgttcttgaatgaccaaccatttagtgatgagtttaaacgtgttaccagtgcattggtttcaggcaaggcaaaatatgggacaatcccaaaggaccattggtccattccatcttggatcgatactgaaaaattcgatgagaaaaggcttgcaatgggaaaattggatattccatatggtagttccgtgccttaccgtcacatgtgccgtttccagtcagggttcatatggagacacccactactggaggagtacgaatggttttggagagtggataccgatatcactttattctgtgatattcagtatgacatattcaagtttttaaaagtaaataacaagaaatatggattcattctttcggtaagtgaatatgagcgcacaatcccaaccttgtgggaaacgacaaagaaattcatcaagaaaaatcctaaattcttacacaaaaataacctcatgaaattcatttcgaatgatgatggtgacacttataatatgtgtcatttctggaccaacttcgaaatcggctctttagacttcttcaggtccgatgcatacagagaatactttgattacttagacagttctggtggattcttctacgaaagatggggggatgcgccagtgcactccatcgctgcctctttgttcttggacaagtcagaaatccatttctttgacggtcttggattccatcatccagatttcacctcttgtcctatcgaacagaagattagactacaaaacaagtgtatctgcgaacctagcaaggacgtcacctggactcctgactacttctgtactagaaagtacttttcagcaggaaattacaagcttccaccaggaatttaa

SEQ ID NO: 2860 - DNA, 1218 bp, Saccharomyces cerevisiae
atgaacattggtggaggaaaatttttacttgggaggatatcgaataatccaacttcagggatagtagggcttgctaatgttggtaaatcgacttttttccaagcaataacaaactcaaaattgggaaatcctgcaaattatccattcgctaccattgacgcagaatgtgccaaagtcaatatacctagcgtgccgctctctaatttattgagaatatatcagagtgcgaaatgcgtacctggaacactcacaatatatgatattgctgggctcaccagaggcgcatctcaaggccatggtttgggtaacaagttcttaaacgatatcagacacgtagaggggatatttcaagtggtgagaggattcttaaaggaagacatcacccatatagaaggtaatgttgatcctgtcagagatctatccgtggtacaagatgaactcatcttgaaagacttagaatttctggaaaacattagggaaagacttagtaagaagatgagaatggtttcgaagaattctaaagaacatcaggaaatgaagatagagacagaattattagatgcattagaggaacatttgtttaacggtaaaaaaatccggcatttcaaagatcattggaacctggatgaagtcaaaattttgaataagcataactttttaacctccaaaccaactttgatattgctaaatgtttcacctcaagattacgttaggaatgaaaataaatttgtcagaaatattatagaatggattaacgaattttcgccaggagataaattcctacttttcagtgcagaatttgaatcgcaattgatggaatgtaaaggcatagcgtcagagtattttgacaagatcaaggaagataccaatgtttctgatcaacagttagtttctgcgataccgcaaataatactagaaatgagaaagttgttgaacttaattagcttctttacatgcggcccacaagaagttcaccaatggaatataagggagggaaccaccgctcaagaggccgcgggtgtaatccatagcgacttgcgtgaaacatttatcagcgctgatgtaataaaatatgacgatctgaagaagatggaaccaccgctaaatgagtctttactaaaatctaagggacttatcaaacgtgcaggcaaacaatatattatgcaggacaatgacattgccttattcaaagccgccggtgggaaaattaagaaatag

SEQ ID NO: 2861 - DNA, 1218 bp, Saccharomyces cerevisiae
atgacagctgctgtaacatcctccaatatagtattagaaacccacgaaagtggtatcaaaccatattttgaacagaagatccaagaaacagaattaaagatccgctccaaaacagaaaatgttcgcagactggaagctcaaaggaatgcattgaatgacaaagtacgttttatcaaggacgaactgcgtctattacaggaacctggatcttatgtgggtgaagttataaagatcgtgtctgacaaaaaagttctcgttaaagtgcaacctgagggaaaatacatcgtggatgttgcaaaagatataaacgtgaaggacttaaaggcatctcaaagagtttgtctaaggagtgactcttatatgttgcataaagttcttgagaataaggctgacccactagtttcgttgatgatggtggaaaaagttcctgattccacatacgatatggttggtggtttgacaaagcaaataaaggagattaaagaagttattgaattgcccgtaaaacatcctgaactttttgaaagtttgggtattgcgcaaccaaagggtgtcatcttatatggcccccctggtacagggaaaaccttattggcaagagctgtcgcacatcacactgattgtaaattcatcagggtcagtggtgcggaactggtacaaaagtatatcggcgaaggttcccgtatggtccgtgagctgtttgtgatggctagagaacatgctccctcaattatctttatggatgaaatcgattccattggctctactcgtgtagaaggttctggtggtggtgattcagaagttcaaagaacaatgttagaactactaaaccaattggacgggtttgaaacttctaaaaatatcaagatcataatggccacgaatagactagatattctagatccagcacttttgagacccggtagaatagataggaagattgaatttccacctccaagtgtcgcagctagagctgaaattttaagaatccattccagaaaaatgaatctaactcgtggtatcaacttgagaaaggttgctgaaaagatgaacggttgttctggtgccgatgtcaaaggtgtctgtacagaagctggtatgtatgctttaagagaaagaagaatacacgttactcaagaagacttcgaactcgctgtgggtaaggttatgaacaagaaccaagaaacggccatttctgtcgccaagctgttcaagtga

SEQ ID NO: 2862 - DNA, 1218 bp, Saccharomyces cerevisiae
atgactaaattgcgaattgctgtacaagggtgctgtcatggtcagctaaaccaaatttataaagaagtgtcacgaatccatgcgaagactcccatcgatctattaattattcttggagattttcaaagtattcgtgatggtcaggattttaagtcaatagccataccaccaaaatatcaaagactcggtgatttcatatcatactacaataatgagattgaagccccagtccctactatttttattggcggtaatcatgaatcgatgagacatttaatgcttctgccacatggtggttatgtagcaaagaacattttttatatgggatactctaacgttatatggtttaaaggcataaggataggttcattgagcgggatatggaaagagtgggatttcaataagcaacgaccagattggaatgacctagaaaataacaattggaaagctaacataagaaatctgtatcatgtaagaatttctgatattgctcctctttttatgatcaagcatcgtattgatattatgctgagccacgattggcccaatggagtcgtttatcatggcgatactaagcacttgttgaagcttaagcctttttttgagcaagatattaaagagggaaaactaggcagcccagtgacctggcaactactaagagatttgcggcctcaatggtggttgagcgcccatttgcatgtcaggttcatggcctccattaagcataataaaagaagccacgaaccgcctaataagtcaacttcaaagacaaaaaaaaacaataatgaaatagatttggatttatccagtgacgaggacgaaaggtctggtattatgaattgccaagaagagaatgagtatgattccaaatacggcgagacacggttcttggcgttggacaagtgcctgccaagaagacgttggttagaaattctggaaatagaaccggatacatcgcatgcttcgtggaaggacgagaatcaccgtatgttctgggatcctgaatttatcaataatttggtaatttgtcaaaaaaataagaatctcctaagcaataaaccgtttaatagcgtcaattggatagaactgtctcaatctaatagagaggaaggaagggatattgattgggaaaattatgccattcctgcatacaccttagatattcagaaagatgaagtacgacaaactaaagcatttatctctaaattcatgacttga

SEQ ID NO: 2863 - DNA, 1218 bp, Saccharomyces cerevisiae
atgagtcagcaaacaccacaggaaagtgaacagaccacagcgaaagaacaggaccttgatcaagagagcgtgttgagcaacattgacttcaatacggatttgaatcacaatttgaatttatcggaatactgtatatccagtgacgcaggaacagagaagatggatagcgacgaggagaagtcgttggccaatctgccggagttgaaatacgctcccaagctatccagcctggtgaagcaagagacgctcaccgagagcttgaaaagaccacacgaagatgagaaagaggcgatagatgaggccaagaagatgaaagtgccgggagagaacgaggacgaaagcaaggaagaggaaaagagtcaagaactggaagaggcaattgacagcaaggagaagagcaccgacgccagggacgagcaaggggacgaaggtgataatgaggaggaaaacaacgaggaggataatgaaaacgaaaacgagcatacagcaccgcctgcgctggtgatgccctcccccatcgaaatggaggaacagaggatgactgcgctgaaggaaatcaccgacatcgagtacaagttcgcgcaattgcgccaaaaactatatgacaatcaattggtgcggttgcaaacggagctgcagatgtgtctggaagggtcacacccggaattgcaggtctactactcgaagattgccgcgatccgtgactacaagctacaccgagcgtaccagcgacagaagtacgagctttcatgcatcaacacagaaacaatcgctaccaggacattcattcaccaggacttccacaagaaggtcaccgacctgcgagccaggctgctgaacagaaccacgcagacctggtacgatatcaacaaggagcgccgcgatatggatatagtcatcccagatgtcaattaccacgtccccatcaaacttgataacaagacgctgagctgtatcacgggctacgccagcgcagcacagctgtgctatcccggcgagcccgtggcagaggacctcgcttgcgaaagcatcgagtaccgctacagagccaacccggtggacaaactcgaagtcattgtggaccgaatgaggctcaataacgagattagcgacctcgaaggcctgcgcaaatatttccactccttcccgggtgctcctgagttgaacccgcttagagactccgaaatcaacgacgacttccaccagtgggcccagtga

SEQ ID NO: 2864 - DNA, 1218 bp, Saccharomyces cerevisiae
atggatacggataagttaatctcagaggctgagtctcatttttctcaaggaaaccatgcagaagctgttgcgaagttgacatccgcagctcagtcgaaccccaatgacgagcaaatgtcaactattgaatcattaattcaaaaaatcgcaggatacgtcatggacaaccgtagtggtggtagtgacgcctcgcaagatcgtgctgctggtggtggttcatcttttatgaacactttaatggcagactctaagggttcttcccaaacgcaactaggaaaactagctttgttagccacagtgatgacacactcatcaaataaaggttcttctaacagagggtttgacgtagggactgtcatgtcaatgctaagtggttctggcggcgggagccaaagtatgggtgcttccggcctggctgccttggcttctcaattctttaagtcaggtaacaattcccaaggtcagggacaaggtcaaggtcaaggtcaaggtcaaggacaaggtcaaggtcaaggttcttttactgctttggcgtctttggcttcatctttcatgaattccaacaacaataatcagcaaggtcaaaatcaaagctccggtggttcctcctttggagcactggcttctatggcaagctcttttatgcattccaataataatcagaactccaacaatagtcaacagggctataaccaatcctatcaaaacggtaaccaaaatagtcaaggttacaataatcaacagtaccaaggtggcaacggtggttaccaacaacaacagggacaatctggtggtgctttttcctcattggcctccatggctcaatcttacttaggtggtggacaaactcaatccaaccaacagcaatacaatcaacaaggccaaaacaaccagcagcaataccagcaacaaggccaaaactatcagcatcaacaacagggtcagcagcagcaacaaggccactccagttcattctcagctttggcttccatggcaagttcctacctgggcaataactccaattcaaattcgagttatgggggccagcaacaggctaatgagtatggtagaccgcaacagaatggtcaacagcaatccaatgagtacggaagaccgcaatacggcggaaaccagaactccaatggacagcacgaatccttcaatttttctggcaacttttctcaacagaacaataacggcaaccagaaccgctactga

SEQ ID NO: 2865 - DNA, 1218 bp, Saccharomyces cerevisiae
atgtcaacaacaggtccgttagatgctactttaataagggacgttgcggttgctactgccaccaaagcatcatacgatatgagcgatactctatattcatatctacccaaggtcgaccaattttatattcctgaatggcttacaatgcaattcattgccaacaatttgatcagctttacccccctattttcatatggtaccacgatcattagcattgagaaatgcaagactgctttagggttttcaatagatatttgtgccacaatgttgatcgctagtatcctaagaatatcttactatctcattacaccgtatgaaatcactttgttgaggcagtcattagtgatgatttttattcaactgatcttgctgagaacaagcttaaaatatagacctgatgagtacaaataccaaaatctcaccgatgtagagtcattgtcacatttgattcacgacatatggttcgagttttttagctgcattaatagaccgaaatttttaagtgaagattggaagaatctgatcaaatctctttcgttcacaaatttactgaaattttcattcaaaatttttttggcatttttttataaaattttgaaattctttgacccaaatttcaaaagaattggagcgttttggcagtgggatgacgacaaaaatttctggaggtttttagctctttttgcaactgtacaaatattggtcacatttttcatctctaatattttaaattgggactcactagctcaaggactgggctctatcatagggtcgttgggtttattggtggagtcgcttttgccgttaccacaaatcgccattctttataaattgaagtctgttcaaggtttcaaattgatccttttggtaagctggctttgtggtgatacactgaaaatcacttacctgatatttggtgcgaaaaatatttctgctttgtttgttatttttgcattatttcaaatgtcattagacttttacatcggtggtcaatacatttactacagatactattatccaaagttaaggcatcaacatcaccctaatgacagtaattcgccatcagatgaagatgaaagcgaaatgtacgaattagatctttttaataccttacaaaaggatgtcgaaaaggccttgaaacaggatagtaatgatacgtcagattcacctcaagatgaccaagtgggtaaatctcaggcacaggcggtaacgctatag

SEQ ID NO: 2866 - DNA, 1218 bp, Saccharomyces cerevisiae
atgtctattaatatttgtagagataatcatgatccattttaccgttacaaaatgcctcccatccaagccaaggtggaaggtagaggtaacggtatcaagactgccgttttgaacgtcgctgacatctctcacgcgctaaatagacctgctccatatattgtcaagtattttggtttcgaattaggtgctcaaacttccatctctgttgacaaagatcgttatttagttaatggtgttcacgaacctgccaaattgcaagacgtattggatggctttattaacaagtttgttctctgtggaagctgtaaaaatccagaaacggagatcatcattaccaaagataatgatttggttcgagactgtaaagcctgtggtaagagaactccaatggacttgagacataaactatcatccttcattttgaaaaacccacctgactccgtttctggttccaagaagaagaagaaagcagctaccgcttcggccaatgttcgtggtggtgggttgtccattagtgatattgctcaaggtaagtctcagaatgcaccttcagatggcaccggctcatccactccacaacatcatgacgaagacgaagatgaattatctcgtcaaatcaaggcggctgcctctaccttagaagatatcgaggtcaaagatgacgaatgggcggttgatatgtctgaagaagccattagagctcgtgccaaggaactagaagtgaactctgagctcactcaactggatgaatatggtgaatggattttggagcaggctggtgaagataaggagaacttaccatcagatgtggagctttataagaaggctgcagaactagacgtcttgaatgatccaaaaattggttgtgtcttggcgcaatgtctattcgatgaggatatcgtaaacgaaatcgctgaacataatgcatttttcactaaaattttagtcactccagaatacgaaaagaactttatgggtggtattgaaagatttttaggtttagaacataaggatctaatcccactattaccaaaaattttggtacaactatacaataatgatatcatctcggaagaagaaatcatgagatttggtaccaaatcatccaagaaatttgtacctaaggaggtatccaaaaaggttcgtagggctgctaagccattcattacgtggttagaaaccgctgaaagtgacgatgatgaagaagacgacgaatag

SEQ ID NO: 2867 - DNA, 1218 bp, Saccharomyces cerevisiae
atgttcagcttgaaagcattattgccattggccttgttgttggtcagcgccaaccaagttgctgcaaaagtccacaaggctaaaatttataaacacgagttgtccgatgagatgaaagaagtcactttcgagcaacatttagctcatttaggccaaaagtacttgactcaatttgagaaagctaaccccgaagttgttttttctagggagcatcctttcttcactgaaggtggtcacgatgttccattgacaaattacttgaacgcacaatattacactgacattactttgggtactccacctcaaaacttcaaggttattttggatactggttcttcaaacctttgggttccaagtaacgaatgtggttccttggcttgtttcctacattctaaatacgatcatgaagcttcatcaagctacaaagctaatggtactgaatttgccattcaatatggtactggttctttggaaggttacatttctcaagacactttgtccatcggggatttgaccattccaaaacaagacttcgctgaggctaccagcgagccgggcttaacatttgcatttggcaagttcgatggtattttgggtttgggttacgataccatttctgttgataaggtggtccctccattttacaacgccattcaacaagatttgttggacgaaaagagatttgccttttatttgggagacacttcaaaggatactgaaaatggcggtgaagccacctttggtggtattgacgagtctaagttcaagggcgatatcacttggttacctgttcgtcgtaaggcttactgggaagtcaagtttgaaggtatcggtttaggcgacgagtacgccgaattggagagccatggtgccgccatcgatactggtacttctttgattaccttgccatcaggattagctgaaatgattaatgctgaaattggggccaagaagggttggaccggtcaatatactctagactgtaacaccagagacaatctacctgatctaattttcaacttcaatggctacaacttcactattgggccatacgattacacgcttgaagtttcaggctcctgtatctctgcaattacaccaatggatttcccagaacctgttggcccactggccatcgttggtgatgccttcttgcgtaaatactattctatttacgatttgggcaacaatgcggttggtttggccaaagcaatttga

SEQ ID NO: 2868 - DNA, 1221 bp, Saccharomyces cerevisiae
atggaaggtatgaatatgggtagcagcatgaatatggacgccatgtctagtgcatccaagacagtagcatcgagtatggcgtcgatgagcatggatgcgatgtctagtgccagcaaaacgatattatcgagcatgtcatcgatgagcatggaagcgatgtccagtgcgagcaaaacgttggcgtcgactatgtcgtcaatggcaagtatgtcgatgggaagcagttcaatgtcaggtatgtctatgtcgatgagcagtacaccaacaagctccgccagtgcacagacaacttctgattctagcatgtcaggcatgtcaggtatgtcatcgtctgataacagtagctcttcagggatggatatggacatgagtatgggaatgaactattatctgactcccacatataaaaactatccagttttgtttcaccatttgcatgcaaacaatagtggtaaggctttcggtattttcttattatttgttgtggctgctttcgtctacaaactactgcttttcgttagttggtgccttgaagttcactggtttaaaaaatgggacaagcaaaataaatattccactttaccttcagcaaactccaaagacgaaggaaaacattatgacacagagaataattttgaaattcaaggtttacctaagctgccaaatttattaagcgatatatttgttccatctttaatggatctctttcatgacattataagggcgttcttagtatttacctctacgatgattatttatatgttgatgcttgctaccatgtcttttgttttaacatacgtttttgctgtaattactgggttagctttatcggaagtcttcttcaatagatgcaaaatagccatgctaaagaggtgggacatccaaagagaaattcagaaagcgaagagctgtcctggcttcggtaactgccaatgtggtagacatcccgaacccagccctgatccaattgctgttgccgataccacttccggaagtgatcaaagtactcgcctggaaaagaacaacgaatctaaagttgcgatttccgaaaataatcaaaagaaaacacctacacaagaagagggatgtaattgtgccacagactcaggaaagaatcaagcaaacatagagcgcgacatccttgagaattccaagttgcaggaacagtccgggaatatggatcaaaacttacttccggccgaaaaattcactcataactaa

SEQ ID NO: 2869 - DNA, 1221 bp, Saccharomyces cerevisiae
atggatagagtacgctctttgattggaaatcgccggggacgccgacataatcgccaacatcctccgtatcctcacagtgggtctccatccaccgtcaatctcttgggagctaatggttatggagacgaccaatctacaatatttgcacgagaaaatgaatctctggaaacctctgccaacgagggcgatgatagtgcggatgcagctactttgaatacagcggtatcagaaggctcaacaattggagacctacaaagacagggttatgttaacagagccccaagattcacgtcagaaagagccatgccattcgtttcggtgctactacaacgagggttttttgcattccccagtgaagaatctctccagctatttttacacaacaagaggaagctcgataacattgatccaaagaggggtctaggacttcccctatttcacgccatttctttaaacctggtcaagtcgcttttcagtgatcaaaatacaccggtaatgaggatatataaatacgttatgatagactcccaatgcgataaacctccattaaactcagaagtggtctctcgaataaacgaaaatgtctccatatataaatatgaattctgcactattctaaaaaaaatggaaagccataatttttcgagcagggtagagcacgattttatatttcatagaaaagatgaacctgatgttcatatccccatgattaattacaatcaaaggaaaaatgcggatacggcaattcatggattaaatcttcgttggtacgggacaactagtttagcttcaccttttggctcaaatagcatcaacctacttgtactcgatgatacgatggcatcctacatgaaccaacaaactattgaagagtttgattcttacagccgttcccgtcccacaagaccgctgggttatctcccagtatgggccagatacacagatgataaagttagtgtcataccgaaaaaaagaactttgagagtagctaccttgtacttacaagaaactgattcgtttgatgatggctctagtttaacatctaccaattatactgaaatgggctctaatatcattgaaaatgtgccgtgggatagtcagatacttacttgcatgtgcatgctattacatgaatatgaatcaagaaaggagaaacgccacaccgcatggggcagctcgaccacatatatgctaaatggaccggcaggattactgatgtaa

SEQ ID NO: 2870 - DNA, 1221 bp, Saccharomyces cerevisiae
atggcagctgatagagataattttttacaaaatattgaaaatgattcaattaacaatggccaggccatggatctgtcacccaaccgaagttcctctgaaagcgatagcagcattctcatgaatgtgaatgatattaaaactttacgtctggacgtagcaccagaagctaaaagcacccaatcaaagaagtcgcttttttatgagaactctgatgatgctgaagaaggagaaatagaagagcgcacgaacaaagaagaaggacaataccatcataaaggatctaaacaacttcgatttgaggttggcaaggaaagtacaggtaaattgcaatctcatctatcggatggaagcgcaacaagtggagagggcaatgtacgaccttgggaattcaggaaggtaatacaagctgagtatagagaaaggttgccgcgcaattatgaattaaagcattggaaaaagccttctaaaataatgataggatccatacttcgtttattagagactaacactgtaagcgctcttgattctgtctttgagaagtacgaaaaggaaatgaaccaaatgacgcatggcgataataatgaggttaaaagaatatattctaagaaggaacgtttgcttgaaataatcctcacaaagataaagaagaagctaagacaggccaaatttccctctaggatatcggaaagagatctagacatcgagtatatttattctaagcgacaatttattcaaaaccggtattcacaagaactacaaaataatgagagattggaagcaattctttcacgtgaacaaaaccttttggaggaaactaggaagttgtgcatgaatttaaaaacaaacaacaagaaacgactcactgagaagctaatacaaaaagatctgcatccagtacttaacaaagcaatggaatatacatatggcttagaatctactaatggatttatgcatcctgatggcccagtaacttttagaaatgatagccacgaattgaacctgatgttgaacgaccccataaaaagtacagccgatgtgaggcttgataaggaggaagtactgtcgttgttaccttctttgaaagaatatacgaagaaatcaaaggaacttaaggaaacaatgggtcaaatgatttcggattcacatgaagaagaaatcaaagaggtttttgtaccgcaccatgagtcgcaccaagataagaccgaagaagatatacactag

SEQ ID NO: 2871 - DNA, 1221 bp, Saccharomyces cerevisiae
atggcttccaagaaaattaaagttgacgaagtgccaaaattaagtgttaaggagaaggagattgaagagaaatcttcttcttcttcttcctcctcctcctcctcctcctcctcctcttcttcttcatcttcctcgtccagttctagcggcgaatcttcaagcagcagcagcagcagcagcagcagcagcagcagtgacagcagtgacagcagtgactctgaatctagctcatcatcatcttcttcttctagctcaagctcaagttccagtgactctgaatcttctagtgaatccgactctagctccagtggatcttcttcttcctctagctctagttctgacgaatcttcttcggaatccgaatcagaagatgaaaccaagaaaagagcaagagaatcagacaacgaagatgctaaggagactaaaaaggctaaaactgaaccagaaagctcttcctcatcggagtcaagctctagcgggtcatcgtcatcttcagaatcagaatcaggttcggaatctgattctgactcaagttctagctcaagtagttcttctgattccgaatcagattctgaatcagattctcaatcaagttctagctccagctctagcgactcttcgtctgactccgactccagctccagcgactcttcatctgactccgactctagctccagctctagcagctcttcctcggattcagattcggattccgactcaagctcggactcagactcttcaggctcgtccgattcttcaagctcgtctgattcaagttccgacgaatctacatcttctgattcctccgattcggattccgactcagactctggttctagctctgaattggaaacaaaagaagcaactgcagacgaatccaaggccgaagaaacgcctgcctcatctaacgaatcaactccatctgcttccagttcatcaagcgccaataaattgaacattcctgctggaaccgacgagatcaaagagggccaaagaaagcatttttccagagtagatagatcgaagattaatttcgaagcttgggagttgacagacaacacctacaaaggcgcggctggaacatggggtgaaaaggcaaatgaaaaattaggtagagtaagaggtaaagatttcacgaagaacaaaaataaaatgaagagaggttcttacagaggtggatccattacattagaaagtggttcatacaaattccaagattaa

SEQ ID NO: 2872 - DNA, 1221 bp, Saccharomyces cerevisiae
atgggcgacgaattacacaaccgtttacttcaccaaaacgatggcaccaaggacgccatactttataagataatagaatcgttagtttgctccatctgccacgattatatgtttgtaccgatgatgacaccttgtggtcataattattgctatggttgtctgaacacctggtttgccagcaatactcaaaaagaattggcttgtccgcagtgcagatctgatattaccaccattcccgcattgaatacaacgttgcaacagtatctatcattcattttagagaaattaagggaccagaatgatgaatcttttaaaaaacttttaacaactaaaaccaaggaggaaaatgattacaagaatgacaaggaaaaggacacattgtttgacaaagtatttaagaatagcgcattggcagtggccgacgactcggatgatggtatcacacgttgtagtaattgtcattgggaattagacccagacgaagtagaggacggaaatgtttgtccccactgcaatgccagaatacggaattacgcaggtggtcgcgacgaatttgatgaagaagaatacagtgaaggagagttggatgaaatccgggaaagcatgcgtaggcgtagagagaatcgatttgcgtctaccaatccgtttgctaatagagatgatgtaagttctgaagacgatgatagcagtgaagaggagcccatgcgagaacatatcccactaggccgttgggccaggtcacataatcgtagtattgctgtggatgctgtggatgatgaagacgacgaagaagaggatgaggaagaagaagaggagatggattccgatttgaaagattttatagaggatgatgaagatgacgaagatgaagatggaagtaggaggaatttggtattgtctgcactcaagaacagacatgtaattattactgatgatgaggaagaggagcaacggcgacatgctacagaagaggaagatcgcgatagtgacttttacgagcataatgatgatggttttgtaagtggtgatagccttgatgaggatcagaaggaggttacacggatacaatcgagttctgattccgaagatcgttcactttcgtattccggctccagcgatgtcaaggataacaatgacgataacacggaagaattagatgacccacaaccgaaaaggcagaaacgcttccgtgtagttctaggagacagtgacgatgaataa

SEQ ID NO: 2873 - DNA, 1221 bp, Saccharomyces cerevisiae
atgtcgcttggtataccactttcccaattaatagtagaaagtccaaagccattaagtagcggcatcacaggattagatgagatattaaacctgggattccaggcaaggtcgatctacgaaatatttgggcctccgggcattggcaagactaattttggcattcaattggtgtgtaattcgttagaaggcatacaacaatcggaaataaacgacgataaaattctatggatagaaacatttcaagaaatgcccataaacatactaagagaacgctttcaaaaatttaaaatcgtggaagaaaatgtgaagcgggtccgaataacgaaatttggacagctattatatttcttccagaatttgttcaaattatctcaaagtgtgcgatataaactagttataattgatggattttctcaattagtctgcgatcatctgtgtacactaagtaaaagaggcggcggaatgatagataaaactatacacgagttaaaatgtcgacatttgatattaatttttacggtaatgaccaaatacacacattccacgggttcgacaataatagttttaaatgactgtatgaacaccgccttccaatcaaacgaattcgaatccttggaagaatactacgaaattttagacgacggatctaacttctttgtcaactctaacaacgaaaggcgtaagaacaatgtacatatattgaaaagcgcgctcgttgccaatatcgctatgggaagcaaggattccacttgggaagtatttctaagagacaggatcggcctttttagggattggaatgaacaagtggacgaaaccgttttcgtgaaaagcaaaagagtgaaggcgtcatcctcgcagagtaacgagggatgtactaccatcaaagaaatgagaataaacaaacgaaactttgaaaacttgagaatagctattgtttttaatttacacggcgaagatagaaaaagagaaggacgaaatttaaagcggtcaagaagcagcgacgatcgtaactatattgtcaaatttgattttgataaagcaacaggtcaactccgcgatataattgatctgaaacctgatactgctaatattgcctcatttccaacattatcaacaagcagcagcagttgctcacaagtgtttaacaatattgactccaatgataatccattaccaaatgcggagggaaaggaggagataatttatgatagtgaaggttaa

SEQ ID NO: 2874 - DNA, 1224 bp, Saccharomyces cerevisiae
atgagtgctgccactgcgactgctgcccctgttcctcctcctgtagggatatccaatcttcccaaccagcgttataaaattgttaatgaagaaggtggtacattcaccgtgatgttatgtggtgagagcggattgggtaaaactacatttattaataccttatttcagactgtcttgaaaagggcagatggtcagcaacaccgccaagaacccatcagaaagactgtagaaatcgacatcacaagagctttgctggaagagaagcatttcgaattacgcgttaatgtcatcgacaccccaggttttggagataacgtgaataacaacaaagcctggcaaccattggtggattttattgatgatcaacacgattcttatatgcgtcaagagcagcaaccgtaccgtactaagaaatttgacttgagagttcatgccgttctgtacttcatcaggcccactggacatggtttaaagccaattgacattgagactatgaagagattgtcaaccagagccaatctgattccagttattgcgaaagctgatacattgactgcccaagaattacaacagttcaagtccagaatcaggcaagtaatagaagctcaagaaattcgtattttcacgcctccattagacgctgattctaaggaagatgccaaaagtggcagtaatccagattctgccgctgttgaacatgcaagacagttgatagaagcaatgccatttgccatagtagggtctgaaaaaaaatttgacaatgggcaaggcactcaggtagttgcaaggaagtatccttggggacttgtggaaatcgaaaacgattctcattgtgatttccgtaagctcagagccctgttactgaggacttatctattagatttgatttctaccacccaagaaatgcattacgaaacatacagaagattaagacttgagggtcacgagaacaccggggaggggaatgaagatttcactcttccagcaattgcaccagcaaggaaattgtcacacaatcctagatacaaagaagaagaaaatgcattgaagaagtatttcactgaccaagtcaaagctgaggagcaaagatttagacaatgggagcaaaacattgttaacgaaagaatcagactgaacggtgacttggaagaaattcaaggaaaggtaaaaaaactagaagagcaggtcaaaagcttgcaagtaaaaaaatcccatttaaaatga

SEQ ID NO: 2875 - DNA, 1224 bp, Saccharomyces cerevisiae
atgatatcaataaaaggaaccggaagatttctcctcgataactatagaatttggcagaggcgtgcattcaacagaccaatacagttaagaaaaggctataaagttttagccattgagacttcttgcgatgatacatgcgtttcagttttggacaggttctcaaaaagtgcagctcctaatgtgctagccaatttgaaagatactttagatagtattgacgaaggaggtattataccaacaaaggctcatatccatcaccaagctcggataggacccttaaccgaaagagccctgatagaaagcaatgcgagagaaggaattgatctcatatgtgttacaagaggccctggtatgcctggttcattatcaggaggattagattttgcaaaaggtttagctgttgcctggaacaaaccactgattggtgtgcatcacatgctgggacacttgctgataccaagaatgggtacaaatggaaaagtgcctcaatttccctttgttagcctgctggttagtggtggtcatactacgtttgttttgtcacgagcaattgacgatcacgaaatattatgtgatactatcgatattgcagtgggtgactcattagataaatgtggcagagagcttggattcaagggaacaatgatcgctagagaaatggagaaatttattaatcaagatattaacgaccaagattttgctttaaaactagaaatgcccagtccgttaaaaaacagcgctagtaaaagaaacatgctttcgttttcgttttcagcatttatcacagcattaagaactaatttgacaaaactaggtaaaacagaaatccaggaactgccagaacgcgaaatacggtcaattgcatatcaagtacaggaatctgttttcgaccatataataaataaactgaagcacgtgctcaagtcacaaccggaaaagtttaaaaacgtgcgtgaatttgtatgttctggtggagtgagtagtaatcaaaggttgagaacaaaattagaaacggaattggggacgttgaactccacaagcttttttaatttttattatcctcctatggacctttgtagtgacaactctattatgatcggctgggcaggtatcgagatatgggaaagcttacgattagttagtgatttagatatatgtccaattaggcaatggccattgaatgacctattaagtgttgatggttggagaacggaccagctatga

SEQ ID NO: 2876 - DNA, 1224 bp, Saccharomyces cerevisiae
atgcaaatagtcagaagttgtaactccaataacaaacccctcataccgtcctcaaattggcatatcgctatcagaatgagaggcgatggggttaaagataggagtatagatgtgttatccctcaaacatttcgaatcccagaaagttgttctgcctcaagaccttttcatggataacttcacctggatgttttatgagttcttcaagtgcttcacgtttcgtacctggttgctattattactgctaatgtggttgccaggttttctttcgcagataaagtccatcaatcggatttttccgtttaaactttgtattttagtctcatgcctagtggggatatttttacccaatatttattcattctctcataaaagtgtgttaacgaatcaacttactcagttctccaaagaaattgttgaacatgcaccaggtactgatactcatgattgggaaacagttgcggcaaatctaaattcttacttctatgaaaataaagcttggaatactgagtacttctttttcaatgctgcagagtgtcaaaaagcattcagaaaagttcttctcgaaccattctctgtgaagaaagatgaatcttcgaaaataaaatcatttggggattctgtcccctacatcgaagaggccttgcaagtctattccacagaatttgacaaaaagtggaagttgttcaatactgagaaagtgtggagccctgataacttggaacatgttcagctccccaagaaaacttatcgttataagtttacctgggttctcaagaggattttcaatctctggctttttccagcatttattctgtttctggcttgtatctatgtgtcatgggataagggccatctatttcgtatcttgtgttgtgggggaggttttctccttatggtaagagtttttcaaaatatgaggcccttttccatgcacatggaagacaaaatgcagttcttgtcaacgattataaatgagcaagaaagtggtgcgaatggatgggacgaaattgcaaagaaaatgaacaggtacttgtttgagaaaaaagtctggactagtgaagagtttttctttgatgggattgactgtgaatggttttttaaccacttcttttaccgccttctatctacaaagaaacctatgtttgatagacctctaaacgtggaactatggccatacattaaagaagcgcaattgacccgcaaacaggcgcctcccgtgtag

SEQ ID NO: 2877 - DNA, 1224 bp, Saccharomyces cerevisiae
atgcctttgaatattattgggacggctctcctagacgggactgacaagattccttactatcaaacaatcaaaaaggtggcaccttatgtgctagcgactggtgccattaaatattggtcgagagggccatcaaatacatgggaaagaaagttgcacggtaaagtttacttggttactggcgctacctctcaaggaatgggaacatccgtggcttataaaatggcagagttaggtgcacaattaatcatcttgactagggaagtagatgaatgggttactgaatggtgcgaagaattacgtgaaaagacaaagaacgagttgatttttgtagaaaaatgtgatttgagcaatttgtgggagattcgtaagtttgccacaagttggttagacaattcgccacctagaagattagatggcgttattgtcatgtccggtgatatggaaccatggggtatcccgaaaatatctttgccacagaggagatcatctaaggatgggctggaattgcaaattgctacaaactatgtagcaattttccatcttttaaacttattacagcctagtttcaaggctcaaccgcctgatagagatgtaagaataattcttgccacctgctggttacaagttgttggtgatattaatatagaagatccgttgtggcaaaatgccaaatacaaaagcgccttgaagtttttcgcaagcagcaagctacaattgggattgagtatgatggaattgcaaagaagacttaccgaagacataaaaaaccaaaagacgaatggcgctgaaagaacaggaaaaaatgttaccattactatggttcaacctggaactatgagatcaaatagcctacgccgcgtcattagtaatggttcggtggtattgttaataatactttactgtattctgttgtaccccatattgtggctgtttaccaagagtggtcgtcgtggtgatcaaagtttcttgtacgctttaatgacaccggaattggaggaagtaaacttaaaagacacgaaggttaagtatatctcagactgttcaattgtgaaatttgctcgtaaagaatttgatgacgaggaattacagaagaaactatttgataatacggaaagagatattttacaattggaaaagaaagtcgcggcaaagagaaatgccaataagaccgggaatcaaaattctaaaaagaagagtcagaacaagagtagaaaagatgattag

SEQ ID NO: 2878 - DNA, 1224 bp, Saccharomyces cerevisiae
atggagacatacgagactagcattgggactcagtcttatcccccgactttgttcccacctcccctgggtaccggtgggtttaccacttcaggttatatacatgcgcttgtggattctacatcgaactcgaactcgaactcgaacacaaattcgaacacaaattcgaacacaaattcaaattcagataccaagattcctatagtgcaaatatcggatgactctcatataacacacgacagcttcaaaccatatatggagtaccacgatgcttcgcacttgaggaaccgtaacataagcaaagcggaccaggttgaaagcactgaagtgatggaacagtttacgcaatggtcgaattataagatgaggtctcgctctcctaccataaacgcaaagccaattcgacacacttcacaacgaagaacagactttaccagcaaaaatgaactctccaagttcagcaagaatcataatttcatttttcacaaagggtttttgaagaggcaacactccatacgcagggaagacaggcaagcaaaggtacggtcaagattcaggagcaagaaggagctgacatccgttttgaactatatagaactggaacaaatggatattgcaaatgtcctggcttcgcaaccggtaaacttacacgctatcagaaatctcactagcagggaccctgcggtaactcctatcccatttttaagaagccagatgtatgcaaccagtagtcgtccaccgtatctaaggaaccgctccataagtaggaaactacccaaatcacaaccaggtagtctcccgacgactatgcctgcgacggcgacgaaaacaattaaacagaattcaacgaccccaaccacaagatctgtttataacaagaatgtggggcggtccaatacttcccctagtgtgttgtaccacccaaaaagaagaggaaaattgaacaccaaatcgcatgcaagaaaggagcaactgctgttggaactgtggagagaatacttaatgctggttataacacagaggacgcaactgcgcctgactttgctttgctctccgggttcagcatcgaatgaaagctctgtctgctcttctaacgccagcgacttagacatgtcccttttatctactccttcaagtctcttccagatggcaggtgagaccaaaagcaatcctataattatacccgacagtcaagacgatagtatacttagtagcgaccccttttaa

SEQ ID NO: 2879 - DNA, 1224 bp, Saccharomyces cerevisiae
atggcggttgcgatcaaaaaggagaagacgaaatttgcccccgttaaggaagttttatccgagaaggatcatgctaattatactaaatttcaggatacatcgaaactagaatggttttgcaggacgtcaaatcacaaaaagttcaagtcacatagtttattaaaagcagtaagaaatccaacggaaacaagaatagagacacaaactctgtattttacggatctcaccaacggcaaatgtggattaattcaactattatattccagtgttatgggcggtatatacaaaggttttcagttaaatttcaaaatatttaaagccagcagtgaggaaaactctgaagaagacattgatatatgggaaagctttaaaattgataatatcaaagattttgatacgttaaaagttgaatcggacaatgttacgtttcacttcgtacctttggaaaattcttcctccagtggatttgctcaattattaattaagatagatattccgaagggaagtacaagctgtttactaaaagatttgaaggttgacattaccgtaaatttacaagaaggattcataataaacccggacggttccaattattaccttgacaagagcatcagcttggaagagttagcaaaaagagactcttctagtacgtccagaaaaatgataagacatgtttttgttcctagaggtttttgcaatggtaccatctcatacaagaaaaacgataaacctgtgaagctggacttgaaggacacgcctatgttgtatctggatgctgtccaggggctaatacccaataaggcggctagtaaatggaattttctttgtttcaatggtgagaagcgttcgatgatgtgtattgaattcaccacaacaaaagaatatggcagcactacagtgactatatgggcggttagtgataaggacaaaattttggaggtcgggtcaagtgtaaatgatcatgctgttaaatttccatctacaaaagaggataagcaaaatggttggaaatatcctacatccatttcatttccgcgtggttttgaagaatctaatttaagattagtcaataggtacgatataatgagtgagctgcccgctttcattaggtctattgctgaaaatctggcaaacatgaagccattcatttaccaattctgccagaagtctaaattcgatgacgatgaaggagtttccatcattgaaagtacatttatcaattga

SEQ ID NO: 2880 - DNA, 1224 bp, Saccharomyces cerevisiae
atggctaccttgcacttcgttcctcagcacgaggaagaacaagtttactccatctctgggaaggcactcaagttaacaaccagtgacgatatcaaaccatacctggaagaattggcagctttgaaaacctgtaccaaattagacctttcagggaatacaatcggtactgaagcttcggaagcattagctaaatgcatcgctgaaaatacacaggtcagggaatctttggttgaagtaaattttgctgacttatacacttcgaggttggttgacgaagtcgttgattcgttgaagtttttattgcctgttctgttgaaatgtcctcacttggagattgtgaacctttctgataatgcgtttgggctaagaacaatcgagttactagaagattacattgcacatgccgtgaatatcaaacatttgatcttaagtaacaatggtatgggcccttttgctggtgaaaggattggtaaggccctatttcatctcgctcaaaataagaaagctgcttccaaaccatttttggaaacttttatctgtggtagaaatagattagagaatggatccgcagtctacttagctctgggtttgaaaagccactccgaaggtttgaaagtcgtaaagctgtaccaaaatggtattaggcctaaaggtgtcgccacgctaattcattacggtttacagtacttgaaaaacttggaaatcttggatcttcaagacaatactttcacgaaacatgcttctttgatccttgctaaggccttgcctacatggaaggatagtttatttgaattgaatttgaacgactgtcttttgaaaactgctggttcagatgaagtctttaaagtattcaccgaagttaaattccccaatttgcatgtcttgaaattcgaatataatgaaatggctcaagaaaccattgaagtatccttcttaccggctatggaaaagggaaatttacctgaattggaaaagctagaaataaatggtaacagattagatgaagattctgatgctttagatttgctccaaagcaaatttgatgatttagaggttgacgattttgaagaggtcgatagtgaagatgaggaaggcgaggacgaggaagacgaggacgaggatgaaaaactcgaagaaattgaaacggaaaggcttgaaaaggaactgctagaagtacaagtagatgatcttgctgaacgtttagctgaaactgaaatcaaatag

SEQ ID NO: 2881 - DNA, 1224 bp, Saccharomyces cerevisiae
atgtacttggaatatcttcaaccgaagttgaacctaatggatgagtctagcactataagcaaaaatttccctgattattcaccaaatttaaacacacccattacttcaaattttaatgaagaaacgggttcggactgctctttagttactccaagaataatttccagttcaaattcgaattcgaactccaattctaattcgaactccaactccaactcaggctctattgacgaaaatgagctaaacaactctaattcatcctcctcgtctgcaagacagataaggaaaaaatggaaagagcctgaggatatagcattcattactacaataatgaataattctcaattactaacattcgtagaatatttcaagcctatgaagaatttttggaaaaaaatttcaaaaatcctattccaacaatatgggtacgagagaaactctcgtcaatgtcatgatagatttaaagtcttatacacaaagtctttgaaagtgcatccatcaaagaaatccaagcaaaagaaaaaaaaatcaaaacaagaggcaggctcaaacttaaattttgatccgtcaaaattatctagaatgcagtatttgctagtgcagttacaaaacacttttagttttgtaaacggaaacattatactcaagtcgcaaaaaacattgaagccgaacaagaatggtactaatgataatattaataaccattattataataattgtaacaataacaataataatattaacaatagtaacaatagcaacaataataatagcaataatattaataggaatagtaatcatagtactaatgtttttagtacaccagagcatattcagtcaagtatcaacctcgataaattagaatctttgccagctttggataccaaaggagaaccatccttcattagcccggctcaattttcccttttgtcatcagcaccggcagacaatctaatcctgcaaactccaccatcgccatttttccagcaaacaatgcctatacagctaccgcgcgatgcacaacaagaacaaatttccccagttttctctacagatgtcatatacatgtggcaaacaatgtttaacactattgaaaatttaaaggaacaagtaaactgcttaaaaaatgaagttaagcaattaaaccataaattttaccaacaaaataaaccgttgcataatatgtcaacttcagactcagaaaattttatgcaacaacattaa

SEQ ID NO: 2882 - DNA, 1225 bp, Saccharomyces cerevisiae
atgaatcaaacaggaaggaccataggcggtcctcaaaatggcgtgaatacagtgattaaccccttcagagtttctccttcagaggacagagtatcaagcagggatgaaacgcccaggaattataagtatgtgtagctccactcccaaaattgcactacagtgtaactaacagtcatgactacttcagaatactaacttaactctttttctcctttcaaaatcgattgagataatccataattattgcagtaacccatttttaaatgaagatgacactaggagggcccataacagtagcgtttccaattctagacaagaaagactcccatcatatgaagaagctgcggggacaccgaaacagcaagctccatacccaaaagaaaagaaacgcagtagtggttcaaatagtcaccaacacaaccaccaccaccatcgtcgtacatcacacggacatagggacaaagataagcagaagagcaaaagcagaaccaaggttaagccccctaaaaatgtagacactattgacaagatggatgttacaggattatttggcggatctttccatcatgacggcccctttgatgcatgcactccacagagaaataagaataataaagtggcgcctgtactggccttcccagcagatggtccaaataatacagtaggcggccgcacaagtaagaagtctaccttagatgaggtgtttggtagggaaacagtagacgacgattctgagacgctgaaccaactacaagatagagcatatttattcaataaggccaattccagtactacgactttggatgcgattaaaccgaattcaaaaaatattacccagttcgattccaaaatgaaaactgaactagtccatgggcccattacgatgggtctaggctcaacgacgttcctggatggcgcaccagcgtcttccgctgccatagagcaagatgttatcaaccacgcacaagaatctcgtaggaaaaacagcatagcaagaaaaaagtctctcccctcaagaagacatctacaagtgaacaacaacaatttaaagctagtgaaaacacatagtggacacttggagcaaaaggacgtagacgataatagaacttctgttccggtcactgccacccaaggaagcggtcacgaagatgttgttaaaaaggaaaacaccggcaacaagctattaaggagggtgaaaagcttgaaaactagtaaaaagcactga

SEQ ID NO: 2883 - DNA, 1227 bp, Saccharomyces cerevisiae
atgagtgacaaatctcatcagatatattgctacttttggctctttggtttgatcaataatgtactttatgtggtaatactttcagcagctgttgatatcgtgggtcctaccttgcctaaatctctagtattgctagcagatatattcccatcactcgccattaaattgtgttccccattctttattgatagaatcaagtacagctatagaatatggtctttgatcacgatgagttgcttaggaatgttcttagtttcttttaaaaacttgtttgtttgtcttttaggaatatctttcgcatctatatcttccggatttggagaagtgacattcctacagctaacacactattacaaacaaatttctttgaatggatggtcgtcaggtactggtggtgcaggaatcattggcggagcatcttatatgttcttaacttcaatctttaaagttccagtgaagctaactttactagtatttagtctccttccatttgcatttttgttttattttaaattagaatccaatgataccaacctgacttaccaaagtcttcaacaaattgacgaagcagaggatgaccagttggtgccctttcctgtcgcctttacacataccaacgcttcgcaatccctgtattctacaagacagcacattttgcaaacggtcaagagacttcgaagattggtttttccatacatggttccattgaccaccgtctacttattcgaatatttaataaaccaagcggtagctccgaccctattatttccgattaatggtgatgaaagaagtaaatcgatgccatttttcttccataaatacagagatatatacgtaacctatggaacgctctaccaattaggtgtctttatatcaagatcctttggacatcttatgagaatgaggagtttatacatcttagcgtttttacaaggtgtgaatttgtgcataacggtactgcaatcatggttttatgtcacacattcgccctgggcggtgatgatattaatattctatgagggttttcttggtggtgcgtcatatgttaacacattcttaaatattctcgaacaagaggatcctgatgaaacagagttcgccatgggtgctgtgtccatcgctgattcctttggcgtttttttggctgcgttacttggtttggggctagaacccaaactttgtaggcatcaaattgccgatgacagaccttggtgtaggatggaataa

SEQ ID NO: 2884 - DNA, 1227 bp, Saccharomyces cerevisiae
atgagtttagaggatacattagccaacatgtcattatatgacgccaagaaatattttcgtaaagctcaaaatgttgttttcaattatactgagatggaggggaaagttcgtgaagcgacaaacaacgagccttggggtgcctcatccactttaatggaccagatttctcaaggaacttacaatttcagggaaagagaagaaattttgtccatgatattcagaaggttcactgaaaaggcaggtagtgagtggaggcaaatttataaagccttgcaattgctcgattaccttatcaaacacggttctgaaaggtttatcgatgatacaaggaatagcattaacttaattaggattttagaaacttttcactatattgattcccagggaagagatcaaggaattaatgtcagaactagggtcaaagctttgattgaattattgagcgacgataataagatacgcgcagaaagaaaaaaggcaagagaaacggcaaagaagtacaagggcgttgctggaggatctgcctctgctgatggcagtttgaattcgaaggcaggtttcacgtcaacgaaagtgcacggcattagcgtgagtgctgatttcgatagtgacaatgaagataacgaagatggttcttttagtcaaaatggatataacgataatgcctcgagagccacatctactcctgggcaaggaaaacaagaaccagaggactttgttgactttttttctagtgagtcttcaaaaccatctaaagaactcatacaagaagatgaaaagaaggcggacgaagaagaggacgatgatgacgagttttcagaatttcaaagcgccgtccctgttaccaaccctgctaattcgtttaacttgctaaacacgagcccaattgagggtatgcccgccaccacgagttcaatgcctttttataacagctccactaccgaccaaggcaagattaccccagctattgcggaacctaaaaaagtagatccttttagctctctcttttcaactgcaaaggcatctgcagaagcacctagtgctcctaaagcatcccaagcgaaagccgctgcctctaatcctgtatctaatagcacaactgcactaagtacagatcaagatgatgatgacgaatttggtgaaatgcatggtggagctgttcaacaagaacagaataccaataataaccatacatcatccaaagaaatcgatttactttccttttga

SEQ ID NO: 2885 - DNA, 1227 bp, Saccharomyces cerevisiae
atgtccaaaatagaagagctaccaccatcagatactgatgaccattcgtattctagtaaaccgggagatgtatttttagcatttgtggacgcacctgttaaagagactgatgacatattagttgaagatagctttattggcggtgaacctaagtggctacatccggattccgaaccacctgctgaactattgaaatgtggtgcttgtaaatcagcggataatatgaagctgttactacaagctttttcgcccttagatgatgagcagatgagtgccatacaacaacgtcttggtatcaataatatgagctatattaatccccaggatgacagagtattatatgtcttcctgtgtaccgaatgtcaaaggaagggcaattctgttcgctgtatcagaggagtaaagaagaataaaaacgttgatagcctttccgaaaaaatggcttcaacttcattggaaaaagacttccaaatcaatccctttgacttgtcgaataattcagattctaaatgtaatgctttttcaagcaacccatttggcggtgcaaatgctaacccttttggagctgatagcattaattccaatatatcacaaagcaaggacgaaggcaaaaagaaggaatctgctaccgtttctgcaaagacggcgagaaaactacatgatttacaaaaggacaaagaatacgatggcaataaatgctttaaaagttgtttgttgtacgttgaagaggaaaccttcaaaaataaaaagccagctcatctgcagctgccaaaaaatttaaaaattgataaggaggcactagatttaacaggagatgaggatctcgaaaaagatccgatcaaattggacccgaggacagaaaaattatccaagtttcttgatgacgacacattccaaaaattccaagaagtggttggttacaacccgcttcaagtattacgttatgacttaggcggaaaacctttgctatatgccgaaacaaaagtcgatattttaagcactgtgccaagaccgggctacaacccatcgagccaaagaatctttgaaatgcagttaatgccaaagatgatttttgatctggaagaagtagtgtctgtcgataacggcatggaatggggtaccattcttgttttcactgatgttgaaaattacatgcctgaatttgatgaacatggtgtcggttatgtagaagaatgtgtcaaagttcagtgggaatcgagaacgtga

SEQ ID NO: 2886 - DNA, 1227 bp, Saccharomyces cerevisiae
atgtcctttgatagacagttgaccgaagaccaggaggtcgtccttaagcaaatttggacacaccttttccatctgtggcaagttcccgtggatggaactcatattttccctaataactccctccactcctcgtccacccctgctaagaagaagaaatcatcctggtttagcaagcttcagtcctcagaccatacacaggactccagcgaagccgctgaagcggcacacctctatgaaaagggcaagatacacaaggcactagccaatctagacccgcaaacgaccaagaagcagttctggcacgatatcaagaatgaaactccagacgccaccattttgaagtttatcagagccagaaagtggaacgcagacaagaccatcgccatgttgggtcacgatttgtactggcgcaaggacactattaacaagatcataaacggtggcgaaagagctgtgtatgagaataacgagaccggtgtcattaagaacctggaattgcaaaaggccaccatccagggttacgacaatgacatgaggccagtcatccttgtgagacctagattacatcattcttccgaccaaactgaacaggagctggaaaaattctccctgttggtcatcgagcaatcaaagcttttcttcaaagaaaactaccccgcatccaccaccatcttgttcgatctgaacgggttctccatgtccaatatggactatgcccccgtcaagtttctaatcacttgttttgaggctcactacccggaatctttgggccatctacttatccataaggccccttggatctttaacccgatttggaacatcatcaagaattggctggatccggtcgtcgcgtccaagattgttttcactaagaatatcgacgaattgcacaagtttatccaaccccaatacatccctaggtatctgggcggagaaaatgacaatgatttggatcattacactccaccagatggctctttggacgtccatctgaaagacaccgagactcgcgctatgatcgaaaaggagagagaagaattggtcgaacaattcttgactgtcactgcccaatggattgaacaccagccattgaacgatccagcatacattcaactgcaggagaaaagagtacaactttccaccgctctttgtgaaaactactccaagttagatccgtacatcagatcaagatccgtttatgactacaatggttctctaaaagtttga

SEQ ID NO: 2887 - DNA, 1230 bp, Saccharomyces cerevisiae
atgaccaattcagtaaagactaatgggccaagctcctcagacatggagtactactataagtcgctctatccattcaaacacattttcaactggctgaatcattcgcccaaaccttctagggatatgattaacagagaattcgctatggcgttcaggtcaggtgcttacaaaaggtataattcttttaactctgtgcaagatttcaaagcacaaatagaaaaagccaacccagacagatttgaaatcggtgccatatataacaaaccgccaagagaacgtgatactctattaaaaagcgaattgaaagctttagagaaggagttggtgtttgatattgatatggatgattacgatgccttcagaacgtgttgctccggagcccaagtttgctctaagtgctggaaatttatatctttggcaatgaaaattacgaacacggccctaagagaggattttggttataaggacttcatctgggtattttcaggtagacgtggtgctcattgttgggtaagcgacaaacgggcacgggctttgacggatgtacaacgaagaaacgttttagattatgtcaacgtgattagagacagaaatactgacaagcgattggctttgaagaggccttatcaccctcatcttgctcgttctttggagcaattgaaacctttctttgtcagcattatgctcgaagagcaaaatccttgggaagatgaccaacatgctatccaaactttattgcctgcattatatgataaacaattgattgattcattaaagaagtattggctggacaatccaaggaggtcaagcaaagagaagtggaatgatatagatcagatagctacatcgctcttcaaaggccccaagcaagactctcacataattaagttacgtgaatgtaaggaagatctcgtattgatgactctttatccgaagctggatgtggaagttacaaagcaaacaattcatttgttaaaggcccctttttgtattcatcctgctacggggaatgtctgtgtgcctattgatgaatcctttgcacctgaaaaagcacctaagctaattgatcttcaaacagaaatggagaaaaataatgatgtttcattaacagctttacaaccttttatcaatcagttccaagcatatgtgagttctcttttgaaaaatgaactgggttcagtgaaaagagaacgtgaagatgatgatgaaccggcttctttagatttctga

SEQ ID NO: 2888 - DNA, 1230 bp, Saccharomyces cerevisiae
atgcctttctcttctgagcaattcacaaccaaattaaatacgttggaagattcccaagaatctatttccagtgcctcaaagtggttgcttctacagtatagagatgctcccaaagtggcagaaatgtggaaagaatacatgttaaggcctagtgtaaacacaagaaggaagttattgggtctttacttaatgaatcatgttgttcaacaggctaaaggtcaaaaaattattcaatttcaagattcctttggaaaggtggcagcagaagtattgggaagaattaatcaagagtttccgagggacctaaaaaagaagttgtcaagagttgtgaatatactaaaagaaagaaatatattttccaagcaggtagtcaatgacatagaaagaagtcttaaaaccgagagctcaccagtggaagcgttggtgttaccccagaaattgaaagattttgctaaggactatgaaaaattagtgaaaatgcaccataatgtttgcgcgatgaaaatgagatttgacaaatcatcagatgaattggatccatccagctcagtttacgaggaaaattttaaaacaataagtaagattgggaacatggctaaagatataataaatgaatcaattctaaaaagagaaagcggtatccataaactgcaaagcacactggacgatgaaaaaaggcatctagatgaggaacagaatatgttaagtgaaatagaattcgttttatctgctaaagacccatccagattaaataaaaacgttgatgaagacaatattattcctacgtatgaagtgggggatggagatgacgatgacgatgatggtgataatgatgatgatgatgatgatgatgatgatgacaaaaattacgatgatagatccaatgacagcaattatggcgttactaatattagcaccacagataagaagaatgaagttgtagaaaagacagatagcgaacataaaaactctactcataatcctagtgacaatcaatttggtatgaaacgaacacatgatatgataggtcatgatgacgctaatgacataccggaaaaaaaggttcatcttgattcgaagacgagtgaagatggtactttcaacagtgaggatggacattatgagttagatatagaaggccacgtcggcgcccaaaccgacgaaggtgttgagaattccggaggggtttcttctagtatacaagacttgttaagtaagcttgcaaattaa

SEQ ID NO: 2889 - DNA, 1230 bp, Saccharomyces cerevisiae
atgggcaatatccttcggaaaggtcagcaaatatatttagcaggtgacatgaagaagcaaatgttgctaaataaagatggaacacctaagaggaaggtgggcagaccaggcagaaaaaggattgactctgaagctaagagtaggaggactgcccagaatagggcagctcaacgagcgttccgagataggaaagaagccaaaatgaagagtttgcaagagagggtagagttactagaacagaaagatgcgcagaataagactaccacggactttttactatgttctttaaaaagtttactgtcggaaattacaaaatatagagctaagaattctgatgatgaaagaatattagccttcctcgatgatctgcaagaacaacagaaaagggaaaacgaaaaaggaacaagtacagcagttagcaaggctgcaaaggaattgccatcgcctaattcagatgaaaacatgactgtgaacacaagtatagaagtacagccgcacactcaagagaatgagaaagttatgtggaacataggctcatggaacgctcccagtttaaccaattcgtgggattctccccccggaaatcgaacaggtgccgttaccatcggtgacgaaagtattaatggtagtgaaatgccagatttcagtctcgatcttgtctccaatgatagacagactggtctagaagctttagattacgacattcataactactttcctcagcactctgaacgcctgaccgctgaaaaaatagatacgtcagcatgtcaatgtgaaattgaccaaaagtatcttccatacgagacagaagatgatactttattccccagcgtgcttccccttgctgtagggagccagtgtaataatatttgcaaccgcaagtgtatcgggaccaaaccatgttcaaataaggagatcaaatgcgacttaataacaagccacctgttgaatcagaaatctctagcttcggtgcttccggtggctgcttctcatactaaaacaattcgaacccaatctgaagcaattgaacacattagcagcgccatatcgaatggaaaagcgtcttgctaccacattctcgaagagatctcctccctaccaaaatattcatcgttggacatagatgatttatgcagcgaattaataatcaaggcaaaatgtacagatgactgcaaaatagtagtcaaagctcgcgacttacagagtgctctggttagacagctcctgtag

SEQ ID NO: 2890 - DNA, 1230 bp, Saccharomyces cerevisiae
atggtagatggactgaatacctcgaacattaggaaaagagccaggactctctctaaccccaatgactttcaagagcctaattacttgctggatcccggtaatcatccctcagatcattttcgaactcgaatgtccaaatttcggtttaatattagagagaagctgttagtgtttaccaacaatcaatcattcacattaagccgctggcaaaagaagtaccgttctgcgtttaatgatctctactttacttatacttccttaatgggatcgcataccttctatgttctgtgtttacctatgcccgtgtggtttggatattttgaaacaacaaaagatatggtttatatcttgggatattctatctacttgagtggtttttttaaagattactggtgcttgcccaggcctagagcacctccattacatcgaattacgttaagtgaatatacaacgaaggaatatggtgctccaagctcccatacagcaaatgcaacaggagtgagtctcttgtttctctacaacatctggaggatgcaagaatcttctgtcatggtccaactattgttgtcatgtgtggttttattttattatatgactttggttttcggtagaatatactgtgggatgcatggcatattagatttagtaagcggtgggctcattggaatagtgtgtttcattgttaggatgtatttcaagtacaggtttccgggtttacgcattgaggagcattggtggtttcctttgtttagtgtgggatggggtcttcttcttttgtttaaacatgttaagcccgtagacgaatgtccttgcttccaagatagtgttgcgttcatgggcgttgtgtcaggtattgaatgctgtgattggttgggcaaagtgtttggagtcaccctggtgtacaatttggaacctaactgtggctggcggttaaccttagccaggctgctggtgggcctaccgtgcgttgttatctggaagtacgtgatcagcaaaccgatgatctacacgttattgatcaaagttttccatctgaaggatgacagaaacgttgcggcaagaaaaagactggaggccacgcacaaagaaggtgcaagcaagtacgaatgtccattatatattggagagcccaagattgacattctaggtagatttattatctatgctggcgttccattcaccgttgtaatgtgcagccccgtcctattttccctcttaaatatagcataa

SEQ ID NO: 2891 - DNA, 1230 bp, Saccharomyces cerevisiae
atggttaaagaaactaagttttacgatattctaggtgttccagtaactgccactgatgtcgaaattaagaaagcttatagaaaatgcgccttaaaataccatccagataagaatccaagtgaggaagctgcagaaaagttcaaagaagcttcagcagcctatgaaattttatcagatcctgaaaagagagatatatatgaccaatttggtgaagatggtctaagtggtgctggtggcgctggcggattcccaggtggtggattcggttttggtgacgatatcttttcccaattctttggtgctggtggcgcacaaagaccaagaggtccccaaagaggtaaagatatcaagcatgaaatttctgcctcacttgaagaattatataagggtaggacagctaagttagcccttaacaaacagatcctatgtaaagaatgtgaaggtcgtggtggtaagaaaggcgccgtcaagaagtgtaccagctgtaatggtcaaggtattaaatttgtaacaagacaaatgggtccaatgatccaaagattccaaacagagtgtgatgtctgtcacggtactggtgatatcattgatcctaaggatcgttgtaaatcttgtaacggtaagaaagttgaaaacgaaaggaagatcctagaagtccatgtcgaaccaggtatgaaagatggtcaaagaatcgttttcaaaggtgaagctgaccaagccccagatgtcattccaggtgatgttgtcttcatagtttctgagagaccacacaagagcttcaagagagatggtgatgatttagtatatgaggctgaaattgatctattgactgctatcgctggtggtgaatttgcattggaacatgtttctggtgattggttaaaggtcggtattgttccaggtgaagttattgccccaggtatgcgtaaggtcatcgaaggtaaaggtatgccaattccaaaatacggtggctatggtaatttaatcatcaaatttactatcaagttcccagaaaaccatttcacatcagaagaaaacttgaagaagttagaagaaattttgcctccaagaattgtcccagccattccaaagaaagctactgtggacgaatgtgtactcgcagactttgacccagccaaatacaacagaacacgggcctccaggggtggtgcaaactatgattccgatgaagaagaacaaggtggcgaaggtgttcaatgtgcatctcaatga

SEQ ID NO: 2892 - DNA, 1230 bp, Saccharomyces cerevisiae
atgtccgaagaagtatggaatggaaaccaaggaatcctctccgtatatgtgagcaaagctagagacttgcctaatttgaataaactggacaagcaaaatgtaatgcttaggttgcgaatagctcatatgacaagagccagcaacactctacatcgagcaggtcaaaaccctgttttccattatttagaaaaatttgatattactccagagataaagcctttaatgtacgtcgaagtttactgcgatagaaggaaaaaatctccgctgccaattggaagatgtgaaatagaccttttaaatgctattagagcagacccgaaggagggttattgtacctggtacgaactgaaaagaagtggggatgaatttgctggcactatattcattgagttgactttcactcccaaagtacctcgtttaaacagggacgatcttaacaaagaaatggacaggttggattcatctatggctatgaggccgataccaccattgccaacagaatcagagtatgactatgttcatggttctacgatgagacagattactccccagtgtgttagcacaagtcacgaggataaggatgagggacagccctacagaaatggcaatgttttctccatgtcatctaaatcagatacagcggtattggcaaatagtaatgacccaataattttacctccaactttttcagcatccatgggtacaacgtctacattagaaactaatgatactgctatatcaaacacttcgaatacaaaattccattttgccaatttaaggaaattaaaggagaagataaatatatttaagaatcctgatagttcaacaaacaactgccaaaatgaatctaacaaggtagatattgaggcacttcaaaaggctattggtgtaacttcgttgtcttacgacgaagatgatgacgatgacgacgaaaatgacgcattttattcttccagccatagagtctcccacaactataaccaaccgcccttacctcctataccgaccagagatgatatgtccaattattcaagttcgcgcaatacgccgttagtaagaagagatagaccctcacgcctagattcctcttcgcctaactcacatcctcatccatcaggcctgaattctccaaaactaccacctctaccgactacttcgaattccaattttaattcgaggaagaattcgatgtctcctacaagaaaaagaccacctccaaggctcagctaa

SEQ ID NO: 2893 - DNA, 1230 bp, Saccharomyces cerevisiae
atgtctatgatgctaagtaattgggcactctcccctcgatatgtgggacagcgaaacctcatacattgcaccactttatttcacacacttacacgatgggcaaaagacgcagacgataaatatcatgatataaactcaatgtatgaaaacatgtttacaccttcaaatgataacgtttcaattttgcaggatgaaggtaaatctgattatgatacgacgaaggccagctctatggaagaagatatcagtgcttttaataaagacttgtacaatttctataatattggatatgccaaacagatcatgtctgcttcacaattggaaaatatagtaaaggcaaagggcagatttgttatacaaagtttatccaccagtccttattataatttggcccttgaaaactatgttttcaagaatacaccaagagccaaaagaggtcccgataattgcagactgttattttacatcaatgataggtgcgccgttataggcaaaaaccaaaatctgtggcaggaagtagatcttgctaagctgaagagtaagaatttcgaactacttagaagattttctggaggtggcactgtactgcatgatttgggcaatgttaattattcatatttaacatcaagggagaaattcgaaacaaagtttttcaacaaaatgataattaagtggttaaattcattgaatcccgaactaagactagatttgaatgagagaggagatattattcaggacgggtttaaaattagtggcagtgcttataaaattgccggtggcaaagcataccatcatgcaacgatgttgcttaatgcggatttagaacagtttagcggcttattagaaccctcactaccgaacaatatggaatgggagtcaagtggagttcatagtgtaaaatcaaaaatcaaaaatgttggtataattactcctaatcagttcattgcagtggtatccgagcgttttcagaaaacattcaaagttgacggcgaaatacctatatattactgtgacgagtttaaatctataaacgatgagattaaagatgctatgaacaccttacagagcgaacaatggaaatatttctcggggcctaaattttcagtgaagattaaagataaaggcttaacaattaaagtcgaaaagggcatgatttatgattgtgatagaaatgatttaatcggcttggaattcaaaggatttttggagaatattgacagttacacataa

SEQ ID NO: 2894 - DNA, 1230 bp, Saccharomyces cerevisiae
atgtttaacatgaatctactttctacaccttcttctgaagagggttctccacagaataggtcatcttcaatgtcttctgttgagggcaagaaggatagggacacctttactaatttgcaaaacgaatttgatggtaaagtatttggcgtctcactcgaggaatcactgaaagttgctcaagaggaagtaattatccaaaaaagtacaaatgaaattggttccataccggtggtaatagcaaaaagtgggaaatacctaaaagagaatgcattagacacaacaggaattttccgtattgcgggaagcaataaacgtgttagagagctacaagctgttttctctaaaccgcccgattatggtcgtaaatttgaaggatggtgtgatttcaatgttcatgacattgcaactttattaaaaagatatttgaactcattaagtgagcctttggttcccctagcattatacgacatttttagaaatccaatattagaaaacccaaaaataaatgagcacaaagaacaaatcattaaggactacgaagatatttatatgctcttaccacaacaaaatcgccatttaatactttatttagccgcgctcttgaatttatttgcaagaaatgaaaagaagaatttaatgtcagcaagcaatttagcggccatcgtacaaccctcacttttgtctcatcccaaggatgaaatgtgcccgaaagagtatgaggcttccagaactgtcatcgaattcctcatactacacgcttcagatataataccgaatacggaaaaagcgaataaggacaccatgccgcatgcaggaacagtagcaaagtttaacaacattaccgttcctgaaatggctattgactccgatgaagaagattttgtgcacccttcaatagatgaccatatgcttccaaggtcacgtgcactttctgactccaacaattttaccatacatcatcatcatcatcatcatcatgcactgtttcctagcccaatagattttgataacaatgggctttctgtaccgagatcctttaaaggtagaacattgagtgcagagtccctttctcccagacttagtaaattacttgggaacgttggaaacagcagcaatactggcatcaaagaccctacagaaagagttcctagaggtgaacataaaaccaaacacaaacaacgacagtcatggttgagaagactcactagcccttctagaacgcagccttag

SEQ ID NO: 2895 - DNA, 1233 bp, Saccharomyces cerevisiae
atgagtacagccgatcaagaacaacccaaagtggtggaagcgacaccagaagatgggacagcttcctcccaaaagtcaactataaacgctgagaatgaaaatacaaaacaaaatcaaagtatggaaccccaagaaacttcaaaaggtacctccaatgatactaaagacccagataacggagaaaagaacgaggaagccgcaatagacgaaaatagtaacgtagaagctgcagaaaggaaacgtaagcacattagcacagatttctcagatgacgacctagaaaaggaggagcataatgatcagagtcttcaaccaacggtggaaaatagggctagtaaagatagagattcaagtgctactccaagtagtagacaggaattggaagaaaaactggaccgtatattgaaaaaaccaaaggttagaagaacgaggagggatgaagacgatttagaacagtacttggatgaaaaaattctaaggcttaaagacgaaatgaatattgcagcacagttggacatcgatactttaaataagagaatagaaactggagatacttcgctgattgccatgcagaaggtcaaattgttgccgaaggtggtaagcgtactgtcaaaggcaaacttggcagacaccattttggataataacttacttcaaagtgtcagaatatggttggaacccttacctgatgggtctctgccatcttttgagattcaaaagtcactctttgcagctttaaacgatctaccagtgaaaactgaacacctgaaggagagtggtttggggagagtagttatcttttatacaaagtccaagcgtgtcgaagctcaactagctaggttggctgaaaaattaattgcggagtggacaagacctattattggtgcttcagataactacagagataagagaataatgcaattagagtttgattctgaaaaattgagaaagaaatccgttatggattctgccaaaaataggaaaaagaaatctaagtctggtgaagatcctacctctcgtggttcttcggtacaaaccttgtacgaacaagctgctgcaaggagaaacagggctgccgcaccagcacaaaccactactgattacaagtatgctcctgtgagtaaccttagcgcagtacctacaaacgcaagagcagttggtgttggttccactttaaacaatagtgagatgtacaagaggttgacttcaagattaaacaagaagcataaataa

SEQ ID NO: 2896 - DNA, 1233 bp, Saccharomyces cerevisiae
atgctaagtgcaatttccaaagtctccactttaaaatcatgtacaagatatttaaccaaatgcaactatcatgcatcagctaaattacttgctgtaaagacattttcaatgcctgcaatgtctcctactatggagaaaggggggattgtgtcttggaaatataaagttggcgaaccattcagcgcgggcgatgtgatattagaagtggaaacagataaatctcaaattgatgtggaagcactggacgatggtaaactagctaagatcctgaaagatgaaggctctaaagatgttgatgttggtgaacctattgcttatattgctgatgttgatgatgatttagctactataaagttaccccaagaggccaacaccgcaaatgcgaaatctattgaaattaagaagccatccgcagatagtactgaagcaacacaacaacatttaaaaaaagccacagttacaccaataaaaaccgttgacggcagccaagccaatcttgaacagacgctattaccatccgtgtcattactactggctgagaacaatatatccaaacaaaaggctttgaaggaaattgcgccatctggttccaacggtagactattaaagggtgatgtgctagcatacctagggaaaataccacaagattcggttaacaaggtaacagaatttatcaagaagaacgaacgtctcgatttatcgaacattaaacctatacagctcaaaccaaaaatagccgagcaagctcaaacaaaagctgccgacaagccaaagattactcctgtagaatttgaagagcaattagtgttccatgctcccgcctctattccgtttgacaaactgagtgaatcattgaactctttcatgaaagaagcttaccagttctcacacggaacaccactaatggacacaaattcgaaatactttgaccctattttcgaggaccttgtcaccttgagcccaagagagccaagatttaaattttcctatgacttgatgcaaattcccaaagctaataacatgcaagacacgtacggtcaagaagacatatttgacctcttaacaggttcagacgcgactgcctcatcagtaagacccgttgaaaagaacttacctgaaaaaaacgaatatatactagcgttgaatgttagcgtcaacaacaagaagtttaatgacgcggaggccaaggcaaaaagattccttgattacgtaagggagttagaatcattttga

SEQ ID NO: 2897 - DNA, 1233 bp, Saccharomyces cerevisiae
atggcatctaacgaagttttagttttgagaggtaccttggaaggtcacaacggttgggtcacatctttggctacttctgctggtcaaccaaacctattgttgtccgcttcccgtgataagactttgatctcctggaagttgactggtgacgaccaaaagtttggtgtcccagttagatctttcaagggtcacagtcacattgtccaagactgtactttgactgctgacggtgcttacgctttgtctgcttcttgggacaagaccttgagattatgggatgttgccaccggtgaaacctaccaaagattcgtcggtcacaagtccgatgttatgtccgttgacattgacaagaaggcttccatgattatctctggttcccgtgacaagaccatcaaggtctggaccatcaaaggtcaatgtttggccactttgttgggtcacaatgactgggtttcccaagtcagagttgttccaaacgaaaaagctgatgatgactctgtcaccatcatttctgccggtaacgacaaaatggttaaggtatgtgatatattttctttccatgatagaatatgatgacaatcgagtagaagaagaaaagtggatttgtgtatgccattcaaatgatgtaataacatatttgctacttcagatggaactttgagttccgaatgagacataccaattatcaccaagatctctgatgaatggtttagcattactctgctcttctctttactcgttatgtcaaaatggaaactttttttttaaattaattttgttcccttactaacaaaaatgatataatgacaggcttggaacttaaaccaattccaaattgaagctgacttcatcggtcacaactccaacatcaacactttgactgcttccccagacggaactttgattgcttccgctggtaaggacggtgaaattatgttgtggaacttggctgctaagaaggctatgtacactttgtctgcccaagatgaagttttctctttggctttctctccaaacagatactggttggctgctgccactgctaccggtattaaggtcttttctttggacccacaatacttggtcgatgacttgagaccagaatttgctggttacagcaaggccgctgaaccacatgctgtttctttggcttggtctgctgacggtcaaactttgtttgccggttacaccgacaacgtcattagagtttggcaagttatgactgctaactaa

SEQ ID NO: 2898 - DNA, 1233 bp, Saccharomyces cerevisiae
atgtctaccacactactttggttttcaagtgtaataggctacgtgattcaaacaaaatgtttgtctaacatacaatctaaaaaggaaatctccgtggggcccaatggtacaattgcaacgcctgaaactaacggcgacaacggaaactcaagttcattaaccttctatctgacctttatgtattttgcttcgtggctgctcttggtgcctgcatctcgactttgggagaagatgagaccgatgtttgtctctgactcagactcgaacaggaattctcagtttgacaacaacaacagcgggtctgtgacaaacgaagatgtcgatacgttctcgcacgtgttggatgatcctcaaccacggattccagcccaacagcagaagcaaaaaatcatatccgtggctaccttcaaatatgtggctaagctaacagtgctggctctcataatgattgtcgctgatttgacttataacatggctttgtcattgtcaccggcatttgatgttgctttgatgcaaaatactgccattttcgaaattgtcactttactatatggtgtttgtggaatctccaggaagaactacgttttccgtaatttcctcatcatgatgaacgcggtcattggaattttgatcatctcatacacgaaggctacctgtgacatgcttgccggaaagctgtccgtcaaccctaacacgggtgaactttctgacccattcttgtttgataggttgaaaggtgctctgatttgcggccttggtgctttgattatgggtccttttgccgtgttatggaaccgttggttttgcagtaacatttccaagaacgaaaattctgctgtagtcttggttaagcagagcacccacatggccctaatcggtattattggcatggtaatacttttgccatttattcctaaatttccctcccgtgagtctgtggaatccatttcgttgttctataatgacaagagcttttggttctctctactaggctcgattatctttggttccttgccgagcttgatttcgatattagagttgaatcgcaaggcccctgctgagtatttgacgacgtgcaacctgggagctattatctttatggggttagctgagtgggtttgcgaacctacgcaaaccacaattgtgagatgggaagtcataggatacataatgctaacggtaagtttgttggtcctatcagtaacactcggggaaggtaaataccaccattag

SEQ ID NO: 2899 - DNA, 1233 bp, Saccharomyces cerevisiae
atgttttccatattcaattcaccatgtgtttttgaacagctgccatcttttagtcagcccctacattcgcgttattttgattgcagttctccagtgagctattatccagaatgtaaaaggaggaaagcaataaaagctaacctaagagctccaaaaaaaagcgatgcaaattgttcagaacctttgaggtatgcacttgctgaaacaccaaatggttatacattaagcttgtctaagcggattccatatgaacttttttcaaagtacgttaatgagaaattaggtgagctaaaggagaaccattacagaccaacttaccatgttgtccaagatttttttggaaaccagtattatgttgaagatgaagcggatgaagatgctctattgagatctgcattgaaagatctggattttagagccataggaaagaaaattgctaaggatcttttccaagactacgaaatagaattgaatcatagaggtgatgaattgagcatattgagtaagaaggataaaatctttaaggaattctctctagaccaagtgtttgaagatgtttttgttattggctgtggagttgaaaacatagatgatggctcgagagaaaaatatgcacttttaaagattggtttagttaagcatgaggaagaaatttccgaaggtggcatcaacgaaccaaagatgccaataattgaatccaaaatagacgagtctcacgatgatgttaacatgtctgaatctttgaaggaggaagaagcggagaaagcgaaagaaccactaaccaaagaagaccaaataaaaaaatggatagaggaagaaagattgatgcaggaggaaagcagaaaatcagaacaggaaaaagctgccaaggaagatgaagaaaggcaaaagaaagagaaggaagccagattgaaggcaaggaaagaatctttgataaataagcaaaaaaccaagaggtcccagcaaaaaaaattgcaaaattccaaatcattgcctatctctgagattgaggccagcaataaaaataataatagcaattctggttcagcagaaagtgataatgaaagtataaacagtgattctgatacgactttggatttctctgtgtctggtaatacactaaaaaaacacgcttcacccctattagaagacgttgaggatgaggaagttgacagatacaacgagtccctaagcagatctcccaagggaaactctattattgaggagatataa

SEQ ID NO: 2900 - DNA, 1236 bp, Saccharomyces cerevisiae
atgacatcagctacggacaaatctatcgataggttagttgttaatgcaaaaacaagaagacgaaactcttccgtgggtaaaattgatttaggtgatacagttcctggctttgcagccatgcctgaaagtgctgcctctaaaaatgaggccaaaaaaaggatgaaagccttgactggtgactctaaaaaggatagtgacctactgtggaaggtttggttttcatatagagaaatgaattaccgtcatagttggttgacaccattcttcatacttgtatgcgtgtatagcgcgtactttttatctgggaatagaacagaatcaaacccgctgcacatgttcgtagccatatcatatcaagttgatggcacagactcatatgcaaaaggtatcaaagatttgagttttgtgtttttctacatgattttcttcacatttttacgtgagtttttgatggatgttgtaattcgaccattcacggtatacctaaatgttacttccgagcatcgtcaaaagcgtatgctagaacaaatgtatgccatattttattgcggagtttcagggccctttggtctttatattatgtaccatagtgatttgtggttgttcaagacaaaaccaatgtacagaacatatcctgttataaccaatccgttcttgtttaagatattttacttgggtcaagcggcattttgggcgcaacaggcttgtgttcttgttctacaattagaaaagccaagaaaggattacaaggaattggtttttcatcacattgtgacattattattaatttggtcatcatatgttttccattttaccaaaatgggattggctatctatattactatggatgtgtcagattttttcctttctttgtctaagacattaaactatctgaattctgtatttactccctttgtgttcggcttgttcgtgttcttttggatctatctgcgccatgtcgtgaatatcagaatattatggtcagtcttaacagaattccgtcatgaaggtaattatgtgttgaattttgccacacaacaatacaaatgttggatttcgttgccaattgtatttgtactaattgctgcgttacaattagttaacctgtattggctgtttttaattcttagaatcttgtacagattgatatggcaaggtatccaaaaggacgaaagaagtgacagtgattctgatgagagcgctgaaaatgaagaatctaaggaaaagtgtgaataa

SEQ ID NO: 2901 - DNA, 1236 bp, Saccharomyces cerevisiae
atgcccagggatccattgattggtattgtgggtaagccatcttcagggaaatccaccacattaaattctttgacggacgcaggtgcggcggtaggagcatttccctttaccacgatcgagccaaatcaggcaaccggctacttgcaagttgagtgtgcttgctccagatttggcaaggaagatctttgtaaacctaactacgggtggtgtagcaagggtaagaggcatatccccatcaaactgttggatgtggcagggcttgtgcctggagcgcattccggcagagggcttggaaataaattcttggatgatttaagacacgcagatgctcttattcatgtggtggacgttagtggaaccacagatgcagaggggaagaacacaagaggatatgatccattgaacgatatagaatggctgcaagacgaaatcaggctttgggttgaggggaacctgaagaaaagatgggggtctattgtgcgtaaacatacagcaacgaaatctagcatagtggacacacttcaagcgcaattcggtgggtacggttcacatgcgcccatgatccaaaaagccctggacaggttgaagggactaccacctttggaaaaatgggatgacgaatggatcactcgagtggtcaagtcctttatgatggagaaatttccaactgtgttggcactcaacaagattgaccaccctgacgccgataaaaatgtttctaaaatcatgctaaagtatcctgacaccaaagctgtactgaccagtgcagtgacggaagtttttttgaggaaattgaaaaagcaaggttttatattatacgaggagggcacggaatttgttgacacatttgaggacgagccagacaaactaaagccactggacgacaagatccttaacagaattgaaaatatcagagatttggtcctgtatagattcggatctacgggtgttgttcaggttctgcaagcagcaacggacatccttggtctaataccggtgtacactgtgaagaacatccagacttttacgggtggcaacggaaccaacgtatttagagattgttttttggtcaagcgaggaacccctgttggcaaagttgccaggtatatcatgggtggcgaggtcaccattgcaagcattgaaaccgttggcggcgtgagagtcagtgaagaaagtcttgttgagcccggtaagaatgacatactcggcttcaagatcgctccaagatcagcataa

SEQ ID NO: 2902 - DNA, 1236 bp, Saccharomyces cerevisiae
atgcgtatagcgatgcatctgccgctgttgcttttatacatattcttactacccctttcaggtgcaaataacacagatgctgcacacgaagttatagcaacgaacacaaataattgggccgtattagtatccacgtcgcggttctggttcaattacaggcacatggctaatgtccttagtatgtataggactgtaaagaggttaggtataccggattcacaaataatattgatgctgagtgatgatgtggcctgcaattcaaggaatctatttcctggaagtgtttttaacaataaggatcacgctattgacctttacggagactctgtagaggttgactacagaggttacgaagttaccgtggaaaactttataaggctgttaacggatagatggacagaagaccatcctaaatctaaacggttgttgacggatgaaaattcaaatatattcatctatatgacaggacatggtggcgatgattttttaaagttccaagatgctgaagagattgcttctgaagatattgcagatgcattccagcaaatgtacgaaaagaaaagatacaatgaaatcttctttatgatagatacatgtcaggcaaacacaatgtattccaagttttattctccaaatattctggctgtaggctctagtgaaatggatgaaagctcgtactcgcatcactcggacgtagaaataggggttgctgttattgatagattcacctattactgtttggatttcctagaacaaatcgataaaaattccacgttaactttgcaggacctcttcgattcattcaccttcgaaaagattcactctcatgtgggtgtcaggactgatctgtttgataggaatccgtcagaagtattgattactgatttttttgcgaatgtgcaaaacgtaattcctgatgattcaaaacctctttccgtaagtcattatcatcattacaaagatcatatcgatactgctcagtatgagcttaacaataatgtgctggatttggccttggagacttaccgcaaaaacaatcaatcctccaagattgaaaaaaaaatcaaagacatcaagtctactagtgtattggatgttgatatagattccaacgaatgtttcttcacctccttcaaacaatcagctaccataatactggcgcttatagtaactattctgtggttcatgctgagaggaaacactgctaaagcaacctatgacctgtacactaattaa

SEQ ID NO: 2903 - DNA, 1236 bp, Saccharomyces cerevisiae
atggaagaaaaggaaggtatcaaggattcttctctccttgagaagagtaatgttccggaatcaattaatgaggatatttcaaagacgacggatgtggatctaaattccgatgggaaaaaggataatgacacttctgccaaggatggtacacctaaggttgaagaaaaggtgaacaagtcctcaggaattgatgaggacgaagtggtgacacccgctgaggatgcaaaagaagaagaggaggagcatccccccttacctgccagaaggaagtctgaggaggagccatctaaagagaatccaatattgcaagaattgaaggatgcttttcccaatttggaagaaaaatacattaaagcggtgatcattgcgtcccagggtgttttgagcccagctttcaatgccttactattcctatcagatcccgaatctggtaaagatatcgagttaccaacacaacctgtaagaaagaacccagaggcgccggcaagaagacgacaaactcaattagaacaagacgaattattggcacggcaattagatgagcaattcaacagctcacattcccgtcgtcgtaatcgtgatcgcgcaactagaagcatgcatgaacagcgcagaagacgtcataatccgaacgaaagggagcaacatcacgaagacagtgaggaagaagattcgtggtcgcaatttgtagaaaaggacctgccagagcttacggacagagccggtcggtcattacaggacacagcaaacaaagttagtaactggataagtgatgcttaccggagaaactttgcgtcaggtaatgagcaaaacgacaaccaacatggtcaccaagatcagcaagaatgggagccagagattgtggatttgtcacaaggcgggaaaaattcaagaccccagcaacctgagagaagaagattcaattcgtttggcgttcaagtcggtgatgactctttagaaagccacggaatcacactacacaacgaagatggatttgaagatgatgaagatgtgccacctcagttaccaacgagaacaaaatctggtgagtcgactggaaaagtagtggcagagacaacctacattgatactccagatacagaaacgaagaagaaatggcagccgctaccaccggaacccctggatactacaccaactaaagtaaacgctgtttctagaaataagaaaaatccggatgaggatgaattcttaatcaatagtgacgacgagatgtaa

SEQ ID NO: 2904 - DNA, 1236 bp, Saccharomyces cerevisiae
atggactcattatcaaaaaagattcaaaatttaggtatccatgatattagaaatgccgcaaggtttgcccaaaacgtgatagtccaatatgagccttatcagatagatatccgtcgtgctacaaataccgatgcttggggccccacaccgaagcacctcgccaaggttttaaggaacagataccaagtgccgctctacttgatgacagaatacacgttgaaaagattagtcgaccatatcgctaccaggcccaagaacctatacgaaaaggcaagaaaggactacgttaattatgggtccgaatggagggtggtcttaaaatgtctagtagtcattgaattcctattattgaacgtcgacacaggtgacgaactgaatcagattagatcatgtttgctcactcataagcatattttaaccagggagattgcccaattcaaggtaaaattctccaatgatggtaaaatggagattcatgagagaggtattaggaaaaagggagaacttatcttgcaatacttggaagactcacaatttttgaaaaaggaaagagccaagaataagaagaatgccttgaaaattcgacagcaaggagaatcctccatttataatgccaaccagatttcaacgtctgcaagttacgataacatcgacgacgatgaatttgatgcagatgcagatggctttgacagtgaaatggatgctaataatgtgaccaacttcaatgttcctgtggaaacagaagcaaattcgaatactcgcaggcgttctcatatggaagaacaaagaagacaaagaagggagatattaagagagcagatcaaaaataaagaacagcagaggaaaagaaagcaacaacaagatagcatccctgacttaatcgatcttgacgatagtactagcaccacgaataatataacaatagacaatggtaataatgacaacaaaaacaataatatcaacagcaatagtgatgatgatgatgatgagtttggcgacttccaaagcgaaacgagtcccgacacaacagcacctaaaacttccaatagtaaaatagatgatttgcttgactgggatggcccaaagtcagacacagataccaccgctgctgcgcaaacatcattgccctttgcggagaaaaaacagcaaaaagcccgtcctcaggctacaaaggacaagtcgaagggaaatgatgcattttccgacttattctcttactccaagtcgttggtctaa

SEQ ID NO: 2905 - DNA, 1236 bp, Saccharomyces cerevisiae
atggatgcaactaccccactattaactgttgcgaacagtcatcccgcccgcaatccaaagcacactgcatggagagcagctgtgtatgatttacagtatattttgaaagcgtcacccctgaatttcctattggtatttgttcctttaggtctgatttggggacacttccaactatctcatacactgacatttctttttaatttcttggcaattataccgttggcagctatcttggctaatgccacggaagagttggctgataaggctggtaacaccattgggggactgctaaatgctacttttggtaacgctgtggaactaattgtttctatcattgccctgaaaaaaggtcaagtgagaattgtgcaggcctcgatgctaggtagtcttctttctaatttgctgttagtgcttggattatgcttcatattcggtggatacaatagagtccaacagacattcaaccaaaccgccgctcaaacaatgtcctcattacttgccattgcgtgtgcatccctactgattcccgctgcctttagagccaccctacctcatggcaaggaagaccacttcatcgatggaaaaatattggagttatccagaggcacctctattgttattctcatcgtttacgttttgttcttatatttccagctagggagccatcacgccttgtttgagcaacaagaagaagagaccgatgaagttatgagcaccatttccaggaatccacatcactctttgagtgtcaagtcatcattggtgatacttctaggtacaactgtgatcatctctttttgtgcggattttctagtcggtacgatagacaacgttgttgaatctaccgggctatctaaaacatttataggtttgattgtcattcctattgtgggtaatgccgcagagcatgtcacttcagtcttggtggccatgaaggataagatggatctggcgctaggtgttgccatcggttcctctttacaagttgccttatttgttacaccattcatggttcttgtgggctggatgatcgatgttccaatgacgctaaatttctccacttttgaaaccgctactctttttattgctgttttcttatccaattacttaattctcgatggtgagtcaaactggttggagggtgtcatgtctctagctatgtatattttgattgcaatggcatttttctattatccagacgaaaaaacccttgactctattggaaatagtttatga

SEQ ID NO: 2906 - DNA, 1236 bp, Saccharomyces cerevisiae
atgtcctccgctgcaacaaaagctactttctgtatccaaaatggtccttcctttgaaggtatatcttttggtgcaaacaaatctgttgctggtgaaacagttttcactacttctctggttggttacccagagtccatgactgatccttcctaccgtggtcagatattagtcttcacgcaacccttgattggtaactacggtgtcccatccggcgaagcccgcgatgaatacaatttactgaagtattttgaatctccgcatatacatgtggtcggcatcgttgtcgctgaatatgcttatcaatattcgcattggaccgctgttgaatctctggcacaatggtgtcagagagaaggtgttgctgctattactggcgtagacacccgtgaactagtgcaatacttgagggaacaaggttcttctttgggccgtattacgttggctgatcatgaccctgtcccctacgtgaatcccatgaaaactaacttggttgctcaagtcaccacaaaaaagcctttccacgtctctgccttacctgggaaggctaaggcaaatgtggctcttattgactgtggtgttaaagaaaacattatcagatgcctagtcaaaagaggtgccaatgtaactgttttcccctatgattacagaattcaagatgttgcttctgaattcgacggtattttcttatccaatggaccaggcaacccagaactatgccaagctacaatttccaacgtcagggaattactaaataaccctgtttatgactgtatccctatttttgggatttgtctaggccatcaactcttggctctggcctccggtgcctctactcacaaattgaaatatggtaatagggctcacaacatccctgccatggatttgactaccggccagtgccacattacatctcaaaatcatggctatgcagttgatcctgagaccctaccaaaggaccaatggaaaccttattttgttaatttaaacgacaaatcaaacgaaggcatgatacaccttcaaagacccatattttctacccaatttcacccagaggcaaaaggtggtcccttagacacagctattctttttgacaaattcttcgataatatagaaaaataccaattacaatctcaggcaaaaagttcaatctcactaaaagtaacatacagtaccgataaatcgagattgcagagtataaatgttactaagttggccaaggaaagagtgttgttctaa

SEQ ID NO: 2907 - DNA, 1236 bp, Saccharomyces cerevisiae
atgtcgttggaagccatcgtctttgatagatcggagccagaaaatgtttcggtaaaggtacttgatcaattacttttaccatatactactaaatacgttccaattcacacaattgatgatgggtactcagtcatcaaaagtatgcaggtgagaggtgccccggcaattgcaattgtgggttcgttatctgttttgactgaggtacaattaataaaacacaacccaacttctgatgttgctacgctgtattctttagttaactgggaatctacaaaaacagtgctaaataagaggctagatttccttttgagtagtagacccacagccgttaatttatcaaattctcttgtagagataaagaacatactgaaatcctcaagtgacctaaaggcttttgacggtagtttatataattacgtctgtgaattgatagatgaggatttggcgaataacatgaaaatgggtgataatggagctaagtatttgattgacgtgttacaaaaggacggtttcaaggacgaatttgccgttctgacgatttgtaatactggatccttagcaacctctggatatggcacggctttaggtgttatccgttctttgtggaaggattcacttgctaaaaccgacaaggcagactcgggattggacaatgaaaaatgcccgaggatgggccatgtcttcccactggaaactagaccttataatcaagggtcaaggctaacagcatacgagctagtttatgataagattccatcaactttaattactgatagttccatcgcgtatagaattagaactagtccaattccaatcaaagcagcatttgttggagctgatagaattgttcgtaatggggatacagcaaataaaattggtactttacaacttgctgtaatttgtaagcagttcggaattaagttttttgtagtagctcccaaaacaactatcgataatgtaaccgaaactggcgatgacattattgtggaagaacgtaaccctgaggaattcaaggttgttactggtacagtaattaatcctgaaaatggttccttgatattgaatgagtcaggagagccaatcactggaaaggtcggtattgcccctcttgaaatcaatgtctggaatccagccttcgacattactccacatgagcttattgacggaattatcacagaagaaggtgtatttaccaaaaattccagtggtgaatttcaactggaaagccttttctag

SEQ ID NO: 2908 - DNA, 1236 bp, Saccharomyces cerevisiae
atgtctgatttgttaccactagctacctacagtttgaatgttgaaccttataccccggttccagcaatcgacgtcacgatgcccatcaccgttcgtattactatggctgctttgaacccggaagccatcgatgaagagaacaaaccatcgactttaagaattatcaaaagaaacccggactttgaagatgatgattttttaggtggtgattttgatgaagacgaaatagacgaagaatcctctgaggaagaagaagaggaaaaaacccaaaagaaaaagaagagtaaaggcaagaaggctgaaagtgaaagtgaggatgatgaagaagacgatgacgaggacgatgagttccaagaatccgtccttttgactttatctccggaagcccaataccaacaatctttggacttgaccattactccagaagaagaagtccaattcattgtcactggttcttacgctatctccttgagcggtaactatgttaagcatccatttgatactccaatgggagtcgaaggtgaagacgaagatgaagacgctgacatctatgacagtgaagactacgacttgaccccagatgaggatgaaattattggcgacgacatggacgacttggatgacgaagaggaagaagaagttcgtattgaagaagtccaagaagaagatgaagaagataatgatggagaagaagaacaagaagaagaagaagaagaagaacaaaaagaagaagttaagccagaacctaagaaaagcaaaaaggaaaaaaagagaaagcacgaagagaaagaagaagaaaagaaagctaaaaaagtaaagaaggtcgaattcaagaaggacttagaggagggtccaacaaaacccaaaagcaaaaaggaacaagataagcataaaccaaagagtaaggttttggaaggcggcatagtaatcgaagaccgtactatcggtgatggcccacaggctaagagaggtgccagagtaggcatgaggtacattggtaagttaaagaacggtaaagttttcgacaagaacaccagcggtaaaccatttgcattcaaacttggccgtggtgaagttatcaaaggctgggacattggtgttgccggtatgtctgttggtggcgaacgtagaatcatcattccagcaccatatgcctacgggaagcaagctctgccaggtattcctgccaattccgaactgacattcgacgttaaattggtttctatgaaaaactag

SEQ ID NO: 2909 - DNA, 1238 bp, Saccharomyces cerevisiae
atgcaatcttctcttcccctttgcagagaattttttgaaaaaataactgcatatttagattatcatgatttcaggttaaccattactgccaatcagccttcaattactctcccttactacgtagacgaaaaagcccattccatagaactaattatcttcaaaacaacatttttatctcttttccaagaagcacatacatattttaacaaaactttctctgatcaaagtatgtctcaacggtaaaatacaaaaaactattgctattttacaatacgcattttggattcattgttacggctactaacaattctacatattgatgtaaattaggcggcatttctaatgagaatatttattacatgactgttggatttctacttacaacacctgaaaacaaaacggtatataatgtacacgaagatttactcaagagatacttccaggacaacagtgttttagtaataccggatttattggtcaaagaagtaagactgattcaacggcttctttgttcatcaaacaatcgtatcaacaagtcgtcatctctttggatattataccgaaaactattcgttttatctcttgatgctaatacactggttcttccagatattttatttgtatttcattcttctggatcccaacatttctctaattactactgttggaatactgctaggtggttctacgataatttaccttacaataaaagaattgagctcttcaatttgactaagagattttgctttcaaaatgttaaggattgttcctcatggagcgcattagcatatatggtatgccagcaggaggaaaaaaaaaccgataatatacgtgattttcaaagactaacaagctcttttaatgttccgttcaagataaataaagtggatttgaattttcaagtacagcctgcggatgcatttactcaggaattagtaaaatggattgatcgaacgtatgctgcagattggcctccatatctgtgtcttctgcaaattacgaaatttaatatcacccttagaattgaaatggactctgtcttattgacttggagaaatgaaattctgaattttgaagagaacagtggtcatatcaaaatgataaataatactccaatagtacctgagaaattttcaaacgatcttctaacttctgtgaattttgcacattttggctataaaaagcttttcttaaataagtttttggataaaaataagaaagaacaatcagatagttag

SEQ ID NO: 2910 - DNA, 1239 bp, Saccharomyces cerevisiae
atgaaaattgcggtagaaacgacactattcgacttctttgtcatcgatcagtttaaaaaatctactttttcagcgccaaacaccaaagttgacactattaagggttgtattaacaagtttattgaacaatttaatgtatatgatgagcaacacatattttggcaacctcctggaaaatcaaacgtcagattgctgtcaaacgccaatgactttggccaattgggaaactttttgcataagaaaatcaaatgtaacatttttattggagaagaagcattaaggaaatacgatttaaatatctgtggaccttatgacaaatttgtagaaaattctgaccctagtgttaaaaaggttgtgaacagagatgatgtcatgttgtcgcgcaaatgtttaaacatcatatcggaacaactctctatacttgagaagtccataagtaaggctcaaaaccaagtgttgcagtcaagtgaggttgaaggaaaaaaatgtattatcttgccggaagataaaccagaactcatcaagtttttttctaaatttgaaacgagtgttcagttacaggaggtttacgagggctataaggtatatgaaaagctattacaaaaatttggtgggcaaaaaaaaagaatggagtctttcttgaatgaaaacacgccaatgtcaggtgccgaagctatcaagcaaataaatatatctgaggagctcaaggaaaaaggggaacgtttaacaacaccaaacgatccgttattacacgttgaggtgagtaatgaggataactcgctgcactttatattgtacaataaaacgaatatcataattccaggaaattgtacatttgaattttctagccaaatctccgaggtattcagtatcaaaatgggaccgcatgagataggcataaagggtcagaaagagctatggttttttccatcattacctactcctctctccaattacacaatgaaagtcgtaaaccaggatggagaaactattctggttggtaaatgtgctgactccaatgaaataactctaaaatctccactagcctcattttcgacaggcagtttccagacaggcagtttccacactttgcaagatcctactaatgttttccgggcagacgcgctttcttcccctgatgaatcaagcatcatgagcactccctttctaggcgagacagatgaagtttataattctggctctacattaagtaggccatttacttgggaagaaatataa

SEQ ID NO: 2911 - DNA, 1239 bp, Saccharomyces cerevisiae
atgacaaagattaaggtagctaaccccattgtggaaatggacggcgatgagcaaacaagaataatctggcatttaatcagggacaagttagtcttgccctatcttgacgttgatttgaagtactacgatctttccgtggagtatcgtgaccagactaatgatcaagtaactgtggattctgccaccgcgactttaaagtatggagtagctgtcaaatgcgcgactattacacccgatgaggcaagggtcgaggaatttcatttgaaaaagatgtggaaatctccaaatggtactattagaaacattttgggtggtacagtgttcagagaacctattattatccctagaattccaaggctagttcctcaatgggagaagcccatcatcattgggagacacgcattcggcgatcagtacaaagctaccgatgtaatagtccctgaagaaggcgagttgaggcttgtttataaatccaagagcggaactcatgatgtagatctgaaggtatttgactacccagaacatggtggggttgccatgatgatgtacaacactacagattcgatcgaagggtttgcgaaggcctcctttgaattggccattgaaaggaagttaccattatattccactactaagaatactattttgaagaagtatgatggtaaattcaaagatgttttcgaagccatgtatgctagaagttataaagagaagtttgaatcccttggcatctggtacgagcaccgtttaattgatgatatggtggcccaaatgttgaaatctaaaggtggatacataattgccatgaaaaattacgacggtgacgtagaatcagatattgttgcacaaggatttggctccttggggttaatgacatctgtgttgattaccccggacggtaaaacctttgaaagcgaagccgcccacggtacagtaacaagacattttagacagcatcagcaaggaaaggagacgtcaacaaattccattgcatcaattttcgcgtggactagaggtattattcaaaggggtaaacttgataatactccagatgtagttaagttcggccaaatattggaaagcgctacggtaaatacagtgcaagaagatggaatcatgactaaagatttggcgctcattctcggtaagtctgaaagatccgcttatgtcactaccgaggagttcattgacgcggtggaatctagattgaaaaaagagttcgaggcagctgcattgtaa

SEQ ID NO: 2912 - DNA, 1239 bp, Saccharomyces cerevisiae
atgacttccctgactaatgccgtgttcaaacgatacctggcagtgactcctagcgctcaccaagctcttaaaacgagaattaagaaaaagtcgtcatctttcgataagtttttcccacagcaaagcaatagtagaaaaaaacaatgggaaacgttgaatgaagacaaagcgtcgtggtttaaaaggaaatacgctcacgtacatgctagggaacaggaccgtgcagcggatccatatggcaagaaaaaggcccacgtcgagaagctaaaggagatcaagaatcaggcgaaattaaaccaaaagagccataaatccaagttccagaataaggacattgctctgaaacttatgaatgataatcctatcttcgaatatgtctacggcaccaacagcgtttatgcagcgttgctgaacccgagtagaaattgccattctcggttgctgtaccatggcactattcctagtaaatttcttcagatagtcgatgaactgaaggttacgacagagctggtggacaagcacagattaaacttgttgaccaattacggggtgcacaataacattgctcttgagacaaaacctttgcagcctgtggagattgcgtacctaggcgacatggacaccagttcagcagcattaagcattcacgagctgggcttcaataacgaaaatatacctcatgaactgccttatggtacgaaaacagacgctaagaagtttcctctcgggttatatctggatgaaataactgaccctcacaatatcggtgccattattagaagcgcttacttcctgggggttgacttcattgtgatgtcgagaagaaactgctctcctttgacgcctgtggtgtccaagacaagcagtggggccctcgaacttctgcccatattttacgttgataaaccgttagagttttttactaaatcacaagaaatgggtggctggacgtttattacaagccacttagctaatgccacgtcagaaaaatacactgttggaaaaactattagcatgcacgatttgaacggattatgtaacgagctgcctgttgttctagtggtggggaacgaaagccagggcgtaagaacgaatttgaagatgaggagtgacttcttcgtcgaaattccctttggtggcattgagaaaggcaatcgggccccagaacccattgttgactcactaaacgtaagcgtggctactgcattgttaatagataatattctaacttgtaaataa

SEQ ID NO: 2913 - DNA, 1239 bp, Saccharomyces cerevisiae
atggctaaaagacccttaggtttaggtaaacaaagtagagaaaagaaaagaaaggtggaaagtgtcgaaaagaagagcgatgaaccttccagagaatccacacctgtgagaagtcaaatgagtgttgagcttgacgatgatgctgatttagatgacgaattagctcagctgaaaggactgtggtctaaatattttcactctgacagagacgacgaatatgttttaaatggaatcgttcacgaatgtgacagattattgcgtctttctgaagaagataaagagattaagaagacgctgaacgatattttccatggtatatatgctctggctttatctgaattgactattttcaaggcaggcgatgaggaagccactgaagaaaagagaaaaaaagatgtatcctcattttttgaaagtgctatcgaaagagtcgaattaggtctttcgcatttccctgaatcccaatttctaaaactagttttagcaaagataattttccaaaggattccgttggaatatatttccaatctccatttgaaatcgaaggataaaaaacttgatcttgtaggacagcttgaacatggtaagaagcatttttcaatttatgaaaacgatactgaatttacttttgaaatcctacaaatggtgaatgacttattggacatcgtcgagaattttggtcgcgaacaatctattcaagagggcatagatagcgataatgaagaggaagaggaactcattgatattgagttggaaccagaacaccctgtatatcccctacaacaatcgctagaagcgaattacgagtggctaagaaaccattttgataaattgcttgacaacacaaatacagatgtgaaaatctatgcatcaatagctaacaccctaggggaactatacctaaaaaaagctgaagaaccaagtaaagttttcttaagcctacagtacgatgatggcggttctgaaaaggttagcgacaaggaagccaagaacgcccaagaaaccgctttgaagcacacaaaaaaggctttagaatacttggaaaaggctaaactggaggatgatccggacacctgggttcaagtcgccgaagcatatattgacctaggtaacctgcttgacaatgaaagtgctgaacaagaagaagcttacaaaaccgccgaagaaatcttaggcaaagcaaacaaggcttctcatggtaaatttcaagatgtcctggacaatttcttacaaggctga

SEQ ID NO: 2914 - DNA, 1239 bp, Saccharomyces cerevisiae
atgtcagaattacatgctttgcttactttcccagagaggcccatttctcaaagttactatgtaccaaaactgcagcatttcttaaaatctggtataccggctacatatactttggagcaggtcgcagccttcgagcatgaggaaaagaacaggaacggggataaggaattcagagagagcactgacgacaataaaacctcaaacacaacgccgttacacgttttagcaagatcgctacccttggatatcaaggatgaggaactgcaagtggtgatggatatgatgaatattctttttgagtatggggctggatggaattttattgactacgaggacaaaacagtgggtgatttgtttttagagagaaatcaaagtagggagagccctctttatagacggctcgtggaagctggtgtgtctgctgaattattactgagaaaactcaatggtggcgacgtcgaattcttggatacagatgaactaataggtatcgagcctgaggaaagcgttcaaacagcagttgatggtcaaaaagaagaatcagttggtagtgatgacgatgctaccgcggcaaatcaacaagtgtacttaaaaacagaactagagtacaaagacgatgcgcttatcacaaaggaaaataaggacggtgttatgatggattgggaaaccaagattatggaacttgcttccgaaaccttatttcctgatccagaggccactaattctgctacgatcttaaacattggatttggaatggggatcatcgatacattcatccaagctcgaaaaccatatcgtcactatatttgcgaagctcatccagatgttttggccaagatgaaaatggatggttggtatgaaaaggataatgtggttattttagagggaagatggcaagatacgttgaataatttattagacaaaggtgaagttttctttgatggtatttattatgatacatttagcgagcactaccaagacatattggacttatacgatgtcgtggtaggtttaattaaaccagaaggcgttttctcatttttcaacggattaggcgctgacagatcgttgtgttacgatgtatataaagaaattgttgagatcgatgttgctacatatggtatgaaatgcgattacaccagatattctcttgacgagcaattgccagattggaatgatgttaagcggtcttactttaactgtaactattattaccatccacgtatcacgtttgcttaa

SEQ ID NO: 2915 - DNA, 1239 bp, Saccharomyces cerevisiae
atgtctcctgcagcagctcaaacagcaatccctcttccatctaccgatttaccagtcaaaatcattacaaatgggttgaaaaacctgaattatacctccaagcaaggttacgggaattttgatacccatttttatgatggccaagatgaggtctctccatctggtttattgaaaatccgtaaatcttatagagagaaatcgaagtatccagattatttgcctacatgggatcctactgaaaagtatggcccgctggaatttcacgaataccatgatcctgctttgagagctgacggtaacttttcaaacctttttgcaaaagaaaacgttggtcaactaaaggtgaagaagatcaccccgaaattaggtctcgagatcaatgggatccagctaactgatctttctgatgctgcaaaagatgaactcgctttgcttgtcgcccaaaagggagtagttgtctttagaaatcagaattttgctgacgagggacccgattatgtgactgaatacggaagacattttggcaagttgcacattcatcaaactagtggccaccctcaaaacaatcctgagctgcatatcactttccgaagacctgatgcggaagaatttgcaagagtttttgatgactcgacatcatctggtggctggcacacagacgtctcttacgagttacagccaccttcttatactttctttagtgttgttgaaggtcctgatggtggtggagatacgttatttgcggatacgatcgaggctttcgacaggttgtcgaagcctttgcaagatttcttgagcacgcttcatgtcatccatagctcaaaggaacaggcagagaattcacagcgccagggcggcataaaaagaagagcacctgtcacgcatattcatccactggtcagagttcatcctgtcttgaaaaagaaatgcttgtatgtcaatcgtgcattttctaggaaaatagtcgaattgaaaagacaagaatctgaatcacttttgaatttcttgtacaatctagtggagagcagccatgatttacagttaagagccaaatgggaacctcattccgtcgtcatttgggataaccgcagagttcaacattcagcagtgattgattgggaagaaccaattcacagacatgcgttcaggattactccacaagcggaaaggcccgtggaagatctaaagtttttgaatgatgaaaattattatccttcttcattaactttggatatttga

SEQ ID NO: 2916 - DNA, 1242 bp, Saccharomyces cerevisiae
atgagagcattcccccgagtactgccatttcgccatcagagatcatataataacatccttcttcgaacagtaaggctttttggttcatcactttcttcttttgatttctctaggcaaatgcctaaggtggaccctgacaataccgctgcaatgctactacagaaaaacttgatccaaagaaacaacatgctctatgggtatggatcagggacaatacgatgtactttgctagactcaactggacgagccaaatcaccattagtagagataaaacgtgaggatctagtatcaaaacatggcttgttgcccagagatctacgtaaaattgaaaaatcaaggaagaatgacttagtccctagtttgctcgtgcgagaaaattccatactaatcagtttacttactgtgaaagccctaattaagcctgatatggttattatcttcgattcagccggcagtggaataactttaaactcagaagctcacaaggattttattaacgatatgaaattgagactaaaaaatcaagaaacaagcgagctaaatagcgatccacttccttatgaattcagagctttagaaacgatcttcatttcggcattatctaaccttaccagtgaaatgaaggtgttgctaaccatatgcaagggggtgcttcaagatctagaatttagtataacaagagataaattaaggttcttactgggtcaaaacaaaaaattgagcagcttcaataaaaaggctgttctagttaaagatatgctggatgacttgctagagcaagacgatatgctttgtgatatgtacttaaccgacaaaaaggctggaaaaattagagttcaagatgatcatactgaaattgaaatgcttctggaaacatatcataactatgtcgatgaaatagttcagaaaagcgaaagcgccatatctgacgtgaaaaccacagaagaaatcatcaatataatcctagattctaacagaaacgaattaatgctgttagggataagatacgccataggaatgctttcgttgggaggcgctctattcctgggttctatctatggtatgaatctggaaagtttcatagaagaaagtaattatgcgtatttaactgtcaccattttggggttaatatctactgtttggctctatgcgaagggaatcagacatttgcataaattacaacgtatgacattattgagtaaaataaaaacagattccgttcacgaactgttgaagaaatag

SEQ ID NO: 2917 - DNA, 1242 bp, Saccharomyces cerevisiae
atgcaatacaaaaagactttggttgcctctgctttggccgctactacattggccgcctatgctccatctgagccttggtccactttgactccaacagccacttacagcggtggtgttaccgactacgcttccaccttcggtattgccgttcaaccaatctccactacatccagcgcatcatctgcagccaccacagcctcatctaaggccaagagagctgcttcccaaattggtgatggtcaagtccaagctgctaccactactgcttctgtctctaccaagagtaccgctgccgccgtttctcagatcggtgatggtcaaatccaagctactactaagactaccgctgctgctgtctctcaaattggtgatggtcaaattcaagctaccaccaagactacctctgctaagactaccgccgctgccgtttctcaaatcagtgatggtcaaatccaagctaccaccactactttagccccaaagagcaccgctgctgccgtttctcaaatcggtgatggtcaagttcaagctaccaccactactttagccccaaagagcaccgctgctgccgtttctcaaatcggtgatggtcaagttcaagctactactaagactaccgctgctgctgtctctcaaattggtgatggtcaagttcaagctaccaccaagactactgctgccgccgtttctcaaatcggtgatggtcaagttcaagctactaccaagactaccgctgctgctgtctctcaaatcggtgatggtcaagttcaagcaactaccaaaaccactgccgcagctgtttcccaaattactgacggtcaagttcaagccactacaaaaaccactcaagcagccagccaagtaagcgatggccaagtccaagctactactgctacttccgcttctgcagccgctacctccactgacccagtcgatgctgtctcctgtaagacttctggtaccttagaaatgaacttaaagggcggtatcttaactgacggtaagggtagaattggttctattgttgctaacagacaattccaatttgacggtccaccaccacaagctggtgccatctacgctgctggttggtctataactccagacggtaacttggctattggtgacaatgatgtcttctaccaatgtttgtccggtactttctacaacttgtacgacgaacacattggtagtcaatgtactccagtccacttggaagctatcgatttgatagactgttaa

SEQ ID NO: 2918 - DNA, 1242 bp, Saccharomyces cerevisiae
atggacacaaattctaaaaccaaagtacaaactgaaaataaaaaaattaaggcgaaatttatacataatcatgggcaaaagccctctcttatccaaattacacctccaatgatttccagcactctgtttcacgcatatccactactactaatattcgacaatgccttagcgaatataatgtggctgtccgacgataaatgtttaacattcatttatctaacgagcatatggctgaccataagtttttttatccccgttgaaacagaggctagccattttctgccatttacaaagattttgagactatggttaggcattataagcggggcatttctattcttatcattcatgtattatattgtttcattgatagcttcgttaagagacacggaacctcctacattggatgaaattgtcgtgctactagagtctgtgttggataaactggaagtactgagaaacgagctgaatgtttggaaaaaattaaagctttcatttgatggcgtcaataaggagtgttctggcaagaggttgttttgcagattattcttattcggtacaatttttcaaattattatcatgagatacatatcaccgggaacttatactagattttttattattaccggcttgatatacaatacgagtagttttcaagctaccttaaggctactttggaggtttactgctgttaggaatttctattatttggggattgaaagttttaaaatttcgagtttcttaccaaaacacttaaagatggaacaaattattcctttatctcaaggacgtgcaatcacggtgccactggtagaggtattgcctaaactacttcgggacaagaagggtgatgaccacattcatattctacagcttctacttaatgagcaaaaagataactttggtaatgaagaccttaaaatactagaaattgaagtatacgaaaatcaaagaaggtggtatcaaaataaaaattggagtacaaaattactgccgtacgaaagacaaaactactgcatagaaattaaaaacactgatggaactttaaccatgaggagttgtttgcccccagatggacttggtgaagaagaattacccaataattggcattggatcaatgataattgggacggaactgattggatatattcagattcagcatggaaagaaattggacaatacagttctttggaaagttttaccaggtcaagaaaatggaaacgacgcctcttccatttgtaa

SEQ ID NO: 2919 - DNA, 1242 bp, Saccharomyces cerevisiae
atgggagctggcactcttttaaatggattagaaaaggaaaactttccaaataacatccattcagatttgcctgcgtatcctaacatggattctcaagaagatggcaatactagtaaggaaagtaaaagaaatagtccagtaaaacagaagtcccaaaaagatgaagaaaagtcatctaaaatggggactgcaagcaacatattccatgaaaataaagatatacacgaaagatctgaacacacggacgattttaatgatggcttaaaactggctccggactctagtccaagcttgaaagagtgtcaatttaaaaattgggaaagtttttggtgtaatacagaaggttacaaaactaaacacatgcagccctttcattttacaagcggattagaagaaataaaggaaccggtcatggaattgaatatttccacttcaccatacaagggacagaggccaaattcagctccaaccgagtattcagctgccacaacagcgtttaccaaaacacaattagaggtgagttttctaaaaaccaacttgcttacatacattaaaaaagagattgacatttgcttgtcaagtgttccattttttgacgacgcagttcaaatgcaaaagaaattcttggaatacagagatattgacttggatgaagaatatgagctcaaaattttgggggaacttttgaatgatttaaacttctttcatatgcaagaaaactctttgctaaatagagagctagcagttcgtagattctccaatcaacctgaaagtcaaaatttaccttccattagggattttagaaatccacttttgccaatagataaccgcccttctcccccattaggattgaaaagaaacggaaagtctttcgaggaaacctatgatttcacgtccaatacatcaaatttttggggagaaaaagcagaactacaaaactccataactggtggaacaccctattttttccaccctaacaatatacatcaaacaaaaccttttatgtcatttgaaaatcaaaatgaacttctattccagagaaaaaattcagattacaagcagcattttaactctggaagaaatatacataatggagtggaatcgaaatcttacagaggtgtggggttaaacgatagttatcaaaagggttatgcagcaatgacaaagtcgtttggaaatatcgatttaaatagaatgcccagaagaagtaatgaagaaatgtatagctggtcacgtaattga

SEQ ID NO: 2920 - DNA, 1242 bp, Saccharomyces cerevisiae
atgggattatattctcctgaatctgaaaagtctcaattaaatatgaattacattggtaaggatgattcgcagtccattttcagacgtctgaatcagaatttgaaagcaagtaacaacaataacgatagtaataaaaacggtttaaacatgagtgattatagcaataattcaccctatgggcgctcgtacgacgtaagaattaaccagaactcacaaaataatggcaatggatgcttttctggcagcattgactccttggttgatgaacatataataccatcgccacctttgtcgcccaagctggagtcgaaaattagccacaatggctcaccccgcatggcctcttcagtgctagtgggatctacgcctaaaggcgctgtagagaatgtgctgttcgtgaagcctgtatggcccaatgggttatcaagaaaaaggtaccgctacgccacctacgggtttctgtctcaatacaaaattttcagcaatttggcccaaccatattctaagaacattatcaaccggtacaacaatctggcctataatgctagacataaatattccaaatacaatgatgatatgactcctcctcctctgccttcctcttcttctagattaccttccccgttagcatctccgaatttgaatagacaagcaagatataatatgaggaaacaggctctctacaataacaatctaggaaagtttgaatccgacactgaatggataccacggaaacgcaaggtatactcaccacaaagaagaacgatgactaccagtccacatcgcgccaagaagttctcaccctctgcatccactcctcacactaacattgcatccattgaggcgattcatgatgctcctcaatatataccaaacgtctcatggaaaaaattaccagattactctccgcccttatctacgcttcctacagacagtaacaagtcactcaagatcgagtggaaggggtctccaatggacctgtccacagacccgctgaggaacgagctacaccctgctgaactagttctcgctcaaactctaaggttaccttgtgatttgtatctggattctaagagaaggttatttttggaaaaagtttatagactaaagaaagggttgccgtttagaaggaccgacgcccaaaaagcctgtaggatcgacgttaataaagcatcaagactattccaagctttcgagaaggttggctggctacaggattcgaattttacgaagtacttataa

SEQ ID NO: 2921 - DNA, 1242 bp, Saccharomyces cerevisiae
atgtccacagagactacaaaaccatcaatcactactacaccaactactgtactcgtttctcccaacacgctcaaaaggaaaaagggtgaagacaccagcgaggaacaactggaagcagaaatcaaacgcgtggccctgaaggatgcagacagccactctgacaacgaccacgattcccccgacaatgttccctctgatgtacatttacgaatgctgtgcttagtcaaacacgcttcactgatagtaggacacaagggcgccactatatctagaataaaatccgaaacctctgctagaataaacatatcaaataatatcagaggtgttcctgaaagaattgtttacgtgaggggtacttgcgatgatgtagccaaggcatacggcatgatagtaagagcgctgcttgaagaacatggtaacgaagataacggggaagacattgagatttctatcaacctattgatccctcatcatcttatgggatgtataattggcaaacgtgggtctcggttaagagaaattgaggatttgagtgcagcaaaattattcgcgtccccgaatcaattgctgctttctaacgatagaattttaaccattaacggggttccggatgctatccatattgctactttctacattagtcaaacattgctaaactttcagatggaatctccgcagaaaaatgtgaaaaggtccatatactatcagccaactcagtttaactcagtattaatagaccatagccaaccgaacaccattttccatcaaagaaaccaccaatatcatccaagcgataaactactttcatacaaacccaacaaaaatttaccaatatcatctactttgttgagtatggccacaccgcagtatactactgctagcgttgcaaacgcaacggcctttcaaccgaacttcgttatccctaatgtgacagtcttagacggccctgttatcagtccggcacccggcaaccatttattaatgaactttgtacaacaagagatattcatagatgagaaatttgtcggaaatgtcattggcaaagatggcaagcacataaattcggtcaaggaatccacaggttgttcaattattatacaagatcctgtagaaggctcttcggagagaagacttaccataagaggtacgttcatggcgtcccaagctgctattatgttgattagcaataaaattgaaattgatagatcaaatgctgaacgtaaaagaaggtcgcccctctaa

SEQ ID NO: 2922 - DNA, 1242 bp, Saccharomyces cerevisiae
atgtggctttcaaagttccagttcccctcgaggtccatctttaagggtgtttttttgggtcacaagttgccgttactagtgcgactgacatcaacaacgactaactctaagagcaacggcagcatcccaacacaatacacagaactctctccgttacttgttaagcaagcggaaaagtatgaagctgaactaaaagatcttgacaaagacctttcttgcggcattcattttgacgtgaataagcagaaacattatgctaaattatcagcgctcactgatacatttattgagtataaggaaaaactaaatgaattgaaaagtttacaagaaatgattgtatctgatccatcattaagggcggaggctgaacaagaatatgcagaactggtcccccaatatgaaacgacctcctcaagattggtaaataaacttcttccaccgcatccgttcgcagataaacctagcttactagagcttcgaccgggtgtaggtggcattgaagccatgatttttacccagaatctattggatatgtatattggctatgccaactatagaaaatggaagtatcgaattatatcgaaaaatgaaaacgaaagtgggtcaggcattatcgatgccattctgagcattgaagaagccggatcttacgatcgtttgaggtttgaagcaggcgttcacagggtgcagagaattcctagtacggagactaaaggaaggacgcacacatccactgctgccgtggttgtgttacctcaaattggtgacgaatctgctaaatctattgacgcttatgaaagaacatttaaacctggtgaaatcagagttgacatcatgcgtgcaagcgggaaaggtggtcaacatgtgaatacgacagactctgctgtcagattaacccatatcccctctggaattgttgtttccatgcaagatgaaagatctcaacacaagaataaggctaaagcatttacgatcttaagagcgagacttgcagagaaggaaaggctggaaaaggaggaaaaagaaagaaaagcaagaaagagtcaggtttctagcaccaataggtctgataaaattagaacatacaattttccacagaacagaatcactgatcataggtgcgggttcacattgttggacctgccaggtgtgttatctggagaacgattggacgaagttattgaggcaatgtctaaatatgatagcaccgaacgggcaaaagaattattggagagtaactga

SEQ ID NO: 2923 - DNA, 1245 bp, Saccharomyces cerevisiae
atgaatccatcagtaccgaaggttatgaaaagagaaaacaatacacacctactagtttctaaagaaatgaatgatacgagtttgcaactaccgtctactacgagatcactttcaccgaaagagtcaaacagcaatgaagactttaacgtcgatggcaacgaaacaacgctgcaaagaataagtaaagattatttgaaaccaaatattgggcttgttctcttgacagtatcatatttcttcaactcggccatggtggtgtctactaaagtcttagaaaacgaccccgatgatattgccaatgatagacagatcaagccattgcaaatcttattagttagaatggtaataacatatattggtacattgatatacatgtatattaataagagcacaatttcggatgtaccatttggtaaacctgaagtacgcaaatggttagtattgagaggttgcactggatttttcggtgtctttggaatgtattattcgttaatgtacttgacgattagtgatgccgttttgatcacttttttggcaccatcactaacaatattcctgtcgtgggttatcctgagggaaagattcaccaaagtggaagcgctcggttcgctgatctcattgctgggcgtggtgttaattgtaaggccttcatttttatttggaactcccgaattgaccgactcttcctctcaaatagtagaatcatcggacccaaaatcgagattgattgccactttggttgggttgtggggtgttttagggatgagttgcgtctacatcattattcgttatattggtaagagggctcacgctataatgagtgtgagttatttttctttgatcacagcgatagtgtctttcattgggattaacactatcccttcaatgaaattccagataccacattccaaaaaacaatggatactgtttggtaatctgggtgtgtccggctttatcttccagctgctattaactatgggtatccaaagagaacgtgctggaagagggtctttgatgacatacacacaactactatatgcggttttctgggacgttgcactgtacaagcattggccaaatatctggtcgtggattggtatgataatcatcataagtgccacgttgtgggtaataaggataagggcggcaaacaatgaaacaactgccaaggacctaaccccaataattgacgacgaagagaactctattcccctgacagagtttgacctatccgattctaaataa

SEQ ID NO: 2924 - DNA, 1245 bp, Saccharomyces cerevisiae
atgagttatagtgtcaacacgtttacagattacgttttattgtttggatcatctagtttagtaggaaaaggtattttagagaacctgttggacataaatttatatattaaaaatgtttcggacctacaaggcaagcttgatagcttaagtgaaataaagggaaatgtcgttctcaataaacatgtcttttgtgttaatagaaggtgcatcaatgaggagaaatcatttatgaagaccattgattatataaatatgagatcagttacttggcaaggtggcagatattacttgagaagcaggaaagaaaaagacactgaaaaagtaccgtctagtcctaatactttttgttatgataattttgaagaaggatttattaaaaatacgcctgaagagaggggaaaagatggttattcttttgtttataatcagaaacagttcagttacacactacattatgcatgcggaaaggaaaaaggtattgagatcatttgtaattttactgtaacgcaattgatcatccccagatctgaaacttggccaaaattgcttccacggatattctcaggaacacaaaagctggaaaagtttgacattgacaacaaaaattacgttcccggtagaagtttgcctagtctgtgtgatattagcactatggtgtgctctttgggctccacctcagctagagtgcggagaactcaggtaccaagttcctttgctgactattacttaccttttaatttagcacaagaattcacgaatacaactaacaaaaggttggtggttacaactgcctttaataatgattttcttagtaaaactttcgagtattttagaataaaagctaaattagaaaatgacttggatgaagctttgccaaataagctaaaggagctagttattttgaggccaggtccgatgtgtggacagcacggaaatcctataaacgttgaattgggtaaagaaaactccactttcttggaaaaaattttttattatcctcactatcttttagtttataaaaagaaatatatcagtgaggccagaaggattggcttaagaacaaagttaagcgaaataattgcttccagtatatataggatgccaggatctgcattattaggatacgctgtcccagtttcaaaggtttcttatgttgcctctttgatggcgattgaaaggaaaagtaaagaggcgggacctaagctggaagtaattagcagttatcaaattgatatgattgtgtga

SEQ ID NO: 2925 - DNA, 1245 bp, Saccharomyces cerevisiae
atgctttcattcagaagtttgactagcacattcggtttcgtatcacgattccaaattagacggttaggaactagtttatcaatacagaatttagaagtgcaagatggccgttggaaaggtaaactagctacagagaagaagaccaatagggaacacaagtcagtggatacgaatatcaagacaatgaagatgcttaaaaacccgaagaattctactcgctatttgagacgaagttttgtgccaaaccacagaaagcaggagaatggacgtgatattctggaggattctttaagtaaagatcacttaaaagtgaagagttgtatcaccattaccaccggagagggttatgatctcaaaagatgcatgaaattgcttactatgcaaggattacaaccgacaaatttgatacctgatgaaatcgtgtcatttagttatcaggataatggcaataaaggtgacgtaatgattttaggtcaaaatggatctattgtaagctggggcttcagtgaatctagtgttcgaaactgcatagtgcctatagttaaagcagcgagtttaaatccactgaacggagaagactttgagactgaggacatggattatgtggaaatagaaggggaacaagattttgataagctttccagtttggataataaggtaacaccgagaattgcatgcgaaagctttctttctggagatttgataataattaactccttggattctgatcaaggaatgctagataaggcggcattctcaagtgggctatcgagaagcaccaacttggcagtcctagaagaagcaatggaaaaacatatatcaaagaccagaacaataacagaaaatatttctaagggaacaaagttaaatctaaggtcaagtgatgcattaaagtcaataggccgcctttttctaattagaggaaagttgaacctctattcagaactaattgagacccctgatctttattggagtgaacctcaattggaagagatttttaaaaatgtttcgaggtatttggacataggcccaagaataaatattctgaacagcaagctggactattctacggacgagtgtcgagccctcatctctcttttaaacgagagaaacagcacttttttggaatggataattatatacctgattgctttcgaactgtgctttgaaatttatcatttctaccagaaatattcttcctactgctcagaacccacgaatgatgatctagatgctacaaagtaa

SEQ ID NO: 2926 - DNA, 1245 bp, Saccharomyces cerevisiae
atggctaagactactaaagtaaaaggtaacaagaaggaagttaaggcttccaaacaagccaaagaagaaaaagctaaggccgtctcttcctcttcctccgaatcttcatcctcatcttcatcttcatctgaatctgaatctgagtctgagtctgaatctgaatcttcatcttcatcttcatcctctgattctgaatcctcttcttcatcgtcttctgacagcgaaagtgaagctgaaaccaagaaggaagaatccaaggattcctcttcctcttcctctgactcttcttccgacgaagaagaagaagaagaaaaagaagaaaccaagaaggaagaatcaaaagaatcttctagctctgattcatcctcatcttcatcttctgatagcgaaagcgaaaaggaagagtctaacgataagaaacgtaaatctgaggacgccgaagaagaagaagacgaagagtcttccaacaagaagcaaaaaaatgaagaaaccgaagaaccagctactattttcgttggtagactatcgtggtctattgatgacgaatggttgaagaaggaattcgaacacatcggtggtgtcattggtgccagagttatttatgaaagaggtaccgatagatctcgtggttatggttacgttgattttgaaaacaaatcttatgctgaaaaggccattcaagaaatgcaaggtaaggaaattgatggtagaccaatcaactgtgatatgtccacaagcaagccagctggtaacaacgatcgtgccaagaaattcggtgataccccatctgaaccatctgacactttgttcttgggtaacttatctttcaatgctgacagagacgctattttcgaattattcgctaaacacggtgaagttgtttccgtccgtatcccaacacatccagaaactgaacaaccaaaaggtttcggttatgttcaattctccaacatggaggacgccaagaaggctctagacgctttacaaggtgaatacattgacaacagaccagttagattagacttctcttctccaagaccaaacaacgatggtggtcgtggcggtagccgtggttttggtggtcgtggcggtggtcgtggcggtaaccgtggattcggtggtcgtggtggcgctcgcggtggccgtggcggtttcagaccatctggttctggtgctaatactgctccattgggcagatcaagaaataccgcttctttcgctggttcaaagaaaacatttgattaa

SEQ ID NO: 2927 - DNA, 1245 bp, Saccharomyces cerevisiae
atggtaaatttcgatttgggccaagttggtgaagtattccgtagaaaggacaaaggagctatagtgtccggagacaacccagaagaagaagaagacgtcgatgcttctgagtttgaagaggatgaagtaaagcctgtgcgtacaaagaacagaagacccaaagaggatgcattcactcaacaaagattagcggctataaacccggtgttaacgccgaggacagttttgcctctttatctgttaattgctgttgtatttgttattgtaggagggtgcatattagcacagaactccaaagtggatgaagtaaccatatattaccaggactgtatgactaacgcaacctcatcatggagcgacatcccttctgaacattggcaatttgtatttcacaaatataaaacatataatactgcaccacaatggaggtttgtggatgatgaatcagatgacttcacaaaacaaagaggtacatgccaaatcaggttcactactccaagtgatatgaaaaataacgtatatttgaattatgtgctggaaaaatttgctgccaatcacagaagatatgtactatcttttagcgaagatcagatacgtggggaggacgcctcttatgagacggtgcatgatgcaaccggtataaattgtaagccactatctaagaacgccgatggtaaaatatactatccatgtggcctaattgcgaactcaatgttcaacgacacgttccccctgcagttaacaaatgtaggggatacgtctaacaactattcattgacaaataaaggaatcaattgggaatctgataaaaaaaggtacaaaaaaaccaaatacaattatacacagatagcacctccaccatattgggaaaagatgtatccagatggatacaacgagacgaatattcctgatattcaggattgggaagagttccaaaactggatgaggccaggtgcttttgataaaattacaaaactgatcagaatcaataaaaacgatactttgccagcgggtgaataccagttggatatcggtctgcattggccagtattggagtttaatggtaagaagggaatctacttgactcacggttctcaccttggcggtagaaatccatttttaggtatagtttacctgattggaggctgtatttgtgctgccatggcattgatattattaacgttttggctcttcggcggtagaaagattgctgatgcatcaagtttgtcatggaatatgaaatag

SEQ ID NO: 2928 - DNA, 1245 bp, Saccharomyces cerevisiae
atgtatagacgatctgttggagtactatttgttgggagaaatacaagatggatttcgtccactattaggtgtggaacgagcgcaactcggccaataagatccaatgcattgaatactgattcagataacgctagcgttagggtaccagttggaaattcaactgaggttgaaaatgcaaccagtcagttaacagggacttcgggaaaaagacgcaaggggaacagaaaaagaattacagagttcaaagatgctcttaatttgggtccatcttttgcagattttgtttcaggtaaagcttcgaaaatgatcttggaccctctggagaaggcaaggcaaaatacagaggaagctaaaaaactacctcgttggcttaaggttcctattcctaagggtaccaattaccataaattgaaaggcgacgtaaaagaattaggcctgagtactgtttgtgaggaggcaagatgtcccaatattggtgaatgttggggaggcaaagataaatctaaggcaacggcaacaattatgctgcttggtgatacttgcactcgtggatgtaggttttgttctgtgaagaccaatagaacgcctagtaagccggacccaatggagcccgaaaatactgccgaagctatcaaaagatgggggttgggttatgttgttttaactaccgttgatagggacgatttagtcgatggtggtgctaatcacctggccgagacggttcgcaaaatcaaacagaaggcaccaaatactcttgtagagactctttctggtgatttcagaggtgatttgaagatggtggacattatggcacaatgtgggcttgatgtttacgcacataatttggaaacagttgaatcactaacaccacatgtcagagacagaagagctacttatagacagtctttgagtgttttagaaagggcaaaagctacggttccgtcactgattactaaaacatcaataatgctgggtctaggagaaactgatgagcaaattactcaaactttgaaggatttgcgcaatattcaatgtgatgttgttacatttggtcaatatatgaggccaaccaagagacatatgaaagtcgtagaatatgtgaaacccgaaaagtttgactactggaaagagagagctttagagatgggattcttgtattgtgcatctggacccctagtaagatcgtcatataaggctggtgaagcatttattgagaacgttttgaagaaaagaaacatgaaataa

SEQ ID NO: 2929 - DNA, 1245 bp, Saccharomyces cerevisiae
atgtctgaagctcaagaaactcacgtagagcaactaccagaatctgttgtcgatgccccagtcgaagaacagcaccaagaaccaccacaggctccagatgctccacaagaaccacaagttccacaggaatctgctccacaggaatctgctccacaagaaccaccagctccacaagaacaaaatgacgttcctccaccatctaatgctccaatttatgaaggcgaagaatcccacagtgtccaagactaccaagaggcccaccagcaccaccaaccacctgaaccccaaccatattatcctcctcctcctccaggtgaacacatgcacggtcgcccaccaatgcaccaccgtcaagaaggagaactctcgaacaccagattgtttgttagacctttcccattggacgttcaagaatccgagttgaatgaaatctttggtccatttggaccaatgaaggaagtcaagatcttgaacggcttcgcgtttgttgaatttgaagaagcagaatccgctgccaaagccattgaagaagttcacggtaagagttttgctaaccaacctttggaagttgtttactctaaattgcctgccaagagataccgtatcaccatgaaaaacttaccagaaggttgttcatggcaagatcttaaagatttagccagggaaaatagtttagaaactactttttctagcgtcaataccagagattttgatggtaccggtgctctagaattccctagtgaagaaatcttggtcgaagctttggagagattaaacaatattgaattcagaggttctgtcattactgttgaaagagatgacaatcctccaccaatcagaagatcaaatagaggtggcttcagaggtcgcggcggcttcagaggcggcttcagaggtggcttcagaggcggtttctccagaggcggcttcggtggccccagaggtggatttggtggtccaagaggtggttacggtggctattccagaggtggctacggtggctactccagaggcggatatggtggctccagaggtggttacgatagtcctagaggtggttacgatagtccaagaggtggttattccagaggtggctatggtggtccaagaaatgattacggtcctccaagaggtagctacggtggttcaagaggtggttatgatggtccaagaggcgattatggtcctccaagagatgcatacagaaccagagatgctccacgtgaaagatcaccaaccaggtaa

SEQ ID NO: 2930 - DNA, 1245 bp, Saccharomyces cerevisiae
atgtttgtcagggttaaattgaataaaccagtaaaatggtataggttctatagtacgttggattcacattccctaaagttacagagcggctcgaagtttgtaaaaataaagccagtaaataacttgaggagtagttcatcagcagatttcgtgtccccaccaaattccaaattacaatctttaatctggcagaaccctttacaaaatgtttatataactaaaaaaccatggactccatccacaagagaagcgatggttgaattcataactcatttacatgagtcataccccgaggtgaacgtcattgttcaacccgatgtggcagaagaaatttcccaggatttcaaatctcctttggagaatgatcccaaccgacctcatatactttatactggtcctgaacaagatatcgtaaacagaacagacttattggtgacattgggaggtgatgggactattttacacggcgtatcaatgttcggaaatacgcaagttcctccggttttagcatttgctctgggcactctgggctttctatcaccgtttgattttaaggagcataaaaaggtctttcaggaagtaatcagctctagagccaaatgtttgcatagaacacggctagaatgtcatttgaaaaaaaaggatagcaactcatctattgtgacccatgctatgaatgacatattcttacataggggtaattcccctcatctcactaacctggacattttcattgatggggaatttttgacaagaacgacagcagatggtgttgcattggccactccaacgggttccacagcatattcattatcagcaggtggatctattgtttccccattagtccctgctattttaatgacaccaatttgtcctcgctctttgtcattccgaccactgattttgcctcattcatcccacattaggataaagataggttccaaattgaaccaaaaaccagtcaacagtgtggtaaaactttctgttgatggtattcctcaacaggatttagatgttggtgatgaaatttatgttataaatgaggtcggcactatatacatagatggtactcagcttccgacgacaagaaaaactgaaaatgactttaataattcaaaaaagcctaaaaggtcagggatttattgtgtcgccaagaccgagaatgactggattagaggaatcaatgaacttttaggattcaattctagctttaggctgaccaagagacagactgataatgattaa

SEQ ID NO: 2931 - DNA, 1248 bp, Saccharomyces cerevisiae
atgaaaaggtccacgttgctgtcgctggacgcattcgctaagaccgaagaggacgtacgagtccgcaccagggccggcgggctgatcactttatcgtgcatcttgaccacgttatttctgctggtgaacgagtggggacagttcaattctgtggtaacaaggccacaattggtggtggaccgtgaccgacacgcaaagctggagcttaatatggatgtgacatttccatcgatgccatgtgacctggtgaatctcgatattatggacgactctggagagatgcaactagacattcttgacgcagggttcacgatgtctaggttgaatagcgagggtcgccccgtgggagatgctactgagttgcatgtgggtgggaacggcgacggaaccgcgccggttaataacgatcctaactattgtgggccatgttacggtgccaaagatcagtcgcagaatgagaatctagcacaggaagagaaggtttgctgccaagactgtgatgcagtgagatcagcatacttggaggcaggctgggcttttttcgacgggaagaatatcgagcagtgtgaaagagagggctatgtcagcaagattaacgagcacttgaatgaaggctgcaggatcaaaggttctgcacaaattaacagaattcaggggaatcttcactttgcccctggaaaaccctaccagaatgcatatggacattttcatgatacttctttgtacgacaagacttcgaatttgaacttcaaccacatcatcaatcatttgagctttgggaagccgatccagtcccacagtaagttgttaggaaacgataagcgccacggcggcgccgtagttgccacttctcccttggacggacgccaggtgttcccggacaggaacacacactttcaccagttctcgtattttgccaagattgtccccaccagatatgagtacttggataatgttgtcattgagaccgcgcagttcagcgccacttttcattcccgacctcttgccggtggaagggacaaggatcatccaaacacacttcacgttaggggtggtatccctggtatgttcgtctttttcgaaatgtctccattgaaagtcatcaataaggaacagcacgggcagacttggtcgggcttcatcttgaattgtatcaccagcattggtggtgtcctagctgtgggcactgtcatggacaagctattctacaaagcacagagatcgatctggggcaagaagagccagtag

SEQ ID NO: 2932 - DNA, 1248 bp, Saccharomyces cerevisiae
atgaacaactcaaagactaaccaacagatgaacacctcaatggggtaccccttaaccgtctacgatgaatgtaacaaattccaactaattgtgccaactttagatgcaaatatcatgctttggtgtattggacaactttcactgctgaatgattctaacggttgtaagcatttgttttggcaaccgaatgacaagtcaaatgtccgaatcttactaaataattatgactatggtcacttgttcaaatacttgcaatgtcaaagaaaatgctcagtttatatcggagaaggaacgcttaagaaatataatttgactatttctacatcctttgacaactttttggacctgacgccctccgaggagaaggaaagcttatgtagagaagacgcacacgaagatcccgtatctccaaaggctggttccgaagaagagataagccctaattccacctctaatgtggttgtgtcaagagaatgcttggataacttcatgaaacaactccttaagttggaagaatcgttaaataagttggaattggagcaaaaggtcacaaataaagaacctaaccacagaataagcggtacgattgacataccagaagataggtccgaactagtgaactttttcacagagttgaaaacagtcaaacaacttgaggacgtttttcaacgttaccatgactatgagaggttatcacaagaatgtgacagtaagacggaaatcgcctctgaccattcgaaaaaggaaactaaaatagaagtggaacccccaaatgagcgctcattgcaaatcacaatgaaccaaagggacaattcattgtatttccagttgtttaacaacacaaactctgttttggcaggcaactgcaaactgaagtttactgacgctggcgataagccaaccacgcaaattattgacatgggtcctcatgaaataggaataaaggagtacaaggaataccgatactttccatacgcacttgatttagaggccggctccactatcgagattgaaaatcagtatggagaagtgatcttcttgggcaagtatggctcttctccaatgattaacttaaggccaccttcaagattatctgcagaaagtttacaggcatcccaagagccattttactcctttcaaatcgatacgttaccagaactggatgactctagtatcatcagtacatccatttcactctcttatgacggtgacgacaatgaaaaagccctgacttgggaagaactctag

SEQ ID NO: 2933 - DNA, 1248 bp, Saccharomyces cerevisiae
atgcttgaatcgagcagtgataagataaagtttgcgcctattaaagaggtagattacaaaaaaccggtaagtaagagtaagaactatactcttattaatgacatccaaccattggagtggtattgtcacaatgatagtgaaacgggctaccaacacaccataagtaacaagacagatggtggtagaggtttattcagagtgatgaaaaaatcgatggagaccagagtcgagacccaaacgttatatttcacagatttgcatacaggcttgtgtggatttgttcaattactgtattctacggttatgggtggtatctataaaggcttccaattgaatttcaaggtttttggctcagaaagtaataatactgactacgacgtttgggaaagttttaaattggatgacatagctgaatttcaaccattaaagtttgtctctagaaatgttatttttgaatttttgagcaacaaaaatgaaaaattaggttccattggccagttatctatcaaatgtgatttaccaacatgtaacaatacaattcaaaatttgaaaatcgatttgttggtggatttgtttcaaggttttaagatgaaccccaacggttgcaattattattttgacaaacaaatctcgatgagtgacgaattcgtttcctcagacaaaatgatcagacatgtttttgtgcccagaggtaaatgtaatggtaatatttcctacgataaaaaactcaatagtggggactttcaaaataaaaatatttcattaactgatgttcctgtcgtttatctggacgctgttcaaggtcttttgccgaataaagcagccagtaaatggaatttcctatgttttcagagcgaaaactactctgttttagcaattgaattcactactcctcgagatcatgataacgtcaccgtaacagtttggtcaattactgaaaaaaacaaactgatatctattggttcttctgtgcagagcccaaaacgtcatgttaggttccgtgctacgagtacagataaggaaagcggctgggtatatccaacctctatcaagttccccggtggattttcagaacacgacttgaggctggttaatcgatacgacgttctcggtgagttaccaagcatggtcaggtcgttagctcagaaaattgtgagcatcaaacctttcatttatcaatactgtcaaccttctaaatataagcacgagaaaggtatttctatcgttgagagcaccttcattagttga

SEQ ID NO: 2934 - DNA, 1248 bp, Saccharomyces cerevisiae
atgggtactacgacaagtcatccagcccaaaaaaagcaaacaacaaaaaagtgtcgtgcacctatcatgagtgacgttagagaaaaacccagcaatgctcaaggctgcgaaccgcaagaaatggatgctgtgagcaagaaagttactgaactgagcttaaataaatgttcagattcccaagacgcggggcagccttcaagggagggatctattaccaaaaaaaaatcgacgttattgctgcgtgatgaggacgagcccactatgccaaagctatctgttatggaaactgctgtggacactgactctgggtcttcgtctactagcgatgatgaagagggagatattattgcccagacgacagagcccaagcaagatgccagtcctgatgatgatcgctcaggccattcttcgcccagagaggagggacaacagcaaatacgtgccaaagaagcttcgggaggtccaagtgaaatcaagagctcattaatggttcccgtggagataaggtggcagcaaggtggttcaaaagtttacgtgacaggctcattcaccaaatggaggaaaatgatcggtttgatacctgattctgacaataatggctcatttcatgtgaagctaaggctgcttccaggcacacatagattcagatttatagtggataatgagcttagagttagtgatttcctgcccacagcaactgatcagatgggaaacttcgtcaattacatagaagtcaggcaaccagaaaaaaacccaactaacgaaaagataaggtccaaggaagcagattccatgcgacctcccaccagcgatcgatcctcaattgctctacaaattggtaaggatccagacgattttggtgacggatatacaaggtttcatgaagatctgtcacccagacctccgttggaatatacaacagacattcccgccgtgtttactgacccgtctgtcatggaacgatactattataccttggatcgtcagcaaagcaatactgatacgtcatggctgacaccaccccaattacctcctcagttggagaatgttatcttgaataaatactatgccacgcaagaccagttcaacgagaacaactcaggcgctctgcccattccgaaccatgtggtgcttaaccacttggttactagtagcattaagcacaatacactttgtgtagcctccatcgttcgatataaacagaaatatgtcacccagattctttatacgcccatagagtcctcgtaa

SEQ ID NO: 2935 - DNA, 1248 bp, Saccharomyces cerevisiae
atgtccggaataattgacgcatcttctgcattaagaaaaagaaagcatttgaaaagaggtataaccttcactgtgatgatcgtgggccagtccggatctggtagatcgacttttataaatactttgtgcggtcagcaagttgtagacacttcgacgacaatcttgttacccacagatacgtccacagaaatagacttacaattgagagaggagacggtcgaattagaagatgatgaaggtgtcaagattcaacttaatatcatcgatactccgggattcggtgattctctcgacaattctccatctttcgaaatcatttccgactacattcgccaccaatatgatgaaatcttattggaagaaagtcgtgtgagaagaaacccaagatttaaggacggcagagttcattgttgtctttacttaatcaacccaactggccacggtttaaaagagattgatgtggaattcatcagacagttgggatccttagttaacatcatccctgtgatcagcaaatcagattccttgacaagagatgaactgaaactgaataaaaaattgatcatggaggatatcgacagatggaacttgccaatttataatttccctttcgatgaagatgaaatatcagacgaagattacgaaaccaatatgtacctacgtacacttctaccttttgctattattggatccaatgaagtttacgaaatgggcggcgatgttgggacaattcgtggcagaaagtatccatggggcatactggacgtggaagattcatcgatctctgattttgttatcttaaggaatgcgttattgatctctcatttacatgacttgaaaaactacacacatgagatattatatgaaagatatagaaccgaggcattatcaggtgaatctgtcgcggcagaatccatacgtccaaatctgacaaaattgaatggttcgtcgtcatcgtccaccacaacaaggagaaacacaaatcccttcaagcaaagtaataatattaataacgatgttctcaacccagcatccgatatgcacgggcaaagcactggcgaaaataacgaaacctacatgacacgtgaggagcaaatacggttagaagaagagcgactaaaggcatttgaggagagagttcagcaagaactgctgttgaaaagacaagaactgttgcaaagagaaaaggaattaagagaaattgaagccaggttggaaaaagaggcgaaaatcaaacaggaagaatga

SEQ ID NO: 2936 - DNA, 1248 bp, Saccharomyces cerevisiae
atgtccgtgaaaaggtctgtttctgaaatcgaaattgaaagtgttcaagatcaaccctctgttgccgtgggaagtttcttcaagggcttccgtgctcccagtgacactacgttcgacttatacaaaaaaaagaagtctgaaaaggacgaattcgtattacacggtgaaaacgagagactagaatacgaaggttatactgattcttcttcccaagcttcgaaccagtatgttgtgggcctatttaatccagaaaagaaaagtattcaactctacaaggctcccgtacttgtttccaaagttgtatccaagtcaagcaagaatctaaggggtccaaaaataaaaagtaagagtgatactcgtccatctgctttgagaaatgcgttgggtgaagcgtttggtactaaaaaggctaaaaaagctattgcagatctagaaagaaaccgtattgactctgataagttgactgattctgctattgacattgtggattccgtgagaactgcatctaaggatttaccaactcgggctcaattggatgaaattacttccaacgatagacctactccattagccaatatcgatgccactgatgtagaacaaatttacccaattgaaagtataataccaaagaaggaattacagtttattcgcgtttcatcaattctgaaagaagcggataaggaaaagaagttggaattgttcccataccaaaacaattccaagtatgtggcaaagaaattggactctttgacacaaccttcacaaatgaccaaattacagctactatactacttatcactattactgggcgtatacgaaaatagacgcgtgaataacaagacgaagttgttagaaaggttgaacagtcctcctgaaatcttggtagatggtatcttaagcagatttaccgtgataaagcctggacagtttggaagatcaaaggatcgctcctatttcattgacccacaaaatgaagataaaatcttatgctacatcttggcaatcataatgcatttggataacttcattgttgaaatcacacccttagcacacgaattgaacttgaaaccttccaaagttgtcagtttgttcagggtacttggtgctattgtcaaaggtgccacagtggctcaagctgaggcttttggcattccaaaaagtactgcagcttcttataaaattgccactatgaaagttccatttaagctacctgaaatgacaagaagaggaagaggtccaagacgttag

SEQ ID NO: 2937 - DNA, 1248 bp, Saccharomyces cerevisiae
atgtctcaaggtactttatatgctaacttcagaattagaacttgggtcccaagaggtcttgtcaaggctttgaagctggacgttaaggttgttacgccagatgccgccgctgaacagttcgcaagggactttcccttgaagaaggttccggctttcgtgggtccaaagggttacaagctaaccgaggcaatggcgattaactattatttagtaaagctttcacaggacgacaagatgaagactcaacttttaggtgccgacgatgacttaaatgcccaagcgcaaatcatcagatggcaatctttggccaacagtgatctgtgcatccagattgccaacaccatcgttcccttgaagggcggcgccccctacaacaagaagagcgttgattctgcgatggacgctgttgacaagatcgtcgacatcttcgagaacagattgaaaaactacacctatttggctacggaaaacatctccttggccgacttggtggctgcctcgattttcaccagatactttgaaagcctgttcggtactgaatggagagctcaacatccagccatcgtgagatggttcaacaccgttagagcctcacccttcttgaaggatgaatacaaggatttcaagttcgctgacaagccattgagtccccctcaaaagaagaaggaaaagaaggccccagccgccgctcccgccgcttcgaagaagaaggaggaagccaagccagctgctaccgaaactgaaacttcttccaagaaaccaaagcacccattagaattattgggcaagtcaactttcgttttggatgactggaagagaaagtactccaatgaagacaccagaccagttgctttaccttggttttgggagcactacaacccagaagagtattccctgtggaaagtcacctacaagtacaacgatgaattgactttgactttcatgtccaacaacttggtcggtggtttcttcaacagattgtccgcctctaccaagtacatgttcggttgtctggtagtctacggtgaaaacaacaacaacggtattgttggtgcagttatggttaggggccaagattacgttccagctttcgatgtcgcaccagattgggaatcttacgactatgcaaagttggatccaactaacgacgacgacaaagaattcatcaataacatgtgggcctgggataagccagtttccgtcaatggcgaaccaaaggaaattgttgacggtaaggtcttaaaataa

SEQ ID NO: 2938 - DNA, 1251 bp, Saccharomyces cerevisiae
atgaaagcaaagtcgatgaagagcataatatctgtgccaatatcagtgtctaaaacagggaaaatgaagttaacagcatctcccgataatctagcatctatgatgtctaaagaccaaaataaacttattcatttagacccagttccgtcttttgaggacaggcacgagattaaaccgtggctacagaaaatattctatcctcaaggaatagatatagtcatcgaaagatcagatagtagcaaagttacttttaagtgtaggtcagtacgatcgaaagtagggttgaaccctaaatccaaaggttcctcttcaagatcccatgcatgtccatttagaattagagcagcctactctgtgcggttacagaagtggaacgtggttgttatgaataacatacattcacatgagctgagatttgatttgattactaaaacggatgactataaaaagtttaaggaaaatcttcgtcagaagaacgacgaaaaagccatcaaaacatttgatgaattagaatataaagcaagtctaaacttaccactcgtcacaccaattatttcttgtgactgtgggttaaccaaggaaattgaagctttcaataacatttttctcccactatcaaacccccctttgacgtctaaaaaaaatttgctcaaaacaaataaaaactccgtttctaaaataaaatccagacagatggataattcgaaacctaggccaaggttgaaaacgaagttggatgcggatctacatgataccggatttttagacaatttcaaaacgcggaattcctgtgtaaagatagagaaagaagattctttaacgaacttaaacgaaattgattttacgaacatgttttgcaacgacaatttcatccaaaattacaaccaaggcctgatggaacttttgacagaacctacaccaggtccttcgtcctcttcttgtatacttccttcaacaccaacgaggcccttgtcacaaagcaaaatggatatagccctgtcagaatcaacaacatcttcaccaaattttatggaaacagacgctccttatggagatgagatcattaaagtttccaaagataccaaaagcaacgcaccaactgctgatacagatattgctacgaacttaggcaaagagagaaacgaaaattttggcatgttaaactacaactacgaagcgttgcttcatttcaacgatgagcattttaatgaattaaattctattgacccagccttaatatcaaaatattaa

SEQ ID NO: 2939 - DNA, 1251 bp, Saccharomyces cerevisiae
atgcctatggttaccgtgaagtataacttccaacttttcaaatgtaaagtttcgttgaattcaacactaaacgatgtgttacaccaatccatacaattctttcaactgcacacctcgtcaaacgactggtcattgatacatttggataaaccggtgccattagatttgccatggaggcttctaaacttaccaacgggtgtcaacttagaattatctaaaagtagtaattttccggtggcgaataagaccaaccgcgaagatattccattcaatacgatcaaaatacggtttcaaatcccaggaagagattccgtggttaaagaaatgccatctgaccaaccaattgcccctatcttgcgacagatgagcggcgctgcgggagatgattttaagatccaggtcttttccaagataatagagttcaaaacaattaaggatgagaatttgactctcgaaaatttagggattcaggagccttcgtcagttagattgatttttaataatacatctcattctgagggcattagcgctaatagcgctattcacccaaaacaaactccccctacgatgacgaacccggaaacggttgcttcactaccacctcacgaactacataaaccttctgtgtttttgccctcggatgagccattagcagttatcaaggatcaaatcgaggatgaagaagattatgaattgacagtagaacaagccaagaaataccaaaaaatgttatcatcgaaggctggtactttgggtggtcctattttgacaaagagacttagagagcaatcagccaacaacttgccaaagaaaaataaggctatatctgagtgtttgctgagagtcaagttccccgatagaagccatattcaaatagcattcaaacccaatgaagacatgcgtacagtttataacgtcgtgtcgcagttcctgatcgatgagaacatgccttttacgttaaaccaatctcatcctttcaaacccttggctaaagacgataagaagctactggatgacctggaatttggctctaaaacaatgctgctttttgaaacaaattcaaattctaatggcccattaataaaggctcatcttttggaagacgcacaaaaaatcacacacgaaacgaggacaaccccatcagttaatacgataaataaatccaatccacagggcccttctgataacgctacaagtatcaaaaagactttaaatagagtacctaaatggatgaaattaagtaaaaaataa

SEQ ID NO: 2940 - DNA, 1251 bp, Saccharomyces cerevisiae
atggtatcttctttgcccaaggaatcgcaagccgaattgcaactgttccagaacgaaatcaacgccgctaatccgtccgactttcttcagttctccgccaactatttcaataaaaggctggaacaacagagagcgttcctcaaggccagggagcctgaatttaaggcaaagaacattgttctatttccggaaccagaggagtcattttccagacctcaatcagctcaatctcaatcaagatccagatcgagtgttatgttcaaatccccctttgtgaacgaggacccacactccaacgtgtttaaaagtgggtttaatttagacccgcacgaacaggacactcaccagcaagcacaggaagaacaacagcatactagagaaaagacatcaactcctccactcccaatgcacttcaacgcccaaaggcgtacttctgttagtggtgagaccttacaaccaaacaattttgacgattggactccagatcactataaggaaaagtccgagcagcaattgcaaagactggaaaaatcgatccgtaataactttctgttcaacaagctggattccgactcaaaaaggctggtcataaattgtctggaggagaagtccgtccccaaaggtgctacgataatcaagcaaggtgaccaaggggactacttctatgtcgtcgaaaagggtactgttgacttctacgtcaacgacaacaaggtcaactcttccgggccaggctccagtttcggggaacttgctcttatgtacaacagccctcgtgctgccaccgttgtagcaacctccgactgtttgttgtgggctctagacaggctcaccttcagaaaaatacttttgggcagctctttcaagaagagactcatgtatgacgatcttttgaagagcatgccagttttgaagagtttgactacgtacgaccgtgccaaacttgccgatgcactggataccaagatctaccagccgggtgaaacaatcattcgcgagggtgatcaaggggagaacttttatttaattgagtacggagctgtggacgtctctaagaagggccaaggtgtcataaataaactgaaagaccatgattatttcggtgaagtggccttgctaaacgatttgcccagacaggccactgtgactgctacaaagagaaccaaagttgccacattggggaaaagtggttttcaacgtttactgggtcctgcagtagacgtattaaagctcaatgatcctacaagacattaa

SEQ ID NO: 2941 - DNA, 1251 bp, Saccharomyces cerevisiae
atggtgacaagacatagagtgactgtactctacaatgcccctgaggatatcggtaatcatatgcgccaaaatgacactcatttgactgttcgtggaggttctggtgtggttttacaacaaaggtggctattagagaggactggaagcttggataaatcctttacgagaatcacttggaggcccagagcggacttggctagaagtttaagcgttatagaaaatgaactgagtgctggcttttcagtttactcaaattcttcggatgtgccggaaaggtttattactaacccagtctacaattcatttcacagtgagaagtttgacatagagcagtacttgcctcccgaagtagatttgaatctgtcatggaatccagaagattttacatatgatatatcagtggagcccacacaaatccaaattgttgaatatcgtctgttgaaacagggtgaagaatttacaattgcaagagtgaaagatgagaaactcgaagtaggtgtattctttgtggatgcaagtgatgaaagtgatgtcgatattggtggaatacgttgtaattggaggatggacgatggtaaaatggaaagatgtcagaaaacatccttattgtataaacagggccatatcgcatacaatcactcgacgactacgacatcactatatctgaatgaacctatcggtttgcatccaaaaatcatgattgatctcacagatttcgaagaacgccctaaatgcatgtatctaatgcacctgcaattgccgttagaattatttatcgataaattccaatcctctcccttactactttttggagaagacgacttagaattaccagaatactctcttcgagataaggcatggggttctgaaagtatctttgaattgaaagccggcacaatgaatgaagtgacattgcatactagatatattgagccttctaataataaaggggataaattagaagtttcatttgatccagaagttatattagcctgcgacacaggtgacaataaagtttcccgtaatccattttataaaaaaggtctaggatatgaatctctctttacagacgatactacattccgccatttgaactcgacaactcttctagtaccaattccaaggcctgacacaaaggattattccaagatcaaaaatggtacgttactatgcttactcatctccatcatatacattttctccaaggtatttggtaacaacaagaagaaaagatcagtaaaacgggaataa

SEQ ID NO: 2942 - DNA, 1251 bp, Saccharomyces cerevisiae
atgtctactaatactgttccctcatctcccccaaaccagacgccacctgctgcttctggcatcgctacctctcacgatcacaccaagttcaacaatcccatcagactaccgatatccatctctctcaccattaacgatacgcctaacaataacagcaataataatagcgttagcaatggtttaggtattttgccctcgcgtacggctacttctttagtcgttgcaaataacggtagcgcaaacggcaatgttggtgctactgctgctgctgctgccactgtggagacgaatacagcccccgcggtgaacactacaaagagtatccgccatttcatatatcctccaaaccaagtcaatcagacggagttttcacttgatatacatctcccaccaaatacctcgctaccggaacggatagaccaatctactttgaaacgcagaatggacaagcacgggcttttcagcattaggctaaccccgtttatagatacttcatccacgtctgtggctaaccagggtcttttctttgaccccattatcaggactgcgggcgcaggctcgcaaattatcatcggaagatacaccgaaagagtaagagaggcaatttccaaaattccagatcagtatcatcccgtagtgttcaaatcaaaagtgatatccaggacccatgggtgtttcaaagttgatgaccaaggaaactggtttttgaaagatgtcaagtcttccagtgggacctttttgaaccaccagcgtctatcttctgcgtctaccacttctaaggactaccttttacatgacggagatatcatacagctgggtatggactttcgcggcgggacggaagagatatatcgttgtgttaagatgaaaatagaattgaacaagtcttggaaattaaaggccaatgcatttaataaagaagccttgagccgaataaaaaatctacagaaactaactactggtttagaacaagaagactgttccatttgtctaaacaaaataaaaccttgccaagccatttttatatcaccatgtgcccatagttggcattttcattgtgtaagaagattggttattatgaattatcctcaattcatgtgtccgaactgtaggacaaactgtgatttggagactaccttggaatccgaatctgaatccgaattcgaaaacgaggacgaagatgagccagacattgaaatggatatagacatggaaataaataacaatttaggtgttcgcctagtagattga

SEQ ID NO: 2943 - DNA, 1251 bp, Saccharomyces cerevisiae
atgtctttatcttcaaagttgtctgtccaagatttggacttgaaggacaagcgtgtcttcatcagagttgacttcaacgtcccattggacggtaagaagatcacttctaaccaaagaattgttgctgctttgccaaccatcaagtacgttttggaacaccacccaagatacgttgtcttggcttctcacttgggtagaccaaacggtgaaagaaacgaaaaatactctttggctccagttgctaaggaattgcaatcattgttgggtaaggatgtcaccttcttgaacgactgtgtcggtccagaagttgaagccgctgtcaaggcttctgccccaggttccgttattttgttggaaaacttgcgttaccacatcgaagaagaaggttccagaaaggtcgatggtcaaaaggtcaaggcttccaaggaagatgttcaaaagttcagacacgaattgagctctttggctgatgtttacatcaacgatgccttcggtaccgctcacagagctcactcttctatggtcggtttcgacttgccacaacgtgctgccggtttcttgttggaaaaggaattgaagtacttcggtaaggctttggagaacccaaccagaccattcttggccatcttaggtggtgccaaggttgctgacaagattcaattgattgacaacttgttggacaaggtcgactctatcatcattggtggtggtatggctttcaccttcaagaaggttttggaaaacactgaaatcggtgactccatcttcgacaaggctggtgctgaaatcgttccaaagttgatggaaaaggccaaggccaagggtgtcgaagtcgtcttgccagtcgacttcatcattgctgatgctttctctgctgatgccaacaccaagactgtcactgacaaggaaggtattccagctggctggcaagggttggacaatggtccagaatctagaaagttgtttgctgctactgttgcaaaggctaagaccattgtctggaacggtccaccaggtgttttcgaattcgaaaagttcgctgctggtactaaggctttgttagacgaagttgtcaagagctctgctgctggtaacaccgtcatcattggtggtggtgacactgccactgtcgctaagaagtacggtgtcactgacaagatctcccatgtctctactggtggtggtgcttctttggaattattggaaggtaaggaattgccaggtgttgctttcttatccgaaaagaaataa

SEQ ID NO: 2944 - DNA, 1254 bp, Saccharomyces cerevisiae
atgaacgaagcagatgttacaaaatttgttaataatgccaggaaaacgctgaccgatgctcaacttttatgttcaagtgctaatttaaggattgtagatattaagaaaaaattgtcatcttggcagttgagtatttcaaaactcaattttctaatagttggcttgagacagcaaggaaagtttctttacactattttaaaggaaggcattgggacaaagctaatccagaaacaatggaatcaagctgtcttagtggtcttagttgatgagatgaagtactggcaatatgaaatcacttctaaagtacaaaggttggatggtatagtaaatgaattgagcatatcagaaaaagatgataccgatccctctaaactaggagattacatctcgagagacaacgttaacttattgaatgacaaactgaaagaagtgccagtaattgagcgtcaaattgaaaacattaagcttcaatacgaaaatatggtcagaaaagttaacaaagaactgattgataccaagttgacggacgtaactcaaaaattccaaagtaaatttggtatagataacctgatggaaacaaatgttgcagagcagtttagcagggaactaacggaccttgaaaaagatttagcagagataatgaattcattgacacagcactttgataagacattgctgttacaagataaaaaaattgataacgatgaacgtgaggagctgtttaaggtggtacaaggcgacgacaaagaactatacaacattttcaaaactctgcatgaggtaattgatgacgtggacaaaacaattcttaacttgggtcaatttttgcaggcaaaaataaaggaaaagacagaactacacagcgaagtttctgaaataataaacgatttcaatagaaatttggaatatctattaatctttaaagatatttccaatctgattgatagcttcaaaaattcctgtacacaagatattcaaacaactaaggaactttgtgaattttatgataattttgaagaaagctacggtaacttagttctagaagcaaagaggagaaaggatgtggcaaacagaatgaaaactatattgaaagattgtgaaaagcagttgcagaatttagatgctcaggaccaggaagaacgtcagaattttatagcggaaaatggaacttatcttcctgagacaatctggcccggtaaaattgacgatttttcttccctgtacactttaaattacaacgtgaagaatccttag

SEQ ID NO: 2945 - DNA, 1254 bp, Saccharomyces cerevisiae
atgactaagaccatcacagttgctcatatccagtatgattttaaagctgttctggaagaaaatgatgaaaatgacgatgaattttacatcaatgttgacaaaaacctaaatgaaatcaaggagcataagatagtagtgttaggaaatagcaggggtgtagatgcaggcaaaggaaatacatttgaaaaggttggctcccacttatacaaggcgcggttggatggacatgattttttattcaatactatcataagagatggttcaaagatgctcaagagggcggattatactgccgtagacacagctaaacttcagatgagacggttcatattaggcactacagaaggcgatattaaagtattggattcaaatttcaaccttcaaagagaaattgaccaagctcacgttagtgaaataacaaaactaaagttttttccaagcggtgaagctttgatatctagttcacaggatatgcaattaaagatctggtcagtaaaagacggctcaaatcctcgcacgttaattggacacagggcgacagtcacagatattgccataatagaccgaggaaggaatgtgctctctgcctctttggatggtacaattcgcctttgggagtgcggcacaggaacgacaattcacacgtttaacagaaaagaaaacccgcatgatggtgttaacagcatagcgctgttcgtagggacagacagacaattacatgaaatttctacttccaagaaaaataatctagagtttggaacatatggaaaatatgtgattgctggtcacgtttctggtgttattactgtacataatgtattttccaaagagcaaactattcaactcccaagcaagttcacatgttcatgtaattcattgacagtcgatggcaataatgcaaactatatttatgccggatatgaaaatggaatgctagctcaatgggatctaagatcaccggaatgcccagttggtgagtttttaattaatgaaggcaccccaataaacaatgtctactttgcagccggagccttatttgtatcttctggattcgacaccagtattaagcttgacattatttcagacccagaaagtgaacggcccgctattgaatttgagacgcccacctttttagtttccaatgacgatgaggtcagccaattctgttacgtttctgatgatgaatcaaatggggaggtgcttgaagttggaaaaaacaacttctgcgctttgtataacttaagtaatccttaa

SEQ ID NO: 2946 - DNA, 1254 bp, Saccharomyces cerevisiae
atgagagccttagcgtatttcggtaaaggtaacatcagattcaccaaccatttaaaggagccacatattgtggcgcccgatgagcttgtgattgatatcgaatggtgtggtatttgcggtacggacctgcatgagtacacagatggtcctatctttttcccagaagatggacacacacatgagattagtcataacccattgccacaggcgatgggccacgaaatggctggtaccgttttggaggtgggccctggtgtgaaaaacttgaaagtgggagacaaggtagttgtcgagcccacaggtacatgcagagaccggtatcgttggcccctgtcgccaaacgttgacaaggaatggtgcgctgcttgcaaaaagggctactataacatttgttcatatttggggctttgtggtgcgggtgtgcagagcggtggatttgcagaacgtgttgtgatgaacgaatctcactgctacaaagtaccggacttcgtgcccttagacgttgcagctttgattcaaccgttggctgtgtgctggcatgcaattagagtctgcgagttcaaagcaggctctacggctttgatcattggtgctggccccatcggactgggcacgatactggcgttgaacgctgcaggttgcaaggacatcgtcgtttcagagcctgccaaggtaagaagagaactggctgaaaaaatgggtgccagggtttacgacccaactgcgcacgctgccaaggagagcattgattatctgaggtcgattgctgatggtggagacggcttcgattacacatttgattgctccgggttggaagtcacattgaatgctgctattcagtgtctcactttcagaggcaccgcagtgaacttggccatgtggggccatcacaagatacagttttctccgatggacatcacattgcatgaaagaaagtacacagggtccatgtgctacacacaccacgattttgaggcagtaatagaagctttggaagaaggcaggattgacattgatagagcaagacatatgataacgggcagagtcaacattgaggacggccttgatggcgccatcatgaagctgataaacgagaaggagtctacaatcaagattattctgactccaaacaatcacggagagttgaacagggaagccgataatgagaagaaagaaatttccgagctgagcagtcggaaagatcaagaaagactacgagaatcaataaacgaggctaaactgcgtcacacatga

SEQ ID NO: 2947 - DNA, 1254 bp, Saccharomyces cerevisiae
atgataatatttaatgggaacaaatatgcgtgtgcatcgtgcatcagagggcatcgctcttcaacatgcaggcattctcaccgaatgctaattaaggtgagaactagaggaagaccttcacccatggctatcagagacgctattttagtagactctacatcgcaaagtacagaatacgaaaatggtgcacaaattgaaggtgactgctgcagcgcaatgaatcaacagccaatactgtttgtacgtgcctctgctgttagaaaggcaagaatgataaacggaaaattgcatatattaatggaggaaggtttcactgctcatgagcctaaagatattagcacatttaccgatgatggtaacaaatatatcaccgaaacggagtttcttaggaaacactctcccaaagctccggcaacaggaacaatatctccggactctaccaagtcatcttcttcaagtgagaagaaagagcgaagccggcttcaacaggagcctatacgacatttttcaaactgctgtaagaaagataaatcacagaacccagcttctaatggcaagacgaacaaggcaccgtctgatgacatatttacgccatacggctccttggaatctacgtccgcttttaacgatattttacaagaaaactacaatagttctgttcctggtgcgcatgacagttcagaaacactcaccccacaaagtacaacaacgattgctgctcctcattcaagcgacgttgcttcgaaagttgaagtcctgactcataagggcatttttttaagcacgcagtgctcttgtgaagatgaaagctgcccatgtgttaattgtctaatccatagaagcgaagaggaactgaattcttatattcaacaaagtggtgttcctttaaccaatattggtgaagctcaaattactgataagatgatggattatttggatgattgtaaatgcactgacaaggaatgcatatgtcctccggataactgcacttgtgatggatgtttttctcactctacaaatataattccatttgaaaaattctttttctatggaattctgaatgcaagattaacaaggaaaactcaaataaaattcaaaggtaaattggtgccgtcaaaatattggtgggattttttgaagttgcaagtgccattgatgacagatgctcagttagaattacttgacattcatgcgtggtttcaaaaattagtctctaattatgcaccacatctaagcgatgccaccacttcataa

SEQ ID NO: 2948 - DNA, 1254 bp, Saccharomyces cerevisiae
atgctggcaagatatttaaatttaataggacggaggagtgcttcaccgtacagaccacagcggctaccggcaaagtttgacaacgtgatagtggcaatgtcatctggggtagattcctctgtggcggcagcactatttgccggagaatttccaaatacccgaggagtatatatgcagaactggtctgaatcacaatctttggacgaccctggcaaggagccatgctacgagagggattggagagatgtgaaccgtgtcgctaagcatttgaacatccgagttgacaaagttaattttgagcaagattattggatagatgtatttgaaccaatgttgagaggctacagtgaagggtcgacacccaatccagatatcggttgcaacaagttcgtcaagttcggcaagctgagagagtggctggatgagaagtatgggacgggtaactattggcttgttactggtcattacgcccgagttatgcaggaaatgaatggaaaaggattattccatttactgagaagcatttataggcccaaggatcaaagctattacctttcacaaatcaactccactgttttgtcatctttgttgctacccattggccatctaacgaaaccagaagtacgagatttagcgaagtatgcaggcctcccgactgcagaaaagcctgattcacagggcatatgcttcgtcaacaattcccagcatgggaagttcaagaattttttaaagcactacctacccagttcaccgggtgatatcattaccgttgacccacaatccggtgccaaaacgacatggggcagacacgatggattgtggtcttacacaattggacagaaagtgggcatatccatgccacaagctgaccctaattaccaagggacctggtttgtcagtgaaaaactaagggataccaacgaaatcttgatagtcagaggaagagataatccggcgctatacagtgacactatgcgaatcgaaaacttttcgtctttgggccccagggaggacactataaacgctttccaaaatactggtgccttgacattacaattccggtccctgcaggtcccagtccaaattaaatcgtgcaaactgaatcgctctgccgacaacctcgacataacaatacacttagcctcaaaacaacgtgccataactcctgggcaatcgtgctgtctatatatcgacgatagagtccttgggagtgggcccatttcccatgttaataataatgacacccatgcatag

SEQ ID NO: 2949 - DNA, 1254 bp, Saccharomyces cerevisiae
atggatgaagtcttaccattgtttcgcgattctcatattccacagattaaagattatcaattggagttacagaacgatttgactaaaaccaatgaggccttccaaaagaatttgctaaagaactataacaagatcttaagcttgaccgattctgttaatgacttgtcgctcaatttgaaaaatgttgatcaagattttaaatccctgtgtttcaatgatgaaaaatttcagttgaataagttaactccactaccataccaaaccactacccatatatcaccacctcgtgacgaagaaaaagtcagcataccatcgcaaaacattttagtaatttcaaattggaccatctccatcaacaacttctgtaatcgtatagttacttccactactccgtcgcggatattcgacgagctactgttgaatttccacgaattatctttgataccagttccttccaaatttgaagcgcttgtcaaggacaaatgttgtcgactacagaagttcttggtggactctatgaagacattaaacttaactttactacagtgggtaaaactatacaatttactaaacacggagttttcctcgaagtgggacgatgatttactttctatattcaatgaatccctattcgagacactatttaacgataacgttcaagcgttactgatatcaagtgccaacagcaaagatcatcaatatcactccaatcagcaatataaggacgcgattgttgtcgattttgtgaattcgtccacctttagagaccatctcattcggagaaccgtgaaagaaataaacacacatttggatacactctctactttgagagccaagcttaaggagcctgaaactcttcataaattagatatcttccatgataatgatacgaacctcaatgatggcactgtatctccacttgatgatgatgcattgaaacaatatattgatacagcggtattctattcaaaaggtttaaccaatgataccacgttgcaaatttatcaaacggtgcagcctacgattgaaatcctacaaaacttagaattgtataaatgccctcaagagacactgacagatttgagaaataaattgattactcaattgcaagagtttaagactcagatctcatcccgcttaccttcaccactggaaaactcaacgagtgttgtggatgattttataacttcgtacaacaatcacaatctcttgcaattagtcatcgatcaaattactcaattaaggcaacagtaa

SEQ ID NO: 2950 - DNA, 1254 bp, Saccharomyces cerevisiae
atggctggcgacaaccctgaaaacaaggatgcttccatgttagatgtcagtgacgcagctagcaacactacgattaatggtaaacatagcgccgattcaactaatgaggcttccctggcgtacactttttctcaaatgaacgtagataatcctaatgaattagagcctcagcatcctttaagacataaatcgagtttaatttttaacgacgatgatgacgatgaaatacctccatattcaaaccatgcggaaaatggttctggggagacctttgattctgatgatgatatcgatgctagcagctcgagtagtatcgacagcaacgaaggcgatatccacgatgcagatatgacaggaaataccttgcaaaaaatggattatcaaccatctcagcagcctgactcacttcaaaatcaaggctttcaacagcaacaagaacagcaacagggcactgtggaaggcaagaaaggaagagctatgatgtttccagttgacatcacttggcaacaggggggtaataaagtgtacgttactgggtcttttacgggatggagaaagatgatcgggttagtaccagtccctggacagcctggacttatgcatgtaaaattacagctgcctccaggtactcatcgtttcagatttattgttgacaatgagttaagattcagtgattatttacctaccgcaaccgaccaaatgggaaacttcgtcaactatatggaagtgagcgcaccgcctgattggggcaatgaacctcagcagcatctggctgaaaaaaaagcgaatcatgtagatgatagcaaattgagtaagagacctatgagcgctcgctcgagaatcgcattggagatagaaaaggaaccagatgacatgggcgatggttacactcgttttcacgatgagacccccgctaaacctaatttagagtacactcaagatatacctgctgtgttcaccgacccaaatgtaatggaacaatattatttgacacttgatcagcagcaaaataatcaccaaaatatggcctggttgactcctccacaactgccacctcatttagaaaacgtcattttgaatagttactcaaacgcgcaaactgataatacgtctggcgcccttcccattccgaaccatgttatattgaaccatctggcgacaagcagtattaagcataatacattatgtgtcgcatccattgttaggtataaacaaaaatacgtgacccaaatactgtatacaccattgcaatag

SEQ ID NO: 2951 - DNA, 1254 bp, Saccharomyces cerevisiae
atggctgtatttactcctccatcaggtaatagcaattccaccgaccatactcacacacaagatgaccacgacaaagatgataatgatatcaagaaattctacataaggccaagtttaggcttaaaactgtggggtccgctcgtacccgctcctgataacctaccgggactatacactctaatcactatccaatctgcagtgggtttctttgccctttggagactgagaaggctctacaaactaccgccaccgcgccgcattgccactggcactcactcggatttatcctttggcgaactacccagtgaaatgattgtcaatggcaagactaaaatcaaaaaggatattgctgactttccaactttgaaccgcttctccaccacccatggtgacattgtgctcgcccctcctcccatcatacctcgccaatctcgattcgtcagcgtcagaaagctcttatgggggttgtttggctctttgctactttctcagtcactgttggagcttactcgcctgaactttcttaaatacgacccctggtgcgacgaaatgaaatccgtacgtgacaagaagtttttcaacaatattgtcaaatattatcacgagggcatagaccccaccaaaataaaagtcaaggatgctatgaacggtactcctctctcgacaaatatccctgaggtcaaacaaagcgtcgctctcgctagagcgcaagttgaggcgcagaatcccattattaaatggttcggacccttggaatacaagcccatgtctttcaacgagtacctcaatcgcatggaatttcacttggacatgttcgagttttttcaaaataaaagaaacattagagaaaattccattgaactcatcaattccatatcccacaatccgcagtcttcttctactggccttgaaggtctttccgagtccaaaaaactccatctacaaaatgtggaaaaaagactgcatttcttagcatcttcgggagattccatttccgcaccagtaaagaagagatccagcaccacactctcccgaggtgtcattttgccccatgacacgaaaggcccgcaagatattgatctcgatacaataagatcgctttatgatccatggatgactttggccttagaaacttcgctaagcatcaaattcataccaactaccatgccctcccataccaagacacccactagcacggaccagccgttaccagggcctacccccaaggctctcactaatgaaaagacacattag

SEQ ID NO: 2952 - DNA, 1254 bp, Saccharomyces cerevisiae
atgtcagaccctatcagaacgaaacccaagtcgtcgatgcaaatcgacaacgcccctacgcctcacaataccccagcatcggttctgaatccgagctatttgaaaaacggcaacccagttagggcccaggcacaggagcaggatgacaagatcggcaccatcaacgaggaggacatcttggctaaccaacccctgttgttacagtccatccaggacagacttggctcgctggtgggccaggacagcgggtatgtggggggtcttcccaagaacgttaaggaaaagctgctgagcttgaagactttacaaagcgagctattcgaagttgaaaaggaatttcaggtggagatgtttgagctagagaacaagtttctgcagaagtacaagcccatttgggagcagcggtccaggatcatttcaggacaagagcaacccaagccggaacagatcgcaaagggccaagagattgtggagtcactcaatgagacggagttgttggtggacgaagaagagaaggcccaaaatgattccgaggaggaacaggtgaagggaattccctcattctggctaaccgcattagagaacttgcccatcgtttgcgacacgatcactgaccgcgatgcggaagttctggagtacctgcaagatattggtctggaatacttgacggatggtagacccggtttcaagctgttgttcagatttgattcttccgccaacccattcttcaccaacgacattctgtgcaagacctacttctaccagaaggagctcggttactccggggactttatctacgaccacgcagaaggctgcgagatcagttggaaggacaacgcccacaacgtcactgtggacctagaaatgcgcaagcagagaaacaagaccaccaagcaggtgaggaccatcgagaagatcactcccatagaatcctttttcaacttcttcgaccctcccaagatccaaaacgaagaccaagacgaggagttggaggaagacctcgaggaacgtctagctttagactactccatcggggaacaacttaaggacaagctaattcctagagccgtggactggtttaccggcgcagccttggaattcgagttcgaggaggacgaagaagaagcggacgaggacgaagacgaagaagaagatgatgatcacggcttggaggatgacgacggggaatctgccgaagagcaagacgattttgctggcaggccggaacaggctcctgaatgcaagcagtcataa

SEQ ID NO: 2953 - DNA, 1254 bp, Saccharomyces cerevisiae
atgtcccagagaaagcgatactcattgaacgtcgtcacgtccccgtcgataccgtcaccgacacccagtgcaccgatacggactaacgaatccaattgggaagctgcttcgccagcgagtgctgcatcttcatttctcccgaatgttcatcatggtggcacggttttgaatcctgggttgggcataatgaggtcaccttcgttgaacaagtctggtgcgtttggccggtccggcagcagtggttccagtacagtaatagaaccgtccaacataaagttgctgctaattggagatgcaaacgtagggaagacagctatgattttgagctattgccgggaactgttgacacgagcggaaatgtcacgatcggcgcgactgaggcaccagcagcagcaacagcataaagacttaggattgaagaaaactgtggtgaaccatagattaagcatgaaagagaaaagaaaacggtacagctctaacgattttgaaaaggagttcaaagatattaatcattttgcagacgaaacaagcgatttcggaaacccgaacatcggtgatgataacaaccacgaaatggcggatcctaatgagattgtcatcgaaaccagaagtactatcggaatagacatcaagacgaacttggtcaacatagataaccggttttttaatgtcatactgtgggacactgcgggacaagaacggtaccaaaacgcaatcattccatcactgtacaagaagactaatgcggtgatattaacttacgatataacaaatgcgaagtccttccaaagctgtatggagcggtggatagttcaggcgttggaaaacttttcttcccaggatttgttaaaagcaagattttttctggtgggtaacaagattgacctttataaggaaaggcaggtaacccattatgatgtggtgcaaatggttcaggaaatgcaactgaaacatggtattaaaatttcgggaaactttgaagtaagctgtaaatgggtcaacgtggtggagagaaccatgaatatgataatactagacctggttgagaacggatgtttcgaaaacaatgatccttgtgtgtcgattacaacatctgacgacgtccagggacatgagcaagaattccacgatacagtagaagagcctttcaatttcactcggcaacgtcaacaccaacttgaaaaaaataacacagtggatattacaaaacctaatgacgacattgcaaataatcaatcaatttgttgcgtttag

SEQ ID NO: 2954 - DNA, 1254 bp, Saccharomyces cerevisiae
atgtctcaaagactacaaagtatcaaggatcatttggtggagagcgccatgggtaagggtgaatcgaagaggaagaactcgttgctggagaaaagacccgaagatgtagttattgtggctgctaacaggtctgccatcggtaaaggttttaaaggtgccttcaaagatgtaaacacagactacttattatacaactttctcaatgagttcatcgggaggtttccggaacctttgagggctgatttgaacttaatcgaagaagttgcctgtggaaatgttctcaatgttggagccggtgctacagaacacagggctgcatgcttggcaagtgggattccctactcgacgccatttgtcgctttaaacagacaatgttcttcaggtttaacggcggtgaacgatattgccaacaagattaaggttgggcaaattgatattggtttggcgctgggagtggaatcaatgaccaataactacaaaaacgtcaatcccttgggcatgatctcctctgaagagctgcaaaaaaaccgagaagcgaagaaatgtctaataccaatgggcattactaatgagaatgttgccgctaatttcaagatcagtagaaaggatcaagacgagttcgctgcgaattcatatcaaaaagcttacaaggcgaaaaatgaggggcttttcgaagatgaaattttacctataaaattaccagatggctcaatttgccagtcggacgaagggccacgccctaacgtcactgcggagtcgctttcaagcatcaggcctgcctttatcaaagacagaggaaccacaactgcgggcaatgcatcccaggtctccgatggtgtggcaggtgtcttgttagcccgcaggtccgtagccaaccagttaaatctgcctgtgctaggtcgctacatcgattttcaaacagtgggggttccccctgaaatcatgggtgtgggccctgcatacgccataccaaaagtcctggaagctactggcttgcaagtccaagatatcgatatttttgaaataaatgaagcattcgcggcccaagcattatactgcatccataaactgggcatcgatttgaataaagtaaatccaagaggtggtgcaatcgcgttaggccatcccttgggttgtactggcgcaaggcaagtagctaccatactaagagaactgaaaaaggatcaaatcggggttgttagtatgtgtatcggtactggtatgggtgccgccgccatctttattaaagaatag

SEQ ID NO: 2955 - DNA, 1257 bp, Saccharomyces cerevisiae
atggaaaacaaactactttgttggtggttgtactggccatgcgtgtattcatctattatagctaccataatatctttttacaccataactagacacttattaaattaccgtaaaccatatgaacaaagactatccatacggatactattgctcgtgcccatttttagtgtgtcatgcgcaagtggcataattaagcctgaagcagctcaattttatgtcgatcctatcagagaattttatgaagcattcgttatttacacttttttcacatttttaacactactactaggaggcgagaggaacatcattactgttttaagcttaaatcacgcccccacaagacatccgataccgctaataggtaaaatttgcaaaccgatagacttatctgatccttttgattttctttttgtcaaaaaaggcatattacagtatgtttggttcaaaccattttattgttttggtacattgatatgcagtgcatggaagctacccaaattcgaaatatttttgaacgttttttataatatttcagtgacttggtcactgtatagtttagcactattttggaagtgtctctatccggaattaactccttataaaccatggttgaaatttttatgtgtcaaattgattatttttgcctcttattggcagagcatcataatccagggtctagtggttactggaaagttgggtacgggaaaccaagatcgaacctctggatatgtgtacaagaatgggctcctgtgtatagagatggtgcctttcgccatcttgcatgcagtagctttcccttggaacaaatacacagcatttagcataccttatggggccaggatgaaattcatttacgctttgaaagattttcttggttgcggtgatctaatatgggattttaaacagactttgtttgctggtcccttgtactataattataggaacttcgatcctgaagccatggatctattaagcactagacaacaatccggtgcgactatggaaagactaaagcatgggctaagatttactgataatggaagaaatagttattgggtggcatatgggagtatagataacaaccttgttccggaatcaatagaggaatcatgggaagatgatattgctggtcagagaacttttcctgaggatccaaattatccggttgttcacgactacacgatgggccatcgatatagtagatcaatgaatgatttaagaagagatgttcaaagtaggtcatcaatggcttgttaa

SEQ ID NO: 2956 - DNA, 1257 bp, Saccharomyces cerevisiae
atggactatttacatgtatataacaacaaccaggcgcacgttcccagaacacctccaggcaggcagtgcctatcgcccgttctgcccccaatcatattggcgttagatcaacaacattcgctgacatttgggtactccagccccaggtgcttgccaacacccatattgccttctatgagcacaaatacgcccgtccattggtcacaacaggttgtcactatccctgtcgctgtacgaaatcatgccgcaatgatgcctattatcacacctatgacctccccaagacctcagtttgaagcaacggctccctcaccccctttggccccggtcgccataaagctgccagatttgaaactaccaccgtcgcctgtgcccagcacagtagaggacagagtttcacatcctatcctgcccaaaattgtgatcgggaatggcggcggccgtgatgttgagcgagatagtaccgaggaattaattaggaagattccaaactacattggttgtgcaaaaacaaaggcacaattgagcaaagttaggtctggtaaacaactaattgcatgcgcacaggaatatcaccatccagtaaacaaggacgagatcgaaaatatcaacaacattctaaacttcagggactttattttcaagcatccaaaatcctccttcgagttcctatgtaccctgtcgtttgagcagttcgttagagtatattcattcattagtttcatctacaggacaaagaaaatcaataagaacaagtacgaactcgtttgtgagatgaatgttcacgagcaactcagcaataagcgtatacaaagaacaaggactcctgaaaagtacaaaatacatttgatctgcgagtcaaaactcatactgaccttcaaccactgtacgaagacagtaaaatttgagtctatcaatggcgggcactgccatccgatttcagccaaccacattatcaagccctccctcttccttacccactgcattaataaatgctaccagaccgtgtcagaccctaccgatttgaaattggcattgagagacgccttagaagcccttgatcatgaaaggataggattgtctttcttaaagaggagacatttcaagtgctcacaccaagcatcatcactctcgaatgccagcgccacattgaagaaacaagaagatcatgacacatttggtgtacatacaggaataattcatacggcaaatttcttcatgtttaatgcatctagcgatatattccagaggaactaa

SEQ ID NO: 2957 - DNA, 1257 bp, Saccharomyces cerevisiae
atgtcaggaacattcaatgatataagaagaaggaagaaggaagaaggaagccctacagccggtattaccgaaaggcatgagaataagtctttgtcaagcatcgataaaagagaacagactctcaaaccacaactagagtcatgctgtccattggcgaccccttttgaaagaaggttacaaactctggctgtagcatggcacacttcttcatttgtactcttctccatatttacgttatttgcaatctcgacaccagcactgtgggttcttgctattccatatatgatttatttttttttcgataggtctcctgcaactggcgaagtggtaaatcgatactctcttcgatttcgttcattgcccatttggaagtggtattgtgattatttccctataagtttgattaaaactgtcaatttaaaaccaacttttacgctttcaaaaaataagagagttaacgaaaaaaattacaagattagattgtggccaactaagtattccattaatctcaaaagcaactctactattgactatcgcaaccaggaatgtacagggccaacgtacttatttggttaccatccacacggcataggagcacttggtgcgtttggagcgtttgcaacagaaggttgtaactattccaagattttcccaggtattcctatttctctgatgacactggtcacacaatttcatatcccattgtatagagactacttattggcgttaggtatttcttcagtatctcggaaaaacgctttaaggactctaagcaaaaatcagtcgatctgcattgttgttggtggcgctagggaatctttattaagttcaacaaatggtacacaactgattttaaacaaaagaaagggttttattaaactggccattcaaacggggaatattaacctagtgcctgtgtttgcatttggagaggtggactgttataatgttctgagcacaaaaaaagattcagtcctgggtaaaatgcaactatggttcaaagaaaactttggttttaccattcccattttctacgcaagaggattattcaattacgatttcggtttgttgccatttagagcgcctatcaatgttgttgttggaaggcctatatacgttgaaaagaaaataacaaatccgccagatgatgttgttaatcatttccatgatttgtatattgcggagttgaaaagactatattacgaaaatagagaaaaatatggggtaccggatgcagaattgaagatagttgggtaa

SEQ ID NO: 2958 - DNA, 1257 bp, Saccharomyces cerevisiae
atgtcgacaataaagccaagcccttcaaacaacaatttgaaagtgaggtcaagaccaagacgcaagtcttccataggtaagatcgacctcggggacactgtacctagtttaggtactatgttcgagacaaaagaatctaaaacggctgctaaaaggcgtatgcagagattatctgaagccaccaaaaatgatagcgacctggtcaagaaaatctggttttcattccgagagataagttaccgtcatgcctggatagctcccttgatgattttaatcgcggtatatagtgcctatttcacttctggtaacactacaaagacaaatgtgttacatagatttgtcgctgtgtcataccaaataggtgataccaacgcatatggtaaaggtattaacgatttgtgctttgtattttactatatgatttttttcacattcttacgtgaattcctaatggatgttgtcattagaccgttcgctattaggttacacgtcacttctaagcacagaataaaaagaatcatggaacaaatgtacgctattttctacaccggtgtttccggtcctttcgggatatattgtatgtaccattcggatttatggtttttcaacacaaaggcaatgtacagaacatatccagatttcactaatcccttcttattcaaggtattctatttgggtcaagctgcattttgggctcaacaagcctgcattcttgtattgcaactagaaaagccaagaaaagatcataacgagttgactttccatcatattgttactttactattgatttggtcttcctacgtatttcatttcactaaaatgggactgccaatctatatcacaatggatgtttctgattttcttttgtcattctccaaaactctaaattatttggactctggattggcttttttttcttttgctatctttgttgttgcgtggatttatttgcgtcattacataaatttaaagatcctatggtccgttttaacgcaatttcgcacggaaggtaactatgtcttgaattttgccactcagcaatataaatgttggatttccttaccaattgtctttgtattgataggcgctttgcaattagtgaatctttattggctgttccttatttttagagttctttacaggattctatggagaggtattctcaaggatgacagaagtgatagtgaatcagacgaagaaagtgatgaaagttccactactccaactgacagtactccaacgaaaaaggatatttga

SEQ ID NO: 2959 - DNA, 1257 bp, Saccharomyces cerevisiae
atgtctgccactctgttcaataacatcgaattgctgccccctgatgccctttttggtattaagcaaaggtacgggcaagatcaacgtgctaccaaggtcgacttgggtatcggggcctacagagacgacaacggtaaaccatgggtcttgccaagtgttaaagccgccgaaaagctaattcataacgacagctcctacaaccatgaatacctcggtattaccggtctgccaagtttgacatctaacgccgccaagatcatcttcggtacgcaatccgatgcctttcaggaagacagagtaatctcagtacaatcactgtctggtacgggtgctcttcatatatctgcgaagtttttttcaaaattcttcccagataaactggtctatttgtctaagcctacttgggccaaccacatggccatttttgagaatcaaggcttgaaaacggcgacttacccttactgggccaacgaaactaagtctttggacctaaacggctttctaaatgctattcaaaaagctccagagggctccattttcgttctgcactcttgcgcccataacccaactggtctggaccctactagtgaacaatgggttcaaatcgttgatgctatcgcctcaaagaaccacatcgccttatttgacaccgcctaccaagggtttgccactggagatttggacaaggatgcctatgctgtgcgtctaggtgtggagaagctttcaacggtctctcccgtctttgtctgtcagtcctttgccaagaacgccggtatgtacggtgagcgtgtaggttgtttccatctagcacttacaaaacaagctcaaaacaaaactataaagcctgctgttacatctcaattggccaaaatcattcgtagtgaagtgtccaacccacccgcctacggcgctaagattgtcgctaaactgttggaaacgccagaattaacggaacagtggcacaaggatatggttaccatgtcctccagaattacgaaaatgaggcacgcattaagagaccatttagtcaagttgggcactcctggcaactgggatcatatagtaaatcaatgcgggatgttctcctttacaggattgactcctcaaatggttaaacgacttgaagaaacccacgcagtttacttggttgcctcaggtagagcttctattgctggattgaatcaaggaaacgtggaatacgtggctaaagccattgatgaagtggtgcgcttctatactattgaagctaaattgtaa

SEQ ID NO: 2960 - DNA, 1257 bp, Saccharomyces cerevisiae
atgtggggcatcttattgaaatcctcgaacaaaagttgttctaggctctggaaaccaattttgacacaatattatagcatgacatcaactgccacggattctccgctgaaatactatgatattggattgaatctgacagatcctatgtttcacggtatttacaatggtaagcagtaccatccagcagattatgtaaaattattagagcgtgctgctcagaggcacgtgaaaaatgcccttgttacaggatcatccatagcggagtctcaaagtgccattgagttggtaagcagcgtcaaagatcttagcccgttaaagctgtatcacacaataggtgttcacccatgttgcgttaacgagtttgcggatgctagtcaaggggacaaggctagcgcttctattgataacccttccatggatgaagcatataatgagtctctatatgctaaagttattagtaatccatcttttgcacagggtaaactgaaagagctttatgatttgatgaatcagcaagcaaaacctcatgatacaagtttcaggtcaattggtgagatcgggttggactacgacagatttcactatagttctaaagagatgcaaaaggttttttttgaagagcaactgaaaataagttgtttgaacgataaactcagcagctatccattgtttctgcatatgagaagcgcatgtgacgattttgttcaaatattggaaagatttattgccgggttcactgatgagagggatacctttcagctacaaaagttaggtgcatcgtcgtctagcgggttttacaaatttcatccagatagaaaactagtggtccattcattcactggttctgcgatagatttgcagaaattactgaacttatcacccaacatcttcataggagtaaacggttgctcgttgagaaccgaggaaaatctagctgttgtaaagcaaataccaacagaaaggttgttattagagacagatgctccgtggtgtgagattaaaagaacgcatgcatctttccagtacttagccaaataccaggaggttagggatttcgaataccctgcattcaagtccgttaagaaaaataagctcgctgacaagttgaatgcagaagaactttacatggtcaagggccgtaatgagccttgtaatatggaacaagtagcaattgtcgtatcggaagtcaaggacgtggatctggctactttgatagataccacgtggaagacgacctgtaagatatttggagagtaa

SEQ ID NO: 2961 - DNA, 1260 bp, Saccharomyces cerevisiae
atgtttgatcctctcgatttgtacacccctgatgacatccaggttgaggctttacagttcaatctagcagagagagagccaaaagatccttgctcaccgcaacgtgacgaaatattaacggctgtagatgaagaagagagtgacgacgatgacaccattatcgataatctggatctgccctccgtgaagtatgctccgccagaagttatcctttgtatactaatacttctgaagcccgatagacaagtaaacttcaatcaggagacagggaagaacaaatctgtactggaggtttgcaagagtcatgggctggaacccgatctgctgaaaagacttttgacttggtatacagaagaatggcctaacaagaggttaaactcgttggaaaagatatgcaataaaatcccaatgctgagatttacagtatccaaagaactactgttgggctactatactagtgtattgaaaaaatacaataatagttgcggattgaatgaggaaatcatacaagaacttcttaaggaattgagctcaaggatatccgaaaactgtgggagaacggcccaaccatccatagtaagatattttgaattaagaaatctaagcacttccataccgcttcatgaaccctctttaacggccgataatcttggttggaaaacatggggatcatctttaatactttcacaattagtcgtagatcacctggattacctacataccactaatgtgaacatgttagcgaacagcgacatcaaacagattaaagtattagaattaggagcgggcactggtttagtaggactttcatgggccttaaaatggaaagaactttatggaactgaaaatatagaaatcttcgtgacggatttacccgagattgtgacgaatttgaagaaaaatgtgtcattaaataatttaggagatttcgttcaagcagagatattagattggactaatcctcacgattttatagataaatttggacatgaaaatgaatttgacgtcatattgatcgccgacccgatatattcgcctcagcatccggaatgggtagttaacatgatatcgaagtttttggcggcatcagggacctgtcacctagaaatacctttaagggcaaaatacgccaaagaacgagaggttttgaaattattactaaaagagagtgatttaaaagtagttgaagaacggcattcagagggtgtggatgattggggtgccgttaagtatttatataggcaaatcgttcgcaattag

SEQ ID NO: 2962 - DNA, 1263 bp, Saccharomyces cerevisiae
atgaaactgtccgccaccactcttaccgcggcttcattgatcggttatagcacaatcgtttccgctttgccgtatgcggctgatattgacacaggatgtactactactgctcatggttcacaccagcataagagggccgttgcagttacatacgtttacgaaacagtcactgtcgataaaaatggtcagaccgtcactccaacctcaactgaagcctcttctacagttgcttccactactactctgatttccgaatcttcggtcaccaagtcttcttccaaagttgcttcttcttctgagagtactgaacaaatcgctaccacctcgtcttcggctcaaacaactctgacatcttcagaaacttctactagcgaatcctctgtgcctatttccacatctgggtcagcttccacatcttcagcagcttccagtgcaactggaagtatctacggtgatttggctgacttttcaggtccatatgaaaaatttgaagacggtaccattccttgcggccaatttccatctggtcaaggtgttatccccatcagctggttagatgaaggtggctggtctggtgttgaaaatactgacacttctacgggtggctcttgtaaagaagggtcttactgctcatacgcttgccaaccaggtatgtccaagacacaatggccttctgaccaaccatctgacggcagatccattggtggtttgctatgtaaggacggctacctgtaccgttcaaatacagatactgactatttatgcgaatggggcgttgatgccgcttacgtcgtctctgaattgagcaacgatgttgctatctgcaggaccgattacccgggtaccgaaaacatggtgattcctacatatgtgcaagcaggtgactctttacccttgactgtcgttgatcaggacacctactacacttggcaaggattgaagacatccgcgcaatactacgttaacaatgccggtatttctgtcgaagatgcttgtgtttggggttcttcaagttcaggcgtcggtaattgggctccattgaactttggcgctggttcttctgatggtgtcgcctacctttctttgattcccaacccaaacaacggtaacgcattgaatttcaatgtcaaaattgtcgccgctgatgactcttctacagtcaacggtgaatgtatctatgaaaacggtagcttcagcggtggctctgacggttgtaccgtttccgttactgctggcaaagctaagtttgttctatacaactaa

SEQ ID NO: 2963 - DNA, 1263 bp, Saccharomyces cerevisiae
atgagtaaaattaaagttgttcatcccatcgtggaaatggacggtgatgagcagacaagagttatttggaaacttatcaaagaaaaattgatattgccatatttagatgtggatttaaaatactatgacctttcaatccaagagcgtgataggactaatgatcaagtaacaaaggattcttcttatgctaccctaaaatatggggttgctgtcaaatgtgccactataacacccgatgaggcaagaatgaaagaatttaaccttaaagaaatgtggaaatctccaaatggaacaatcagaaacatcctaggtggaactgtatttagagaacccatcattattccaaaaatacctcgtctagtccctcactgggagaaacctataattataggccgtcatgcttttggtgaccaatatagggctactgacatcaagattaaaaaagcaggcaaactaaggttacagtttagctcagatgacggtaaagaaaacatcgatttaaaggtttatgaatttcctaaaagtggtgggatcgcaatggcaatgtttaatacaaatgattccattaaagggttcgcaaaggcatccttcgaattagctctcaaaagaaaactaccgttattctttacaaccaaaaacactattctgaaaaattatgataatcagttcaaacaaattttcgataatttgttcgataaagaatataaggaaaagtttcaggctttaaaaataacgtacgagcatcgtttgattgatgatatggtagcacagatgctaaaatcaaagggcgggtttataatcgccatgaagaattatgatggcgatgtccagtctgacattgtggcacaaggatttgggtctcttggtttaatgacgtccatattgattacacctgatggtaaaacgtttgaaagcgaggctgcccatggtacggtgaccagacattttagaaaacatcaaagaggcgaagaaacatcaacaaattcaatagcctcaatatttgcctggacaagggcaattatacaaagaggaaaattagacaatacagatgatgttataaaatttggaaacttactagaaaaggctactttggacacagttcaagtgggcggaaaaatgaccaaggatttagcattgatgcttggaaagactaatagatcatcatatgtaaccacagaagagtttattgatgaagttgccaagaggcttcaaaacatgatgctcagctccaatgaagacaagaaaggtatgtgcaaactataa

SEQ ID NO: 2964 - DNA, 1263 bp, Saccharomyces cerevisiae
atgcataaatttgatctagagctctcgagaagagcgaaccctttgctttttagtgcagaacgatacgaagagtatccattgaaatacgatgaattgaaacagtaccttctctcccaaaatccgtcacatccgcatcacaatagtagaccatacacttccattgactattttgactatcttctgtatagaagtaaaaatgacgagtcagaaatagaccttgacaaaaagctagtgtctgagttcgccctatactacgttcaaaaagagcacttgaactctgatgatctaaatcccacactcaatgagttgctgaagctgcagccgaagtctgcggattggtatgaaatgatgctgaggatccttgaatccattaacactacagggatagaccagcttacgaaggaaaacaacaacagtttcccaaattctaaaagagcgaggtcttccactaatatgggtggcacagataaatttaacaagggtgcttaccatactgacaaagctgatgacgataaaaatgaaatacttcaagaattaacgtccttcttgatgtcaaactccattcagaaaggcattgatatcaagccaataccattagatgaccctgtgaagttcttgaaaaatgggataaattctatcttggatacctgcgtcagtctagaaaaaaatacgtcatcaccacctatttcgcctaacgccgctgcaattcaagaggaagactcctctaaaaaattagaagaactagaaacggcatttagtgatttgcaactggcacacaatttcttgactaagcaattcgagaatgaccgtgccgaatatgtacaagatatcgagaagctaacgcggactaacagagaattacaagataagttattaaacaaccactcgaatttgagtaaaactgaaaagaaattacacgaattggagcaggaaaataaagaacttgaaaaagccaacaacaagctgaattcaagcagacataatttcggcatgtcatcaccagcgagttcgccggtgacttgggatccaagttcaccttcctctgtaggaagccccacaagcggttctggatcacgttcactttcaataatgacaagtgagtttaaaaaagtgcttacgagtacacaaagaaagtatgaaaaagaattgtcggatgagcgtgaacatagattcaagctggaaagggagcttgctttgctgaaaaatgcagaggcaaacacctcgctggcgcttaatagagacgatccaccagatatgctatga

SEQ ID NO: 2965 - DNA, 1263 bp, Saccharomyces cerevisiae
atgcttgctgcttcattcaaacgccaaccatcacaattggtccgcgggttaggagctgttcttcgcactcccaccaggataggtcatgttcgtaccatggcaactttaaaaacaactgataagaaggcccctgaggacatcgagggctcggacacagtgcaaattgagttgcctgaatcttccttcgagtcgtatatgctagagcctccagacttgtcttatgagacttcgaaagccaccttgttacagatgtataaagatatggtcatcatcagaagaatggagatggcttgtgacgccttgtacaaggccaagaaaatcagaggtttttgccatctatctgttggtcaggaggccattgctgtcggtatcgagaatgccatcacaaaattggattccatcatcacatcttacagatgtcacggtttcacttttatgagaggtgcctcagtgaaagccgttctggctgaattgatgggtagaagagccggtgtctcttatggtaagggtggttccatgcacctttacgctccaggcttctatggtggtaatggtatcgtgggtgcccaggttcctttaggtgcaggtttagcttttgctcaccaatacaagaacgaggacgcctgctctttcactttgtatggtgatggtgcctctaatcaaggtcaagtttttgaatctttcaacatggccaaattatggaatttgcccgtcgtgttttgctgtgagaacaacaagtacggtatgggtaccgccgcttcaagatcctccgcgatgactgaatatttcaagcgtggtcaatatattccaggtttaaaagttaacggtatggatattctagctgtctaccaagcatccaagtttgctaaggactggtgtctatccggcaaaggtcctctcgttctagaatatgaaacctataggtacggtggccattctatgtctgatcccggtactacctacagaactagagacgagattcagcatatgagatccaagaacgatccaattgctggtcttaagatgcatttgattgatctaggtattgccactgaagctgaagtcaaagcttacgacaagtccgctagaaaatacgttgacgaacaagttgaattagctgatgctgctcctcctccagaagccaaattatccatcttgtttgaagacgtctacgtgaaaggtacagaaactccaaccctaagaggtaggatccctgaagatacttgggacttcaaaaagcaaggttttgcctctagggattaa

SEQ ID NO: 2966 - DNA, 1263 bp, Saccharomyces cerevisiae
atggttttatcaaggggagaaacaaagaaaaatagcgtgagattaacggcaaaacaagaaaagaaacctcaatctacgtttcaaactttaaaacagtcacttaaacttagcaacaataaaaagttgaaacaggattcgacccaacactcaaacgatacaaataaatctgttaaagccaaaaaaaatggcacgtcctcgaagaaaaccggaacacaaaggaaaagaatatcaactcagagattttcattgtttacctatggcaatgttcaggttatgaattcattcgttcccattcataatgatattccgaatagcagttgcattcgtagaaattcccaagtatccgcaaataatgtcactgaaagtagtggagtattcttcaatgatacgcaaagtcaagacagtcaaaacactattaagttaaaacctacatctttaatggcaaaaggacctattgaaatatatcagatatgtacagggtttgataagttaaaggaaaatatagcgccctttcaaaaatctagtaaagctagtagtcatgatgggcatgtagtaaactatttatcgataggacgacatggtgatattgtgcatccagtactacccaaactacaaataacaaggctaaatggcgcaggtttcaaatactttattagcttttataatccggaacggtactgggaaatcgaatttctacctttgattagtcaatcccaatcagagttggaaaatagtgtgaaagcttttgaaaacgtcattagcaaaatttgccaattttcgcatattaatgaaggagctactattgggaataatgagtctttgagcgataaattcaaactgccgcctacttcggacatagagccccccaatactgaaataattaataatgatgatgataacgatgatgatgatgataattatgatgatgacgaccttaattacttgctggatgaagaatacgaacaaggatgtacagataatagcttctccgtgatatcgaacacttgctctaatctaaatgcaagctttctctatccgagcgaccctaccgatgccgtgtcaatctccataaatgaagctttcaaaaatgctatcagacgaaccgctcctgtactgaatattccaatagcagccccaagtattcattcgaaacagcaaaacaaaagatatagttcatacccttttatcgactctcccccgtatctgcaggacaggcatagaagatttcagaggagatccatatctggtcttggcgacctttga

SEQ ID NO: 2967 - DNA, 1263 bp, Saccharomyces cerevisiae
atgtctaagggaaaagtttgtttggcttattctggtggtttagatacctccgtcattttggcttggctactagaccaaggctacgaagttgtagctttcatggctaatgtagggcaagaagaagatttcgatgccgccaaggaaaaggccttgaagatcggtgcctgcaagttcgtttgtgtggattgtcgtgaagattttgtcaaggatattctattcccagctgtacaggtcaacgctgtgtacgaagacgtttatctgttgggtacctctttggcaagacctgttattgccaaagcccaaattgacgtcgctaaacaggagggctgtttcgcggtctctcatggttgtaccggtaaaggtaatgatcaaatcagattcgaattgtcattttacgctctgaagccagacgttaagtgtattacaccatggagaatgcctgaatttttcgaaagatttgctggcagaaaggatttgttagactatgctgcacaaaagggtattcccgtcgcccaaaccaaggccaagccatggtctactgacgaaaaccaagcccacatttcttacgaggcaggtatcttggaagacccagataccaccccaccaaaggacatgtggaaattgatcgtcgatccaatggatgctccggaccaaccacaagatttgaccattgactttgaacgtggtcttccagtcaagttgacctacaccgacaacaagacttccaaggaagtttccgttaccaagcctttggatgttttcttggccgcatccaacttagcaagggccaacggtgttggtagaatcgatattgtagaagatcgttacattaacttgaaatccagaggttgttacgaacaggctccattgactgttttgagaaaagctcatgttgatttggaaggtttgactttagacaaagaagtccgtcaattgagagactcattcgtcacaccaaactactccagattgatatataacggttcctacttcaccccagagtgtgagtacatcagatctatgatccaaccatcccaaaatagcgttaacggtactgtcagggttagactgtataagggtaacgtcatcattctgggcagatctacaaagactgaaaagttgtacgatccgacagaatcctctatggatgagttgaccggtttcttacctaccgataccaccggtttcattgccatccaggccattagaattaaaaaatacggtgaatccaaaaaaaccaaaggtgaagagttgactttgtaa

SEQ ID NO: 2968 - DNA, 1263 bp, Saccharomyces cerevisiae
atgtctatcaaaggtgattccccctcatcaacaaatgccagtagtagtccgaagtctacatattcaatacaatcggatgataaagcaaaccttggcagtggtaacgtcgatatacgtacagataattcacaacaggacagtaataatagacgcgatattgtggtagtgacgagggtagcttctgaagagactttagaatcacaatcatctacttcatcaatgggaattagaccagaatcatcttttaactatgaggatgcttctaaccaagctagggtcgaaatgaataacagggtacatggctcaaatatgaacacaattaacaaatattatccagtacgattcccaaagaataacgaaaggcaattgagcgacacaaataatttaaatgagaaagtgcaaggcacacatacagttcaatcatccacccaggaagacaaaatactcgacggtgacacaagcaactcacaagtaaccccgtctttgaacattgcagagtttcccacagacaagcttcttaaaatgctgacagcgttactaactaaaattattaagtcaaatgataggacggcagcgacaaatcctagtttgacacaagagattgagaatggtaggtgtcttgctttaagtgacaatgaaaagaaatacttaagccccgttctggggtttagagggaagcacgtaccacaaattggtcttgaccaatatttccagaggatccagaaatattgccccacaacgaatgatgtatttttatcgctcctcgtgtactttgatagaatatccaagagatgcaatagtgtcactacgacccctaaaactaatactgcaaaacatgaatctccctcaaatgaaagctctctagataaagctaacaggggcgctgacaaaatgtccgcatgtaacagtaacgaaaataatgaaaatgacgattcagatgatgaaaatacaggagttcaaagggattcaagggctcatcctcaaatgttcgtaatggattcacataatattcacagattaatcatagcaggtattactgtcagtacgaagtttctgagcgatttcttctatagcaattcaagatactcaagggtaggtgggatatctttacaagaactcaaccatttggaactgcagtttctagttttgtgtgattttgaacttttgatatcagtcaatgaattgcagagatacgcggacttactatacaggttttggaacaacgcaaaagctcaatcgcaagcactagttacgggcatgtag

SEQ ID NO: 2969 - DNA, 1263 bp, Saccharomyces cerevisiae
atgtctcaaccccagatgtcccctgaaaaagagcaagaattggcctccaagattttgcatagagctgagttggctcagatgacgcgtcaattaaagcttggtttaagtaatgtcccatcaacaaaacgaaaacaggactctacaacaaagaaaagaagcggagaggatgccgaagatgttgatgaggaccacaaaactcttttggaagccatatcgcctgcgaaaaagcctctccacgatgatacaaataaaatgactgttatatcgcccgtaaaatttgtagagaagccaaatactcccccaagttcacgccaacgaaaagccgaagaccgctcacagcagatcaagcctaggaaggaggacactccatctactccgagggcttctgctacacctataatcttaccacacgcttcgtcacactaccagcgcccccatgataagaatttcatgacgccaaaacgtaataataacaacagcagtaaccatagcaataacaataataatatcaagaagaaggcagcaggctctaaggatgctccacaggacagcgacaacactgcgggcgctgatctcttaatgtatttagccacaagtccatataataagtcatcacatcatggaacaccgatggccgtaaggatgcccactactccacgctcttatcattacgcgtcgcaattgagtttgaacggtaatacagcaagcacatcaaacgatgcagtaagattctctcatatcaaaccttcagcgtcttctccgcagtccactttcaaatctaatctgttaccgaattttccggacgaatctctcatggattctccatcactatacttgagcaataataacggtagtgtccaggcgacactatcgccacagcagagaagaaagcccaccacaaacacattgcatccacctagtaacgtacctaccacgccttcaagagaattgaacggtaccaattttaacttactcaggacgcccaacttcaacatgggagactatctgcataatcttttcagcccttcaccaagggtccccgcccagcagggagcgtcaaacacgtcagcttcaattccttctgttccagcgatggtgcccggatcatcttccaacacttctgcgatagcaacagctgctatatcaagccacaccacaaacaattttctagatatgaacgcaaacgggatcccgctcattgtaggacccggcaccgaccgtataggcgaaggggagtccattgatgacaaactcactgattga

SEQ ID NO: 2970 - DNA, 1263 bp, Saccharomyces cerevisiae
atgttcaaagttccagtgggattagccagtaggacaagggagcttatgaacagcgttacgctcaatagtctcaataatggaaagggtttcaatatgtacttgccaggaatattaagggcttttcctaaaccagtgccttcggcgattacatctcccgcaattccaaaatatcgaggagaaagtttccagtttcgtaagctttcatgcatttcttctaattattgttctaccactcaccaatttctatccagtctgaaaagctcgacatccaggttggttggtaaaagagccttccattcgtcacgacgtgcagaaataaagtttatattttcttcgaagtcaccaaagaacggtaacaagccgtttgtgaaagtatataaagtctccccattttttatcatatttgcaactgcaagtatcttcacattcattctaacatcaacgatagtcgttattcccttaatttttcactttttttttccccttcttattatgttctttttttttaaacaattcaaaaaatggcagaaaaatatcttttacaaagatgtcttgacctccttaccgaaaacaaaattgaaaataacattacccaccatgagatcattacaattacaacctatggttcagagttggaaagagatatcttccaggatgggaattccaaacgagtttgccaaaggtttgaatgttgatttagtaaagcaagaagaaaccagaaagcagtttctaagtttcctgcagaaaagagtgttggagtccttcaccaagaacgaactgggaataagatcctactttttaggagacagcgtcgagaaatggatcaaagaatcctatgacttggaactcgatattgataattgccgaagtgaactcagaaaattccaaactttcatattttccagtgttcgatacaagttgtatttagactcaatgaaaaatttaccgctaaacccttcaaaaaaactcgagggcaagaagcatattgcagacgtatatgtcattattttagacgaatcctttcctgcaataatgttcaatggcggagcttattcgaaggctgattttttcaagatattacaagaaagtgaaacctctaacagcagcaaaacccttaacacaattattgccatcaaaagtgtaaatacgctactatcaaaacactttgttatcacaacaaatggtgattctggagaattcttttcaaaatataacatttcaaaaataaacgacaaaaacactgaatacaccctaaaagagtaa

SEQ ID NO: 2971 - DNA, 1266 bp, Saccharomyces cerevisiae
atgacagacgctgaaatagaaaattcccctgcttctgatttaaaagaattgaatttggagaatgaaggcgttgaacagcaagaccaggcaaaagctgacgagtcagacccagtagaaagcaaaaagaagaagaacaagaaaaagaagaagaagaaaagcaatgtgaagaagattgaattactgtttccagatggaaagtacccagaaggtgcgtggatggactatcatcaagatttcaatctgcaaagaaccacggatgaagaatcacgttatttgaaaagggatctggaaagggccgaacattggaatgatgtcagaaagggtgctgagatacatcgtcgtgtgagaagggccatcaaggacagaatcgttcctgggatgaagttaatggatatcgctgacatgatcgaaaatactacaagaaagtatacaggtgccgaaaatttattagcgatggaggatcccaaatctcaaggtattgggtttccaacgggtctctctctcaaccattgtgctgcacatttcacacccaatgcaggcgacaaaaccgttctgaaatacgaagacgtgatgaaggtagattatggtgtgcaggtaaacggtaacatcattgattctgcctttactgtttcctttgatccacaatacgataacctgctagccgctgtaaaggacgctacttacacgggtattaaagaagcgggtatcgatgtgagattaaccgacatcggtgaagccatccaagaagttatggaatcctacgaagtggaaatcaatggtgagacttaccaggttaaaccttgtcgtaatctatgtggccacagtatcgcaccatatcgtatccacggcggtaaatccgttcccatcgtcaaaaatggggacactacaaaaatggaggaaggtgagcactttgccattgaaacttttggttctactggtagaggttatgttactgccggtggggaagtttctcattatgccagatctgctgaagaccatcaggtaatgcccacgttagacagcgccaagaacttgttaaaaacgatagaccgcaactttgggactttaccgttctgtcgccgatacctagacagacttggccaagagaaatacttatttgcgttgaataacttggttagacacggtttagtacaggattatccaccattgaacgatatccccggatcctacactgcacaattcgaacacaccatcttgttgcatgctcacaaaaaggaagtcgtttcgaaaggtgatgactactga

SEQ ID NO: 2972 - DNA, 1266 bp, Saccharomyces cerevisiae
atgacggccgtaactgatatcatcgatgaattgaatgattcgagtctttcttctacaaggcttcgagagttgtgtctccagttacgaaagaagacagatactggatgtgcaattacggtgtccgatgaggtcaaccttattgaatctctctcatatcactccatatctccaggagtagacatacaaatcaacacagatgttttgcagactatagattactactttcagcgtaacaaaagtgaacatgacgaaattatgtgcgtccttatttctaagttacagccactacttttaaaacgcaaaagcaacttcgaactcaaagagcaacgtaatcttggtctcaaacccacgcttggaatgtctttgaaagaagataacctaatgcaggcgtgggtaagtcagggtggcttgaaaggcattccgttattctacgtaattctgttacatttgaaaaggagagacatatctacgaatctttcttggattattccaggaattctaaacatactagatgataccactgatataagaagaattaaacttcgtggtgttctgctcctacagacgctattaaatcatacctttatgaacgaaaccaatgactcaaaatggatacagttctctagtactggtttatttccactgttcgaaaagacgctaatcaatatgtgctattttctccctccctcatacaatgctgatgaaacaatagccatatggcgggtcgttttcccaacgatacagtcgttatataaagtagaatttttggacaattacacaaagtatcaatatcacctggaaaagttcatgtcagagataatcttgcaaaacataattcctagggctagccttgcatacgaaaatttgacgttatacgcattggaatgcacaatgaacatactgagacttcaaagagaagggtctgttgtacatctccagaggctgatttttgttttaggtgaatatattgtacgaaatcctttttacacaacttttccaaaacttatttcaaaaactctttcagtggtaagtactctcataaaggtttgcccgaatgaaagaatagtggctcacagattcgacattttatcattaattctagttacatacgataagtgttcgcaagaggatgcgttgaacgaatcaatactacaacaatgtaaggaaacgataagctggttgctgaattgtgactgcgctatgggtgaacagttatcgactctatctaagcaaccgcggtttcagttactttttgagttctcatag

SEQ ID NO: 2973 - DNA, 1266 bp, Saccharomyces cerevisiae
atggtccggattcttcccataattttgagcgccctatcttcgaaattagtggcgagtacaatattgcattcatccatacactcagtgccatctggaggcgaaatcatatctgcagaagatcttaaagaacttgaaatttcagggaattcgatctgcgttgataatcgttgctatcctaagatatttgaaccaagacacgattggcagcccatactgccaggtcaagaactccccggtggtttggacattagaataaacatggacacaggtttaaaagaggcaaaactaaatgatgagaagaatgtcggtgataatggtagccatgagttaattgtatcttcagaagacatgaaagcatcgcctggtgactatgaattttccagtgatttcaaagaaatgagaaacatcatagattctaacccgactttatcttcacaggacattgccagattggaggatagttttgatagaataatggaatttgcgcatgattacaagcacggctacaaaattattacccatgaattcgccctcttggccaaccttagtctcaatgaaaatttgccgttaacattgagagagctcagtactagagtcattaccagctgcttgagaaacaatcctcctgtagtcgagttcattaatgaaagttttccaaattttaaaagcaaaatcatggccgctctgtcaaatttgaatgattctaaccacagatcctctaatatcctaataaaaagatacttgtccattttaaacgaattacctgtcacatccgaagatcttcctatatactctacggttgttttacaaaatgtatatgaaagaaacaacaaggacaaacagttacaaataaaagtcctggagttgatcagcaaaattttgaaggccgacatgtacgaaaatgacgatacaaatctaattttgttcaaaagaaatgctgagaattggtcgtcaaatctgcaagagtgggcaaacgagttccaagagatggtccagaacaaaagtatagatgaactacatacaagaacgttttttgacaccctttacaacttgaagaaaattttcaaaagtgacatcacgatcaacaaagggtttttgaattggttagcgcaacaatgtaaagccaggcaatctaacttggacaatgggctccaagagagagatactgaacaagactcatttgataagaaacttatcgacagcagacacttgatctttggcaaccccatggctcatagaataaaaaatttcagagatgaactctga

SEQ ID NO: 2974 - DNA, 1266 bp, Saccharomyces cerevisiae
atgtcccagctgacggagttcattagctgtatccctgtggttaatgaagaacaaaatgaagaagatgagcgtggcctctgtaagattcagattgaagatggcgctatgttggaaacattagatgagaacagtctttcagggcttagaatagagaaaatgttggtaagtgaaggtacaggaattttttccaaaagcagttttggaatcaatgatttgcgaatctttacgggagaaaatatcgatgaagagtctaagaaatatgtgtggtatgaactactcaaaatgttaactggtcacaaagtgtacattgcatcgttagacgaaaaagtcgtattcacaaaatggacgtgcagaatgcaagatgatgaggtatggaaagtagttatggagttggagtcatcggcgatcataagaaaaatcgctgaacttaccttgcatccagtcaaaaagggagagattgatttatttgaaatggcagataaactctataaagatatctgttgtgttaacgattcttaccggaatataaaggagagcgattctagcaatagaaatcgagttgaacagctggctcgggaaagggagctattggataagcttttagaaacacgtgatgaaagaaccagagcaatgatggtaaccttgttgaatgagaagaagaagaaaataagagagcttcatgagattctgcgacaaaataatatcaaattgtctgacgatgatgttttagattctgcgcttattaatacggaagtgcaaaagccaatttctgagttaaactctccaggaaaaagaatgaaacgaagaaagacggtagtagagcctcaaaatttacaaaagaagttgaaagacacaagtcggaggagagctaatagaaaaatatctaatcaatccgtgatcaaaatggaagacgacgattttgatgactttcaatttttcggactttctaaaaggccaattattactgctaaagataaactcagtgaaaagtacgatgatattacctcttttggagatgacacacaatcaataagttttgaatctgatagtagcagtgatgttcaaaaacatttagtgtctttagaagacaatggtattcaaatatcagcaggaagatcggatgaagattacggagacatttctggttctgaatctgagactgatgcaagtgcaggggaaaagaagagctccaaccatagtgaacaatccggtaatgatagggaaccttgcttgcagacagaatcggaaacggatatagaaacatag

SEQ ID NO: 2975 - DNA, 1266 bp, Saccharomyces cerevisiae
atgtctgaattactagatagctttgagacagagtttgcgaaattttataccgacagcaatctggaagagacaaaccttcaaaaatgtcttgatcatactcatgaattcaagagtcaattaaagaagttgaaagcgcacttaaacaagcatattcaggaatcaaaaccagaagtctataataagctgagtgataaggagaaacaaaagtttaagagaaaaagagaactaattattgagaagctaagcaagtcacagaggcaatgggaccattcagtaaagaaacaaataaagtacgtttctcagcagtcgaatcgcttcaacaaaagcacgctgaacaaattaaaagaatttgatatagatagcgtatatgtcaataaattaccgaaagagacaatggaaaatgttaatgaagccatcggttaccatattttgaggtatagtatagacaacatgccattaggaaataaaaatgaggctttccagtatctaaaagatgtctacggaattactaataaagaatctactgaatttattgagatgggccaaatcgtacatgatcttaaaaagggtgacacagaaagctgtctgaaatggtgctccaatgaaatggaaagcttatcatctaaccatacggctttatcgtccctaaaatttgatttatacactttgtcagcaatgcagatagtgaagcatggaaatccggtagagttgtactaccaaataacacagaacgcacccctggattgctttagacatagggagaaggaattaatgcaaaacgtcgtaccattattaactaaatcgctaataggtcaacctattgaagatattgattctaaagtaaataaggaattaaaagaatgcacgtcgttatttataaaagaatattgtgctgcaaaacatattttctttgactctcccttgtttttgatagtattgagtggtttaatttctttccaatttttcatcaaatacaaaaccatcagggagttagcgcacgttgactggactacgaaagatgagttgccatttgatgtcaagttaccagattttctgactcatttccatccgatcttcatctgtcccgtcttaaaggaggaaaccactacagaaaatcctccttattcactggcatgccatcacatcatttctaaaaaggcgctagacagattatcgaagaacggaacaattactttcaagtgcccatactgccccgtaaatacttcaatgagcagtacaaaaaaggttcgttttgttatgctttga

SEQ ID NO: 2976 - DNA, 1267 bp, Saccharomyces cerevisiae
atgggatattttgttccggattcacatatcgaaaatctaaagtcatataagtatgtgaagcgtccattggctgcctttaaagtgcagaagtcagaagcattgttactaactttcaacaatttttattccttttcatgatagatatcaaagtgaagaccgctcgctggtatcgaagtatttcttaaagccattttggcaaagattttgtcacatatttcccacgtggatggcgcccaacatcatcacattatcaggatttgcttttatagttatcaacgtgttgactgtattctattacgatccaaaccttaacacagatacgcctcgctggacatatttttcttacgctttaggtgtattcctatatcaaacgttcgatggatgtgatggtgtacacgctcgccgtatcaatcaatcaggacccttaggagaactattcgatcatagtattgatgccattaattctactctgtctattttcatcttcgcatccgaaactggaatgggattttcgtataacttaatgttatcccaatttgcgatgctgacgaatttttacttaagtacttgggaagagtaccatacacacacattatacttaagtgagttttctggacccgtggaaggcatcctgattgtttgcgtttcattgatactgacaggtatatacggaaaacaggtaatctggcatacctacttatttacaattacagttggtgataaggtaattgatgtagacactctagatattgttttttccctagctgttttcggtttggttatgaacgcattgtctgcgaaaagaaacgtggataagtattatagaaacagcacttcttcggccaacaatatcacgcaaattgagcaagatagtgctataaaaggtcttttgcccttttttgcctattatgcaagcattgctttactagtgtggatgcaaccaagctttattacactctctttcatcctttccgttggtttcacgggagcatttaccgtcggaagaataatcgtttgccatttaactaagcagagctttcccatgttcaatgcacccatgttaattcctttgtgccagatagtattgtacaaaatatgtctatccctttggggaattgagtctaataaaatcgtctttgccctatcttggcttgggttcggtctctcactaggtgttcacattatgtttatgaatgacattatccatgaatttactgagtacctggacgtttatgctttatccatcaagcgctccaagctgacataa

SEQ ID NO: 2977 - DNA, 1268 bp, Saccharomyces cerevisiae
atgaaagtatgttatcactctaaaactgccatgctctttattcgaaattactaacattgtacctgaaccctccttttcttccttagtttattgatgagctagatatagagagagtgaatcaaactctcaatttcgagacaaatgactgtaaaatcgtgggcagttgcgatattttcacaacaaaggcggttgcatcagatagaaaattatataaaactattgatcagcatttggatactattttacaggaaaatgagaattacaatgctacccttcagcaacagctagctgctcccgaaacaaaccaatcaccctgctcgtcgccattttattctaataggagggatagcaactctttttgggagcaaaagagaagaatatcttttagtgaatacaatagcaataataacactaacaacagtaatggcaatagcagtaataacaataactattctggacctaatggttcttctccagcaacttttcccaaaagtgccaagctaaatgaccaaaatttaaaagaattagtctcgaattacgattctggctctatgagctcatcgtctcttgattcttcttctaagaatgatgagaggataagaagaaggagcagtagcagtattagcagtttcaaaagtggtaaatcatcgaacaataattacagttctggtacagcaaccaacaatgttaacaaaagaagaaaatcttcgataaacgaaaggccaagcaatttaagtttgggtccgtttggtcccataaacgaaccgtcaagccgcaaaatatttgcttatctgattgctatcctcaacgcttcttatcctgaccatgatttttcatcggttgagccaacggattttgtcaaaacatcattgaaaacttttatttccaaatttgaaaacaccttatattctcttggtagacaaccagaggaatgggtctgggaggtaattaattctcacatgactctttctgattgcgtcctttttcaatattcaccttcaaactcttttttggaagatgagcctggctatctttggaatcttataggttttctttacaacaggaaaaggaaaagagtggcttacctttacttgatttgctcgcgtctaaattcgagtacaggcgaagtggaagatgccttggcaaaaaaacctcagggaaagcttataatagatgatggctcaaatgaatacgaaggagaatacgatttcacttatgatgagaatgtaatagatgataaatcagatcaagaagaatccctacagtag

SEQ ID NO: 2978 - DNA, 1269 bp, Saccharomyces cerevisiae
atgaatcagtgcgcgaaggacataactcatgaagcctccagtatacccatcgatttgcaagaaagatactcgcactggaagaaaaacactaaactactttatgattacctaaacacgaattcaacaaagtggccgtccttaacgtgccagttctttcctgatttagataccacttcggatgagcatcgcatcttgttatcctcatttacatcttcccaaaaacctgaagatgagaccatatatattagcaaaatatccacgttgggtcatataaaatggtcatctttaaataatttcgacatggacgaaatggaattcaaaccggagaactcgacaaggtttccctccaaacacttagtaaatgacatcagtattttcttcccaaacggggaatgcaatagggcaagatatttgcctcaaaatccagatattatagccggcgcctcttcagatggtgcaatctacatattcgatagaacaaaacacggctctactagaataagacagtccaaaatttcacatccctttgagacaaagctgtttggttcacatggtgttattcaagacgtggaggcaatggatacttcttcggcagatataaatgaggcgacttctttagcctggaacttgcagcaggaggcccttttactttcttctcactccaacggccaagttcaagtttgggacattaaacaatattcgcatgagaaccctataatagatttacccttagtgtcaataaacagcgacggaacagcggtgaatgatgtaacttggatgccaacacacgattccctctttgctgcttgtactgaaggaaatgcggtctccctattagatctgaggactaagaaagagaagctccagagtaaccgtgaaaaacacgatggtggagtaaactcctgtagatttaactataagaactctttaattctagcatctgcagattcaaatgggaggctaaatttatgggatattagaaacatgaacaaaagcccaatcgctaccatggagcacggtacttccgtttcaactttagaatggagtccaaatttcgatactgtattggcaacggctggccaagaagatgggttagtcaagctatgggatacctcctgcgaagaaactatatttacccatggtggtcatatgctcggtgtgaacgacatttcgtgggacgctcatgacccttggttaatgtgcagtgtggcaaatgataattcagttcacatatggaaacctgcaggaaaccttgttggacattcgtga

SEQ ID NO: 2979 - DNA, 1269 bp, Saccharomyces cerevisiae
atgagaatatcaatattacagctggtgccggttgttggctacatcggatttgcactgggagaattatacaaacccaaaaactccatttcttgttctccaaataacccttgtcccgcagaatggccgtgctgctcgccgtataatgaatgtggcgctggaccgatatgtgtcggtggctgcaacgtgaggtcatctttcgacgaggaaagctgtgctcctatacctgcattagtcgccagtcaaaaacttgaatttgttagcacaccaaaggttcctaaatttattgtgaactatcaacctaagccaccaataagagagggaaatggaccgaataaggcaaataccaaggtgggtgtagtagaaggggagctaaattccaagagaatcatacactacgccaaattcttggtcactccagacagtaaagaggcagagaaaatgttggaagatttcgatttcacacatagcggctacacatcaattgaagcgagtagcgggaatattgttctggctatgccaaaaaaaactaccggaagtttgatcacatcgaccaggtcgtttctatacggcaaggcaagcgtgcgaatgaaaacggcgaggtcgaggggtgtggtgactgcatttgacttaacatccgcaattggggacgagattgattttgagtggctgggtggtgatttaatgacggcccaatcaaactactattctcaagggcatttggattacacaagaatgcaaagatttcccgtaggcgctgacacttgggccacttaccacacttatgagattgattgggacccggataggataatatggtatgttgatggtaaaatagctcgcacagtcctgaagaaggatacctgggaccccattagtaaagaatataggtacccacaaacgccgatgagactagaaatcgctgtttggccaggcggctcggaaaccaacggacccggtacaataaactgggcaggtggcctcatagattgggaaaattcacccgatattatcgaaaagggccaatttacggcgcatgttgaacaaatcaccgtaacgccgtaccaaaataaattcacagaacaagtgcagttttgtataaaggcaaagaaaaaggcaccaaccttttcccaaaaagatttgtcaagagtagtcgtttcgtataacaggcaagacagactgaatcatcatgatgaggggtctctcaaatgggactgctttgttactccaaagataaatgactggttgagttcttggaaacggtcaaaatag

SEQ ID NO: 2980 - DNA, 1269 bp, Saccharomyces cerevisiae
atgagcagtaataaaggaaatgggcgcttgccatcattaaaagattcctcctccaatggaggaggatctgccaagccctcattaaagtttaaaccaaaagcagttgcaagaaagtccaaggaagaaagagaagcagctgcgtccaaagtaaagctagaggaggaatctaagagaggtaatgacaagaaacatttcaataacaagaataaaagagtaaccggcgctggcggccagcaaaggcgaatggccaaatacttaaataacacacacgttatctctagcggtccattggcggctgggaactttgtaagtgagaagggtgatttgagaagaggattcatcaaatcagaaggaagcgggtcatctcttgtgcaaaagggcctggaaactattgacaatggtgctgagagctctgagaatgaggcagaagacgatgataatgaaggtgtagcgtccaaatctaagaagaagttcaatatgggaaaagaattcgaggcacgcaatctcatagaggacgaagatgacggcgaaagtgaaaagagcagtgacgtcgacatggatgacgaagaatggagatctaaacggattgaacagttattccctgtgagacctgtccgcgtaagacacgaagacgttgaaactgtcaaaagagaaatacaagaagctctttcagaaaagccaactcgtgaaccaacccccagtgtgaagacagagcctgtcggaaccggattacaatcttatttggaagaaagagaaaggcaagtcaatgagaaactggcagatcttggacttgaaaaggagtttcaatcggttgatgggaaagaagcggccgctgagttggaattattaaatgcagatcatcagcatatattacgaaaactaaagaaaatgaataataaaccagaaagattcatggtattccagttacctactaggttaccagcttttgaaagacccgctgtgaaagaagaaaaagaagacatggaaacccaggctagcgacccttcaaagaagaagaagaatattaaaaagaaggacacgaaggatgctttgtctactagagaacttgccggcaaggttgggtctatacgggttcacaaatctggaaaactttccgtgaaaattggaaatgtggtgatggatattggcaaaggtgccgaaaccacatttttacaagatgttatagcattaagtatcgctgatgatgcatcctcagcggaacttctaggccgtgtggacggtaaaatagtagtcacacctcaaatctaa

SEQ ID NO: 2981 - DNA, 1269 bp, Saccharomyces cerevisiae
atggcaatcaaaccaagaacgaagggcaaaacgtactcctcaagatcggtgggttcgcagtggttcaacaggcttggtttcaagcagaacaagtacggaacttgtaaatttttgtcgataataacggcctttgtttttatcctctatttcttctccaatcgcttctatccaatttctcgttccgccggtgcatcatattctccatcccatgggctgtatattaacgaaattcctgcctccagccggttgatttatccacatgtagaacatgtgcctgtgttaaaacaaatgaccgttaggggcctgtatattacgaggctagaagtggatggcagtaaaagattaattttgaaaccagaagagaatgctttgacagatgaagaaaaaaagaagactactgatcaaattctattagtgaagcactcgttcttagaccatggtaaattagtgtatcggaagagcaatgatgcacctgaagtggtcgtagtaaccctgatagattttgaaaactacgaattagaaacaattattcaaattgttcaaaatagggttgattacgctcaaaagcaccaatatggtgtatacattcgttggatacaggagtttttgcctgttcttgaaaatcagaatttggctgaaagctacgaattcattaagccattggtgataagagccgccatgcatgctttcccaactgccaagtatattcattttgttgatcaagatgctttattgatgaatctcgatctttctttacaaaaatacctgttagatccaaagattatggatttggctctattaaagaacgtccctgttgtggcgaattcaaacatcaagacatacaatcattttgaatatagttcggcaaagattatcattccacatgatgcggatggtaatattgatgcgtcctcatttgttattgccaatgacttttatggtaaagctctgatagactacttgaatgatccgttactgagaaatttcccatgggataataccggtgataagttgagtgctgctatcggtcatattttacagtggcatcctacattactgggtaagacggcaatcgtcataccaaaagttttggcaagtcagtacgatgcatccttggatcaagaaggtgagtctggaaacggtgcttctaatggcgatgtttaccattataatgaaggggacttggctgcctccttcaagggatgtagatcaagaggtacgtgtgctagtgaaataggtcacatgtaccagaaaatcaagaaatcttag

SEQ ID NO: 2982 - DNA, 1269 bp, Saccharomyces cerevisiae
atggttgatcttatagcgagggatgactccgtagatacttgccaagcttctaacggctacaatgggcacgcaggtcttagaattctggcagtattcattatactgatatcgtcaggattgggagtttatttcccaattttgtcatcacggtattcgtttataaggctaccaaattggtgctttttcatagcgaagttcttcggttctggtgtcattgttgccacagcgttcgttcatcttctacagcccgcagccgaagctctgggagatgaatgtcttggtggcacatttgccgaatatccatgggcttttgggatctgtttaatgtcgcttttcttacttttcttcactgaaatcatcacgcattattttgtagcgaaaacgctgggacacgatcatggggaccatggggaagttaccagtattgatgttgatgctcccagttcgggatttgtcatcagaaatatggactcggatcctgtatctttcaataacgaagctgcctactccatccataatgacaaaactccgtacactactagaaatgaagagattgtcgctactcctataaaggaaaaagaacccggctcaaatgttactaattatgatctggaaccgggaaaaacagagtcactagctaatgaactagttccaaccagttcccatgcgacaaatctcgcttctgtacctggaaaagatcattattctcacgaaaatgaccatcaagatgtctcccagttggccacacgtatcgaggaggaagataaagagcagtatctcaatcagatactagctgtttttattctagaatttggcatcatctttcactctgtatttgtgggtctttcgctatctgtcgcgggtgaagaattcgaaaccttatttatcgttttaactttccaccaaatgttcgaaggtttgggtctaggcacaagagttgccgaaacgaattggccagaaagtaagaagtacatgccttggttaatgggattagccttcactttaacgtcacccatagcagtcgcggtaggtattggtgtcagacactcttggatacctggctctagaagagcattaattgctaatggtgtttttgactcgatatcatcaggaattcttatttatactggactagtcgaattaatggctcatgaattcttatactctaatcaattcaaaggacctgatggcctcaaaaaaatgcttagtgcatatctcatcatgtgttgtggagctgctttaatggctcttctagggaaatgggcatag

SEQ ID NO: 2983 - DNA, 1269 bp, Saccharomyces cerevisiae
atgtcgacaattggagctgttgatattcttaatcaaaagaccataacttctgaagtggctgcctcagtgacttcaaaatatctacaaagtacgttttctaaaggtaatacaagtcatatcgaagataaaaggttcattcatgtcagttcgcgttctcattcaagattcacctcgactcccataactccaaatgaaattctttccctaaaatttcacgtatcaggttcatcgatggcgtatagtagaatggatgggtcattgaccgtttggtttattaaagatgcaagttttgacaaatctgtagaagtttatattccagactgttgtggttccgataaattggctactgatttgtcctggaaccctacttctttaaatcaaatagctgtcgtgagcaattcatcagagatatccttactcttaatcaacgaaaaatcgctaacggcatccaaattaaggaccttgtcattgggaagcaagactaaggtcaacacatgtctttatgatccattaggaaactggttattagctgccaccaaatctgagaaaatctacttgtttgatgtgaaaaaggatcacagctctgtctgttctttgaacatcagcgatataagccaagaggataatgacgttgtgtattccttagcatggagcaatggtggaagtcatatatttattggctttaagagtggttatttggccattttaaaagcaaaacatggcatattggaggtttgtaccaaaattaaagcacatactggtcctataaccgagatcaaaatggacccatggggaagaaacttcattactgggagtatcgatgggaattgctacgtatggaatatgaagtcactatgttgtgaattaataattaacgatttgaactctgcggtaacaacactagacgtctgtcatttgggtaaaatactaggaatttgtacagaagatgaaatggtatatttctatgatcttaatagtggtaatttactccactctaaatctttagccaattacaaaaccgatcccgttttgaagttttatcctgataaatcatggtatatcatgtcaggcaagaatgacacactatcaaatcattttgttaaaaacgaaaaaaatctaataacttattggaaagacatgttcgataacacgatgattgaaaaacgtaggaaaaacaacggtggaggcaacaaccacaataaaaggacgagtaagaatactgataggattggcaaggataggccgagtagattcaactcaaaaaaataa

SEQ ID NO: 2984 - DNA, 1272 bp, Saccharomyces cerevisiae
atgacaaaagcttatactatcgttatcaagctgggcagttcgtcgctcgtcgacgagagcacaaaagagccaaagttgtccatcatgacgttaatcgtcgagaccgtgacgaatcttaagcgcatgggccacaaagtgatcatcgtatccagcggcggcattgccgttggtttggacgctctcaacattccgcacaagcctaagcagttgtctgaagtgcaagcgattgccgctgtcggacaaggccgtctcatcgcgcgctggaacatgctgttttcccagtatggcgagcaaacagcgcagatcctgctcacgcgtaacgatatactgcgttggaaccagtacaataacgcacgcaatacaatcaacgaactgctggccatgggtgtcatccctatagtcaacgaaaacgatacgctatccattagcgagatcgagttcggcgataacgacacgctttctgccattaccgctgctcttgtaggggcggatttcctgttcttgctcacagatgtggactgcctatatacagacaatccgcgcactaatccggatgctcgtcctattgttctcgtgccagagctatcagagggccttccgggcgtcaacacttccagtggttcaggctccgaggttggcacgggcggaatgcgcaccaaactcatagccgccgacctcgcctctaatgccggtatcgagactattgtgatgaagagcgaccgtccagagtacgtcccgaagatcgttgactacattcagcatcacttccgccctccgcgccatatcggaaacggcacacagcagcagtttctcgatcttcaggatacggagctcgaacagttgcgtcgctacgatgttcccatgcacaccaagttcttagctaatgacaacaaacacaagcttaagaacagggaattttggattctgcacgggctcattaccaagggcgccattatcatcgacgagaacagctatgataaacttttgtcaaaggatatggctagtctgactccaaacgccgtgatcgaagtccgagacaacttccacgaacttgaatgcgttgatctcaaaataggccagcggttacccaatggcgaattggatatctcgaagccgattcagtctgttggatgcgtccgctccaattatacgagtctggagcttgcgaagatcaagggcttacccagtgagaagattcacgatgttttgggctacagtgtgagtgaatacgtagcacatagagaaaacatcgctttccctccgcaattttga

SEQ ID NO: 2985 - DNA, 1272 bp, Saccharomyces cerevisiae
atgacagacaaaggcaagaacgatttaacaagcaaagctaaggacaaagccagaggcaaccccgagaagccaccatattggtttgaaatcattgtttctgatccacaaaaaagaactggtgacccaggctcttcatctggctacgtgagttatcagatatcaacaaagactaacaacacgtcattttatgataatcgtggcgatccagaatctattatagttgtacatagaagatacagtgacctattgctcctgcatgatattttactcaacaggttccccacctgcatcatcccgccattacctgataagaaagtttttcaatacatagcaggcgataggtttagccaaagatttacacaaaagagatgtcatagtttgcaaaatttcctaagaagggtctctttgcatcccgatctttctcaatcaaaagtcttcaaaacttttttggtgagtaaagattgggaatctcaccgcaaagtcctccaggatagcttgcaaccaaataaagatgaagttactgatgcttttatgaatgccttcaaaacagttcacaagcaaaacgaagaattcactgagataagggagaaaagtgataaactagatcggactgtgacaaagatagataaactttttcataaggttgtgaaaaaaaatgattcgatgtctgaagactatacaaagttgggcagtaatttacaggaattacaagaattggtcacaggcgaaaacgaggaacttgctgcgaagttgaagatttttaatgaaggtgtaacacagctgtcatatggcttgcaagatcttacaaagtatctggattacgaatatattgttgatttgaaggatcttgaacactacattgatagtatgcgacagctgatcaaattgaaagaccagaaacagatagactacgaagaactaagtgattatttaaccaggtcaatcaaagaaaaaaataacttgatttctggatacggaggtagtaatttctttgccaataaattggaagaactagcgggaataaatcaggaggcttcacgtagagaaaaaatcaataaactagaaggcaaaataacgtcattaacaggtgaattagaaaacgctaaaaaggtggcggatggattcgaacaggaatgcttgaaggaaatagaccatttcgaaagtgtaaaaacggctgaaatcaagaaatctctgggctcactagcggaccatcatatcgaattctacgaaaggatacttgaagcatgggaaaaagtagacgatagtctatag

SEQ ID NO: 2986 - DNA, 1272 bp, Saccharomyces cerevisiae
atgactgaacctgccctgagtagcgctaataacgctctgatgcaaaaactaacaggtcgacaactttttgacaagatcggccgtcctactaggatcgttgcaccaatggtagaccaatccgaattagcatggcgtattctatcgagaagatacggtgcaaccttggcgtacactcccatgttacatgcaaaattatttgctacctcgaagaaatatagagaagataattggtcttccttagacggctctagcgtagataggccgttggttgtacagttctgcgctaatgacccagagtatctattggcggcagctaaactggtggaagataaatgcgatgcggtagatttgaatttgggctgtcctcaaggcatagctaagaaaggtcactatgggtcatttttgatggaagaatgggaccttatacacaatttaatcaacaccttgcacaaaaatttgaaagttccagttacagcaaaaatacgtatatttgacgactgtgaaaagagtttgaattacgccaagatggtgctggatgctggagctcaatttttaaccgtccatgggagagtaagagagcaaaaaggacaaaaaactggtttagctaactgggaaacaatcaaatacctaagagataatttacctaaagaaaccgtgttttttgctaacgggaatatcttatatcctgaagatatttcacgttgtatggaacatatcggtgctgacgcagtgatgagtgctgaggggaacttatacaatcctggtgttttcaatgtaggccaaactaagaacaaggagaagatatttccacgcgtagataagattatcagagagtatttccagattgtcaaagaatgccaggaatctaaagcctccaagacagcaatgaaatcacatttttttaagattttaaggcctttcttgccgcatcatactgatattaggtcaacacttgctactatgaatgcaaaagccacgtgggaagaatgggaggaacaagtagtgaagcctgtcgaaaaagtagtgcaagaaatatttgaacagccagatatcgctattaaggatgaaattactatcggcgaaaagcaatcatggggtggttcatatagaactgttccatactggagatgtcaaccatattttaggcctgttaacggtatcacaggtgataaaagagttatgcaaggcctcatagatgaaagcgtgaacaagaaacgtaaagctgacgtgccattagaatctgctgataaaaagaaggacgtgaaagcttaa

SEQ ID NO: 2987 - DNA, 1272 bp, Saccharomyces cerevisiae
atgccacaatttggtatattatgtaaaacaccacctaaggtgcttgttcgtcagtttgtggaaaggtttgaaagaccttcaggtgagaaaatagcattatgtgctgctgaactaacctatttatgttggatgattacacataacggaacagcaatcaagagagccacattcatgagctataatactatcataagcaattcgctgagtttcgatattgtcaataaatcactccagtttaaatacaagacgcaaaaagcaacaattctggaagcctcattaaagaaattgattcctgcttgggaatttacaattattccttactatggacaaaaacatcaatctgatatcactgatattgtaagtagtttgcaattacagttcgaatcatcggaagaagcagataagggaaatagccacagtaaaaaaatgcttaaagcacttctaagtgagggtgaaagcatctgggagatcactgagaaaatactaaattcgtttgagtatacttcgagatttacaaaaacaaaaactttataccaattcctcttcctagctactttcatcaattgtggaagattcagcgatattaagaacgttgatccgaaatcatttaaattagtccaaaataagtatctgggagtaataatccagtgtttagtgacagagacaaagacaagcgttagtaggcacatatacttctttagcgcaaggggtaggatcgatccacttgtatatttggatgaatttttgaggaattctgaaccagtcctaaaacgagtaaataggaccggcaattcttcaagcaataaacaggaataccaattattaaaagataacttagtcagatcgtacaataaagctttgaagaaaaatgcgccttattcaatctttgctataaaaaatggcccaaaatctcacattggaagacatttgatgacctcatttctttcaatgaagggcctaacggagttgactaatgttgtgggaaattggagcgataagcgtgcttctgccgtggccaggacaacgtatactcatcagataacagcaatacctgatcactacttcgcactagtttctcggtactatgcatatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataa

SEQ ID NO: 2988 - DNA, 1272 bp, Saccharomyces cerevisiae
atggaaaacttatgccctccacctccttcccaaatgaaggatttttccactcctccaagaaacaggcatcgtcacaaaagatcctttgctatatctggagattttgaattcttaaaacaacctgcctctgcgcctgttttgccttctgcgtacgactcacctaccttcgaaaatacaccaagaagagtaagcggtatgagcgtaacaatgcctgatgaatctcaaaatgaatcagcattactaaactcaccaagcccaaggttttttattagcgaagcatccacatattcatcaccaattaaaggagtgccggacgctatcattaatttggatgatgtgctcattaataaaccaaaaatgtgtagatcacatcgcaaaaccaaatcagtaccagtaaaattggacgaattttattcctcccataaatgtagctcagtaccagaattaactataaatgaagaaatagatgaagatgacaccaaccctcagttgctggagcccgtaaaaccattatcatcaacttctctatctactgatatgaatgaagataaaaaaatgacactaaaaaatgccaggagccataactcgttaaaaattcaggcacaaaagcaaaggtactacaactcagcaaggtatctgcctttgaatagtgaggaccgagcaacagatccacaaattttaacgaagcaaagctctgttacgtctttattttcttctaggtcaattacacctgtatcttgtaacattaacaatgcgggtagaatcaatgcaatcagtggtaattatctagatgacgtcctttatgaccttgacacccctgccacaactctaattcaggatattgataaccttcaaactagtatcaacgaaagggttaggttgtcaccacaatcctcgtcgataaaaaagtatttttccaaagatggaaaatctgttagcagcttcaatttccagtctcaggagtgcgatatggtatcttttactgaggattttgcccatgtaacatcattgtcttcttctattcttgactctgagaaacaaacagacgacgaagaagaagagagtattccggaagaaatactacgaggagaacccctccacgtatacaacgaaactagtggatctgataaaagtgtcattttgccgacgaaacaaaaatctgctcccattaacaaggatagtaagcacagttcaactcagtatgaagaaaaatcttttaagaagaatagaaagttcaaaattttcgccaagttattctgcactaggaaatag

SEQ ID NO: 2989 - DNA, 1272 bp, Saccharomyces cerevisiae
atggatgttgatataggatgttattttgaagagaaacgctatgacgacaaactgttagacttcatcagatatgacgttaaaacacctaaaaagactaaatatatactacaaaggcctacggcgacagatgaagagagtgtacgattacaaaggttttaccaattaggagtagatctaaaattgaagtattccaagcggaggtcattgaagaagcaagggcggatcaagaatgctactgaggaattgctgcgattagccaatgaacagttgaaacttttcaacagaatagtagaaagagaaaccaattggataatttatccgctgtgggtaatggctaaacaattaattcgtctggcaaacgaatctagtgaacttaataaagactcaattgaggaatgtggacgcactatccatagaagctttactatatgcctcaatgataggaacccaagattgaatgaaaataaaaaaatcgggtgttatatgtttgctaatctagagttttccatctaccatcggttaagtaataaagatatgattaaaaatttagtgaaagtcctcgagagcagagtgaacgcccgggatataccaccgttgaataaaagcctggcaatggaacataagtctcaagtggtgttgtataattattatctaggtcaatactacggatgtctggaaaacgatcacgaacgcgggttcttccatttaaatgaagcattattgcaatgtccaatgctatatgtggaatctaccggcaagttcgtcttacagggccaaatggaaaagataatgatactgctggttccgcttgctcttttaactaaaaggttgtaccctcactgggatcatccagtaatcgccggagtaattactaggagtaagcgcttaagtcaagtttatccgacattagtgcgtagcgtaatctcagggaacctgtcactgtacgaggctaccgcagcaagccatgaaagatttttcctttcgcaaggattgcatgtcgtcatcacattacttcgagaggtggtcttcactcggttggtacaacgatgttggcaatgggggaatgatcggaaaagtatcatgcccttgaaaattcttctggcaacaaaacaacacgatagttctgccaatgaggacgaagaggagcagttggatgccctagaatgccgtctagcaagtgctatagcaagtgggcttttgcgtgcttatctttctcactccaaccgctgcatcgttttcagtaagaaggagccctttccccatagcaaatga

SEQ ID NO: 2990 - DNA, 1272 bp, Saccharomyces cerevisiae
atggattctcgagttgcactggtacgaaaatacatagcaccatcggtgataaaaagcgattctattcaattgcacggtttagtgaaggcaccactatttaaagcgttgaatagccgttacaaattaggttcactacagatagtacaggatgtcgattggaatgcgaagacaacaccatccgattctccagagcctctggccgctactctaaactctaatcgatccctaccaatgactaagttccccaagcaggagatcttggaacaggtaaaattggatactaaggttggcaaatggaggaaattcatgacaggttggtttagaattggattgtatcttttaaaaagctataaaacaggaattcagaacacgttaaaagtattctgggatactcgaaacgaagagcagaaattcagcataaaaaacggtgcattggctaacttagtacgggaaatagaaatgcatgaaatcaatacaagactatcgtcttcatcattgcctacaagttcttcagcaaaagccccattaaggccactttcaatcaataggaaaacactggtggaactgatcagacgagatcaaatctggaaattacctgtatttttcaccttagtattcatatttgaggaggtaagtgtattgatctttaccttttttccacgtgtctgtccgtacaattgtttaactcctggtggatacaagaagctttccaactcatatatcaagggaacaacaagcacacaaggtaactacggtctgggtcccttagagtttactaagcaaggtacaattaagtatgagccaccatatgcagttcctattgagaatttgtataattttctgacaagctttcctcaaagtatgatatcaaactggaaactgtatatttataaaaagttaaaattacagaagctactttgcaatgagatagaaaaaatttaccagtatctgtttatcgatgactggttgctgttgcagagtatactcaacactgatgttgagaaaactaaaatcgcgctaagtgatagagaattggttaactgtatacttgaaagaaaactttatcacatgggcgatgacttgaatgagatggttaatgacacgttagggaaagaaatcttactgaaaagattgtttctttattggacattaagatataatgacactatatccttaaacggaaagcatacattcagtgagaaatggggtgtcaacaatatatcattgttaaaatataattcagaattggtagctacgaaagatattcaatag

SEQ ID NO: 2991 - DNA, 1272 bp, Saccharomyces cerevisiae
atggcaacccaagccctagaggatatcacggagaggcttttaataaggtcgcaagaggctatcttgcaattagatctgtggatacaacgtcagcagagatcatcaatatgccagacaacagatcaagagtcattggataagttatcccaacagtacaaccagtatatgtctcaactgaactctttgtatgttagatcggaatctgttcgagacaagttgagcaaggaacaacaacgcagattgatcacagaggataatgagcatcaacgcatagaagacttggttcgtgaattccaggatatcactttgaggttgaacgagctggccaccgtcccaaatgaagcgcctaatgattctccacaatcgcaatccaccagaagtagtttagggtcatttcaacctcgaccattgaaaataattgagaggcaacgtctgtgtatggtaactccatcgaaaccaccaaaaaaatcggtaggctttaaccccatcaatgaagtcgattgtccttcgaaaactaactctttaccgtgctcacctaaaaaacaacctgcaagaaatcgcactttacgtgcagccaaatcacatgatactggcttgaacaaaagtaagaaaccgtcttcctcggatacgtatgagtctttcttcaaaaatagacaaagactttcgttgaccttctttgatgaaatggatgatgaagattttgattctgatcaagatactatcattctaccaaacataagtacccctccacatgttggtgtgaccgcaaagggtgctgaattcgaacctttaaggagatataactctcacgaaagtatactatctaacaaaccagcaccttctaagtcgctcaatctgggaagtttctccgcctcattcttcaggccatctaatccgacgtttggaacttcgatatcaaatgtccaagtgaactgtcatccaactgttgcagcgacaatggctcctagtcgtaatggtcctcgtatttcaagttctaaggcgttgttatcatcattcattgcacgatcagatacacatacggtaaaagagaacaacacaaatcttaagcatgcatcttttatggataagtttaattcatcgttaagcacaatatcagaatcttttcaaagtaagagggggagaaagaataagggcatgaatgaagaacgaatatcaaatcataatgtagcacaggaacaaaaaaataatatggatataagcgtctctatagaagaattgcaagatgctttgaatacagaactgctgttttaa

SEQ ID NO: 2992 - DNA, 1272 bp, Saccharomyces cerevisiae
atggcagcacatcagatggactcgataacgtattctaataatgtcacccaacagtatatacaaccacaaagtctacaggatatctctgcagtggaggatgaaattcaaaataaaatagaggccgccagacaagagagtaaacagcttcatgctcaaataaataaagcaaaacacaagatacaagatgcaagcttattccagatggccaacaaagttacttcgttgaccaaaaataagatcaacttaaagccaaatatcgtgttgaaaggccataataataaaatctcagattttcggtggagtcgagattcaaaacgtattttgagtgcaagtcaagatggctttatgcttatatgggacagtgcttcaggtttaaaacagaacgctattccattagattctcaatgggttctttcctgcgctatttcgccatcgagtactttggtagcaagcgcaggattaaacaataactgtaccatttatagagtttcgaaagaaaacagagtagcgcaaaacgttgcgtcaattttcaaaggacatacttgctatatttctgacattgaatttacagataacgcacatatattgacagcaagtggggatatgacatgtgccttgtgggatataccgaaagcaaagagggtgagagaatattctgaccatttaggtgatgttttggcattagctattcctgaagagccaaactcagaaaattcttcgaacacattcgctagctgtggatcagacgggtatacttacatatgggatagcagatctccgtccgctgtacaaagcttttacgttaacgatagtgatattaatgcacttcgttttttcaaagacgggatgtcgattgttgcaggaagtgacaatggtgcgataaatatgtatgatttaaggtcggactgttctattgctactttttctctttttcgaggttatgaagaacgtacccctacccctacttatatggcagctaacatggagtacaataccgcgcaatcgccacaaactttaaaatcaacaagctcaagctatctagacaaccaaggcgttgtttctttagattttagtgcatctggaagattgatgtactcatgctatacagacattggttgtgttgtgtgggatgtattaaaaggagagattgttggaaaattagaaggtcatggtggcagagtcactggtgtgcgctcgagtccagatgggttagctgtatgtacaggttcatgggactcaaccatgaaaatatggtctccaggttatcaatag

SEQ ID NO: 2993 - DNA, 1272 bp, Saccharomyces cerevisiae
atggcggaaatacctgatgaaaccatccagcagttcatggcattgaccaatgtgtcgcataacatagccgttcaatatctctctgaatttggagatttaaatgaagcactaaattcctattatgcttctcaaacggatgaccaaaaggatagaagagaggaagcacattggaacagacagcaggagaaggccctcaagcaagaagccttctccaccaactcttcgaataaagccataaatacggagcacgttggtgggttatgtccaaaaccaggatcctcacaaggtagcaacgagtacttgaaaaggaaaggttctacctctcctgaaccaaccaagggtagtagccgctctggaagtggtaacaactccaggtttatgagcttttcggatatggtaagaggtcaagctgatgatgacgatgaagatcaaccgagaaatacttttgctggtggtgaaacatccggcttagaggttacagatccttcagatcctaattcattactgaaggatttgctggaaaaagcgagaaggggtggtcaaatgggcgctgaaaacggattccgtgatgacgaagaccatgaaatgggtgccaataggtttactggaagaggttttagattagggtcaaccatcgacgcagcagatgaagtcgtagaagacaacacttcacaatcacaacgtagaccagaaaaagtcacaagagaaattacattttggaaggaaggttttcaagtggccgatggtccgctttatcgctatgatgatcctgcgaacagtttctatttgagcgagttaaatcaagggagggctccattaaagctcttagatgtgcaatttggacaagaagttgaagttaatgtatataaaaaattagatgagtcttataaagctccgacgagaaaactgggcggtttttcaggccagggccaaagactaggatctcctatcccgggtgaatcgtcacctgcggaggttccaaagaatgagacacccgctgctcaggaacaacccatgccggacaatgagccaaaacaaggcgacacctccatccaaattagatacgcaaatggcaaaagagaagttttgcactgcaattccacagatacagtaaagtttttgtatgagcatgtgacatcaaatgcgaacactgacccatcgaggaatttcaccttgaattatgcctttcctatcaaaccaataagcaacgatgagacaacattgaaggacgctgatctgctgaactccgttgtcgtgcaaagatgggcatga

SEQ ID NO: 2994 - DNA, 1272 bp, Saccharomyces cerevisiae
atgttcccaatgaaagatcactcagctcttgaacaacatactctcagcagagatgagttaagacgtcgcaagggttacaagaaaggactgcagttgtcaattttgttacttggagaaaaaggcagcggcaaatcaacgtttttaaacaatctgtgcggtcaggatatatcgctttctgatggggattatgatgatgatgatgataaagtgacaaataatgtaacaccagaaaatggaaacgccatcgaagatatagatcctggatataaaacagcccatttgagtcctgggctgaagcttgtcaccagaagagtgtatttgaacgatgaactaggcgtacccataacattagatatcatattgtttccaggctgcggtgacaatgtcgacaattcacaaagctctgttgttataaaaaactacttagaccaacagtttgcaaatgttttaaaagaagaggtcagaataaagagaaacacaaaagaaactgatgggaggcctcatgtttgtttatactttctgaagagtactccaagaggagtcaaaaaatttgatattgagttaatgaaaacgatttgtgataaagttaatttaattcccattattccaaaagccgatggtctcacagaaactgaattaaatttacacaaagacattgtgcgccaagaaatctctcagaacaatatacgtgtttttgattttaaaagtgacaccctaggcgaaacattagctctgtacgatatggacatcgattccagttcagcaaaatccaaatacgataatgacacgaagatcaaggaaatatcgccatttgccattgtttgcagcaaaacttttaataaaaattcggaaaatagggttgagcatatcagaacgtacgaatggggtagcttggtggtcgaagaccaaaacacctccgattttatatacttaaaagcaatactgttaggttctcaccttcaggaattaaaagatgtaacaaacaacgtattgtatgaaaattatagggctaaagtgttaactgagaagaaaaacaactatgatattccaaactatagctatatcgacgaaacctcaaggggaagtgtcagcaatgtttccaccagaagaaatagtgcaagtagaacacttgggaatccagatacaaacgatgaaaatgcttatcaaatacacaaagaaatagacgaaaaaaacagaattattgaagactatcaaaggaagattgatttattggagaaaatgttggcagctccccatcaaaataaggtctaa

SEQ ID NO: 2995 - DNA, 1272 bp, Saccharomyces cerevisiae
atgtttaaaagatatttatccagtacgtcatcaagaagatttacaagcattttagaggaaaaggcctttcaagtgaccacttactctagacctgaagatctatgtataactagaggtaaaaatgcaaagctgtatgatgacgtgaatggtaaagaatatatcgatttcaccgcaggtattgcggtgaccgcattaggccatgcaaatcctaaagtggcagaaattctgcaccatcaggctaacaaactggttcattcctccaacctttacttcactaaggaatgtttggatttaagtgaaaagattgttgaaaagaccaagcaattcggtggtcaacacgacgcctcaagagtatttttatgtaattctggtacggaagcaaatgaagctgctttgaagtttgcaaagaaacatggtataatgaaaaatcctagcaagcaaggcattgttgcatttgagaactcttttcatggccgtactatgggcgctttatctgtcacttggaatagtaaatatagaactccttttggggatttggttccccatgtctcattcttaaatttgaatgacgaaatgaccaaactacaaagttatatcgagaccaaaaaggacgagattgctggtttaattgtcgagcccatacaaggtgaaggtggggtttttcccgtagaagttgaaaagctaaccggattgaagaaaatatgtcaagataatgatgtgattgtcattcatgatgaaattcaatgcggtttgggccgttcaggtaaactatgggctcatgcttatttaccaagtgaggctcatccggatatttttacatctgccaaagcattgggaaatggcttccccatcgctgccaccatcgtcaatgaaaaagttaataatgctttgagagttggtgaccacggcaccacgtatggtggtaatccgctggcctgttctgtaagcaactatgttttggataccatagcagacgaagcttttttgaaacaagtctctaagaagagtgatatcttacaaaagcgcttgcgcgaaattcaagccaaatatccaaatcaaataaagactatcagaggaaaaggtttgatgcttggtgctgagttcgtcgaaccacccaccgaggtcatcaaaaaggccagagaattgggacttttgatcattaccgctggtaagagtaccgttagatttgttcccgcattaacgattgaagacgaactaatcgaagaagggatggatgcttttgaaaaggctattgaagcggtttacgcttaa

SEQ ID NO: 2996 - DNA, 1274 bp, Saccharomyces cerevisiae
atgggattctttattcctcagagtagtttgggaaacttgaagctttacaagtatgttgcttatcttattgcaccctaaatcttctgtggcaagaaaaataaatactaactattgtaacattaaattactaatctgactttaggtatcaaagtgatgaccgctctttcctttcaaaccatgtattgaggcccttttggagaaagtttgcgactatttttccactatggatggcacccaatttggtaacattattagggttctgctttattatatttaatgtgttaacaacactttactacgacccgtattttgaccaggaatcgccacgttggacctatttctcctatgctataggtttgtttttataccagacttttgatgcttgcgatggaatgcatgcacgtcgtacaggccagcagggccctctaggggaattgtttgaccattgtattgattcaatcaacacaactttgtcaatgattcctgtctgttccatgacaggtatgggttacacatatatgaccattttttcacaatttgcgatattgtgcagcttttacttgagcacatgggaagagtatcacacccacaaactttatctagctgaattctgcggtcctgttgaaggtattattgttttgtgtatttctttcattgcagtcggaatttacggacctcaaaccatctggcacactaaagtagcgcaattctcctggcaagattttgtgtttgatgttgaaaccgttcatctaatgtatgcattttgcacaggagcattaatatttaatattgtcacagctcatacaaacgtcgtgaggtattacgaatcccaatcgaccaaatctgcaactccaagcaaaactgcagaaaatataagtaaagcagtaaatggtcttttgccattctttgcatacttctcttcaatttttaccttagtcttgattcaaccatcttttatttctttggctttaattttatcgattggtttttcggttgcctttgtagttggtcggatgattattgctcatttaaccatgcaaccattcccaatggtcaatttcccatttttaatcccaactatccaattggtattgtacgcatttatggtttacgttttagattaccaaaaaggaagcatagtttctgcattggtttggatgggactcggcttgacacttgctatccatggaatgttcatcaatgatattatctatgacatcactacctttctggatatttacgctttatcaattaaacatccaaaagaaatttag

SEQ ID NO: 2997 - DNA, 1275 bp, Saccharomyces cerevisiae
atggcaaacccaacaacagggaagtcctcgattagggctaagctttctaactcatcgctatcaaacctatttaaaaaaaataaaaataaaagacagcgtgaggaaacggaagagcaggacaatgaggataaggatgagagtaagaaccaggatgaaaataaggacacacagctcactccccgcaagcgtcgccggttgacgaaggagtttgaagagaaggaggctcgttacaccaacgagttgcccaaggaactgcgcaagtatcgtcctaaaggtttcagattcaatttgcctccaacggatagacccatcaggatatatgcagatggtgtttttgatcttttccatcttggccacatgaagcaactggaacagtgtaagaaggctttccccaatgtaacactgatagttggtgtgcctagcgacaaaatcactcacaaactaaaaggtttgactgtgctgaccgataagcagcgttgtgaaactttaacgcactgcagatgggttgacgaagtcgtgcccaacgctccctggtgtgtcaccccagaatttctactagaacacaagattgactacgtggcacatgacgatattccttacgttagcgccgacagcgacgatatctacaagccaataaaggagatgggaaaattcttgactacccaaagaaccaatggtgtctctacaagtgatattatcacaaagatcatcagagattatgacaaatatttgatgagaaactttgcaaggggtgctaccagacaggagctgaacgtttcttggttgaagaaaaacgaactggagttcaaaaaacacatcaatgaattcaggtcatatttcaagaaaaaccagacaaatttgaataacgcctccagagacttgtacttcgaagtccgtgaaatcttgctaaagaaaacgttgggcaaaaaactctactccaagttaataggcaatgaattaaagaaacaaaatcaacgacaaagaaaacagaattttttggatgatccgtttactaggaagctaatcagggaggcctctccggctacagagtttgccaacgaatttacgggcgaaaactctaccgctaaatcaccggatgacaatggaaatcttttcagtcaggaagatgatgaagacacaaattctaacaacacgaatacaaattcagattcagattcaaacactaactcaacgcctcccagtgaagatgacgacgacaacgacaggttaactttggaaaacctaacacagaagaagaaacaatcagcgaactga

SEQ ID NO: 2998 - DNA, 1275 bp, Saccharomyces cerevisiae
atggcagccaactctggtctcgactcaaaagttgaatattatcggcttcaagagaatgaaattattagcgctgtatcaagtgaggatgcagatcaaaatgatgcgggctttcgattgagtaccatccatttgcatttgttccatggattgaaatttgccgctctattgttcacagtggtgcctgtatttataatcctcgacagtatgaagatcatttttcaacgcaaacgtaggttttgccttgaccatgtcaacagaagttttttaagacaaagttcttggatcctcgatgaacgcatctgtcaatacgtgctcaatcctttatttgtttgtttatatccttctacattttctagtccaacatatgtcaaatgcaacattcctatagaagatcagaaatctccagaaaacaatattttccaagaccatcaattaaacgcacccaaaatagttagcacaaagttttatcaatatgttatgccggaaggatttgaccccacgacagatccagttttagtattctatcatgggggtggttatgctcttaaattgacgcctacgtcgttttctttcttgaataatatgcgaaatgcctttcctaaaatggccattcttgtaccagattataccgttacagctaccgatgaccagtcgaaaaagtaccctctgcaaattttacaaaatgtggccatttttgattacgttgttaagactatggggtgcaaaaatgtagtgattatgggggattctgctggtggcaatgctgttttgaacattgttttatatttaagaaagtgtcacagagaaatatacccgaaaaaagtcatagccataagtccctgggccaatgccactttcttccacgagggagaaaaggaatatatgcaaggaacacaagaatgggatggtctatgtttgaagagtcattcgatgtttgggcgaatgtttgtaggaaacaacccaaacgtcgattttaccagcgacccttttgttaatattgaaaagaatttcgaaactaaaatgtggcaagatattctgaaaaagtgctctgtgatgattacttatggtagtgatgagttgttgagctttcaaaacaagatcttggcaaagaaaatgagtgacgctagcgagggatgtaaccactttaccgccaaaaatgtgctggttgaacaccaaggttatcatacgggcccaatattaaactactctcgtaatatggatcgctggaccaacataccatctatcgctcgcattcttgagtttatgcaatcctga

SEQ ID NO: 2999 - DNA, 1275 bp, Saccharomyces cerevisiae
atgtccgaagctaccctctcctccaagcaaaccattgaatgggaaaacaaatactccgcccacaactaccaccccttgcccgtcgtttttcacaaggctaagggcgcacatgtgtgggacccggagggtaagctgtacctcgacttcctgagcgcttattctgccgtcaaccagggccattgccatcctcacatcatcaaggctttgacggagcaagcacaaacactaacattgtcctccagagcgttccacaacgatgtttacgcgcaattcgccaagttcgtgaccgaattcttcgggttcgaaaccgttttgcccatgaacaccggtgcagaagccgtggaaactgctttgaagttggccagaagatgggggtacatgaagaagaacatccctcaagataaagccatcattctgggtgccgagggtaacttccacgggagaaccttcggtgctatcagtttgagtaccgactacgaggactccaagttgcatttcgggcctttcgtgcctaacgttgccagtggtcactccgtgcacaagatcagatacggccacgcagaagatttcgtccctatcttggaatctcctgaaggtaagaacgttgccgccatcattctagagccaattcagggtgaagccggtatcgtcgtgccccccgcagactacttcccaaaggtctccgcattatgccgtaagcacaacgtcctattgatcgttgacgaaattcaaaccggtatcggtagaaccggtgagttgctttgctacgaccactacaaggcagaggccaagcctgatattgttttgttaggtaaggctctctcaggtggtgttcttcccgtctcatgtgttctgtcttctcacgacatcatgtcttgctttaccccaggatctcacggttctactttcggcggtaatcctttggcttcccgcgttgccatcgccgccctcgaggtcatccgcgacgagaagctgtgccaaagagccgcccaactgggtagctctttcatcgcccaattgaaagctctccaagccaaatctaacggtataatctctgaggtgcgtggtatgggactgcttaccgccatcgtaatcgacccatccaaggccaatggtaagaccgcttgggacttgtgtctattgatgaaggatcacggcctcttggctaagcccacccacgaccacatcatcagattggctcctcctttggtcatctccgaagaggacttgcaaaccggtgtcgaaaccattgccaagtgtatcgatctgttataa

SEQ ID NO: 3000 - DNA, 1278 bp, Saccharomyces cerevisiae
atgaaattggatacttctcatatgagatatttgacaactgatgattttcgtgtcctccaggccgttgaacaaggttctagaagtcacgaagtcgttccaactcccttgattcatcaaatctcggggatgagatcgcagtccggaacaaaccgagccattagtgatttggccaagcttagccttatttccaaaatgagaaatgtcaaatatgatggttacaggctaacttataacggtattgattatttggctttgaaaaccatgttaaacagagacactgtctattctgtcggtaacactattggtgttggtaaggaatctgacatctataaagtaagtgacaaaaatggaaaccctagagtaatgaaaattcacagattaggtagaacctcttttcattccgtcagaaataatagagattatctgaagaaatccaaccagggggcaaactggatgcatctttcacgtttggcagccaataaagaatatcagtttatgtccatgctttattctaagggtttcaaggtccctgagccattcgataactcgcgtcatatagtcgttatggagcttatcgagggttacccaatgaggagattaagaaaacataagaatatacccaagctttatagtgatctgatgtgtttcatcgttgatctagcaaatagcggacttatccattgtgattttaatgagtttaatattatgataaaggacaaactagaggatgaaaacgattgtgggttcgtagttattgattttccacaatgtatatctattcaacaccaagacgccgactattatttccaaagggatgttgactgtattcgtcgtttcttcaaaaagaaactgaagtacgaaccaaaacctgattcatcaatgctcgacactgaaggtttcggcgatggttataaatatgcgtatccagatttcaaaagggacgttaaaagaaccgacaatttggatgaattggtgcaggcttccggatttagcaaaaagcatccaggagataggggcctggaaactgccgttgaaagcatgagaaatgctgtttataattcagatgacgatatgtctaatgacgaggccgaagaagaaaatggggagggcgattattcagaggaggatgaatactatgactccgaacttgataatgaaagttctgaagatgacagtgaagatgcacaagaagaggagaacgaacgtattatagaggcgctttccagtggtgttgaaaatctaaaaatggataaactaggaaactatatactagagtag

SEQ ID NO: 3001 - DNA, 1278 bp, Saccharomyces cerevisiae
atgacagatcccagaagaagaacaggccgtcatttcttgacaccggagaatttatcctctacattacaaatcacaaacttacctccagaatggaaccaagatataattacttcggtcgtggccggttctggtccagttatagatataaaagctaagaatgacccgagaactggtaaactaaccggtgtactgttcgattatttgactagtaaagattgtaaacgcgcttgggaaattttaaatagaattgaaaactttcccgtaaagatagagcaaataatcccaccaaattataaggaccatcttagagaaacagcaaataaaaattctcaaaagcaggtattacaacttaatagagattcgtaccccttcgaggcgggtttggagctacctttcgaaatggtgacagaagtccccattcctaggcgaccaccgccaccacaggctgcaaataacacaaactctgtatcaaataacacaaacattcaattccccgacatactaagtaaagcatctaaacacttgccaagtttccaagatggctcgattattgcaccagacaaaatttcacaaaatttaagtaaaattccgccgttgcaacttattgaaattatatcaaatttgaaaatattatcaaaccaagaaaacatccaaaaatcgcaattagaatctttcttagatactaacagtgatatcacaatatcagtgacccaagccctactagaaatgggatttatagactacagcgtggtgactaaagtgttgaaatcccaagttggcgaggccccatctttgctttcgagtaataacacaagtaattcgaacacccccgtaagcgtaattagaaataacactccgttgcatgtaccttctaatgaagtcagcaacaatcctaacaatatgccactgaacgtagctatgccaatgcctatgtcgacaccaccatttatccctttacctctgcaacaacaaccgttcggttttgcgccaccgggccctttcatgcctccagctcaaggcccctccatgggacagcctgtgttggcaaatcaactcggccaggtccagcaacaaaatataagttctacagaaggaccctctaacgcgaataaagcgaatgacagcggcaccattaatatggcgaaactgcaattactacctgaaaaccaacaagatatgatcaaacaagttcttactttgacacctgcccagatccaaagtttaccaagtgaccagcaacttatggtggaaaactttagaaaagaatatataatctaa

SEQ ID NO: 3002 - DNA, 1278 bp, Saccharomyces cerevisiae
atgagtggctctacagaatctaaaaaacaaccaagaagaagatttattgggagaaaatctggcaacagtaataatgacaaattaactacagtggctgaaaatggcaacgaaataatccacaagcaaaagagtagaatcgccctaggtaggagtgttaatcatgtgccagaagatatattgaatgacaaagagttgaatgaagccatcaaattattgccctctaactacaactttgaaatccacaaaactgtgtggaatatcaggaaatataatgctaaaagaatagccctacagatgcctgaaggtttgctgatttactcattgattataagtgacattttggaacagttctgtggtgttgaaactctagtaatgggggatgtgtcttatggtgcatgctgtattgatgattttactgctagggcattggattgcgattttattgtgcattacgctcattcgtgtttagttcctattgacgttacaaagattaaagtactatatgtctttgttactataaatattcaagaagatcatattatcaaaacgctgcagaagaattttcctaagggatctagaatcgctacatttggtaccattcagtttaatcctgcggtacacagcgtcagagataaactgcttaacgatgaagaacacatgctgtatattattccaccacaaatcaagcctctatcgaggggtgaagtattggggtgtacttctgaaagattagataaagaacaatacgatgccatggtattcatcggtgatggtagatttcatttggagtctgcaatgatacataatccggaaattcctgcattcaagtatgacccatacaacagaaagttcactagagaaggatacgatcaaaagcaactcgtggaagttagagcagaggccattgaagtcgctcggaagggtaaagtttttggtctgatcttaggtgcattaggtagacaaggtaatttaaacactgtaaaaaacttggaaaaaaacctgatcgcagcaggtaaaaccgtggtgaaaattattctaagtgaagtttttccccaaaagctcgcaatgttcgatcaaattgatgtttttgttcaggtcgcatgtcctagactgtccatcgattggggttatgccttcaataaaccactattaacaccatatgaggctagtgtcttactaaagaaagatgtcatgttcagcgaaaaatattatccaatggattattacgaagctaaaggatacgggcgtggggaaactccgaaacatgcgattgaatag

SEQ ID NO: 3003 - DNA, 1278 bp, Saccharomyces cerevisiae
atgcaaatctgcaaggtatttcttacacaggttaaaaaactactttttgttagtcttctattttgcttgatagctcaaacatgttggcttgcacttgtaccatatcagagacagctgagcctagattcgtatttttttagaagatctcgagaagtttcatcgagatatgattttacaaggaggcgacatatgaatcagacgctgaagctatctagcaacacttataatgatgaaccactaaacaagaccaagggaataaaaaatcaaagagaaaatgctacattgttaatgcttgtgcgtaattgggaactttcgggggcactccgttccatgagatcactagaagaccgtttcaataaaaactaccagtatgactggacatttcttaatgatgtcccatttgatcaagagttcatcgaagccaccacagccatggctagtggtagaacgcaatacgctttaatccctgcggaggactggaacaggccatcttggatcaacgaaactctatttgaagaggctttacaattaatggaggaaaaaaatatcttgtacggtgggtcaaagtcatatagaaatatgtgccgatttaattctggatttttctttagacaaaagatattagatccgtacgatttttatttcagagttgagccagatgtagagtatttttgcgattttccctacgatccattcaaggtgatgaggcagaacaataagaaatatggctttgtgataactatgtatgaatacgaagatacaattccgagcctatgggaagctgtagaagaatatctcgaagaaacagagtcagcagatattgacatggaaagcaacgctttcgggttcgtatcaaatttcgacttcatcggtaaatcttttggtgtcatcgatagtaacagcggctataatttatgtcatttttggacaaattttgaaattggcgatttgaactttttcagaagtgagaaatacattagatttttcgagtacttggattcaaagggcggtttttactatgaaaggtggggagatgcaccagttcattcgattgctgcctcacttcttttgaaaaaagacgaaatcatccattttgatgaattaggctataagcatatgccttttggcacgtgtccatctgcatactacctgagacttcaacaaagatgtctttgtgatagcaatcacccagacaatattgatctcaatgtcatcagctgcctgagaagatggtggaaggacggcagcggtaaatacttcctcaaacacgattcatag

SEQ ID NO: 3004 - DNA, 1278 bp, Saccharomyces cerevisiae
atggtagtacattggacaattgtggatgaaatacgacttcttagatgggcatctgaattcaaaccggccggaattcataagcatttccacatgttttgcatagtggaaagaatgaattcgccagataagtatccagtgacgctattacagaaagaaaccatgaagttggggaaggtatttactgcaaaagacatatgggataagttgagccaatcttacaatttagagaaaattgatgaaatggagaatacatattccttggaagccactacagagagttcacggaatggcaatggaaatggtgacgatgcagaaattcatgaagaaactttacttgaattgaataatcgaataagagtacgcaagcaagattttacattaccttgggaggaatacggtgagttgatcttagaaaatgcaagaaaaagtccaaactctaacgaagagtatcctcgagttgaagatatgaatgagaaagatagtacaattccaaaggaaagtccttctacagacctaaagaacgacaacaataaacaggaaaaaaatgcgacaattaaagtgaaagagttgcctgaatatcatacagaggaaaatgatagccccatagacgtccagaaagaacccattaaggaggtgcaaagcgatgaaaaggaactccagagggaacatatgagtgaagaagaacagaaaatgaaaagtacaaataaaacagcagctccagtaagaaaatctcaaaggttgaaaagaagtaaggaagttaaatttgaagatgaagaaaaggaagagatagaagaagataatacgaaagacgaagaacagaaagaaaagaaagaggagatccaggagccaaaaataacccacaatgaagaagtagataaggaaaaaaacgaaaacgaagaaggtgatgatgagcgtgaaaaatccacctcttatgaaaataccaatggctctgaaagcgaaggagttgacgaaggagttgacgaagaactgggatacgagtctgaacgtgaggcagaaggtaaaggaaaacaaattgaatcagaagggggcaacttaaagaaaaaaacggaaaacaaaaaaggagatgatcaacaggatgataccaaaaaggattctaaggacaaaaatgaaccattagcaaagagaactaggcattcatcatccacaggtaatactagcaatgaaacctcgccgaaaaggaaaaggcggaaggcaggctctcgtaaaaatagccctcctgccacaagagtttccagcaggctacgaaataaaaaataa

SEQ ID NO: 3005 - DNA, 1278 bp, Saccharomyces cerevisiae
atgtcggaccaggataatacccagacttcttcaagcaagttggcacctcaccataatatttttatggcaaacttggaaagttcccccacaaaagatagaaatacctccagccaaaatgcctcatcttcgagagtcattgaatcactgcatgaccagattgatatgctgacaaaaacaaatctacaattgactacgcaatctcaaaatttattgagtaaattggaattagcacaatccaaagaatcaaaactactggaaaatttaaatctgctgaagaacgagaacgaaaatctcaactcgatatttgaaagaaagaacaagaagctaaaagagctagagaaagattatagcgaattgagtaaccgttacaatgaacaaaaggagaaaatggatcaattgagtaaattggcgaaaaattctagtgccattgaacaatcttgctctgaaaaattgcaaaatatggaagttaactataattcattattggagtcacaaaatctttacagagaccactattctgatgaaatttccaaattaaatgaaaaaatcggtttgttggagttagagttaagtaatcaaaatttaaattatggttcagatactagttcaaattcagatatagaattgaatttaaataaattcaatgactctgtgaaagatttgaaatctctggaaacagaaaaggattcaaaattaagcaagataatcactcactctttagatgagttaaatctacaaagctggctaaatctgtaccagacgaacgaaaatctgatatcaacttttgctgaaaagatggatttgaaagacgtcttgaaaagaaacgatgagaagattagtaataaaggcgcggtagtacaaaccttgaagaagaatgtacaaacccaggtggaaagcaacaacgctgacgctttgagtagcaataatgcacaggatatgcttcctattaagatggtcaaattaagaaagacgccgaacacaaacgattcatcctccaatggtaatagcagtaacaataaaagaagaagtttctatactgcgtcgcctttgctgtcatcgggttctattccaaaatctgcatccccggttttgcctggtgttaaaagaactgcctcagtaagaaaaccaagctcgagcagtagtaaaacaaatgtaacgcataataacgatccaagtacatctcccacaatctcagtgcctcccggtgttacaagaactgtttcctccactcataagaaaaagggaaatagtatggttgttcacggggcccaatcctag

SEQ ID NO: 3006 - DNA, 1281 bp, Saccharomyces cerevisiae
atgaacatccttttacaggatccattcgctgttcttaaggaacatcctgagaagctcacacatacgattgagaaccctttacgcactgaatgtctccagttcagtccttgcggtgattacctggctcttgggtgtgccaatggagcacttgttatttacgatatggatacgttcaggcctatttgtgtcccaggaaatatgttgggagcacatgttcgacccattacatctatcgcatggtctccagatggtagattgttgcttacaagctctagagactggtcaataaaactgtgggatctttcaaagccaagtaagcctttgaaagaaatacgattcgattctccaatttggggttgccaatggctggatgctaaaaggcggctttgtgtagctacgatatttgaggaaagtgacgcatatgttattgacttcagcaatgatccggtcgcaagccttctcagtaaatcagacgaaaaacaattgagttcgacacctgatcatggatatgttcttgtttgtacagtacataccaaacatccaaatattattattgttggaacttcaaaaggttggctagacttctataaattccattctctatatcaaacagaatgtattcattcccttaaaatcacgagttctaatatcaaacatttaattgtctcgcaaaatggtgaaagattagctattaactgctccgatagaacaataagacaatacgaaataagtattgatgatgaaaactctgcggttgagttgaccttagagcataagtaccaggatgtgattaataaattacagtggaactgtatcctctttagtaataatactgccgaatacttagtcgcttctacacatggttcttctgcacatgaactatacatctgggaaacgactagtggaacgttggtgagagtcctggaaggggctgaagaggagttgatagatataaattgggacttctatagtatgagtatagtgagtaatggttttgaatctgggaacgtgtatgtgtggtctgttgttattccgccaaagtggagtgctttggcgccagattttgaagaagtagaagagaatgtcgactatttggagaaggaagatgaatttgatgaggtcgatgaggcagaacagcagcaaggactagaacaagaggaagaaatagctatcgatcttcggacgagagagcaatatgatgttagaggtaataacttgcttgtagaacggttcacaatccctacagattatacgaggataattaagatgcagtcatcatag

SEQ ID NO: 3007 - DNA, 1281 bp, Saccharomyces cerevisiae
atgacaggagaaaaaatacttcattcgcagttgttaaccaacagcgacatgtctagcgggaatgtccaccatacgaaaccgatgatgtacaacgtaaccctgccttcctacaacagcagtagtataggtccagtcgataatttgaaaataaacgagagacctggctctcatgatcattccatgagaagtgaaatgtcatccaaaaactccggaagcgattttatgccacaatctatttcacgttccgaaggtagtgtctaccaggtcaagatagatcgtggtgactccccgaatacagaaggattcgactttaaagttaatgcaagagatctgctgttacttcgaatgtcctgggatatcctcctcagggagtatttaacacctaaagaattaaaagtttttcaagcacttctgtattccaataaacatattacttcaacagaaagaccctatttgaatactgctcctgacggtatgatttccaaaactattgaccctactgccaggccacgtaaaacaaaacaaagggacaatgataacaaggttgatactgcactattttgttcacagttttatgacaatttgattgcaatggatcccttgttagaagaatattttccatcattaaaacatcaagcagtttcgttctgtaaggtccttgattctgctattgacaaccttgaaaacgttcatgtcctagatgattatattgtgaaattaggaaaacgccattccagaattctcggcatcaaaaccgttggtttcgaagtaatgggaaaagcatttatgactacattgcaggacaggtttggatcttttctcacactggaactcaaaaatctatggggacaactttactcatatttggcaaattgtatgattactgcagggaaggacccaatggaaaagattcaaccagatttttcgtataatggtgactctgtggttttaaatttttccattcccaaacttgcgatgcatgatataagtacagttaacaagctacaaatggtgaaaactaaaaacgctactatacctcataatataacacaagtaccgacaaataaaattcctacagaaatactcttagacaattcttctactccaataaaaagcgaccgtgaatcgacgcctccaatctcaccaaagggctctggaagtacaaaaccaagcatcggtagcagtaccgtcgtggaaagtaataccaagaaaaataattatgatgaaaaaatccatttattgcaaaaaactgctcagcagaagaactgctcgattatgtaa

SEQ ID NO: 3008 - DNA, 1281 bp, Saccharomyces cerevisiae
atgactgatagtgagaatgaatccaccgaaacggattcgttaatgacgtttgacgattatataagcaaagagctacctgaacatttacagagactaatcatggagaatttgaagggttctactactaatgacttaaagcaaacttcaaacaactcagagtttaatgtcagtaaaaacgggagcttcaaaggtctcgatgatgcaattcaagctttgcaaatgcaaagcgtgttgcatccttcttcgttaggatcgttagcaacgtcctccaaattttctggatggtcgtttgctcaagggttttttgtaggacagctaagcatagtgttgttgttcatctttttcctaaagttctttatattcagtgatgagccatctaaaagtaagaatccgaaacctgcagcctcccgtcacagatcaaaatttaaagaatatccctttatatctcgcgaattcctgacttctcttgttaggaagggtgctaaacaacactacgagctcaatgaagaggcagaaaatgaacatcttcaagaactagctcttattttagagaaaacctattataatgtcgacgtgcaccctgcagagtcattggactggttcaacgttttagttgcccaaataatacagcaattccgcagtgaggcttggcacagggacaatatccttcattccttgaatgattttattggaagaaaatcacccgatctgcctgaatatttggataccataaaaataactgaactggatacaggtgatgatttccccattttctcgaattgcagaatacaatattcgccaaattcaggaaataaaaagctagaggctaaaattgatatagatttaaatgaccacttaactttaggagtagaaacaaaactattacttaactatccaaagcctggtattgccgcactccccataaatctagtagtgtcaattgtgaggtttcaggcgtgtttgaccgtatctttaactaatgcagaggagtttgcttctacttcgaacggtagcagtagtgaaaacggtatggagggcaattcaggatactttttgatgttttctttttctcctgaatatagaatggaatttgaaatcaagtcgctaattggctcacggtctaaacttgaaaatattcccaagatcggcagtgtcattgaataccaaataaaaaaatggttcgttgaacgatgcgttgaaccaagattccaatttgtcaggttaccaagtatgtggccacgtagtaaaaatacgagagaagaaaagcctacagagttataa

SEQ ID NO: 3009 - DNA, 1281 bp, Saccharomyces cerevisiae
atgtaccttggacgacattttttggcaatgacatcgaaagcactgtttgataccaagatcttaaaagttaacccgctatcaatcattttctcccctgatgcgcatatagatggttccttaccaacgataacagatcctgaaacggaagcagcgctagttgaagcggcgaggataataagagatacagatgagactgtggcttttccaaccgaaactgtttatggtcttggaggttctgctttaaatgataattcagtgcttagtatatacagggccaaaaataggcctagtgacaatcctttgattacacatgtttcatccattgatcaacttaacagaaaggtctttaatcaaccgcatctatcaggtacatccttgtttgataacataccctcaatctatcgcccattaatttcaagcctttggcctggcccattaacaattcttttgccagttccatcttcagagcatagtgcattatcaaagttaacgaccgcagatcagcctacgtttgcggtacgcatacccgctaatccagtggctagagcactgattgccctgagcgatacaccaatagctgctccttcagcgaatgcgtctactaggccatctcctactttagcgtctcatgtttatcatgatctaaaggataaaattcccataattcttgatggcggagcgtgcaaggttggtgtagaaagtactgttgttgatgggttatgtaatcctcctacgctactgcgacctggcggttttacatatgaagaaattgttaaattgggtggtgaagcttggtctctttgtaaagttgagaataagaaaacagttgaaaagggcgaaaaggtaagaacgcctggtatgaagtatagacactattccccttcagctaaagttgttttactagttcctcattgcgaaggcgatggcattcttaagggcgttgataggatggaaagattaaagaggttaatcgaaacggaattaaaagccaacagtaatataaaaaaaattgcgattttaacttccctaaaattacgtgattccgacttacaatctaagatctttaatgaacccgatttttcttcgaaaactttcatcatcgaaagacttggccaatctggtgaagaaatacagactaacttgtttgcagctttaagaaaagtggatgaaaatgataaagtagacctaatatttgtcgaaggtataaatgaggaaggagaaggattagctgttatgaacagattgcgaaaggcggctgcaaataattgtatacagttttaa

SEQ ID NO: 3010 - DNA, 1281 bp, Saccharomyces cerevisiae
atgtcgcaccaaaaccagcttattccacaagcttatatttctaactttcataacagattgacaaacgaagatgatggtatccccatctttacaatggctcaacaaacaaggcagcataaaagggctaaagtggtcaactatgcggaatatgacaacgatctctttgatgaattcaatatgaacggttctaatttcaacaatgctgatacacactataaagataatgcagtgtctcatgaaaatactccggcacttacaaatggtgttaccatggacggttccgaatacaatgtcctagagaacatgaatggagctgatagtattatctctaacaacaaatacgatgcgggttcaaacatggttgtggaatctttatccggtttgaatagcaataacaacgccagcaatggtccgagcaacaaagcgcaggcacaggatattggaaacgccgttctaccggatctgcaagaccaacaccacaaccccttcaacatattgagataccctaaaataagagatactttcattaacggaaaagtggtgtctccatatagactcaacactgatcaagaaacgaaggcaaacgccaattctggagaggcaatcatgataccaattactttggatatagaacatatgggtcataccataaaagaccagtttctctggaactacaatgacgactccatatctccggaggaatttgcctctatatactgtaaagatcttgatatgacttccgctaccttacaaactcaaattgcgaatataataaaagagcagttgaaagacctcgaaaatattgcagccactgagataatgtctgacctccacgtgataatcaacctaacctgcaacttacaagacagattttttgaagataacttccagtggaacttgaacgacaaatcacttactccagaaagatttgctacatccattgtacaggaccttggcttaacaagagagttcatccccttaatatctcaatcgcttcatgaaactatcttgaagataaagaaggactgggtagatggccacttgattcaggaccatgtcccaaacgatgccgcatttgggtacttatctggtataaggctggatattgatgaactgggctccaattggtgcccaagggtggaaatattaacaaaagaagaaatacaaaagagagaaattgaaaaagaaagaaacttaagaagattgaaaagagaaactgatagattatctagaaggggcaggagaagattagatgacttagaaaccacaatgagaatgtag

SEQ ID NO: 3011 - DNA, 1281 bp, Saccharomyces cerevisiae
atgttgaaagagccctcagttcgcttgcgggaggctattattgaaggcaatttacttatagtgaaaagattattgcgacggaatccggatttgctaaccaacatagactcagagaacggatggagttcattacattacgcctcataccatggaagataccttatatgcgtgtatttaattcagctggggcacgacaagcatgaactaataaaaacctttaaaggaaacacctgtgtgcatttagcattaatgaaagggcacgagcaaaccttacatttacttttgcaacaatttccgcgatttatcaaccatcgcggagagaatggtagagcccccatccatatagcatgtatgaacgattactaccaatgtctgagtctgttgataggagttggtgctgatttatgggtaatggacactaatggcgacacgccgctgcatgtatgcctggagtatggcagtataagttgtatgaagatgcttctcaatgaaggtgaggtgtccttggatgataatgtcagggacaagggaaattggaagccaatagatgtagcacaaacgtttgaagtaggtaatatatattcaaaagtgttaaaagaggtgaaaaagaaggggccaccgttgggtgcaggcaaaaaaccaagttcattcagaactcctatactaaatgcgaaggccactttcgaggacgggccttccccagttttaagcatgaattcgccatattcgctctattccaataatagtccgttgccggtattaccaagaaggatatcaacgcatacaacaagcggtaacggtgggaatcggaggagttctatcacaaatccagtattcaacccacgaaaaccaaccttgtctacggacagtttttcgtcaagctcaaattccagctcgagactaagagtgaactccatcaacgtcaagactccagtaggtgtgtcgcccaagaaagagcttgtatctgaatcagtacgacacagtgcaacaccaacaagtccgcacaacaacatcgcgttgattaatagatacttgttgcctaacaagagcaatgacaacgtgagaggagactcacagacagctacaatcaacgatgacggtggcggcggcaatggcggtgatgccactataggaatgggactaagaaaggacccggacgatgagaacgagaacaagtacaagattaaggtaaacaatggcgagccgaggagacgagtgtcacttctgaacatacccatctcaaaattaagaaatagcaataacacgcgtgcagaagattga

SEQ ID NO: 3012 - DNA, 1284 bp, Saccharomyces cerevisiae
atgcatcataactcacagtctttgagctctggacacatcaggagccccgaggatgaaaatgtggcacctataggtaatcttaaacacaggactggatccctcagtcatatttcatctgcgcacccgagggtcgcacttagcgacgttaccaatatagttgcgacaaactctagcaacaacagcataagtaagccaaaagtcgccccaattaaagaaagattggattcagctgcgataattgaggaagaaaggctggatgcgaatagtgttgcacagagaaaagaagctgatcataacgatttgttaacggacagggaacaagaggaacccgttgaagacgacggagaaagcgaagaggatgaagaagaagaccaggagcctctactgttgcaacattatgctagtgatacattggtctgggagcatgcatttagaacttactatagaactacattagatcccaatgatgatgacgtgtacgatgtggtcatggttgccgaattatctaatgagatattcgagtatatgaggaaattggaagacctgtataaacccaacccgtactacatggataaacaaccagagttaagatggtcgtttcgaagcacactgattgattggatcgtccaagtacatgaaaaatttcaacttttacctgaaactctatatctctgcattaatataatagacagatatctgtgcaaagaagttgttcctgtaaataagttccaacttgtgggtgcagcctcactcttcattgctgctaaatatgaggaaatcaactgtcctacaatcaaggatttcgtatacatgtcagaaaactgctactcaaggaacgacctgctggacgcagaaagaactattttgaacggcttagaatttgaattgggttggcctggtccgatgtcatttttacgaagaatcagtaaggcagacgattacgagcatgatacgagaacactggccaaatatctattggaatccacaataatggaccatcgactggtttccgctcaacctagttggttagctgccggtgcatactttctaagtaagattattctgggccaaaatcagtggtctctggcgcacgtctactattccaattatacacaagaacaaattcttccgttggccaccattattttagaaaattgcagatatgcctctaaacgtcataacgccatatggagaaaatattcttcacgtcgttatttgcattcttcacagatcgtagcgaagtggatagcattagctgaacacagagtagaaagatctaactaa

SEQ ID NO: 3013 - DNA, 1284 bp, Saccharomyces cerevisiae
atgcgtaagtgtaaaatttttgttggtaactctcacccagagttgggtaatatggtttgccaaagattaggtatcgaaccagctccatgtacattaaaaaaatttgcaaatggtgaaacgtcagttcaaatcggtgtatctgttcgtgacgaagatgtgtatgtcattcaatctggttctccatccataaatgatgacattatggaactgttgattttagtttctgcctgtaggggcggatctgctaggaaaattacagcagtcattcctcaatttccttactctaaacaatgtaaaatgaagagacacagaggcgctattactgcaaggatgttggccaatctgttggtcatggctggcgctgatcatgttgtgtctatggaccttcatgcttctcaaatgcaggggtttttcaccaaaccagtcgataacctatacgggggccctagtttagcgaaatggattagagaaaatgttgaagactatgaagatgcagtagttgtctctaagaatccaggtggtactaaaagagttacagccctggcggattctttgaagatcaactttgctatgatccatactgatcgtcgtcgttctaaggatctgtattctcaaaacaaggatttgcaacaactaaagttgagaaagcaatcaatgttgaggaaaaatagaccgatcatcagacaaggtgaccatccaaatgaggaggaaaacattattttaagtaacggtattcaaactgctaggatccgtaacggccacgttatcggtgacgatgaggcagacgatgatgaagacgctatcttagaatctgacagcgaattgcattctattgatggcttagactcgcatggcttgggcggtacatatgatgctgtcgactccgaagacgaagaggaaatcccagttctctatagggaacaactgattacattggtcggaaacgtccgtggtcgctctgccatcattctagatgatatgattgatagacctgggtcatttattagcgctgctgaacatttggtgcaaaattgtggtgccaaaaaggtttatgttgttgctactcacggtatattcactggagactgtttggaagaacttgaaaagtccgatgccattgacacaattgtggtcacaaatacatatccgatttctggcgaacgcatagctgggtccaagaaattggttactatcgatgtttctccaattttcgcagaatgtatccgtcgtgatcattatggtgagagtatttccgttttatttgactctttggcagctctgtaa

SEQ ID NO: 3014 - DNA, 1284 bp, Saccharomyces cerevisiae
atggagagagagctagggatgtatggaaatgataggagtagatcaagatcacctgtacgtcgtcgtttgagcgacgacagagacaggtacgatgattataacgatagtagcagtaataatggtaatggcagtcgtcgtcagagacgcgaccgaggctcccgtttcaatgatcggtacgatcagagttatggtggcagccgctaccacgatgataggaactggccccctcgccgaggaggccgtggcagaggaggaagcagatcattcagagggggacgcggtggcggtaggggtcgtactttaggtccaattgttgaaagagacttagaaaggcaatttgacgcgaccaagagaaattttgaaaatagtatcttcgtgagaaacttgacttttgattgtacccctgaagaccttaaggaattgtttggtacagtgggcgaagttgtggaggctgacattatcacatcaaagggccatcaccgtggtatggggactgtggaatttaccaaaaacgaatctgtccaagatgccatatcgaagtttgatggtgccctctttatggaccggaaactaatggtaagacaggataatcctcctcctgaagctgccaaggaattttctaagaaagctactagggaagaaatagataatgggtttgaagtgttcatcatcaatttaccgtactctatgaattggcaatccttaaaagatatgtttaaagaatgtggtcatgtcttgcgtgccgatgtagaattggatttcaacggattttcaagaggattcggttctgtcatttatcctactgaggatgaaatgattagagctatcgatacattcaacggcatggaagtagaaggtagagttttggaagttagagaagggcgtttcaacaagagaaagaacaatgatcgttataatcaaaggcgtgaggaccttgaagataccagaggtactgaaccaggtcttgcgcaggatgccgctgtccacattgatgaaactgcagcaaaatttactgaaggtgtcaatccaggaggggatagaaactgtttcatttattgtagtaatttaccattctcaacagcaagaagcgatttattcgacttgtttgggcctatcggcaaaatcaataacgcggaattgaaaccacaggaaaatggtcaaccaactggtgttgctgttgtagaatatgaaaatttagtagatgcagatttttgtattcaaaaattaaataattataattatggtggttgtagtttacagatctcttatgctagacgtgattaa

SEQ ID NO: 3015 - DNA, 1284 bp, Saccharomyces cerevisiae
atggccattgaattgggactttcccgtattacaaaactactagagcatttaggcaatccgcaaaactcacttagagtgctgcacattgcagggacaaatggtaaaggttcagtatgtacttacctatcttctgtgttgcaacaaaagtcctaccaaattggaaaatttaccactccacacttggtgcatgttactgattccattacaatcaacaataagccgattccgttagagagataccagaatattagattacaactagaagctttaaacaagtcacactctttaaaatgtacggaattcgagctattaacatgtaccgcattcaaatatttttatgatgtgcagtgccaatggtgtgtcatagaagtaggccttggcggaagacttgatgcgaccaatgttattccaggcgcaaataaggcatgttgtggtattactaaaatcagtttggatcatgaaagctttttaggtaacaccttgtctgaaatctctaaagagaaagcaggtataataacagaaggggtacccttcacagtgattgatggaaccaatgaggcaagtgttataaatgttgtgaaagaaagatgcaaggctttagggtctgaactatccgttacagattctcaacttaacggaaatatgattgacaccaactcctggggttgttttgacttggcaaaattgccactgaatggagaatatcagatatttaatctcagggtggccatgggtatgttagactacttacaaatgaacgaacttattgatattaccaagaatgaagtaagtacgagattggcgaaggttgattggccaggaaggttatatcgtatggattatcgctttgacaaagtaagtaataggacagtgcctatattaatggacggtgcccacaatggctcagctgcagtagagttagttaagtacctaagaaaggagtacggaaaccagcctttgacctttgtgatggcagtaacgcatgggaaaaacttggagccgctgctccagccattattgaggcctatagatcaagtaattcttactcggtttaataatgtggaaggtatgccctggattcatgccactgatcctgaagaaataaaagattttattttgactcaaggatacacaaaggagatagtgattgaaaatgatttacatcaggtattgccttctctggcgcatgtatcagacgagcaaagacggccaattgttgtatgcggttcactgtatttatgtggtgaattattacggattcacaatagtcacttgagaaactaa

SEQ ID NO: 3016 - DNA, 1284 bp, Saccharomyces cerevisiae
atggctaaaggtttcaagttgaaggagttgctttcgcatcaaaaggaaattgaaaaagctgaaaagcttgaaaatgacctaaagaaaaagaaatcccaagaattgaagaaagaagaaccaactatcgttacagcttctaatttgaaaaagcttgagaagaaagaaaagaaggccgatgttaagaaggaagttgctgcagatactgaagaatatcaaagccaagccctttctaaaaaagagaaaagaaagttgaaaaaagaattgaaaaaaatgcaagaacaggacgctaccgaagctcaaaagcatatgtctggcgatgaagatgaatctggcgacgatagagaggaagaagaagaagaagaagaagaagaagaaggaagactggatcttgagaaattggccaaaagtgactctgagtctgaagatgattctgagtctgaaaatgattctgaagaggatgaggatgtcgttgctaaagaagaaagcgaggaaaaggaagagcaagaagaagaacaagacgttccattgtcagacgtggaatttgattctgatgcagatgtcgttccacatcataaactaaccgtcaacaacacaaaagcgatgaaacatgccttagaaagggtacaattgccatggaaaaaacattcattccaagagcaccaaagcgttacatcagaaactaatacggatgaacatattaaggacatatacgatgatactgaaagggaattagcattttacaagcaatcactggacgctgttttagtagcacgtgacgaattgaaacgactaaaagtacccttcaaaagaccattggattattttgctgaaatggtgaaaagtgatgaacatatggacaagattaagggtaagttgattgaagaagccagtgacaagaaggcacgtgaagaagctagaagacaaaggcaattgaagaaatttggtaagcaagtccaaaacgctaccttacagaaacgtcaattggagaaaagagaaacactggaaaagatcaaatctttgaagaacaaaagaaagcacaacgagatcgatcactccgagttcaacgtcggtgtagaggaagaagttgaaggaaaaaggttcgatagaggcaggcctaacggaaagagagccgcaaaaaacgctaagtatggccaaggaggcatgaagagattcaagaggaagaatgatgctacctcttctgctgatgtcagcggcttttcttccagaaaaatgaaggggaagaccaatagaccaggaaagagtagacgtgccagaagattctaa

SEQ ID NO: 3017 - DNA, 1284 bp, Saccharomyces cerevisiae
atgggtttcatatcgtcaatactgtgctgctcttccgagacgacacaatccaattccaattctgcttatcgccaacaacagagcagttctctcaataaaaacagaagcgttaaacattccaacacgaaaagccgaacccgtggcgtacatcagacaaactctcctccttctaagacaaattcagccgctactttcagttccactgaacgatccaccggtaaatctgggataagcacgaacgataatgaaaaaaagaagccatcgtcgccgactgcagccgtcaccgccactactactaataatatgacaaaagtagagaagcgaattagtaaagatgatctttacgaggaaaaatacgaggttgacgaagatgaagagatcgacgatgaagataaccgtcgcagtcgtggcattgtacaggaaaaaggagatgctgtgaaagatacttccaggcagaaaaaacaacagcagcaacaacaacaacagtcacaaccacaaccacaaccccagtcacagtcacagtcacagtcgcagtcgcagtcgcagcagcgagggcctactgtacaagtatcgtctgaccatcttatccaagatatgaatttgagtagggtaagtagcagctctcaagccagtgaaacttccaacgatgccgacgacgaagacgatgaagatgaagaatatattgatctaacgcttttgcagcagggccagtatcatgcaccaggttacaacactctgctccccccacaagatgaaagtacaaagggcaagaaatgcctaatactggacctggatgaaaccttggtacactcttctttcaaatacttacgatctgcggattttgttttgtctgtggaaatagatgaccaagtacacaatgtctatgtcattaaaagacctggtgtggaagaatttttggaaagagtcggaaaattattcgaggttgtagtcttcacggctagtgtctctcgatacggtgatcctttgcttgatatattagacacagataaagtcattcatcacagattattcagagaggcttgctataactatgaaggaaactatataaaaaacttatcccagattggaaggccgttatcagatatcatcattctcgataactctccggcatcttatatttttcatccccaacatgcaataccgatttcgtcctggttctcagatactcatgataacgaattattagatattattcctcttttagaagacctttctgtgaaaacctcactggatgtgggcaaaattttggatgtaacaatataa

SEQ ID NO: 3018 - DNA, 1284 bp, Saccharomyces cerevisiae
atggttgaaacatttagttttgctcatttggcttatttggtctttgagtccgttttacaggtagtcattatcgcactcgctggtttttggagcgctagttctggtctgctgcccaaacaaagtcaaaaaatcatttctctgttgaacgtggacctttttacaccatgtcttatttttagtaagttggccaaatccctgtccatggccaaaatctttgaaatagccatcattcctattttttttggtttgactactggtatttcatttatttccggaaagataatgagccgtatcctagacttggataaagatgaaactaattttgtggtggcaaactctgtctttggtaacagtaactctctacctgtgtccttgacattatctttggcttacactctgcccaacttaacttgggaccaaattcctaatgataacagagataacgttgcatcaaggggtattttatacttgctgatctttcaacaaatcggacaaatgctgaggtggagctggggttacaataagctaatgaagtggtctggagagaacactcagcatatgccaccttctcaagtgcaatctttgttggaaaggacgcccaacattgataacgaggaacttgtcaatgaggaacaagaggaacaagaattgcttgaagaagaaaataacagaatgaactcatcttttttgagttcgagttccatcggtgataagatttggcaaaaatcatgcactgtatttgagagaatcagagcgaaccttaatcctccgttatattccatgatttttgctgttgttgtggcagcaattggtccgttgcagagagagctatttatggaagatgggtttatcaataacacatttgccgaggctgttacgcagctgggttcagtttctatcccactgatcctggttgtcctcggttctaacttatatccttctgcggaagtcttccctaagacggttcaccatagcaagttattgatcggctccatcatcggaagaatgattttaccttcttgcttccttttgcctattattgctattgctgttaagtacataaacgtgagtattttggacgatccaattttccttgttgtcggttttcttttgactgtttcccctcctgccattcaattaactcaaatcactcaactgaatgaatttttcgaggcagaaatggccgatattctattttgggggtacgctgtcttaagtttgcctgtaagtattattgttgtctcaggtgcaatttacgttttacagtgggctaacccaacttaa

SEQ ID NO: 3019 - DNA, 1284 bp, Saccharomyces cerevisiae
atgtactcaagaaaatccttatccctaatttcaaagtgtgggcaattaagcaggctaaacgcgcaagctgctttacaagcaaggagacacttgtcaattcatgaatacaggtcagctcagttattgagggaatacggtattggtactccagaaggatttccagcgttcactcccgaagaggctttcgaagcagccaagaaattaaacactaacaaactggtcatcaaggcgcaggcattgaccggaggtagaggtaaaggtcacttcgacaccggttacaaaagcggtgttcacatgatcgaaagtcctcagcaggcagaggatgttgcaaaagaaatgctcaatcataacctgattactaaacagacgggaatagcggggaagccagtatctgctgtatatatagtgaaaagagtagatacaaagcatgaagcttatttatctattctaatggacagacaaaccaagaaaccgatgatcattgcgtccagtcaaggtggtatgaatattgaagaggtggctgagagaaccccagatgctataaagaaattttcaattgaaacttcaaagggattgagcccacaaatggccaaggatgttgccaagagtctcggtttcagtcccgatgcacaagacgaggcagcaaaagctgtttccaatttgtataaaatattcatggaaagggatgctacacaagtggagattaaccctttgagtgaaattgaacatgatccaacccacaaaatcatgtgtacagacgccaaatttgggtttgatgataacgcatcattcagacaggaaaagatatattcctggagggacttatcacaagaagatcctgatgaagttaaggcaaagaagtatgatttgaattttgttaagttgaagggtaacattggatgtttagtcaatggtgctggtttggctatggctactatggatgtcatcaaattaaatggaggcgatcctgcgaactttttggattgtggtggtggtgccacccctgagaccatcaaacaaggtttcgaattgatcttatccaataagaacgtagatgcaattttcgtcaatattttcggcggtatcgtaagatgtgactatgttgccctggggctggtagaagccgccagagaactagaagttagggtccccattgtggcacgtttgcaaggtaccaaagtagaagaaggccgcgacattatcaataagtcaggcgtgaagatttattcgtttgatgaattagatcctgctgctaaaaaggtcgttgaattgacccaaaattaa

SEQ ID NO: 3020 - DNA, 1287 bp, Saccharomyces cerevisiae
atgaaggatgctaatgagagtaaatcgtatactatagtgatcaaattaggctcttcatcgctagtagatgaaaaaaccaaagaacctaagttagctatcatgtcgcttattgtcgaaactgtagtcaaattgagaagaatgggacacaaagttatcatcgtgtccagtggtggtattgctgttggtttgaggactatgcgtatgaataaaagaccaaaacatttagcagaagttcaggccatcgcagctattgggcagggtagattgatcgggagatgggatcttctgttttcgcaatttgatcaacgtatcgctcaaattctattgaccagaaatgatattctggactggacccaatataagaacgctcaaaacacaattaatgaattgttgaacatgggcgttattcccattgtgaatgaaaacgacacactatctgttagagaaatcaaatttggtgacaatgacactttatcagcaattacttctgctttaatccatgcagattatcttttcttactgacagatgttgactgtttgtatactgataatccaaggacaaacccagatgccatgccgatcttagttgtcccagatctctcaaagggtttgcccggtgtgaatactgctggtggttcaggttctgacgttgggaccggtggtatggaaactaaattggttgctgcagatttggcaacgaatgccggtgttcatacgttgatcatgaaaagcgatacacctgcgaatataggtagaattgtcgagtatatgcaaactctagaacttgacgatgaaaataaagttaaacaagcatataatggcgatttaacggatttgcaaaaaagagaatttgagaaattaaaggctcttaacgttccactacatacgaagttcattgctaatgataataaacaccatctaaagaatagagagttttggattttacacggtcttgtctctaaaggcgctgttgttatagaccaaggtgcgtacgcagccttaacaaggaaaaataaggcgggattattgccagcaggtgttattgatgttcagggcactttccatgagttagaatgtgttgacataaaagttggtaaaaagttaccagatggcacgttagatccagattttcccttgcaaacagtaggcaaggcaagatgcaattacacgagttctgaattaactaaaattaaaggtttgcacagtgaccaaatcgaagaggaattgggctataatgacagcgaatatgtcgctcatagagaaaatttggcattcccacctcgttga

SEQ ID NO: 3021 - DNA, 1287 bp, Saccharomyces cerevisiae
atgactgctgctaaaccaaatccatatgctgccaaaccgggcgactatctttctaatgtaaataatttccagttaatcgattcgacgctgagagaaggtgaacaatttgccaacgcattcttcgatactgaaaaaaagatcgaaattgctagagccttggacgatttcggtgtggactacatcgagttaacctcaccagtagcatctgaacaatcaagaaaggactgtgaagctatatgtaaactaggtttaaaggccaagatccttacacacattcgttgtcatatggatgacgccaaagtcgccgtagagactggtgtcgacggtgtcgatgtcgttatcggcacctccaaatttttaagacaatattcccacggtaaggatatgaactacatcgccaagagtgctgttgaagtcattgaatttgtcaaatccaaaggtattgaaatcagattttcctctgaagattccttcagaagtgatctcgttgatcttttgaacatttataaaaccgttgacaagatcggtgtaaatagagtcggtattgccgacacagttggatgtgccaacccaagacaagtatatgaactgatcagaactttgaagagtgttgtttcatgtgacatcgaatgccatttccacaacgatactggttgtgccattgcaaacgcctacactgctttggaaggtggtgccagattgattgacgtcagtgtactgggtattggtgaaagaaacggtatcactcctctaggtgggctcatggcaagaatgattgttgccgcaccagactatgtcaagtccaaatacaagttgcacaagatcagagacattgaaaacctggtcgctgatgctgtggaagttaacattccattcaacaaccctatcaccgggttctgtgcattcacacataaagcaggtatccatgccaaggccattttggctaacccatctacctacgaaatcttggaccctcacgatttcggtatgaagaggtatatccacttcgccaacagactaactggctggaacgccatcaaagccagagtcgaccagttgaacttgaacttgacggatgaccaaatcaaggaagttactgctaagattaagaagctgggtgatgtcagatcgctgaatatcgatgatgttgactctatcatcaagaacttccacgcagaggtcagcactcctcaagtactatctgcaaaaaagaacaagaagaatgacagcgatgtaccggaactggccaccatccccgccgccaagcggactaagccatccgcctaa

SEQ ID NO: 3022 - DNA, 1287 bp, Saccharomyces cerevisiae
atgagcgatgttctatctcaatataaagggtgctcagtcagagatttacccacacccaatttcgttattaatgaagaaaaatttgataagaattgtacgacaatgttgaacaacgttgaaaagctcagccaggaatgtggcgtaccaatcaaatttcgtgcacacgtaaaaacgcataagacagcaaagggaactttgaaacaattgggccacggacttccattggctaaacgcactacaagagccatattagtatcaactttgaaagaagcagaagaacttcttaattatcaagatagacaatgttcggattatattgacgatataacatatagtttaccctgttgcgttccagagtttattcctcttttgagcaatttgtcaagaagggtgaataattttcaggtttttgttgataacattgaacacttggagaatttaaagaatttcggtaggcctgcttccggcaagaaatggtcggtttttatcaaggttgatatggggactaagagggcaggtcttgctttcgactctccagaatttttgagtcttttaaaaaaactgacttcctcagaaattaaagaagtaattgagccatatgggttttatgctcatgccggacacagctactcttcaacctcgatcaacgacactcagaatcttttgatggaagaagtgaaagcagtcaattctgccgctaaagttttgtgctctgtggatcctcagtttgatccttctaaattaacactttctgtgggcgctactccgacttccaattctttgaaactcgataataaaagtacccttgttaaattcattactactcaattagttagtacgcttgaaatccactgcggtaattactgcatgtatgacctgcaacaggtggcaacaggctgtgtccaagatcacgaattgtctggttttgtattaggaacagtactatcatcttacccttctagaggtgaattgttgagtaatacaggtgtaatgtgtctaacgcgagaagcatcctcaataaaagggtttggaatatgtgctgatttggaacatgtgttaaaatccgagagtttcagtagggaatggtatgtagcaagggtctctcaagaacacgggatactgaggccaataagaaactggaacgaaactactccattaaaattaggcagcaaaattgccgtccttcctcaacacgcttgtatcacaatgggacaatttccatattatttcgtggtaaacagcgaaggcattgtcaacgatgtttggttaccttttcagaaatggtaa

SEQ ID NO: 3023 - DNA, 1287 bp, Saccharomyces cerevisiae
atgagtatgttatctagaagattattttccacctctcgccttgctgctttcagtaagattaaggtcaaacaacccgttgtcgagttggacggtgatgaaatgacccgtatcatttgggataagatcaagaagaaattgattctaccctacttggacgtagatttgaagtactacgacttatctgtcgaatctcgtgacgccacctccgacaagattactcaggatgctgctgaggcgatcaagaagtatggtgttggtatcaaatgtgccaccatcactcctgatgaagctcgtgtgaaggaattcaacctgcacaagatgtggaaatctcctaatggtaccatcagaaacattctcggcggtacagtgttcagagagcccattgtgattcctagaattcctagactggtcccacgttgggaaaaaccaatcattattggaagacacgcccacggtgatcaatataaagctacggacacactgatcccaggcccaggatctttggaactggtctacaagccatccgaccctacgactgctcaaccacaaactttgaaagtgtatgactacaagggcagtggtgtggccatggccatgtacaatactgacgaatccatcgaagggtttgctcattcgtctttcaagctggccattgacaaaaagctaaatcttttcttgtcaaccaagaacactattttgaagaaatatgacggtcggttcaaagacattttccaagaagtttatgaagctcaatataaatccaaattcgaacaactagggatccactatgaacaccgtttaattgatgatatggtcgctcaaatgataaaatctaaaggtggctttatcatggcgctaaagaactatgacggtgatgtccaatctgacatcgtcgctcaaggatttggctccttaggtttgatgacttctatcttagttacaccagacggtaaaactttcgaaagtgaagctgctcatggtaccgtgacaagacattatagaaagtaccaaaagggtgaagaaacttctacaaactccattgcatccattttcgcgtggtcgagaggtctattgaagagaggtgaattggacaatactcctgctttgtgtaaatttgccaatattttggaatccgccactttgaacacagttcagcaagacggtatcatgacgaaggacttggctttggcttgcggtaacaacgaaagatctgcttatgttaccacagaagaatttttggatgccgttgaaaaaagactacaaaaagaaatcaagtcgatcgagtaa

SEQ ID NO: 3024 - DNA, 1287 bp, Saccharomyces cerevisiae
atgctaaagggaccgcttaaaggttgcttaaatatgtctaaaaaagttatagtgattgctggtacaacaggagtaggaaagtctcagttgtccatacaattggcacaaaaatttaatggcgaagttatcaattcggattctatgcaggtatataaagatattcctattataacaaataaacatccgcttcaagaaagagagggcattcctcaccatgtaatgaatcacgtagattggtcagaagaatactattcccatcgttttgaaactgaatgcatgaacgctattgaagatattcaccggaggggtaagatacccatcgttgttgggggtactcattattatttgcagactcttttcaataagcgggtcgatacgaaatcatccgaacgtaagctcacaaggaagcagctcgatattttggaatcgactgaccctgatgtgatttataacacacttgtgaagtgtgatcctgatatagctaccaaataccatcctaatgactacaggagggtacaacgaatgttggaaatctactataagacgggcaaaaaaccaagcgagacatttaacgaacaaaaaataactttgaagtttgataccctatttttatggctatacagtaagccggagccacttttccaaaggcttgacgatcgtgtagacgacatgctagaaagaggcgccttgcaagaaatcaagcaattatatgaatattacagtcaaaataaatttacgccggagcaatgcgagaatggtgtttggcaagttattggcttcaaagaattcttaccgtggctaaccgggaaaactgatgacaacacagtaaaattggaggattgtatagaaagaatgaaaacgagaacacgtcaatacgcaaaaaggcaggtaaaatggatcaagaaaatgctgatacctgacatcaaaggcgatatatacttactggatgccactgacctttctcaatgggacacgaatgcatctcaaagagcgatagctatttccaatgactttattagcaatcgacccatcaagcaagaaagggcacctaaagccctagaggagctgttgtctaaaggcgaaactacgatgaagaaattggacgattggacacattatacttgcaacgtctgtcgtaacgcagatggtaagaacgttgtagctattggcgaaaaatattggaaaattcatttgggtagcagaagacataaatccaacttgaaaagaaacactcgtcaagctgattttgaaaaatggaaaataaacaagaaggagactgtggaatga

SEQ ID NO: 3025 - DNA, 1287 bp, Saccharomyces cerevisiae
atggaggaactaggtattgtgacacctgtcgaaaaggcagtcgaagaaaaaccagccgtcaaatcatacgcatcattgttggctcaactcaatggtacagtcaacaataacagtgccctgtctaatgtgaattctgatatatatttcaaattgaagaaattagaaaaagagtatgaactgctgactttgcaagaagactatattaaggacgaacaacgccatttgaaacgtgaattgaagagagctcaagaagaagtaaagagaatccagtcggttccattagttatcgggcaattcttagaacctattgatcagaacacaggtattgtttctagtaccacaggtatgagttatgtcgttagaatattatcaaccctagaccgtgaactattaaagccatctatgtctgtagctttacatcgtcattcaaatgctttagttgacatcctaccacctgattccgactctagcatatccgtaatgggcgaaaacgaaaaacctgacgtcacttatgcagatgttggtgggttagatatgcaaaagcaagaaatcagggaagccgtagagctgccattagttcaggctgatctatacgagcaaatcggtattgaccctcctaggggtgttctattatatggtccaccaggtaccggtaagacgatgcttgttaaagccgtcgccaatagtacaaaagctgcattcataagagttaatggctccgaatttgttcacaaatatcttggtgaaggtccaagaatggttcgtgacgtctttagactcgccagggaaaatgctccatccattatattcatagatgaggtagattccattgccacaaagcgttttgatgctcaaacgggttccgatcgtgaagtacagcgtatcctgattgagttgttgacacaaatggatggtttcgatcaatccaccaacgttaaagtcatcatggctacaaacagggcagacacattggacccagctttgctgagaccaggcagattagatagaaagattgagtttccctcacttcgtgataggcgtgaacgtcgtttgattttcggtaccattgccagtaagatgtcccttgccccagaagcggacttagactcgcttattattcgtaacgactctctatcaggtgctgttattgcagcgatcatgcaggaagctggtttaagagcagtgaggaaaaacagatatgtcatcttacaaagcgatctggaagaagcttacgccactcaagtcaagacagataataccgtcgataaattcgacttctacaaatga

SEQ ID NO: 3026 - DNA, 1287 bp, Saccharomyces cerevisiae
atggatttaacaatttcaaacgaacttactggcgagatatacggcccaattgaagtcagtgaagatatggctttaactgatctaatagcattactgcaggccgattgcgggtttgacaaaacaaaacacgacttatattacaatatggacattctagactcaaacagaactcagtctttaaaagaactagggctcaaaaccgatgacttattattgattaggggtaagatttccaattccattcaaacagatgctgctactttgtccgacgaagcgttcatagagcaatttagacaagagctacttaataatcaaatgcttagatcacaactcattttgcaaatccctggattgaatgatttagtaaatgacccactgttgtttagggaaagattgggcccgctcatattacaaagacgttatggtggctataacaccgccatgaatccttttggcatcccccaagatgaatatactagactaatggccaaccccgatgatcctgacaacaagaagaggattgcagagcttttagaccaacaagctatcgatgaacagttgcgcaatgctatcgaatatacacctgaaatgtttacccaggtccctatgctttacattaatatcgaaataaataactaccccgtaaaggcatttgtagatacaggggctcaaacaacgattatgtccaccaggttagcgaagaaaactggcctgtcgagaatgattgacaagagatttattggagaagctcgtggcgtaggaaccggcaaaattattgggagaattcaccaagcccaagtcaaaatagaaacacaatatattccatgcagttttaccgtcttagatactgacatcgatgttttgataggactagacatgctgaaaaggcatttggcttgtgtggacttaaaggaaaacgttcttaggatagcagaagtggagacaagctttttgagtgaagcggaaatcccaaaaagttttcaagaaggacttccagcaccaacgtcagttacaacttcgtctgataagcccctaacacccaccaagactagttcaactctaccaccacaaccgggggctgttcctgcgcttgctccaaggactggtatggggccaacacctacgggaagaagtacagccggtgctacaacggcaaccgggagaacgtttcccgaacaaacgattaaacagcttatggatctaggtttccctagggatgctgtggtaaaggctcttaaacagactaacggaaatgcagaatttgctgcatccctccttttccaatga

SEQ ID NO: 3027 - DNA, 1287 bp, Saccharomyces cerevisiae
atggcaaaaggaggctcgctatacatcgttggcatattcttaccaatatggacctttatgatctatatttttggcaaagagttattcctcatacgaaaataccaaaagattgacagtacgtatactgctctttcccaaagagtaaaagaacaatatgatacaagtcgaagaagaaactattttcctaaagtaaaactttcccgcaatagctacgacgactacactttaaattataccagacagaatgattctgattcttttcacctacgagaaaatgcaacaattttaatgctggtgagaaattcagaattagaaggggcattggattcaatgagatcattagaggacagatttaacaacaagtatcattatgattggacttttctaaatgacgttcctttcgatcaagacttcattgaagctacaacatcaatggcgagtgggaagacccaatatgctttaataccaccagaagattggaatcggccgcaatggattaacgatacactttttgaagaaagacttcgagtcatggaggatgagggtgttttatatgggggatccaagtcatatagaaatatgtgtcggtttaattctggtttttttttccggcagtcaatactggacaactatgattactactttagggtggaacccaatgtcaagtattattgcgatttcccatatgacccgttcagagttatgagattgaagggcaaaaaatacggatttgtcatatcattatatgaatatgaagaaaccataccaaccttatgggacgcggtagaggagtatttagtggccagcgaagagaccattttacgtaaagaggacagtgcctatgcatttttgaccgattcagggctagttggtaagcattatcccgttgttgaagcaaactctgactacaatttgtgccatttttggtcgaattttgagattggcgacttgaatttcttcagaagtgacgaatataagcatttttttgaaactttagatgccaagggcggattttactacgaaaggtggggtgacgcacctgtacattcaattggtgtctccctactgctgagacctgacgaaatcattcattttgacgaacttggctattttcactcaccgtttggcacctgtccagcatcttacgctgttaggctcgatcagaggtgtagatgcaaaagcgatgatgaaagtgtcatagatataaccccacatagttgtttgatgagatggtggaaaaacggtagcggcaaatatttcttaaaagaagagcaagacgagatttaa

SEQ ID NO: 3028 - DNA, 1287 bp, Saccharomyces cerevisiae
atggttaataatatcatgcacgagtacgtaccacccagtcagcggctattccatagcaggcatagaataacaagaaacgatttgaaagaagaggccctacattccgggaccacagattggacaacaattctggacacaacaatagataaagatactaatctcattagttatgctgtccccataatagacaactttgccattcctcgagcaaactctcaggggagtcctgtggccccttcgccgaatcacagatcaacgatgtactcttcttcatcttcttctgcgtcttctgtgttttctgatggtttgtttactccaaacaacaacaggaactcatcaggatcatcttcattagtcattagaccacaaaaaaatttgagtgtagattctttgattcaggaaaataaaaggaaaatcaatagtgaaaaagaatcgttatcattaattgccaataataacgatgaaaccttgtgcactcatactgatccatccatacaaaacctcattaaatcggaaacaaagaggaacatcttaaatttaaagtttcaaaatagaaacttatttcgaagagaactaaaattggaaaagttttggagcaatttgagaagttgtcatacatctggcgatgagacggacctgctgttggtgataagtaagcataacttatattggtttgggataccgaacgattttcgtcttccaatatacaagagatgtttatatcactatagcgaactagacgaagccggatttttcagtcagtatgcgaacaactcattgtatctagcaataaggaaatgttgtaacaacgaagagcaggaaactctatcccggtctattttcatcaatttgacgaaaaacgttacctggttgaatagtcgtttcgatgacaataaggacaacaagaattcttacacggttactgaggggaagttctatcaggactttcctaacttatactaccatttaaaggacaagttgaaattaaatgtgataatggatttcatcaagcctgtaataagaaattttatgaccaacgcattgaataagcacaaattagatggtattggtctagaacttttagatattctaatagtgactacctattatggtccgaataaaatcaatgctttcttaatggatacatttatcttaaacttgctaaaacagtgccattacaagttttttgtcagtaatatctctgagctggttattcaaatttctaaaatcgattgtgacttagtcattctgctagaagatttaaggtcacggattgatttagattga

SEQ ID NO: 3029 - DNA, 1290 bp, Saccharomyces cerevisiae
atggcaaataatacgtggaagttaattgctactacagctcttatatcggtgttttcaacccaacttgccaaaagtgtatggaaagaatacaaactttcatgtgcggctaataagaataaaaccgtatcgcgacctcgtcaatatgatgaccacttatttagggaacaattggctcgtaactatgcatttcttggcgaagaaggtatgaggaagatcaaagaacagtatatagttatagtcggagctggagaagtgggatcgtgggtatgcacaatgttaattcgttcaggctgtcagaaaattatgattatagatccagaaaacatatctatcgactctttgaatacccactgttgcgcagttttatcagatattggaaagcccaaagttcaatgcttgaaagaacacttgtctaaaattgctccttggtctgaaataaaagcaagggccaaggcctggactaaagaaaactcacacgatttaatttttgcagacggtgagtccccaacttttatcgtggattgtctagataatctagaatctaaggtagacctattagagtacgcccatcacaataaaatagatgttatttcttccatgggtgttgccacgaaatcagatcctacccgtgtgagtataaatgacatatccatgacagaatttgaccctatatctcgttgtgtaagaagaaaattgaggaagaggggtatcgccacggggatttccgttgtttttagtaatgaaatgctcgatccacgccgagacgacatactctctcctatagattgcgaacatcgtgcaatcaatgctgtcagagatgaggctctcagacatttaccggaattagggaccatgcctggtatttttggtttgagtattgcgacatggattttaaccaaagtgtcaggctatccaatgaaagaaaatgaggtcaaaaataggttaaagttttatgacagcatcctagagactttccaaaagcagatggcgcggttgaatgaaaataaggagcgatcgtcattgcttggattagaagaggtcggttatatagttgaagaaatgtttagaggcaagtctcctattagcggatactctacgaaactagctctaacaaaatgggaagctaacaaagaaatctccttaaccaatgttgttctgatgacgaaagaagagcaagaaattcacgaaaaaaggattttgctggatggtgagaaactgacagctgtatactctgaagaagttctcgattttattgagaggctttttaaagaggaggagtactattcttag

SEQ ID NO: 3030 - DNA, 1290 bp, Saccharomyces cerevisiae
atggctaaagatattttgaagaaccaggaccctaaattgcaagcgatgatcgttgaacactcggcgcctgctcccaaagagatacctatggacgctcctgttttgaaaagagtcgctagacctttaagacatgtaaagttcattccaattaaatcgctgatattccatactaaaacagggcccatggatttttcttatgaaaagaagatcaagacgcctattcctaagaacaaaattgtagttcgagtaagtaatgtgggtttgaaccctgtagatatgaaaatcaggaacggctacacatcgtcgatttacggtgagatcggcttggggagagagtacagtggtgttatcactgaggtaggcgagaacctaaactacgcctggcacgtgggtgatgaagtatacggtatatactaccaccctcatttggccgtgggatgtttgcaaagttcaatcttagtagatccaaaggtggacccaatccttttgagaccagaatcggttagcgccgaagaagctgcaggctccttattctgcctggccaccggctataatattctgaataaattatccaagaacaagtatttgaagcaagattcaaacgttttgattaatggtggaacttcgtcagtggggatgtttgtcatacaattattgaagcgtcattacaagttacagaaaaaactagtgattgtaacgtctgcaaatgggccccaagttttacaggagaaatttcctgatctggctgatgaaatgattttcatcgattacttaacgtgtaggggtaaatctagtaaaccactaagaaaaatgctcgaagaaaagaaaatttctcagtatgatccggtcgaggataaggaaactatacttaactataatgaggggaagttcgatgttgtactcgattttgtcggtggttacgatattttgagtcattctagttcattgattcacggcggtggtgcgtacgtaaccactgtaggtgattacgttgccaattataaagaagacattttcgattcatgggataacccaagtgccaatgcaagaaaaatgttcgggtctattatctggtcatataactacacacattactattttgatccgaatgcaaagacggcttccgccaataatgattggattgagcaatgtggcgactttttgaagaacggtactgtaaaatgtgtcgtcgacaaagtttatgactggaaagaccataaagaagcattttcttatatggccactcaacgtgcccaaggaaagttaatcatgaacgtcgaaaaattctag

SEQ ID NO: 3031 - DNA, 1290 bp, Saccharomyces cerevisiae
atgggaggagaggttctaaataatgaaggaatgccactggccgaacttaaacaggagaccattcccatatcacgatcagagagttcagaatcattgaacagtttaacatcaactagaagctcatcgagcaataggccaaagacatatttctgtgactatgatggctgtgataaggcatttacaagaccttcaattttgactgaacaccaattaagcgtacatcagggtttaagagcatttcagtgtgataagtgtgcaaaatccttcgttaaaaagagtcacttagagagacacttgtatacgcattctgatacgaaaccattccaatgttcttattgtggaaaaggagtgacgactcgccagcaactgaagcgacacgaagtaacgcataccaaatctttcatttgtccagaggaaggatgcaacctccgattctacaagcatccacaattaagggcacatattttatctgttcatttacataaactaacctgtccacactgcaataaaagctttcagaggccatataggctaagaaatcacatttctaaacatcacgatcctgaggtagaaaatccttaccaatgtacttttgctggttgttgcaaagagtttcggatatggtcacaattgcaatcgcatataaaaaatgatcatcctaaattaaaatgtcctatttgtagcaaaccatgtgtgggggaaaatggtttacaaatgcacatgattattcatgacgactcactagtaaccaaaaattggaagtgtcatatatgtcctgatatgtctttttctagaaaacatgatcttctcacgcattatgggtctattcatacggaagaagatatcccactggaactaaaatataaaatttctgatattcaacaacttgtccaagaccacggagttcaactggggaatagcaaacactcgaatgagcaggatgaagagaagatttccaataggttgaggaaaaggagaaaacttaccgaaaacaataatgtagagtttttacagaatgaagtggatttagaaaagcgacttgagtctggtgaaaatgggctaaaccttttattgaataccgttggaagaaaatacagatgcttttacaataattgttctaggactttcaagacaaaggaaaaatacgagaaacatatagacaagcacaaagtacatgagctaaagttaaaaatattacaggaaaaggaagaaaataaaacgctagtggaccagaaccataaggaaccttttataattcaaaaggaaacgcagtcagcgggtgacaaataa

SEQ ID NO: 3032 - DNA, 1290 bp, Saccharomyces cerevisiae
atggtagacgtggaagagaaaagtcaagaagttgaatatgttgatccaacggtgaatagggtgcccaattatgaggtatctgaaaaggcgtttcttttgacacaatcaaaggttagtattgaacagcgtaaggaagcggcagagttcgttttagccaaaattaaagaggaagaaatggccccttattataaatatctttgcgaggaataccttgttaataatggccaatctgacttggaacacgatgaaaagtcagattctttaaacgaatggatcaaatttgaccaggagctatacaatgaattgtgcaaaaaaaatgaaagtaagattaaagagttaaatgaaaagatccaaaaattggaagaagatgatgaaggtgaactagaacaagctcaagcctggattaatctgggtgaatattatgcacaaatcggtgacaaagataatgctgaaaagacgctagggaaatcattatcgaaggctatttccacaggcgccaaaattgatgttatgctaacaattgcaaggctggggttcttttataacgaccaactttatgttaaggagaagttggaagcagtcaattctatgattgaaaaaggtggtgactgggagagaagaaatagatataaaacatactatggtatccactgcttggccgtaagaaactttaaggaagcggcaaagttattggtcgattctctagcaactttcacctctattgaattaacttcctatgaaagcattgccacatatgcatcggtcacaggtttattcactctggaaagaacagacctaaaatccaaagtcatcgattcacctgaattgttatctttaatctcaacaactgccgcactacaatctatctcgtcgttaacaatttccctttacgcgtccgattatgccagttactttccatatcttttggaaacatatgcaaatgttttgattccatgtaaatatttgaatagacatgcagatttctttgttagagaaatgagaagaaaagtctacgcacaattgttggaatcatataagactttgtcgctgaaatctatggcaagcgcatttggtgtttcggttgcgttcttggataacgacctgggtaagtttattccaaataagcaactaaattgtgtcattgatagagttaatgggatcgtagagaccaacaggccagacaacaaaaatgctcaataccatctgctagttaagcaaggtgacggtttgctaacaaaattacaaaaatacggtgcagcagtgagattgacagggtcagatcgtgtttga

SEQ ID NO: 3033 - DNA, 1290 bp, Saccharomyces cerevisiae
atgtcagaaccagtgataaagtctcttttggacacagacatgtacaagattacgatgcatgctgctgtcttcactaattttccagatgttacagttacttataaatataccaacaggtcgtcccaattgaccttcaataaggaagccattaattggttgaaagagcaattttcgtatttgggaaatttgaggttcacagaagaggaaattgaatacttaaaacaggaaatcccatatttgccatcggcatatattaagtatattagcagttctaattacaaactacaccctgaagagcagatttccttcacttcagaagaaatcgagggcaagcccacccactacaaattgaaaattttagtcagtggtagttggaaggatactatcctttatgagatccccttactgtccctaatatcagaagcgtattttaaatttgttgacatcgactgggactacgaaaaccaattagaacaagctgagaagaaggcggaaactttgtttgataatggtattagattcagtgaatttggtacaagacgtcgtagatctctgaaggctcaagatctaattatgcaaggaatcatgaaagctgtgaacggtaacccagacagaaacaaatcgctattattaggcacatcaaatattttatttgccaagaaatatggagtcaagccaatcggtactgtggctcacgagtgggttatgggagtcgcttctattagtgaagattatttgcatgccaataaaaatgcaatggattgttggatcaatacttttggtgcaaaaaatgctggtttagcattaacggatacttttggaactgatgactttttaaaatcattccgtccaccatattctgatgcttacgtcggtgttagacaagattctggagacccagttgagtataccaaaaagatttcccaccattaccatgacgtgttgaaattgcctaaattctcgaagattatctgttattccgattctttgaacgtcgaaaaggcaataacttactcccatgcagctaaagagaatggaatgctagccacattcggtattggcacaaactttactaatgattttcgtaagaagtcagaaccccaggttaaaagtgagccgttaaacatcgttatcaaactattagaagtaaatggtaatcacgctatcaaaatttctgataacttaggtaaaaatatgggagatcctgccactgtgaagagagtgaaagaggaattgggatatactgaacgaagttggagtggtgataacgaagcgcacagatggacctaa

SEQ ID NO: 3034 - DNA, 1290 bp, Saccharomyces cerevisiae
atgtctgcattgagaaacatcaagttcaatgaagaagaagatggtgaactaccctgcctcgtaacaggtgaagaaaataatctacaagaaattttggaaaatgtctcgtatgatggtggaaatattgttagcgatgcaaaagttgaaagggtaaacaagcaagtggagaacacttctgcaggcgcaacagatgtgcacgagaaaaagcgtattcctgtgagcattattaccggctatctaggatcaggtaaatcgacgttgctggaaaaaattgcattaaaaggtgcagataaaaaaattgccgtaattttaaatgaatttggagattctagtgaaatcgaaaaggctatgaccattaaaaatggatcgaacagctaccaagaatggttggatttgggtaacgggtgtctgtgttgttcgttgaaaaatataggtgttaaagccatcgaagatatggtggagcgttcacctggtaaaatcgattatatccttttagagacctccggtattgcagatcccgcccccattgcgaaaatgttctggcaggacgaaggattgaatagcagcgtttacattgacgggatcatcacggttttggattgtgagcatatactaaaatgcttagatgatatttccatcgatgcccattggcatggtgacaaagttggtttggaggggaatctgactattgcacacttccaactagccatggctgatcgaattataatgaacaaatacgatactatcgaacattcaccagaaatggtcaaacaattaaaagaaagagtacgggaaataaattctatcgcaccgatgttcttcaccaagtatagtgatacgccgattcaaaatttactagatattcatgcatacgacagtgtacggatatctgacatcttagatagtggtagcggaaacggtaccattcatgatgatcgaatgggcacaataatgcttactttcagaccattaaaaaacgaggaagaatataataataagtttattaagcaatttttgcaacctttattgtggaagaattttggagccatgacagtgctgggagggcgtcgccgagatgacggccgtgattgggaagtacaaagaactaaaggtctgatacttattgaaggagagaaccccattgctcgtgtaatccaaggcgtccgcgacacctacgatgtctttccaggcaaatatgacggatccaataaagagtgtaaaattgtgctgattgggaagtacctagaaaaggaatccatagaggaactgttacgtaaaaccctggaatga

SEQ ID NO: 3035 - DNA, 1293 bp, Saccharomyces cerevisiae
atgacagttttatacacatctgcatcgctgaaaaaaatgaagtgcttggcattcaacatgggcatgaattgcgtacgaacagtatctcatgcaagaagtggaggtgcaaaatttggaggacggaatgtatttaatatatttgactcaaaaactcctgattcagtgcgtataaaggccttcaaaaacacaatataccagtctgccatgggcaaaggtaagaccaagttttctgcaatggaaattaatctcataacaagtctagtgcgcggatataaaggagaaggtaagaagaacgcgataaatcctctccaaactaacgtgcaaattcttaacaaattattactaacacatcgattaacagacaaagacatattagaaggaatgaacctggcagccggtcctgtcaatgttgctattcctcgagacataacaccgcaggaagaaaagaagaaagttgaactaagaaatcgaaaagcagagaatatggatcttcacccgagcaggaagatgcatattaaggaacttctacactctttgaacttagatatgtgtaatgatgaggaggtttatcagaaaatatcactttacttacagaaaaatgaggaaagcaggacttcagtgggtgcctcgcaacaaaaccacgtagatatcgatataaactccctaaaacgctatctacaaaatattgaaaagaaggcacgtcaaaaaagtgccatcgataaacaaaaaaagaatcaagctcgtatatatcaatggaatactcaatccttctccgaaatagtacccttatcagctggaaatatcttattcaaaagggaacccaatcgcttatggaaacgtttacaaaatggaataagtgtatttttaggttcaaacggaggaggaaaaaagagtaaaactactaaaaaagtacttcaagggaataacatattgttacactcattagaaaacaataaggatatgaccctgtcaaacaactttgatcacagtgtctttaacatcaattttacggacttatttggcgttattaatgcatctgggtccccaccagatagagttttgaacgaaattaatgagatcgaattaaaaggttggaaatgtgtggggaacttatacgataataataaaattgtagtttttcaaagtagcaatccactcttagaggatacgaagattcctcaaaagtctttcactaattcaaagagattccttatttcactctcagcattgctggcctccttttttgcatattatagataccgtctatctcaacgtcaagaatcaaagaaatga

SEQ ID NO: 3036 - DNA, 1293 bp, Saccharomyces cerevisiae
atgactattaggagcagtatgaaaaacaacgcagaattggaaagcaagagtgtgttagctaatgaatcgaatataattagcacatttactagaaggataataaaggaaaaaagcggtaactatcaggtactgaaaagatcccttgatggaaaactaatctatcctgaggccactggcatatcctctaacagaggtaacaaacttttgcagagaagcgaagtagtaacaagaagagacttgaacaattctaagccaatgattgagcaaactgtgttctataacggttcggagcatcgccttctgcaaacaaatattgtcactgatagtagacgcaaaagaataaaattcacacctgacatcaacgtcgagcctgttttagtcggtgatgaaaacgacatcgatggtagtgagaaggaagacgaaaatatcactgatgagtattacggcgaagaagacgatgacgacctatcaaaactagtgaatgtaaaggagattttgactcccattctttccctaggggatataataaatcataaaactatctcaaggacattttcaagcccaattttgaaaaatttagccttgcaaataattctaatgattgaaaaagaacagatgtcagttgttagatattcccagtttttggaggtttttttaggagatcatcctgaaccaatttatgaatctaacttgaacctaccatcttataatcacaatttgacccttccagaggatagaggggcaagcgacgaggatgacattaacaacaaaaacaatatcaacgaggttaactcgaatagtttgtctactgaagctggtcatatcaataatggcatggaagaatttggagaggaagatcctttttttgcattgccaaggttggaacaatctaatgcgctgttatcgttgctgccatcttcttccggttctgcttctatatcaacattaacagcggccgaacaacaacagttaaatgaggaaattgagtctgcccgacagctgtcgcagattgcactacagaggaataaagaattcataagaaacttacaaaaaatcagaaagtctgtaataaaagccaatagaataagaggtaggattttaaattggagtcgggaatatttgggtatatctgacgatgatattactatcccggtggctctacgtgttgtgaagagaggtctgatcagtgctacaacaaataagacaacaaattttgaggaagaaattgaaaataccatggaagacggtgttgtagacgataatgaacctgatgaagaagctaatagagcctaa

SEQ ID NO: 3037 - DNA, 1293 bp, Saccharomyces cerevisiae
atgccaagaaagtttttgggcaataaaattgaaaagaatgttgatgcagtcagaccatcttcgctaacattaacagctgatgacttgaagtatattccaccgataccacaagattttgaagatgaagatgataaggttttacgtaccagcaacggtggtaacaggttgtctaaaagatttgggggtacactgaaactgaagaaacggttagagtctgttccagaattgttcttacatgatttcaagaagaggccacgctcccaacttgaggtgattagagagaaaaaatttactgacatgcaagttcccaagggaccagtttgtcctcaaagcacgattctaccattacgagaaagaaagaaggtaaaatcactaccaattcaaagaaaaagtttacgtaggccgacgctgtcaaagcctgcagtagtacaatctttagggcataagacacattcggatcatattattgataaagtgtttgtctctcgcccggccccaattgtaatgcctgtaaaagcccttactcctattaatccggtctccctaatgcaaacacagacacaagattgctgtagaaaaaataagtatggcaaaagcggtagtgaaatattgtttgacgaaattctatcagcctatgaaaacgtttctacaagcgattctactgccctaaattcagaaattgacagaattatcgatatatgcgcttcaaaacaaatagctaaaaaaaatgaggcatttcaggtaccatatgtcgtctgccctgacgacacagagactttgttttcgtcaacaacaccaaagttgaaacctgtcaattctaacacattaaacgatgtcatttctagcccagaatacaccacgtctggatgcagtacatactctgaccaatcgaattcagatgaggaattgtccgaagtagaaagtatagtatggaacacgaataagaggacaatgagatcatccattgtgtctgaaagcactagtgaggaaggctattgcactgctgcggagactttgccctcaacagtatcagtggaagatctggatatacataacaagcttccaaaagttgcacaaacatcatcgtgcaatacgcttttgaataaactctctataagaaaattaaaaaaagtaattctcgatccgcctaaaataatgcatgtcatgacttttgacgatgacagtgatgatggagatgacaacgatgacgaggatagggctttgaatattcttcaaaaaaaaattgactgcattgaaatagcaagttgcagcagtagcatttacagcgaataa

SEQ ID NO: 3038 - DNA, 1293 bp, Saccharomyces cerevisiae
atgcggaccgattggaattttttcttttgtatccttctgcaggccattttcgttgtgggcacacaaacttcaagaacgcttgttctttacgaccaatctacggaacctttagaggagtactcagtctatttaaaagatctagaacaaaggaattacaaacttgaatatttagatattaacagtacttccactactgtggatttgtatgacaaagagcaaagattgtttgataacatcatcgtttttcctaccaaaggaggcaagaatttagcgagacaaatcccagttaagcagttgattaaattttttgaaaatgaaggtaacattttatgcatgagttctccaggtgctgttccgaataccattcgtttatttttgaatgaattaggtatctatccaagtccaaaaggacacgttattcgtgactatttttcgccctcctcagaagagctagtggtttcttctaaccatcttctgaacaaatatgtgtacaacgccagaaaaagcgaggattttgtttttggggaaagttcagctgctttattagaaaatcgtgaacaaatcgtcccaattttaaacgctccaagaacatcctttactgagtccaaaggcaaatgcaactcttggaccagcggatctcaaggctttcttgtagttggtttccagaacttaaacaatgctcgtttagtatggatcggcagtagtgatttcttaaagaacaaaaatcaggactctaatcaggagtttgcaaaagaattactaaaatggacatttaatgaaaaatctgtaatcaaaagtgtgcatgcggttcattcacatgcggatggtactagttatgacgaagagccctacaaaatcaaggacaaagttatttattctgtaggcttttcggaatggaatggagaagaatggctaccacatatcgctgatgatatccaatttgaactaagacaagtggatccgtactaccgtctaacattgtcgccaagcggaaacgattctgaaactcagtattacaccaccggtgaattcatccttccagaccgccatggagtgtttacattcctcactgactatcgtaagattggcctgtcgttcactactgacaaagacgttaaagctatccgtcaccttgctaatgatgaatacccaagaagttgggaaatcagcaattcttgggtttatattagcgccatttgtggcgtcattgttgcgtggatattttttgttgtttctttcgttacgacttcctctgttggcaagaaacttgaaacattcaaaaaaacaaactaa

SEQ ID NO: 3039 - DNA, 1293 bp, Saccharomyces cerevisiae
atggatgatataagcggaaggcaaactttacctcgaataaaccgtttgttggagcacgtgggaaatccccaagatagtttgtcaatcctacatatagcgggaacaaatggtaaggagacagtatctaaatttttgacatccatattgcagcatccggggcaacagcggcaaagggtcttgattggtaggtatactacatcttccttgctaaacgccaaagaagaggatattagcattaataatgaagccatttccttgatagagtattctaggatcgagaaggaacttatagaagcagatagttctttgaaattacagtgcaacaacctcgaactgctaacaagcgtagctctcgtatacttcgctaagaaaaattgccaatggtgcataatagaaactggtttagctggaaaacaggaccctggaagtataattgctggtcaaagtagagtctgttgcgccattactaacgtgggcattagcgatgaagcttttttatgcaagtttttgtctcaaattactgaaagttccacaaataaagcaatttttctattagacggttctaatgacgaatttgtacgaaatacgataacgaaacggtgccatgatgttggatgtccattagaaatcaccgacccttctcttagggattacaatgtacacacagacacatggggcactcttgaagttcgcctgccatacagtgaagaagaatatcaaatatttaatttgagagttgcgatagcggttttagactttttgagcaaggaaaaaaaggtttgtatttcaaaggatcaactatcccaaggtttaatatctgtggattggccaagaagtttacatcgcttggattactgttatgaatctactagtggaaagaaaatcgcattactattagacaacgcaaataatgcgaaggcagctcgaaatttagcctgccatttaaggaccacgtacggtgatacgccattaacatttgtcattgctataacaactgggaaaaaggtgtctcccttacttgatccgctaatacgtccacaagattatgttattgtgactagatttgggtcagtggttggaatgccgtggatccaatccctagaaccggtgaatcttctcgcatttatcaaaaaccggtatacgagaaatgttaacatgcagccggatcttcaaagtgtctggaccttccttgaaacaagtgggttaaagacgattgttcctgttatcgtatgtggatcactgtatatctgcaaagagctattgcgcttacacaactgtcacttgccagtatag

SEQ ID NO: 3040 - DNA, 1293 bp, Saccharomyces cerevisiae
atggcagagaaaatcttggaaaataaagaccctaaactagaagcgatgacagtggaccatgaagtttcagcgccgaagccaatccccgtggatgaacctacgctgactagagtcgccagaccgttaagacatgtaagacatattcccgttaagtcattagtttttcattctaaacacggtcccattactttttcatatgagaacaaaattaagttgcccataagtaaaaacaaactggtagttcaagtgaactatgtaggtttgaaccctgttgatatgaagattaggaatggttacaccaagcctatttatggtgaagccggcattggaagagaatacagcggagtgataacacatgtcggtgataatttgacaaatagatggaacgtgggtgacgatgtgtacggcatttactatcatcccaagttagccattggcgccctgcaaagttcgttgctcattgatccgcgtgtcgatcctattttaatgcgacccaaaaatactctatcaccagaaaaggcagcaggctccttattctgtttaggaacagcacttaatctgttagctcaactaaaggagaaggatcaattgaatacagaatctaatgttttaataaacggtggtacaagctctgtagggatgtttgctatccagttattgaagcgttactataaagtttctaaaaagctagtagtggtaacgtcaggtaatggtgcagcagtcctgtcagaacatttcccggatttgaaagatgaaatcattttcataaattatctgtcatgtaggggaaaatctagtaaaccactcagacgtatgttggataccggtaaagttgtagattatgatgattttaatactctcaaagaaaccgaagattatactcagggtaaatttaatgtcgtgttggacttcatcggtggttatgatatcttgagtcactcgagttctttaattcacgctaaaggtgcttatattacaacagttggtgattatgttggaaattataagaaagacgtctttgattcttgggataaccctagcgccaatgcaagaaaaatgtttggatcaatgttatggtcatacgattattctcatttttactttgaccccaatatcaagattatccccaagaagaatgattggatacatgaatgcggcaagctgctaaatgagggagtcgtagattgcgttgttgataaggtttattcctggaaaaatttcaaggaagcattttcctatatggctacacaacgtgctcaaggtaagcttataatgaaagttgaaggtttttga

SEQ ID NO: 3041 - DNA, 1293 bp, Saccharomyces cerevisiae
atgggaatacctggcttactgcctcaattaaagagaattcaaaaacaggtgtccctgaaaaaatacatgtatcaaacattagccattgatggttatgcgtggctacacagggcttcttgtgcgtgtgcttttgaacttgtgatgaataagccaacaaacaaatacttgcaatttttcattaaaaggctgcaactcctaaaacgccttaagatcaagccatatatagtttttgatggtgattccctttttgtgaaaaatcatacagaaactagaagaagaaagaaaaggttagaaaacgaaatgattgcaaagaaattgtggtcagccggcaacagatataatgcaatggaatattttcaaaaaagtgttgacatcacaccagaaatggcgaaatgtattattgattattgcaaactacattcaattccctacattgttgcaccatttgaagcagatccgcaaatggtttacttggaaaaaatgggccttatacagggtatcatatcagaagattctgatttgttggtctttggttgtaaaacactcataacaaagttaaatgatcagggaaaagctttagaaatctcaaaagacgatttttcagctttacctgaaaatttccctctaggagaattaagtgaacaacaatttcgtaatctagtttgtttagcagggtgtgattacactagcggaatttggaaagtgggtgtagtcactgctatgaagattgtgaaacggtattctgaaatgaaagacatccttatacaaatagaacggacagaaaaactttgtttcagtaaggcgttcaagcagcaggttgagttcgccaattatgcgtttcaataccaaagagtgttttgtcctctatcaaatcagattacaactttaaataatattcctaaagcagtcacaaattcccacgctgaaattattaaaattatgaaatgtattggttccgttgttgaaaggggatcaggggtacgaaaagatgtcattaatactaaaaatattgatcacaaagttcatgaaatgatagcaaaaggggagttgcaccctgtagatatggcttctaaacttattaatagagaaagaaaattaaaagcaagaaagctgtttaaagtaggtctacttgggggtgaatccaactcattcaataagaaagtggagcaaccgctagtggatacgcaggacgtgttatcggagagggagaattctcttgataacaaaaacgcatcctctatttatatgacctcaccagcagcgatctcaggcaccgtaccatcaattttctaa

SEQ ID NO: 3042 - DNA, 1293 bp, Saccharomyces cerevisiae
atgggtttatttgataaagtgaagcaatttgctaacagcaataataacaacaatgattctggcaataacaatcaaggcgattatgttaccaaagctgagaatatgatcggcgaagatagagtcaatcaattcaaaagcaaaatcggagaggacagatttgataagatggagtccaaggttcgtcaacaattttctaatacctctataaatgacaacgactccaacaacaacgactcatatggttctaataacaacgattcatatggttctaacaacaatgattcatatggctctaacaacaatgattcatatggctccaacaacaatgattcatatggctctaacaacgatgattcctacggttcttccaacaagaagaagagctcttatggttctaacaatgacgattcgtacggctccagcaacaacaatgactcttacggttccaacaacaatgactcttacggttccaacaacaatgactcttacggttccaacaatgacgactcttacggttcgtcaaacaagaataagagctcttacggttccaacaatgacgattcttatggctctaacaatgatgattcatatggttcttccaacaagaagaagagttcttatggttccagcaacaacgattcgtatggttctaacaacgatgattcatatggttctaacaacaatgattcatatggctctaacaacgatgattcctacggttcttccaacaagaagaagagctcttatggttctaacaatgacgattcgtacggctccagcaacaacaatgactcttacggttccaacaatgacgactcttacggttcgtcaaacaagaataagagctcttacggttcttctagcaacgatgattcttacggatcttccaataacgacgactcttacggttcttccaacaagaagaagagttcttatggttccaacaatgacgattcttatggctctaacaatgatgattcatatggttcttccaacaagaagaagagttcttatggttccagcaacaacgattcgtatggttctaacaacgatgattcctacggttcttctaacaaaaagaagagttcttatggttccaacaacgatgattcatacggctccagcaacaacaatgactcttacggttccaacaatgacgactcttacggttcctctaatagaaacaagaactcctatgggtcttccaactacggttcatccaacaatgatgactcttatggttcatctaatagaggcggtcgtaatcaatacggtggtgacgacgattactaa

SEQ ID NO: 3043 - DNA, 1293 bp, Saccharomyces cerevisiae
atggtagatagtaatgatgatcaaccggaacgccatgcattacttcataatgacatccaaacatcaaataacagtaggccatcactggtccaaaaaaagtacttacctaccccacaagatacaagaaagtctagagcatcgtatacaggaagtgccatgatcaacccgacaagtaaacaaagtcgtacaggatcgggcgctcaaagaacatcacgcacagcacagaaactaaaacttttgccagaagaaccattccaaagagatagcgaaagacttactgatttaaagaatcaggaagtatattctcaggtaaacaggataaaagataagcctgctagaagggatgctgaaaagttgggaaaagctcacagacatttactccccaggtcaactgcatattgtactgctagcagttacaatatgaaagagctggtaaggtggttaaaggactgtcgaaagctacatcatactcatcctaaattgtttgatgaatgcttgtacactcccttcatttacaacgattggaggggcgacaaaagatttgaggatgaagatgtgattaggttggatgatgagggcggtgaaattattgttagtgacaagcacccagatctgtttatctttgaatatggtgttgtcgttatgtgggggtttactgaaagagaagaaaaagctttcttaaacgatatagaaaagttcgaaaaagaaaaattggcggaagaagatattcaagttgaagagttcaattattatgtcacaaaaagttatcaaccaagaatatataacgattttattaccttgagagatggttcaaattacatggtaaaactctctatctctcatgcaattgctcaaagcgtaaaaatttcacttttcgaagagcttgtggataatactattgaagatactcaggatataccacaagaaattgcatacagcggtaaagtttctatgagcaaagaagatataatgaaaagtataggggagctattcattttgaggataaatatcaatctacatggatcagttttagactctccagaaattatgtggtcagaaccacagttagaacccatataccaagcaacaagaggttacttagagatcaatcagcgcgtttcacttttaaatcaaagactcgaggtcatttcagatcttcttcaaatgttgaaggaacagctgggccattctcatgaagaatatcttgaatttattgtcatattactagttggtgtggaagtcctaatatcggtgatcaatatagtggttgacatgctggctagtcaacattga

SEQ ID NO: 3044 - DNA, 1293 bp, Saccharomyces cerevisiae
atgtcagctttcggtaacccattcacgtcgggtgctaagcctaatctttctaatacaagtggtatcaaccctttcacaaataatgctgctagtaccaataacatgggaggaagtgcatttggaagacctagttttggaacagcaaacacaatgacaggaggaaccaccacttcagcatttggaatgccccagtttggtaccaatacaggcaatactggcaatacgtcaattagcgcttttgggaacaccagtaatgcggctaaaccgtcagcatttggagcaccagcatttggttctagcgcccccatcaatgttaatccgccttctactacgtcagcatttggagcaccgtcatttggatcaacaggttttggtgctatggcggcgacaagtaatccttttggtaaaagtcctggctcaatgggctctgcatttggtcaaccagcttttggagcgaacaaaactgctatcccttctagttcggttagtaatagtaataactccgcatttggtgctgcgtcaaacacgcccttgaccacaacttctccttttggttcactgcaacaaaacgcatcacaaaatgcatcatctacatcgtcagcgtttggcaaaccgactttcggcgcagctactaatacccagtcgccatttggtactattcaaaatacaagtacaagcagtgggacaggagtatccccatttggcacatttggaactaatagtaataacaaatcaccttttagtaatctacagagcggagcaggcgctggttcttcgccgtttggtactacaacctccaaagctaacaacaacaataacgtgggcagtagcgcattcggaacgacgaataatcaatctccttttagcggaggttctgggggcacctttggttctgcttctaacctcaataaaaataccaatggcaactttcaatcttcttttggtaataaagggttttcattcggaattacaccacaaaacgatgccaacaaagtctcgcaatcgaacccttcatttgggcaaacaatgccaaacacagatccgaacataagtttgaagagcaatggtaacgcaacctcttttggatttggacaacaacagatgaatgctactaatgtcaacgctaatacggccaccggaaaaattagatttgttcaagggttatcttctgaaaaggacggtattctagaattggccgatctcgcagaggaaacactgaaaatattcagagcaaacaagtttgaactaggccttgtccctgatatacctccaccacctgcattggttgcatag

SEQ ID NO: 3045 - DNA, 1293 bp, Saccharomyces cerevisiae
atgttgcacatgaattcgttgtggggttgttttcttttcgttttactagccgtgacaggtgctgtgcagggtctccaagaggattacagtgaatacgctgtttacaggtttacttcagacaactattctaccctggtaagagatgtgatcgcaccgctgacagatgattatgatgtatggacgagaagcaataatttcattgatattaagttgcctaaagaaataggtgagcagataaatgatgggcaggtgatcatagataacatgaatgaattgatacaaaatacattgcctacaagtcagatgatggcacgtgagcaggctgtttttgaaaatgattacgatttcttctttaacgaatacagggacctggatactatttatatgtggttggatcttctagaaagaagctttcccagtttggttgcagtggaacacttgggcaggacatttgaaggcagagagctaaaagctctgcatatatccggaaacaagccagaatcaaacccggaaaagaagactattgttatcacaggtggtatacatgccagagagtggatcagtgtcagtaccgtctgttgggcactttatcagttgttaaatcgatatggttcgtctaagaaggaaaccaaatacctggacgatttggactttttagtcatacctgtgttcaatccagacggatacgcatatacgtggtcgcatgacagactatggcgtaagaatcgtcaaaggactcatgttcctcaatgtcttggtatcgacattgatcattcctttggtttccagtgggaaaaggcacacacccacgcttgcagcgaagagtatagtggggaaacgcccttcgaagcttgggaagcatctgcttggtacaagtatattaatgaaaccaagggcgattacaaaatttatggctacattgacatgcattcgtattcacaggagattttatatccctacgcatactcgtgtgatgccttgcccagagacttagaaaatttgttggagttatcatatggcttatccaaggccatccgttcaaaatcaggtagaaactacgacgtaatctccgcatgtaaggaccgtggttccgacatattccccggcctcggtgcaggttctgcgttggacttcatgtaccaccacagagcacattgggcattccagttgaaattacgggatacagggaaccatggatttttattgcctccagaaaacatcaagccagttggaaaggaaacttatgctgctttaaagtacttttgtgacttcctactagacccagagatataa

SEQ ID NO: 3046 - DNA, 1296 bp, Saccharomyces cerevisiae
atgaccccacctcatttttttttatctctcataaaaaaaagatgcatatgctggatatgtttggaagaatccacatatgactctacatggctacagcacacgtgcggttgcaacttacaaattcataaacgctgctatataagatggctctatcaaatgcatgttgaactttttcttccgaacacagtggacctaccaaaggatgctgatttacctataatcacctgtttaaaatgtctcgttgatgggcaccatgattttatgacgactttctctcttacagaaatatgggaaactcgtcccatttgggggcaaaaatcagtaccgtttcaaaatgactacgtgttcaatctaatgtctctttataccaaacgggataatcatccaccttatgtgttagtgaaatttggcgaatgtcctcaatgcaagaaaacaaatttcataaaaagacctacagtaaccatccagtcttctgtactatccctgttttatcagtggcaaaaaattacacgatacgtgataccattagggataactagtttatttcttttaaaccctgaaaagacaagttttgacattggattatggcaactacgctgccttttccctgagaatgttctacgaaatatgttaaacatcagcactacaaaggcattggacgtatatgcgcaaactgaacgtggcttattaagcattcctttaacctcctcgatcataatatatgggttcatacattatcttagcaacatttctaacgtcagtgctaatgcaatactctttaagtgggtgtatctcagtattgtaaaaactgctggaaacaaatattacaagggtataggtttacctaaaataattttgtattctaacttggctacattttgctataattttacctttaaaagattggttgacttaatttacaggaggctgatcaataaaggaggtaagtatttgtatcacggaaattttgaaaactctagtaatagcgttccagctgaggaattttttatcaggcggaattggtatgctattcttgcagaaaagatactatggccctttgttggtaaatgtacaggaggtcttctattgaatgcttttctatggatacagagaaagtttaaaattgaatggacgccgaattgctccccttcggaatttagaatgattttcaatattataggttgtggtactgctgctataggctggtcaagtctgaagctctatgccagttacaaaagatgtcaggaacttgaaaagatcaatgaatttattgaacaaagttgcaaaggtgagtaa

SEQ ID NO: 3047 - DNA, 1296 bp, Saccharomyces cerevisiae
atgcacagatccacttttatcaggacgtccggcacgagctctaggacactaaccgcaaggtacagatcgcagtacacaggattactcgttgcccgagtattattctccacctctacgacccgtgcgcaaggtggaaaccctcgatcaccactccagattttccgcgatacattcaagaaggaatgggagaagtctcaggaactgcaggagaacataaagacgctgcaagatgcttcgggaaagttaggcgagtctgaggcctacaaaaaggctagggaagcatatttgaaagctcagagaggctccacaattgtgggtaaaactctgaaaaagaccggtgagaccatggaacatatagccactaaggcctgggagtccgaactcggtaagaacacaagaaaggcggctgccgccacggcgaagaagctggatgagagttttgagccagtgagacagacgaagatttacaaggaagtctcagaagtcattgacgatggggagagttcccgatacggtgggtttatcacgaaagagcaaaggagacttaaacgtgagagagacctggcctctgggaaaagacacagggcagtaaagagcaatgaagatgcaggaacagcagtggttgcgacaaatatcgagtctaaagaatcgtttggtaagaaagtggaggatttcaaggagaaaaccgtggttggccgttctatacaatctttaaagaacaaattgtgggatgaaagtgaaaaccccttaattgttgtcatgaggaaaataaccaacaaagtgggcggtttctttgcagaaacagaatcctcccgtgtttacagtcaatttaagctaatggacccaaccttttcgaacgaaagcttcaccagacacttaagagaatacattgttcccgagattctcgaagcgtatgtgaaaggcgatgtcaaagttctcaaaaaatggttcagcgaggcgccattcaatgtttacgccgcccaacagaaaatcttcaaagaacaggatgtttacgccgatggccgtatcctagatatcaggggcgttgaaatagtgagtgcaaagttattggctccccaagacatcccagtcttggtggtcgggtgtagagcacaagaaatcaacctttacaggaaaaagaaaactggcgagattgcggctggtgacgaagctaatatcttgatgagctcttatgccatggttttcaccagagacccagagcaaatcgacgatgacgaaacagaagggtggaagatcttggagtttgtgcgcgggggttctagacaattcacctga

SEQ ID NO: 3048 - DNA, 1296 bp, Saccharomyces cerevisiae
atgcgacagagagtaggaaggtccatagctagggctaaatttataaatactgccttattaggaagaaagagaccagttatggaaagagtcgtcgatatagcgcatgtagattcaagtaaagcaatccaaccattgatgaaggaactagaaaccgacactacagaagcacgatacaaagtactacaaagtgtattagagatatacgatgatgaaaagaatatagaacctgctctcacgaaagagtttcacaaaatgtacttggatgtcgcttttgagatatcgttacctccacaaatgacagcactagatgcttcacaaccgtggatgctatattggattgctaactcattgaaggtaatggacagagactggctttcagatgacaccaaaagaaaaattgtagataagctctttactattagtccttcaggaggaccctttggtggaggtcctggccaattatctcatttggccagcacttatgctgcaattaatgctctctccctttgcgataacatagatggatgctgggacagaattgatcgaaaaggaatttaccaatggctgatatcgttgaaagagcctaatggaggattcaagacctgtttagaagtcggagaagtggatacaagaggtatatactgtgccttgagcatagcaaccttattaaatattcttacagaagagcttacagaaggtgtgttaaactatttgaaaaattgtcaaaattatgaaggtggattcggcagttgtcctcacgtagatgaggcacacggaggctatactttctgtgctacagctagtctagcaattttaaggtccatggaccaaataaatgttgaaaagcttttagaatggtctagtgctcgtcaattgcaagaagaacgaggattttgcggaaggagcaacaaacttgttgacggttgctatagtttttgggttggaggttcggctgccattcttgaagcttttggatatggccaatgcttcaacaaacatgctcttcgggactacatattgtactgttgccaagaaaaagagcaacctggtttgagagataaaccaggggcccactcagacttttaccatacaaattattgcctattaggactggctgttgcggaaagttcatacagttgcactcctaatgattctccacataatattaagtgtactccagaccgcctaattggatcatcgaaacttactgatgtcaaccctgtctatggtttaccaatagaaaatgtaagaaaaattatccactactttaaatccaatttatcttctccaagttaa

SEQ ID NO: 3049 - DNA, 1296 bp, Saccharomyces cerevisiae
atggaacctcaagaagagtttataactaccgaagaagttgagcaggagattgtgcccactgtggaggtcgaacaagacgttcccgttgatattgaaggagagaatgacgacgatgatgaaatgatgaatgatgatgaggaagctttggaggtcgacatgtccaacaactcgcttacctatttcgataagcacacagactccgtgtttgccattggccatcatcctaacctgccgctagtatgtaccggtgggggtgataacttggcacatctttggacatcacattcacagccacccaagtttgctggcactctaaccggttatggcgaatctgtgatttcatgttctttcacttctgaagggggcttcttggtcactgccgatatgtcggggaaggttcttgtacacatgggtcaaaaaggtggcgctcagtggaagttggcatcgcaaatgcaagaagtcgaagagattgtttggctgaaaactcatcccactatagcaaggacgtttgcgtttggtgcaactgatggatctgtttggtgctaccagattaatgagcaggatggttctttggaacagttaatgtctggttttgtacaccagcaagattgctctatgggtgaattcattaacaccgacaagggtgaaaatacgctggaattagtcacttgttctttggatagcactattgtggcatggaattgcttcactggccaacaattatttaagatcacacaggcagaaatcaagggattagaagctccatggatttccctatcattagctccggaaactttgaccaagggtaactcgggtgtcgtggcatgtgggtccaacaatggtcttctggcagtaattaattgtaacaatggcggtgcgattttacatttatctacagtgattgaactaaagccagaacaagacgaattagatgcctccattgaatccatttcttggtcatccaaattctcccttatggccattggccttgtctgcggtgaaatactcttatatgatacaagtgcatggagagtaagacacaagtttgttctcgaagattctgttacaaaacttatgtttgataatgatgacttattcgcatcgtgtatcaatggtaaggtttaccagtttaatgcaagaactggccaagagaagtttgtttgtgtgggccataatatgggggttcttgattttatattactgcatcctgtggcaaataccggcaccgagcagaagagaaaagtaataactgcaggtgatgaaggtgtatctctggtgttcgaggtaccaaactga

SEQ ID NO: 3050 - DNA, 1296 bp, Saccharomyces cerevisiae
atggcagactttaaatctttaggtctttcaaaatggcttacggaatccttaagagctatgaaaattactcagccaaccgctatccaaaaggcttgtattcccaaaatcttagaaggaagagattgtattggtggtgccaagactggttctggtaaaactattgcatttgcagggcctatgctgactaaatggtccgaagatccgtcagggatgtttggagtggtcttgaccccaaccagagagttagccatgcaaattgccgaacaatttactgcacttggtagcagtatgaacattcgcgtgtcagttatagttggtggtgaaagcatcgttcagcaggcattggatttacaaaggaagccgcactttattattgccacgcctggacgtctggcacatcatatcatgagcagcggagatgataccgttggagggctaatgagagctaaatatttagttctagatgaagccgatattttgctaactagcacgtttgccgatcatttagcaacatgtataagtgctctacctcccaaggataagagacaaacacttctattcactgcaactataacggaccaagtaaagtcgttacaaaatgcaccagtgcagaaagggaaacccccattgttcgcttaccaagtagaaagtgtagataatgtggctattccatcgacgttgaaaatagagtatatcttggttccagaacacgtcaaagaagcatatttgtaccaattattaacatgcgaggaatatgagaataaaaccgctataatatttgtaaatagaacaatgaccgcggagatccttagaagaaccctgaagcagttggaagtgagggtagcgtcgttgcactctcaaatgccccaacaggaaagaacaaattccttacatagatttcgagctaacgctgcaagaatcctcatcgctacagatgtagcatccagaggtttggatatcccaactgttgagcttgtagtgaattacgatataccttcagacccagatgtattcatccatagatctggtcgtacggcccgtgctggcagaattggtgacgccatatcattcgttacccagcgagatgtttctaggatacaggccattgaggaccgtatcaacaagaagatgacagagacaaacaaggtacacgataccgctgtaataagaaaagccttgaccaaggtaaccaaggcgaagagggaatcgctgatggcaatgcaaaaggaaaacttcggtgagagaaaaagacagcaaaagaagaagcaaaatgacgggaaaagtttgcgctcttga

SEQ ID NO: 3051 - DNA, 1296 bp, Saccharomyces cerevisiae
atggtagtacaaaatagcccagtttcgtctgttcacacagccaatttctctgaacgggggagcaataccagaacaatgacgtataaaaataagcttactgtttgcttcgatgacatcctaaaagttggagcagaaatgatgatgcaacaacagttaaaaaatgtacaactagattcttatctcgtcaatggtttcagtcaatctcagcaaaaattattgaaagagaaggttaaattatttcatggaattttagatgatttagagacttctctaagccagagttcttcatatttagaaactcttactgcactcggaaaagaaaaggagaaagaaagagaggaagctgaaaaaaagagggctgaacaagaaaatatgaggaaggttagagaacaagaagaattaaaaaagcgacaagaactcgaagaagcctcccaacagcagcaactccagcaaaattcaaaggaaaaaaatggccttggtttgaacttctccacaacagcacctgcgaacacaacggatgccaacggttccaaagagaattatcaagaacttggatctcttcaatcatccagtcaaacacaacttgagaacgcaaatgctgctaataacggtgccgcattttctcccttaaccactactcgaatccaaagccagcaggcccaaccctcggatgtaatgttcaacgatttaaactctatggatatttcgatgttttcaggccttgacagtactggttttgactccacagccttcaatgccacggtggacgaaaccaaaggctttgacgataatgactcaggtaacaactacaatgacataaatatttcttctattgaaaacaacataaataataatatcaatagcaccaagaacggcaaggataacaacaacgaaagcaacaaaaataacaacggcgatgaaaagaataagaacaacaacgaggacaacgagaacaacaacaacagcagtgagaagaacaacaataataataataataacaataacaacaatgacgataacggcaacaacaacaacaacaacagtgggaacgacaataacaataccaccaacaacgacagcaataacaagaacaattctatcactaccggaaatgataatgaaaatatagttaataatgatttaccaacgaccgttgtttccaatcctggagataaccctcctccagccgacaacggtgaagaatacttgacattaaatgatttcaacgaccttaatattgactggtcgaccactggagataatggcgaattagacctcagcggcttcaatatatag

SEQ ID NO: 3052 - DNA, 1296 bp, Saccharomyces cerevisiae
atgtctgatgcggctccttcattgagcaatctattttatgatccaacgtataatcctggtcaaagcaccattaactacacttccatatatgggaatggatctaccatcactttcgatgagttgcaaggtttagttaacagtactgttactcaggccattatgtttggtgtcagatgtggtgcagctgctttgactttgattgtcatgtggatgacatcgagaagcagaaaaacgccgattttcattatcaaccaagtttcattgtttttaatcattttgcattctgcactctattttaaatatttactgtctaattactcttcagtgacttacgctctcaccggatttcctcagttcatcagtagaggtgacgttcatgtttatggtgctacaaatataattcaagtccttcttgtggcttctattgagacttcactggtgtttcagataaaagttattttcacaggcgacaacttcaaaaggataggtttgatgctgacgtcgatatctttcactttagggattgctacagttaccatgtattttgtaagcgctgttaaaggtatgattgtgacttataatgatgttagtgccacccaagataaatacttcaatgcatccacaattttacttgcatcctcaataaactttatgtcatttgtcctggtagttaaattgattttagctattagatcaagaagattccttggtctcaagcagttcgatagtttccatattttactcataatgtcatgtcaatctttgttggttccatcgataatattcatcctcgcatacagtttgaaaccaaaccagggaacagatgtcttgactactgttgcaacattacttgctgtattgtctttaccattatcatcaatgtgggccacggctgctaataatgcatccaaaacaaacacaattacttcagactttacaacatccacagataggttttatccaggcacgctgtctagctttcaaactgatagtatcaacaacgatgctaaaagcagtctcagaagtagattatatgacctatatcctagaaggaaggaaacaacatcggataaacattcggaaagaacttttgtttctgagactgcagatgatatagagaaaaatcagttttatcagttgcccacacctacgagttcaaaaaatactaggataggaccgtttgctgatgcaagttacaaagagggagaagttgaacccgtcgacatgtacactcccgatacggcagctgatgaggaagccagaaagttctggactgaagataataataatttatga

SEQ ID NO: 3053 - DNA, 1299 bp, Saccharomyces cerevisiae
atgacagtgaatgacaaaaaaagattggcaatcataggtggggggccaggagggttggcagctgcaagagttttctcgcaaagtcttccaaattttgaaatagaaatatttgtaaaggattacgatattggcggtgtctggcattatccagaacaaaaaagtgatgggagggtcatgtatgaccatttggaaaccaatatatcaaagaagttaatgcagtttagcggctttcccttcgaggaaaacgtccctttatatccgtctcgaagaaacatttgggaatacttgaaagcctattacaaaacgttcattgccaacaaagatgctatcagcatccatttcagcaccgaagttacctacttaaagaagaagaactctcaatgggagataacatctaaagacgaactaaggactactaaatcggattttgacttcgttattgttgcgtctggtcactacagtgtccctaaactaccaactaatatcgcaggtctcgatctatggttcgacaataagggcgcctttcattctaaggatttcaaaaactgcgagtttgcccgtgaaaaagtcgttattgtggtgggaaacggcagttccggccaagatattgccaaccaactaactaccgttgcaaagaaagtatataatagtataaaagagcctgcgagcaatcaactgaaggccaagttaatcgagactgtccaaacaatagacagtgccgattggaaaaatcgttcagttactttatctgatggaagagtacttcagaatatagactacattattttcgccacaggctattattacagctttccatttatagagccctccgttagactggaagtgctaggtgagggtgttactggcgacaagcactcgtctgtcaatctgcacaatttgtgggagcacatgatctatgtaaaagatcctacgctgtcctttatcttgaccccgcagttggtcatcccgttcccgttgtcggaactacaggcggctattatggtcgaagtattctgtaaaagcttaccgataactacaactttcgactctaatgcctgcggaacgcacaacttcccaaagggaaaggacctggaatactatgcagaactacaggaactactgaatagcattccacgtagggtcggtcatttcgaaccagttgtatgggatgatagactgatcgatctaagaaacagtagttatacagacaaagaagaaagaaatgtgcttctagcggaacacgcacaagccctaaagaaaaaaaaagcaccatacttccttccggcgccacatacttaa

SEQ ID NO: 3054 - DNA, 1299 bp, Saccharomyces cerevisiae
atgagcaacgacgaaactgtagagaaagtcacccaacaagtgtcggaactaaaaagcacagatgttaaagagcaagtagttacaccttgggatgtggaaggtggggttgatgaacaaggtagagcccaaaatattgattacgacaaattgatcaaacaattcggtactaagccggtcaacgaagaaaccctgaagagattcaagcaagtgacgggtcgtgaaccacatcattttttgcgtaagggattgtttttcagtgagcgtgacttcactaaaatattagacctttacgaacaaggcaaaccatttttcctatacactggtagaggtccttcgagcgattctatgcacttgggtcatatgatcccttttgtcttcaccaaatggttacaggaagtgtttgacgtaccattagtcatagagttgacagatgacgaaaaatttttattcaaacacaagttgaccatcaatgacgttaagaattttgcccgtgaaaatgccaaggatatcattgctgttggctttgatccaaagaacacctttatcttttctgatttgcaatacatgggtggtgcattttacgaaactgtagtaagagtttccagacaaattacaggatccactgcaaaggctgttttcgggtttaatgactccgactgtattggtaagttccattttgcctccattcaaattgctaccgcattcccaagctcatttcctaatgtgttaggcttgcctgataagacaccatgtttgattccatgtgcaattgaccaagatccatatttcagagtttgtagggatgtcgcggataaattgaagtactccaaacctgctttgcttcattccagattctttccagctttgcaaggttccacgaccaaaatgtcagcctctgatgataccactgccattttcatgaccgatacaccaaagcaaattcaaaagaaaattaacaagtacgcattcagcggtggtcaagtgtccgccgacctacatagagaattaggtggtaatcccgatgtcgatgttgcataccaatacttgtcatttttcaaggatgacgatgttttcttgaaggaatgctatgacaaatataagtccggtgaattactatcaggtgaaatgaagaaactgtgtatcgagactctgcaagaattcgttaaggcgttccaggaacgcagagctcaggtggacgaagagaccttggacaaattcatggtcccacataagttggtttggggcgaaaaggaaagacttgtcgcacctaagccaaaaactaagcaagaaaagaagtaa

SEQ ID NO: 3055 - DNA, 1299 bp, Saccharomyces cerevisiae
atgagctctactttctttacatgcaactgttgtgttattcagttcaagactagtgatttgcaaagatatcacatgaagaccgaatggcacaggtacaacttaaagagaagaattgccaacctgccgccaattggtgcggaacagtttgctgagaaattgcaaatttcagaaaaggaacaagctgaaaatcaggttgatgagtttggtttccctgttctaaagcctgttatgaaccaaagtaacgctttgcctcagaaacagaagaaaccgatcaagtcaaagagaggaagaaaagttggtacgaacttattgaagaggaaagacagggatattgctaaagaaaaacagaatagatcggtgtccccttctggatcaatatcttcacaattatctaatttgacagtaggaacagaaaacacgaatacagattatggtgaagatactgtctctgaatacggtttcactagtgactctaattatgagtatgctactagtgatgaggaactagatatagcggataagccaagtgataaagaaaatgaaaagattaccatcacggaatgtatatattgcgggaaagacaataaagaagtggaaagaaatgtcaaacatatgtttagcgagcatggtcttttcatacctgaaaggtcatatttgattgatctaaacggtttactagagtttttaataaaaatgattgttattgatcataactgtctgtgttgtaactttcatggctccggtttggaaagtataagagcgcatatggcttctaagcgtcattgcaggctgccatatgaaacaaaggaggagcgtcagcttttcgccccattttacgattttacttacgatgatcactctattagcaaaaatcttcagaatgacagagcaattacttccaagctttcatctgtctatggggccaaaaatgatgaagaagatggggaggtagatatcacgttggtctcatccgaaaatgacattaatgcaaactataccaccgtatctattgatgaatctggtttagaacttaccttgccaacaggcgctaggctaggtcatcgtgcgggccagaggtactatagacaaaatttaccttcgcagccaaaccctaacgaaagcagaagaacgattacagctgctgatagaaggatggtcagtggtgttaccgagaagcaatataagaagggtatgaagaaaatgcaacaattggagaaaaatgccattaatacgcagatccgtcgcgaaattaaaagggttaactttcaaacacattacagggatgagttgttgcaatag

SEQ ID NO: 3056 - DNA, 1299 bp, Saccharomyces cerevisiae
atggaattctatttgtcatccgattgtgcatcactagcgcggtatgtgagtaaagtagtatatttggaggataatgatattgcccatatctatgatggggagcttcatatccattgttctaaaattggttccgaggacttttcatttagaacagttcaaaaattagaattggagttgtccaaaatcaaaaaaggcccttacgataattttatgcaaaaggaaatatacgagcagtgtgaaacaacaaaaaatgtcatgagaggaagagttgacgcctttacaaacagagtagttttgggaggactagaaaattggttgacagaattgagaagagcaaaacgaataataatgattgcatccaaggcctccttccattcatgcctagctgcccgtcccatctttgaggagttaatggaagttccagtaaacgttgaattggccttggattttgttgaccgcaattgttgcattttcaggaacgatgtttgcatatttgtttctcgaagtggggagacaactgatacaattaatgctttgaactactgtatcaaaaaagaggcagtcacaatcggggtagttaattgcagcggttcctctatctcaagatttacacattgcggtgttcatacaaacacaggccccgagaaaggtattgcaacaaccaagtcttatacttctcaatacatcgctttagtcatgattgccctatggatgtcggaagatttggtgtctaaaatagaaaggaggaaagaaataattcaagccttaactatagtcccaagccaaataaaagaagttttggagcttgaaccattgattattgaattgtgtgacaagaaactaaaacagcatgatacatttttgcttttaggaagaggttaccaatttgcctctgctttggaaggcgcctcgaagatgaaagaaatttcttacgtgcattctgaaagtattcttaccaacgagctaggacacagagtcctagctgtggcatctgataatccgccaattatcgcctttgcgacaaaggatgctttttcgcccaaaatcgcgtcttgcattgaccaaataatagaaaggaagggcaatccgattatcatttgtaacaaggggcataagatatgggagcaagacaaacaaaaaggaaacgttgttacactcgaggtaccccaaaccgtagattgtctccaagggatacttaacgttattcctttacaattaatttcttactggttagcgatcaagaaagacatcggagttgatttgccaagggactcggcgatgtcggccccggatatataa

SEQ ID NO: 3057 - DNA, 1299 bp, Saccharomyces cerevisiae
atggacccacataatccaattggtatgttgttgatatttttagtgtttgtggaggcaattgagctcggtgccccttttggctttgcctcttttgcattttagttcttttacccctatattattaatactaaccatctcgatatagtccttgatcagggtactggtttcgtcaaaattggtcgtgctggcgagaatttcccagattacacgtttccttctattgttggtagacccatcttgagggcggaagaacgtgccagcgttgctacaccattaaaggacattatgattggtgatgaggcaagtgaagttcgctcttatctgcaaatatcttatcctatggaaaacggtattattaagaattggacagatatggaacttctttgggattacgcctttttcgagcaaatgaaactaccatccacctccaacggtaagattttactaacggaacctccaatgaatccgctgaaaaatagggaaaaaatgtgtgaggtaatgttcgaaaaatacgattttggcggagtttatgttgccatccaagctgttctagcattgtacgcacaaggtttgtcttcaggagtcgtcgtcgattccggtgacggtgttactcatatagtcccagtttacgaatctgtcgttttgagccacttaacaagaagattagatgttgcgggtagagacgttactaggcatttgattgatctgctttctcgtcgtggttatgcatttaacagaactgcagatttcgaaactgtgcgtcagataaaggaaaaattatgttatgtttcatatgatttagacctagatacaaaattggctagagaaacaaccgcccttgtggaatcgtatgagttaccagatggcaggacaatcaaagtgggacaagagagatttgaagcaccagaatgtttgttccaacctggtttggttgacgttgaacaacctggcgtgggcgagctgttatttaatactgtgcaatcggctgatgttgatatcagaagttccctgtataaggccattgttctttcaggtggttcaagtatgtacccagggctgccttcgagattagagaaagaattgaaacaattatggtttagtagagttttacacaatgacccttcaagacttgataaattcaaagttagaattgaagatcctccaaggagaaagcatatggttttcattggtggtgccgttttagctagtatcatggctgataaagaccacatgtggttgtctaagcaagaatggcaagaaagcgggccatctgcaatgactaaatttggtccaagatag

SEQ ID NO: 3058 - DNA, 1299 bp, Saccharomyces cerevisiae
atggttgttgatactgagtattacgatttgttaggtgtgtctaccactgcatcttccattgaaataaaaaaggcctatagaaagaaatctattcaagagcatcctgataagaatcccaatgaccccacggctaccgaaaggtttcaagcaatatccgaagcttatcaagttttaggtgacgatgatcttcgcgcaaagtatgataagtatggaagaaaagaagctattcctcagggcggctttgaagatgcagctgaacagttctctgtcatctttggtggagatgcgtttgcctcatatattggcgaactgatgctattaaagaacctacagaaaactgaggagctaaatgctgaagacgaagctgaaaaggagaaggagaatgtggaaacaatggaagaatcacctgcagacggtaagacgaatggcaccactaacgctgttgatgcagcattgggcaatactaacgaaaaagatgacaaaaataaggcgaggacaacttctggtaatttaactgtacacgatggaaacaagaaaaatgagcaggtaggagcagaagctaagaagaagaagacaaaattagagcagtttgaggaagaacaagaggtagaaaagcaaaaaagagtagaccaattaagcaaaacattgattgaaagattatcgatattaacagaaagtgtctatgatgatgcatgtaaagattcctttaaaaaaaagttcgaagaggaagccaatcttttaaagatggaatcatttggtctggacatattacacacaataggcgacgtttactacgaaaaagctgaaatttttcttgcatcccagaacctgttcggaatgggtggtatatttcattctatgaaggctaaagggggagtatttatggatacactaagaactgtttcggcagccatagacgctcagaatactatgaaggagcttgaaaaaatgaaagaagctagcacgaataatgagcctttgtttgacaaagacggaaatgagcaaattaagccaaccactgaggaactggcgcagcaagagcagctattgatgggcaaagtattgtcggctgcttggcatggttctaaatatgaaataacatccactttacgtggcgtttgtaaaaaagtactagaagatgactcggtaagtaagaaaacgcttatcagaagagctgaagcaatgaaactattgggtgaagtctttaagaaaactttcagaaccaaagtcgaacaagaagaggcacagatctttgaagaacttgtagcagaagctacaaaaaagaagagacatacatga

SEQ ID NO: 3059 - DNA, 1299 bp, Saccharomyces cerevisiae
atgtacaagttggacaataacgacattgacgatgaaacgaataactctgtttcactgacgagccttttagaatttctcgacccgatcgcttcaaaagtagtttcaaaatactaccatggttctcatctttcgaaagcagaacagaaattgcgaaattttgagggttttagaagacgtaaaccccatcatgaacatgatagtcatcatccacatcacctgaatagaagtcgctctttcttgcaattagaggacttcaaagtaagagcgttacaaagaattaggaatctggataaacccttggattccatttttttcaaaaacagctcaaggttggagaaagcattttaccctttcacactgtttaatatatttttcatcggatttttgatgggcaggtttccagaatggtttcatgtttactataccatcctgttcttcgttctgatgcccatacgtttttacacatactataaaaccaaaaaccactactttctggctgatttttgttactttgtgaacatgctatgcctattgtttatttggattttcccatattcatacagccttttccagtcatgttttgcattcactttcggaacgttatgctttgccgttattacttggagaaattccttggtaatacattctatagataagactacttcatgcttcattcacataatacctccctgtgtcatgtacgtcatctatcatggattaccactcgaatacaaaatcgaaaggtttccgggagcaattattcaaagtgaattggacatcaaaaaaaatattctttggacatccctttattatttggtttggcaatcattataccattacttcatcacgttgaaaaagtctagcaagatcaagtcaggggaaagaatgacaagttttgaatatttaaccacacaccaatttaaaaacttttgggcagttaaattaaggtcaccttggccgatgataatttacacactttctcaatatttctatcaactattcactatgctattgtgtggcatatggattcgttacaaattagctgcggccctatttttaactatagtatttctatgggcgtctcataatggggctacctactatatcgaccactacgggaagaatttcgaaaaagaagttgatagattacgtcttgaagttgagaatttacaacaaaagttacagcctgattctgatgcagtcatatctgatgcctccgtgaatgataaggattacttgaatgtcaaccgtgacgaagattttgacgactcttcaagtgtatcctcaaagagtgattaa

SEQ ID NO: 3060 - DNA, 1299 bp, Saccharomyces cerevisiae
atgtatccaggtagtggacgttacacctacaacaacgctggtggtaataatggctaccaacggcccatggctcctccacctaaccagcagtatggacagcaatatggtcagcaatatgaacagcagtatggacagcaatatgggcaacaaaatgatcagcaattcagtcagcaatatgctccaccaccaggtcctccccctatggcttataacaggcctgtgtatcccccccctcaattccagcaggaacaggcaaaggcacaattaagcaacggctacaacaatcctaatgtaaacgcatccaatatgtacggtccaccccagaatatgtcattacctccacctcaaacacaaactattcaaggtacagaccaaccttatcagtattctcaatgtactgggcgtagaaaggctttgattatcggtataaactacataggttcaaaaaatcaactgcgtggttgtatcaatgatgctcataacatcttcaactttttgactaatgggtacggttacagttcagatgacattgtcatattaactgatgatcagaacgatttggtcagggttcccactagggctaatatgattagggccatgcaatggttggtcaaggatgcgcaacccaatgattctttgttccttcattattctggacatggtggccaaactgaagatttggatggggacgaagaagatgggatggatgatgttatatatccggtcgatttcgaaactcaagggccaattatcgacgatgaaatgcacgatataatggtgaagcccttacaacaaggtgttagactaacagcattgtttgactcttgtcattcgggtacagtgttggatcttccatatacctattctactaagggtattattaaggagcccaatatttggaaggatgttggccaagatggcctgcaagcagctatttcatatgccacaggaaacagggctgctttgattggttctttaggttctatattcaagaccgttaagggaggtatgggcaataatgtggatagagaacgcgtgagacagatcaaattctcagcagcagatgttgttatgttatcaggttcgaaggataatcaaacttctgcagatgctgtcgaagatgggcaaaatacaggtgcaatgtcccacgccttcatcaaggttatgactttacaaccacagcaatcatatttatctcttttacagaacatgaggaaagaattggctggtaagtattctcaaaaaccacaattatcatcgtcacaccctattgacgtaaatctgcaatttattatgtag

SEQ ID NO: 3061 - DNA, 1302 bp, Saccharomyces cerevisiae
atgaagaaatatctgctgtatatggtacaagttcatttgaactttagaagagcagaactggaatcgttagcagacctatataatctttccatagacttttcgcagtacgatgccaatagccctttctttattgtagagctggaaaatgatcagcaagcaaaggattggattaagaggtctattttaaccagaggtatttatgagtattgggggcagggtacaacgctcgatgagctgcataaagatattcagcgtcagtctaactttgaacaggatctgcaattgaaattcaaacattccacttttaagttcgaattcgaatgctataaaggcaacagtaaagctaagagggtagagcagattgaaactttccgttaccttggctttgaaggaaagattgatatgaaacatcctcaagaggttttcactgttatagaagagtacacaccaatatcggaaaacgttggtggtaagacccccaccaggatttattttggtaggcaggttcagatgagcaataggagtgccatggagaaatatgatttgaagaaaagaccttataaaggtacaactagcttcgaagcagaattatcgttggtcagcgccaatatagctcaagtgaaaccgggaactataatgtacgacccgtttgcaggtacaggatcctttttggtagctggtgggcattttggttctttagtgattggttcggatatagatggcagaatgattcgtggtaagggtgctcaagtgaacatttcggccaacttcaaaaaatatggcgagagttctcaattcctcgacgtgttgaccatggactttacaaataacgcattaagaaacaatcttgtcattgatactattttgtgtgatcctccatatggtatcagagaaagcataaaagtcctaggtgctaaggatccagaaagatttctaggcaaggaagatatggaaattgacggtgaaaaggcatatttgcgtcgcgattatattccaaccaaaaaaccgtatgctctagattcattactggatgatcttttacaatactcttccgaaagattaccgattggcggaagattagccttctggatgcccactgcaaacgacgccaatattgaaactattgtcccaatgcacgaaaatctagagctaaaatacaactgcgttcaagaattcaataaatggtcaaggagactactggtttatattaataggggtagcactttcaatggatcaagtaatcatggcataaaacgttcaaaagataatttcagggagcggtacttcaataattttaactga

SEQ ID NO: 3062 - DNA, 1302 bp, Saccharomyces cerevisiae
atgaatgtaacttctccaaaagatgggaatcacagtttctcgaagaaaaatagatttaatacaaataaaccgcgattccacaaactaaatgagcaggcgcagagtataaatttaccagaagaccgtgattcaattgtttcaagtaatacaacgtcaattatgacagatgatgcatttgattacaatgagggcattgcatcgcgtaccaaaaatattaattctgatagtgatagaagcaatgataccataaaacaaaacaactacaataaaagggagaccggatataaccctttctacaatggatcagggatcaatcagcgatatacacagtttcgaaaaagagagtttgaaccaacacttgcagaaaacaaagccgaagagtacatatcggacgaagataatgtaaaaattgatgaagataatatagagaacgaactccagtttacgccgaaaattaaagaggctagtatactccgatctagtttactaggacaaagaaatgttttaaatactcggaatccaaaatcaaaagaatcacacattaaagtaaaacccatcatcaataacaagagctcctcacaaagaaaatctagtgcagcacttcggaaacaattaggaaaacccctaccgctgccgtatttgaatagccctaatagtgatagtacacccacattacagagaaaagaagaagtattcacagacgaagtgcttcaaaaaaagagagaattgattgagtctaaatggcatagacttctctttcatgacaaaaaaatggtggaaaaaaagctagaaagtttaagagaatacgaaaggaaaagaatgcctccacgaggaactgatgtttctagctctgagcaggacaattctttcaaaatatcgacgccaacaaaatcgtatgtttctttggagcaaaaacccttaccaaatctctctgctatgaataactttaatgatgttaccgacaataaggagaaagaagaaacgaacaacaatatattaaagttccaagcgcaacgagatccattacaaatactacagtctgagatcgaaatgcatactaagaaacttgacacgataatagagttactaaaagacgataccgattcaaaggaaaaaaggaaagtagtgactaatgacaacgcagcgcctgaacaaatggtcaacaaaggatggcggaaaaacgtgatgatgatctacaaaaaatcaggaaatattatgaaaaagtatagggaatatttcttatggacaatttgtattttaatattgttatattgcaatatatatgtgtattataggttttaa

SEQ ID NO: 3063 - DNA, 1302 bp, Saccharomyces cerevisiae
atgacaattgaaagcactctagctcgggaattagaaagcttgattttacccgctgattccatagtgaatgtagttgaccaattccaagaggagttgttatcacggcttcagacaaatacgatttctatgctcccgcagtgtttagtcccagataaacgatcgcgatggaaccctgaagacaaaattctgaccattgatttcggcgggacaagactgaaatttgcaattatctctctgccccaaatcgttatcgaatacaatgatgccttcgaacttacctacaacatcgttgattcgaatttctttaatcaaatcatctatacaatatgtaccaggctggctgcaaatggttatataaaaaaaaagaacgagtcatctgaggcgtctaaattttttgtttccgtgacattcagttttcctctaaatccagaaggggaggtagttgcaatgggaaaaggatttgtgatgactgacacccttcaaggatccacggtgaaacagctcatccaatcttcctttcaccggattatatcagaaaatatcgaagaatttttctgtaccatgaacgtgtgtcatgtaataaacgatgcaattgcagtttcactaacaagcaaatttatatgcgaaaacgattccatctcattaataataggaactggtacaaatgcatgttttgaggttccatacggatatttaccacctttcaagagagatgccctgagagaaacattaccgtcaagctataataaggagacattaaatttcaaacatgttctcattaattctgaaattggctttattggtaaaaatgtcattgcattgcaaccgtttgacattcatggagcaatctcatacgaaatgccactagagtgcgttacttctggtaaatggcttcccctatcattaaaaaatattctattgcaatataacataatccccaaaaacttcccagtagagttcaatggggaactggtatgccagctggcagaagactgtactaatgcttggttcgaaaacgaacattatgcactaatttgtcagatcgcacgactattaatcaagagagccgcattttatgttgctgcaattgtacaagctattgatatcatcacaggctgcaaaaactataactttattcatattggctacgttggatcctttctccacaattcaaatttttatcgagagcagataaaatattactccagcatacatattaagttgcaattcttaaatcacagtaatcttctaggcgctgcaatagccacctacttgaacaaatcagacaaccaagttcaataa

SEQ ID NO: 3064 - DNA, 1302 bp, Saccharomyces cerevisiae
atgattgtggggttgacactttattttgtattattccgttcaatacagtatttactggtttttttgactccaattaggcagtttgatacatcaacatcacttttattaaacgaattatgttcttctccctctgaaatcaacagttattggaacaagtatttttggaataagctactatcatgggacagtgttttttttatcaagaacataacttccaaaaacggaaaacctcaatttgagcatgaatacgcgttttctcagttgtggacttttttcgttaggctgtttattaaaagtaataacgatagcatctaccatgccttaagggttggagttgcaatagaaaatgttttattttacttgtcaggtattgttttatattttctaacaaaaaaaattttcagccaaaatataaggcaatcacagtttgctagaactatcgctaaaaaaacatctctgttgtttttcttaacgagtgccgctggatttttaacaagcatatattctgaaccattatcttttttttttgcatttgttggtatttggagtcgtgaatgctccatttccgtgcccgtattgggtcaattcgatatttcgtggagatattggtttccttactcctttatcagcatggcttgctttaccttagcatccttgaatcgttcaaactgtgttttgttagggatttactttatttttgaccttattgaactaacaaagaacaggaagtttgtaaaagcaatatgtttcccactattatcaggatcattaatgttttctgctctactatatcaacaatattacctaccatataagacattttgtcctcaaaggggtgaatggtgtaaatctcaattgttttcaagcatttttatcacgaaaacttctttatattcctacattcagagtcattattggggagttgggttattgaaatactggaccccaaacaacatcccaaactttttgtttgctgtcccaaatattattattttaatctattcctccatatatttcagcaaaatttatccctcctataacttgaaggctctcgtatggatcaccagagcactggtcgtcatagtatgcttttttgcccatgtccaaattctgaatcgtatagcctcctttttacccttgcacctttggtatttggctgatagattggttaaaacttctgatccaaaaaaaatggaaaatccgaaaggtgacgataagatagtcaagttttacatatactggttggcattctggatacctttacagactatcctatttgcagcttttttaccaccagcctga

SEQ ID NO: 3065 - DNA, 1302 bp, Saccharomyces cerevisiae
atgcaatctatgaatgtacaaccgagggtattagctgtaggaggtgagcagtttttctctcagaggcaggcttctgaacaacaccagcagcaaaacatgggacctcaggtgtattcgccaaaggttaatagagcaagaatgtttcctcaagggatgcctgtaaatacaattaatggctctgttaatcaggagatgaacaatgcctatcttttgaagcagaagaacgagccactgttaactcagcaacaacagcaacagcaacaacaacagcagccatttaatataggaacgcctgtttcggtggctagtttgccgcccggactgaacgttctgcagcaacaacaacagcagcaacaacaacagcagcaacagcagcagggagtgggactcaatcgtcccttggcttcccagctacccaagcatttaaccaaccaaagtatgccaccgatctttttaccacccccaaattatcttttcgttcgcgatgtctggaagtccaacctttacagtgaattcgccgttataagacaactggtctcgcagtataatcatgtgtcaatcagtactgagtttgtggggactttggctaggccgatcggcactttcaggtcgaaggtcgattaccactatcagacaatgagggccaacgtagacttcttaaacccaatacaacttggtctttccttgagtgacgccaacggcaataagcctgacaacggtccctcaacgtggcagttcaattttgaatttgacccaaagaaggaaatcatgtccacagaatcgttagaattactcagaaaatcaggtatcaacttcgaaaaacacgaaaatttaggcatcgatgtatttgaattttcgcagcttctaatggactctggtttaatgatggatgattctgttacttggatcacataccatgcggcatatgatctaggtttcctgatcaacattctaatgaatgactccatgcccaacaacaaggaggatttcgagtggtgggtccatcaatacatgcccaatttctacgacttaaacctggtgtataaaataatccaggagttcaagaaccctcaattgcaacaatcttcacaacagcaacagcagcagcaatattcactaaccacacttgccgatgagttagggctaccaagattctctatatttactactacaggcggccagagtctattgatgcttctatccttctgccaattgagcaagctgtctatgcataagttcccaaacggtacggatttcgccaagtaccaaggtgtcatatacggtattgatggggaccaatga

SEQ ID NO: 3066 - DNA, 1302 bp, Saccharomyces cerevisiae
atggacatgactaaaaaccacaccactgacacagaggagtttgatgatggtgatatacgtccagtcagtttgggaattgtggacgattataacgcttcgttcgaattacctttgaaaccaaagtttttacagagtgagaatttctcagatttaacaagtgaatgggaccagtctagatcaaatacgcctggtcttgcagaaggcaagactgagaaagcacagccatgcggtacaacagatagttcaaaaaatagaatacatgtagagcaactgttggaatccgctaatgaaatgaataattatttggcgcagaatatagagaacataaacaattttcaggtggggctattgaatggagggaaaggattatatagttccatgggtgatgattcgagcgcgtgtattaatggcactaattttagctcaacgtccaattttgaactaagtgatgatgagctagaggataccacgggttgcacaagttctatttttgataaagatcttttccatcaacaaaacgggctaagcatacctcgccgtagatcaccactcttcaaatctccaactgccagtttcgaaattggcgatgctacggatgtggaggagcaagatattgatgactccattttttctgaatgtagcagcattacaagctttgatatgggagggttgcatatcagtctaccacacgatgaagaagaagatcaagaaaaaactaagtccgaaagtgaaaacccgttgctacatggcataccggttgatgtagaagtgccccacatatcggttgatgaagctctggcgaatttcaaggaaaccatagaactactactaaaacttagtggcaatagaaagtgtaccggtttcaatactagagtggagaaaaaagaatactcgaatttctacatgaaaagtaaacccaccttatcatcagcagattttctcaagagaatccaagacaaatgtgagtaccagccaactgtttaccttgtggcaacatttttaattgacacgttgtttttaacaagggatggcaataacattttgcagttgaagttaaacttacaggaaaaggaggtccatcgaatgataatagcagcggttagattgagcacgaaattattggaagatttcgttcactcacatgaatattttagtaaagtatgcggtatttcgaaacggcttttgactaaattagaagtcagtctattgatctgtgtgtgcaatactaaattaatggtcagtaacaggaaattagccgcctccaaattacttttgaatgaactacggtccttctgtgtatag

SEQ ID NO: 3067 - DNA, 1302 bp, Saccharomyces cerevisiae
atggcgactgacaccgagaggtgtattttccgtgcattcggccaagattttatcctaaataaacattttcatttgacaggtaagattggtcggggctcacacagccttatttgttcttcaacttacacagaatcgaacgaggaaactcacgtggctatcagaaaaataccaaacgcgtttggcaataaactatcttgcaagagaactcttcgtgaattgaaactactaagacatttaagagggcacccaaatatagtgtggctcttcgatactgatatagtattttacccaaatggggcactaaatggcgtttatttatatgaagaactaatggaatgtgacctttctcaaattataaggtccgaacaacgcctggaagacgcacactttcaaagcttcatatatcagatactgtgtgctctgaaatacatacattctgctaatgttttacattgtgacctgaaaccaaaaaacttacttgttaatagtgattgccaactaaaaatttgtaattttgggctatcgtgtagttattcagaaaaccacaaggttaacgacggcttcattaagggttatataacctcgatatggtataaagcaccagaaattttgctgaattatcaagaatgcacaaaagctgtcgatatttggtcaacaggctgtatcttggccgaactacttggtaggaaaccaatgtttgaagggaaggattatgtagatcatttgaatcatattctacaaatacttggaacaccacctgaggaaacattgcaggaaattgcctctcaaaaggtgtataattatatctttcagttcggtaatatcccgggaagatcgtttgaaagcatactacctggtgctaatccagaagcgcttgaattgctaaagaaaatgctagaatttgatcctaaaaaaaggattactgtagaggatgcactagagcatccatatttgtcaatgtggcatgatatagatgaggaattctcatgtcaaaagacctttagattcgaattcgagcatatcgaaagtatggcggaattaggaaacgaagttataaaggaagtatttgatttcaggaaagttgttagaaaacatcctattagcggtgattccccatcatcatcactatctttagaggatgccattcctcaagaagttgtacaggtccatccttctaggaaagttttacccagttatagtcctgaattttcctatgtaagccaacttccatcactaactacaacccagccatatcaaaaccttatgggaataagctctaattcatttcagggtgttaactaa

SEQ ID NO: 3068 - DNA, 1302 bp, Saccharomyces cerevisiae
atggtatatgaagcaacaccttttgatccgatcacggtcaagccaagcgataaaagacgcgttgcatatttttacgatgcagacgttgggaactatgcatatggagcaggtcacccgatgaagccgcatagaataagaatggcacattcccttattatgaattatggcttgtacaagaagatggaaatttacagagctaagccggcaacgaaacaagaaatgtgtcagttccatactgatgaatacattgattttttatcgagggttactccagataatttagaaatgtttaaaagagaaagtgtcaagtttaatgtcggagatgattgtcctgtctttgatgggctctatgagtactgtagcatatctggtggtggctctatggaaggagctgctcgtctgaatagaggcaaatgtgatgttgctgtcaactatgcgggtggtttgcatcatgcaaaaaaatcggaagcttctgggttttgttatttaaatgacatagtactgggcattattgagctactacgataccaccccagagttctgtatattgatattgatgtgcaccatggtgatggtgtagaggaagcgttttatacaacggatcgtgtcatgacatgttctttccacaaatatggtgagtttttccctggcacaggtgaactgagagatataggggtgggtgcaggaaaaaactacgcggtcaatgtgccattaagagacggtattgacgatgctacgtatagatctgtgtttgaacctgtgataaaaaaaattatggaatggtatcaaccttctgctgtcgtgttacagtgtggtggggactccttgtccggcgatcgtcttggttgctttaatctttccatggaaggccatgctaattgtgtaaactatgtgaaatcctttgggatcccaatgatggttgttggtggaggaggctatactatgagaaatgttgcaaggacatggtgctttgaaacaggtctactaaataacgttgtcttggataaagatttaccgtacaatgaatattacgaatattacggtccagattataagttaagtgttagaccttcgaatatgttcaatgtaaatactcccgaatatcttgacaaggtaatgaccaatatatttgctaatttggaaaacacaaagtatgcccctagtgttcagttgaatcacacacctagggatgccgaagatttgggtgatgttgaagaagattctgccgaggctaaagatacgaagggtggttcgcaatatgcgagggacctacatgttgagcatgacaatgaattctattga

SEQ ID NO: 3069 - DNA, 1302 bp, Saccharomyces cerevisiae
atggttaacgttgtattgggctcccaatggggtgatgagggtaaaggtaaactagttgatttactggttggtaaatatgatattgtagcccgttgcgccggtggtaacaatgccgggcataccattgttgtagacggtgttaagtatgatttccatatgttaccatctggtttagtcaacccaaactgccaaaaccttttgggtaatggtgttgttattcatgttccatcttttttcaaagagttggaaaccttggaagctaaaggtttgaagaacgcaaggagtagattatttgtttcttccagagcacatttagtctttgactttcatcaggtgactgacaagctaagagaattggagttatcaggtcgttctaaagatggtaaaaatatcggtactaccggtaaaggtattggtccaacttattccacaaaggcttctagatctggtttgagagttcatcatttggtgaatgatcaacccggtgcctgggaggaatttgttgctagatataagagattattggaaacgagaagacaaagatacggtgatttcgaatacgactttgaagccaagcttgctgaatacaagaagttaagagagcaactaaagccattcgtcgtcgattctgtcgttttcatgcacaatgctattgaagcaaagaaaaagatattggttgagggtgctaatgctttgatgttggatattgattttggtacttatccatatgtgacttcttccaatactggtattggtggtgtcctcaccggtttaggtattcctccacgtactattgatgaaatttatggtgttgttaaagcctacacaactagagttggtgaaggtcctttcccaacggaacaattgaacgaaaatggagaaaaactgcagaccattggtgctgaatttggtgtcactactggtcgtaagcgtcgttgcggttggttagacttggtagtcttgaaatactcaactttgatcaatggatacacgagtttgaacattaccaagttagacgtcctcgatactttcaaagaaatcccagtgggtatttcatattctattcaaggtaagaagctagatttgttccctgaagacttgaatattcttggtaaagttgaagttgaatacaaagttttgccaggttgggatcaagatattaccaaaattacaaagtatgaagatttgccggaaaacgcaaagaagtacttaaaatatattgaagattttgttggcgttcctgttgaatgggttggtaccggccccgcaagagaaagcatgttgcataaagaaattaaatag

SEQ ID NO: 3070 - DNA, 1302 bp, Saccharomyces cerevisiae
atgtttgtttcaccaccaccagcaacttcgaaaaaccaagttttacaacgacgtccattagaatcgactaacagtaatcatgggtttgcaagctccctacaggccattccggaaaacacgatgagtggcagtgataatgcttcttttcaaagtttgccactatcaatgagtagctctcaatccacgacttcttcgagaagagagaactttgtgaatgctcctccggagtacactgatagagctagagatgagattaaaaaaagattattggcctcctcacctagcagaaggtcacatcattcaagcagtatgcattcagcgagcaggagatcaagcgtggctgaaagtgggagtttactttcggataatgcctcgtcttatcaatcaagtatattttctgccccctctactgtgcacacgcaactaactaatgactcttcgttctccgaatttcctaaccacaagttaatcacgagagtgagcctggatgaagcattacccaaaacgttttatgacatgtattcgccagatattctattagcagacccatccaacattctctgtaacgggcgtcccaagtttaccaagagagagttattggattgggatttaaacgatataagatcgttattgatagtcgagaagttaaggcccgaatggggtaatcaactaccggaagtaataacggtgggtgataatatgccccagtttaggttacaattattaccactatattctagcgatgagaccataatcgcaacgttagtccattcggatctgtacatggaggctaacttagattatgaattcaaactaaccagcgccaaatatacagtagcgaccgctagaaaaagacatgagcatataactggtagaaatgaagccgtcatgaatttgtcgaaaccggaatggagaaatatcatcgaaaattacctcttaaatatagcagtagaggcacaatgcaggtttgatttcaaacaaagatgctccgaatataagaaatggaagttacaacagtccaacttaaaaagaccggacatgcccccaccaagcataataccgcggaaaaacagcacagaaacaaaatcgcttctgaaaaaggctttattgaagaacattcagttgaaaaaccccaataataaccttgatgaattgatgatgagatcaagcgccgcaacaaatcaacagggaaaaaacaaagtcagcttatctaaagaagaaaaggctacgatatggtcgcaatgtcaggcacaagtttaccaaagattaggattggattggcagccggattcagtatcctga

SEQ ID NO: 3071 - DNA, 1302 bp, Saccharomyces cerevisiae
atgttttctttacctaccctaacctcagacatcactgttgaagtcaacagttccgctaccaaaaccccattcgtccgtcgtccggtcgaaccggttggtaagttctttttgcaacatgctcaaagaactttgagaaaccacacctggtctgaatttgaaagaattgaagctgaaaagaacgtcaaaaccgttgatgaatccaatgtcgacccagatgagttgttattcgacactgaattggccgatgaagatttactgactcatgatgctagagactggaaaactgccgatttgtatgctgctatgggtttgtctaagttgcgtttcagagctactgaaagtcaaatcatcaaggctcacagaaaacaagttgtcaagtaccatccagacaagcaatctgctgctggtggtagtttggaccaagatggctttttcaagattattcaaaaggcctttgaaactttgactgattccaacaagagagctcagtacgactcatgtgattttgttgccgatgttcctcctccaaagaagggtaccgattatgacttttatgaagcttggggccccgttttcgaagctgaagctcgtttttctaagaagactcctattccttctctaggtaacaaagattcttccaagaaggaagttgaacaattctatgctttctggcacagatttgactcctggagaacctttgagttcttggacgaagatgtcccagatgactcttctaacagagaccacaagcgttacattgaaagaaagaacaaggccgcaagagacaagaagaagactgctgataacgctagattggtcaaacttgttgaaagagctgtcagtgaagatccccgtatcaaaatgttcaaagaagaagagaagaaggaaaaggaaagaagaaaatgggaaagagaagccggtgccagagctgaagctgaagctaaggccaaggccgaagctgaagcgaaggctaaagctgaatctgaagccaaggctaacgcctccgcaaaagctgacaaaaagaaggctaaggaagctgctaaggccgccaagaaaaagaacaagagagccatccgtaactctgctaaggaagctgactactttggtgatgctgacaaggccaccacgattgacgaacaagttggtttgatcgttgacagtttgaatgacgaagagttagtgtccaccgccgataagatcaaggccaatgctgctggtgccaaggaagttttgaaggaatctgcaaagactattgtcgattctggcaaactaccatccagcttgttgtcctacttcgtgtga

SEQ ID NO: 3072 - DNA, 1305 bp, Saccharomyces cerevisiae
atgaagactcagtactctctaatacgaaaaatttgggcacattcagtaacagaatttctgaaatcccagtggtttttcatctgtttggctattttaatcgttattgcaagatttgctccgaattttgcaagagacggagggttaattaaaggccaatatagtattgggtacggctgcgtcgcctggatttttctccaaagtggcctgggaatgaaatcaaggtcactaatggcaaatatgttaaattggagagctcatgccactattctggttctgagtttccttattacctcgtccatagtatatggattttgttgcgcggtaaaggctgctaatgatccgaaaatagatgactgggtacttatcggtctaattttgactgccacttgtccaacaaccgtggcttcaaacgttatcatgactacgaatgcaggtggaaatagccttttgtgcgtttgtgaagtattcattggaaatttgttgggtgcgtttattacacctgcattggttcaaatgtttactaaccgcgcaccatttgcatacggcaaccctgccactggaaatggcattggtgcgctttatggccgtgttatgaaacaggttggtctctctgtattcgtacccttgtttgtgggtcaggttattcaaaattgctttccgaagggtactgcttattacctgggctttttgaaaaaataccatattaaaattggatcttacatgcttttattgattatgtttagttcattctcaactgccttttatcaggatgcgtttactagcgtttctcatgtttgcatcatatttctctgcttttttaatttgggaatttatatattcttcacgggtctgtcatacttatgtgcaaggccatggttcatcctcaagcttttccctcatgaaccaatagagggcaaatctacaagattgtaccgctattcgtataatatctttaggcctttttattattcaaaggaagatgcgatttgcattatgttttgtggcccggctaaaactgcagcactgggtgtatcactaattacttcacaatacggcgataaaaaagaacacctgggtaagttgttggttcccttggttttatatcaagttgagcaagtcatgacggcaaatttctttgtaagcttgttcaaaagatggatacaaaaggacgctcaagcagacggaagcgagtcatcttgtgcaaatgagaatgaggaagttgatttggaaaagatcatatcaattggaactggtgaaaatcaatccgttctgtcgaacaacgtcccatatacacaaccaaggtga

SEQ ID NO: 3073 - DNA, 1305 bp, Saccharomyces cerevisiae
atgagagaggaggggagtgaattagaaatggaaaaaggcttccttaaatggaaaccagtcaacttgatgaagaaaatattgtctttaccaatgaaaaaaactaaaaacgatataggtttgagattagatatatcatatattttagttaatctaatagtctgctcatacccggtaaacacgtatccaaaactgctttataggaatagcttggatgacttaatattgtttctaacagtgtaccatggcaagggaaattttagaatttttaattttagaggtgagaaagaagacagcgattataaagataatgatcttattggtatcgctgccaagtttgagagcaaagattttgaaattcaagaattacgttcgacgctgattaatgatggaaagataccaatatcacccattgatctcgaaacaaggaccttggtcgaagaagaaaccaataatgtaatttgtgaaaggatcggttggctagatcattttccaccgccatttgaactgctggaagagattgtagatggtatagaaaattacctgtccgtttcgaagaatagagtggctgttttacattgtcgaatggggaaaggccgatctggtatgataacagtagcatacctcatgaaatacttgcagtgtcctcttggagaagcaagattgatattcatgcaggctagattcaagtatggtatgacgaatggcgtcaccataccctctcaattaagatacttaaggtaccatgagttttttattacccatgaaaaagcagcccaagaaggaatttctaatgaggcggtaaaattcaaatttaaattcaggcttgctaaaatgacgttcctccgcccatcaagcttaatcacttccgagtctgctattgtaactactaagattcaacactacaacgatgatagaaatgccctcctaacccgaaaagtagtatattcagatatcatggcgcatgaatgcggtggtaatatgaccttcatttttggtagggactacttaacactggaaaatgattgtcgtatagaatttaccctggggaccagcaagtccaaagccgccagtagcataatatcttggacttcatgcgccagctgttggctgaatatataccttgagactttgatgcacataattaaagacgattcttcgccagattactttcaagtagagaggttaaagagagacgaaatgcttgggacaaccataagctggcaagagctggacggttttggggagctcagcactcacggcttgaaattatttcaggcactgaaattggaatgggaaattatatag

SEQ ID NO: 3074 - DNA, 1305 bp, Saccharomyces cerevisiae
atgagtaattcacttgaggagcgccttcgtgctaattcaagcgccttcgatggtttattggctttaattcctgcaaaatactattatgatgaaaaaagtcaagagcaatggaaggccaagaagaaaaccaaagaacagagtaaaaatgataaactgaaaaaattagacccggagcaacgtgatgatgaaacatctagtacattagaagtaatgaagaagaaggagaaagacgcaaagccggtggtcctacctggtgaaaaattcaagcacatgaaaatgcaaaagcaaaaggaagcaacatcaaaagtggaaggagactccgacctgaacgtagaagtaaacgatcctatgataatagcaccagacgaagatgaagaagaggaagaggatattaaggtgatctttgatgatgagggaaatgaaataccattagaatctaaaaaagatactacagagcccgatagatctgtcgaaaagaagtctattacagaggaagagaaactacaaagaaagaaaaacttggaagcactacgttccaagttacaagcgaaaatttcagatatgaagagtaaaaggaaagcacccggttctagagaggctattcttgctcaaaggaaacgcaaggaagagttgaaaaaaagaaagcgtctagaaagtgaacaggaacaggatcaggatgaaattgcgtctgattccgatatggaagacatcgatagtgatttagaaaacaattcgaaaaaaagattcaaaaaaggcaagaaggactcagaaattaacgcagatggtgtaatgtttcaaaatatcatattcgatgatggtgcaagggccacttcagatttacaaaggttaagaaaagctggtagaacgaagggtccggctaagaatgatgtaaaatcacacttaaagttattagaagccaagaagaataagatggaggcgaaagacgaactagaacaaatcaagcagaaggaaaaggaaaaatggcaaaaggctatgttacaagcagaaggaattaagattagggatgacgaaaaactacttcgcaaagctataaagagaaaggaagcacaaaagagaaagtctgcgattgaatggagcgaacgtaagagggttgtggaagacacgatatctgaaagacaaaagagaagagaagagaatctgaggattaggaaagacaacaagggtaaaaagagaaataagcaagaaaagatgaaaagaaagtatgtcggtagtgccgtaccaaagaaaagagccggatttgagggtagattaaaaacaggtaaaaagaagggaggacctaaataa

SEQ ID NO: 3075 - DNA, 1305 bp, Saccharomyces cerevisiae
atgccaaattttcaaaaacctttttctggttcttcggatggcaattctgtaatgaacgacctaggtaataaagtcgccatcaaggtttttgattgtagaagtgctcaagatggcagcgaagagcagaatgtaaatgtaaccacgaaccaaatgtatttaatgtttcaaagtaacaattacaacgtgccgccaccaaattacaataccgaggatttgggttctcaaggacctccgacgcatgcttattacgctccatttcagcatcccatccatcttcaacctcccgtgcctcctgtatataagaacaacacatattctgccacagaccagtatagtgactcctcgtttcctaatacttcaggccacactccagtaattgatagtaattactataatgatgctctggcttctatacctacaacaacgacgggtagtactacaatgactacagacaatggcaatactattgacagcgaagaatacattgataacatggaagtctttagtagcgaggaaaatgaaaacattgataatgtaaagcaaaccgatcttaaatctgaaaaggactcgagtcttctttcagcagcttcaatcgtgaaaaaggaacaattgtctggctttgaaaattttttgcctttatcgaagacagagtctcccttagttactgcagacgagattaaatcatctttgaatttggagaatattgacaatgctgacagtatgagcttcaagttaaaaacttcacctatacggaaacattttcatgttaaacccaaaagaataacaagggtgaggacaggaagggtatcacacaatataattgaaaagaaataccgttccaatattaatgataaaattgaacaattaaggagaactgtcccaacgctacgagtagcgtataaaaaatgtaacgatcttcccattacatctagagacctagcagacttagatggcctagagccagcaacaaaattgaataaggcgtccattttaacgaaatctattgaatatatttgtcatttagaaagaaagtgcctacagctaagcttggctaatcaacatttatcaaatgacacacgggattctttcgtccatcttaccgagccatctcaaccgttgagtgacaacagtagtagtgaacaagtacaaaagcaaaccagaagctgccaacgccaacggcagcggcagccacgacaacaacaaccattgcataacattcaatataatattccacatcaaaacggcctcatgagcggcaccaacaattcacatgatatggattttaacaacgcaggagacttttaa

SEQ ID NO: 3076 - DNA, 1305 bp, Saccharomyces cerevisiae
atggccaccttggaagaattggatgctcaaactttaccaggagacgatgaattagatcaagagattttgaatctttcgacgcaggagcttcaaacaagagccaagctcttggacaatgaaattcgtatttttagatctgaattgcaaagactgtcccatgaaaacaacgttatgctcgagaagattaaggacaataaggaaaaaatcaagaataatagacagttaccgtaccttgtggctaacgttgtcgaggtcatggatatgaatgagattgaagacaaagaaaatagtgaatctactacacaaggtggtaatgtcaacttagataacaccgctgttggcaaagctgctgtagtcaagacttcttctagacagactgttttcttgcccatggtcggtttagtagatcctgataaacttaagccaaatgacctggtaggtgtgaataaagactcgtatttgattttggatactttaccctctgaatttgattctcgtgtaaaagctatggaggtagatgaaaaacccacagaaacttactcggacgtgggtgggttggataaacagattgaagagctggtggaggccattgtgttacctatgaaacgtgcagataaattcaaagatatgggaattagagcgcccaagggtgccctaatgtacgggcctccgggtacaggtaaaactttattagctcgtgcttgcgcggctcagacgaatgctacttttttgaagctggcagcacctcaattggtacaaatgtatatcggtgaaggtgctaaactagtccgcgatgcttttgcactggccaaggaaaaggcaccaactattattttcattgacgaattggatgccattggtactaagagatttgattctgaaaaatccggtgatagggaagtgcaaagaaccatgctggaattattgaatcaattggatggctttagctccgatgatcgtgtcaaagtcttggcggctaccaatagagttgatgttttagatcctgctttgttaagatcaggaagattggatagaaaaattgaattcccactcccatccgaagactcgagagctcaaattttacaaattcattcaagaaaaatgaccactgatgatgatattaactggcaagaacttgccaggtctactgatgagtttaatggtgcccagttaaaggcggtaactgtggaggcaggtatgattgccttaaggaatgggcaatcttccgttaaacacgaagatttcgttgagggtataagtgaagttcaagcaagaaaatcgaaatcggtatccttttatgcataa

SEQ ID NO: 3077 - DNA, 1305 bp, Saccharomyces cerevisiae
atgtcaaacaagtttcactgtgacgtttgttcagctgattgcacgaacagagtgagggtttcatgtgctatttgtcccgaatacgacttatgcgtgccctgcttttcacaaggctcgtatacaggaaagcatcgcccttaccatgattataggataatagagaccaattcataccccattctctgtcctgattggggtgccgatgaagaattgcagttgattaaaggcgcacagactttagggctcggtaattggcaggatattgctgaccatataggcagcagaggcaaagaagaagttaaggaacattacctaaaatattatctggaaagcaaatactatccaatacctgatattacccaaaatatacatgtcccacaagatgaatttttggaacagcgaaggcatagaatcgagtccttccgggagaggccgctagagcctccaagaaagcccatggcatcggttcctagctgccatgaagtacaggggtttatgccgggcagattagaatttgaaacagaattcgaaaatgaagctgaaggtcccgtaaaggatatggtttttgaacctgatgaccagcccttagacattgaattgaagtttgccatcttggacatttacaattctagattgacaaccagagcagaaaagaaaaggctattatttgaaaaccatttaatggattacagaaagttgcaagctattgacaaaaagaggagcaaagaagccaaagaattgtataaccgcataaaaccttttgctcgtgttatgactgcacaggattttgaggaatttagcaaggatatattagaagaattgcattgcagggcaagaatacagcaattacaagaatggagaagcaatgggttaaccacgttagaagcaggtcttaagtatgaacgagataagcaagctagaattagcagtttcgagaaatttggcgcttctacggcggcgtcactcagtgagggcaatagccgttataggtcgaattctgcacataggtcgaacgcagaatacagccaaaactacagcgaaaatggcggtagaaagaaaaatatgaccattagcgatatacagcatgcacctgactatgcactgttgtccaacgacgagcagcaactttgtattcaactgaaaattttacctaaaccgtatctcgttctaaaagaggtaatgttcagagaactgttgaagactgggggtaatctaagcaaaagcgcatgtagggaactacttaatatagaccccataaaagcgaatagaatatacgattttttccagagccagaattggatgtaa

SEQ ID NO: 3078 - DNA, 1305 bp, Saccharomyces cerevisiae
atgtctcaacacgcaagctcatcttcttggacttcttttttgaaatcgataagttcgttcaacggagatctatcgtctttgtctgcaccaccgtttattctttctcccacttccttaacagagttttctcagtattgggctgaacatccagctttatttctggagccttcgttgattgatggtgaaaactacaaagatcactgtccctttgacccaaatgtggaatcaaaggaagtggcgcagatgttggcggttgttaggtggtttatttctactttgagatctcaatactgctctagaagcgaatcgatgggttctgaaaagaagcctttgaacccattcttgggtgaggtatttgttggaaagtggaaaaatgatgagcatccagagtttggtgaaacggttcttttaagtgagcaagtttcacatcatccacctatgacagcattttcgatttttaatgaaaaaaatgatgtttctgttcaaggatacaatcaaattaaaactggttttaccaaaacattgacgctaacggtcaaaccatacgggcatgtcattttgaagattaaagatgagacctacctgattacaaccccgcctttgcatatcgaaggtattttagtcgcttctccatttgttgaattaggaggcaggtcattcatacagtcatcaaatggtatgttatgtgttatagaattttcaggaagggggtatttcacagggaagaagaactcctttaaggcaagaatttacagaagcccacaagagcatagtcataaagaaaatgcgctatacctaatctctggccaatggtcaggtgtttcaacaattataaaaaaagactcgcaagtttcacatcagttttacgattcatcggaaactcctactgaacatttattagttaagccaatcgaagaacaacatcctctggaaagtaggagggcatggaaggatgtggcagaagcaatcagacaaggaaatattagtatgataaaaaagactaaggaagaactagaaaataagcaaagagccttgagagaacaagaacgcgtaaaaggtgtggaatggcaaagaagatggttcaaacaagtggactacatgaatgaaaatacatcaaatgatgtagagaaagcaagtgaagatgatgcctttaggaaattggcgtccaaactgcagctttctgtgaaaaatgtgccaagtgggacattgattggcggcaaagatgataagaaagatgtttcaaccgcattgcattggaggtttgataaaaatttgtggatgagggagaacgaaattactatataa

SEQ ID NO: 3079 - DNA, 1305 bp, Saccharomyces cerevisiae
atgtctcaatacgcaagctcatcctcatggacttctttcttgaagtcaatcgcttcattcaatggtgatctttcttcgttatcggctcctccattcattttatctccaatctcattgaccgagttttctcagtactgggctgaacatccagagctattcttggaaccctcttttatcaatgacgataattacaaagaacactgtttaattgaccctgaagtcgagtcacccgaattggcccgtatgctggccgttactaaatggttcatttccactttaaaatctcaatactgttctcgtaatgaatccttaggttctgagaaaaaacctttgaacccatttctaggtgagttgttcgttggtaaatgggaaaataaagagcatcctgaatttggagaaacggttttgttaagtgagcaagtttctcaccatccacccgtcactgctttttccatcttcaatgataagaacaaggttaagctgcaaggctacaaccaaattaaagccagtttcactaaatccttaatgctgactgttaaacaatttggtcacactatgttggatattaaggatgagagttatttggttaccccacctccattgcatattgaaggtattcttgtcgcttctccctttgttgaattggaaggaaaatcatatatccaatcttcgacaggtctactttgtgttattgaattttcaggtagaggctacttttctggtaaaaagaattcattcaaggcaagaatttacaaagactctaaagatagcaaggacaaggaaaaggcattatacacaatatcaggccaatggtctggctcttctaaaataatcaaggcaaataagaaagaagaatcacgattattttacgatgctgctagaatccctgctgaacatctgaatgtcaagcctttggaggagcaacacccactggaaagtagaaaagcctggtacgacgtggctggtgccatcaaattaggcgattttaacttaattgccaaaacgaaaactgaattggaagaaacgcaaagagaattgagaaaagaggaagaagctaaaggcattagctggcaaagaagatggttcaaagattttgactactctgtcacgcccgaagaaggcgcccttgtacctgaaaaggatgacactttcttaaaactcgcctctgctctaaatttatcaacgaagaatgctccaagtggtactttggtgggtgacaaagaagacaggaaggaggatctttcatccattcattggagattccaaagagagttgtgggacgaagaaaaggaaattgttttgtaa

SEQ ID NO: 3080 - DNA, 1305 bp, Saccharomyces cerevisiae
atgtctctgccaggttcgaaattagaagaggccaggagactggttaatgaaaaacagtataatgaggcagaacaagtctatttgagcctgctggataaagacagctcacagagcagcgccgctgccggtgccagtgtggatgacaagcgtagaaatgaacaggagacaagcatattggaattaggacagttatacgtgactatgggtgcaaaggacaaattgcgcgagtttattcctcattctacggagtatatgatgcaatttgccaaatccaaaacggtaaaggtattgaaaacgttgattgaaaaattcgagcaagtgccggactccttggacgatcagatctttgtgtgcgagaaaagcatcgaatttgccaagagagaaaaaagggtgtttttgaagcattcactctcgatcaaattggccaccttacattatcaaaagaaacagtacaaggactcattagcattgattaacgatcttttgagggagttcaaaaagctggacgacaagccctctttggttgatgtacatctattggaaagtaaagtttaccataaactgaggaatctagccaagtccaaggcctcgttgactgcagcaaggacggccgctaactccatatactgtcctacacaaacagttgcggagctggacttgatgagtggtatcctgcactgtgaagataaagactacaaaactgcattttcgtatttcttcgaaagttttgaaagctaccacaatttgactacgcataattcctacgaaaaggcatgtcaagtgttgaaatacatgctattgtctaagatcatgctgaaccttattgatgacgtaaaaaacatcctaaacgcaaaatacacaaaggaaacgtaccagtcccgaggcattgatgccatgaaagctgtcgctgaggcttataacaacagatcgcttttagacttcaacacggcgctaaagcaatacgagaaggaactaatgggcgatgaactaacaagatcccatttcaatgcattatacgacacgttattagagtccaatttgtgtaagattattgagccatttgaatgtgtggaaatatcccacatttccaaaataatcggtctggatactcaacaagttgaaggaaagctctcccaaatgatactagataagatattctacggtgttctggatcaaggtaatggttggctttacgtttacgaaactccgaatcaggatgccacgtacgactctgcattggaattagtcgggcaactaaataaagtcgtcgatcaactatttgaaaaggcaagtgtcttgtattag

SEQ ID NO: 3081 - DNA, 1305 bp, Saccharomyces cerevisiae
atgtctgctgaaaccgccgccgcaaacactgctactgccccagtcccagaagtgcaagaacaagagagctccaagagcaagcaagtcaacttgacgccggcaccattgcccacatcttccccatggaaacttgctcctactgagatccctgtttctactatctcaatagaagacttggatgccacaagaaagaagaagaacagaacacccactccgaaatcatcgactgctaccaagtgggttcccatcaaggcctccattaccgtctctggcaccaaaagatccggttccaagaatggtgcaagtaatggcaacagcaacaagagcaaaaacaacaaaactgcagcatcgtcgacatcgtcgagtaatgctaacaggaaaaagaagcatcaccaacataatgctaagaagcaacaacaaatgaagaaagatggctttgaatcggcagtaggtgaggaagattcaaaagacgctacctctcaagaaaatggtcaatctacacaacagcaacaaccacctcaccaccgtaatcatcaccacagtcatcaccataacagcaatggtcctcaaaggagaaagttccacaacagtaataacgccggtatgcctcagaaccaaggcttcccaccacagtttaaaccttaccaaggacgcaacgctcgtaataacaacaacaaccgctctaaataccacaaccacttccatcacaaccaacaacatcctcaacaacctatggtcaaattacagcaacagttttatccagtccaaccagtgttaatggccatcaacaacattgctagacaaattgaatactatttcagcgaagaaaacttgaccgtcgacaattacttaaggtccaaactctccaaggatggttttgctccattgtctttaatctctaagttttacagagttgttaacatgtccttcggaggtgacactaacctgattttagccgcattgagagaaattgtcgctaacgaagccgctaccgtcaatgttgcagaaggtactttggccgccaaggaaggtgataacgttaccggtgaagccaaagaaccatctccattggataagtacttcgttcgttccaagagctggtcaaactggttaccagaaacttttgaaactgaaattaatattgaaaaagaactggtcggcgatgcattggaccaattcatgatatccctaccacctgttcctcaacaagaagaggaatcatccactgaactcgcttctcaagaacaagaaaccaaagaagactctgcgccggttgctgccggtgaatccgagtcttccttataa

SEQ ID NO: 3082 - DNA, 1305 bp, Saccharomyces cerevisiae
atgttactgaaaaacttacacagtctcttacaactaccaattttttcgaatggagcagataagggtatagaaccaaactgccctataaacattccattatcatgttccaataaaactgatatagacaactcgtgttgttttgaatatccaggtggaatatttttacaaacccaattctggaattactttccaagcaaaaacgatttaaatgaaactgaattagtgaaggagttagggcctctagattcatttacaattcacggattatggccagataattgtcatggtggctaccaacaattctgtaataggtccttacaaattgacgatgtttactacttattgcatgacaagaaatttaataataatgatacatccctgcaaatatcgggcgaaaagctgcttgaatacctagacttatattggaagagtaataacgggaatcatgagtccttatggatacacgagtttaataaacatggcacgtgcattagcacaattagaccagagtgctatactgagtggggtgctaatagtgttgacagaaaaagagcggtctatgattattttagaataacttataatctattcaagaaattggacacattttcaacactagaaaaaaataatattgtcccaagtgtggacaattcctattctttggagcagatagaggcagcactaagtaaagagtttgaaggaaaaaaagtcttcataggctgtgatagacataattccttaaacgaagtatggtattataaccacttgaagggttcccttttgagcgaaatgtttgtgcccatggactcacttgccattcgaacaaattgtaaaaaagatggtattaagttttttccaaaaggttatgtcccaactttcaggaggagacctaataagggagcaagatacagaggagtcgttcgtctatcaaatattaataatggagatcagatgcaaggctttctaatcaagaatggacactggatgagtcaaggtacaccagcgaattacgagttgattaaatctccctatgggaattactacttgagaactaaccaagggttttgtgacattatttcgtcttcatctaatgaattggtctgcaaattcaggaacattaaggatgcaggtcaattcgattttgatccaacgaaaggaggagacggatatattggttattctggtaactacaactggggcggtgacacctatccaaggagaaggaatcaaagccccattttctctgtagacgatgaacaaaattccaagaaatataagtttaaattaaaattcatcaaaaattaa

SEQ ID NO: 3083 - DNA, 1308 bp, Saccharomyces cerevisiae
atgaaggaagagctcagcaaagtgagcagtatgcaaaatttcgagatgatccagcgtgaacgattgccaacattgtatgaagtgttaatacagaggacatcgcagccagttgatctctggactttttatacatttctttcacaattcccatatgccatcaactatctggacttttgggttgaccttatgacacatacacgactttgcaaaaactacatagagttggtaagaaaatcattaatcaactttccacaagaacaacagcagaatggaagtacatctacggctacatttgacttgctgaacgcactgatagaagaagggcacctagacccggaagcacctgataaactcttagaaaatagcggcccagacgtgcccttttcaccaaaattaaacgaattgctgggtgattggaagcaccaatcgggtatcggtcaagaagccctgagaaacgaagacgtagcgctgatcgtcgacgagataatgaaaaggcgctcccaacaagacggaaaaccgcagataactacaaaacaactgctgcacagcgcagttggtctctgcaacacctatttagtatcgcccgaacaaagcgaacggtacctgagcaacatccccatggaaacgcggaaccgcataatagaaagcgtacaaatcgagcgaaagtacgacattgagatttttgacgacctaaaaaacctaacttaccaattcctagaaatggattgtttcccaaaatttctaagccgcgtcgcactacacaacatccacgatgaaatatctgattggagattccactcagtgggcgtcaccaacgaaaaaagcaatcgctctcgaggccagacgcacatttctcgctcgccattctccaatcacacgtcaatcagtcgtattggctttggtttgctctggctaggcatcggcttttggatcggatatgttctaatcttcctggcgtatagtcgcgcaatccgtgtcgttacggtcgtgccatttacactgggatgctactgcattgtgtgtggcatgtatcaagtggacattgtgtattcctggtttggcgtcacacagagacttctccacagacacaaaaacgctggcaatgacgaaggagatgcttctagtgataccgatcacgtgccaatgatacttgcggtgttcggcggtaggcgccgtcttacccgcatagagcacccatttactcggcagcttctacgtaagcgtggactgtggtgtctgcttctcgtagtgggtgccactgccgcattcacagttattttcagctgtgttcccggccgtcgtgtatga

SEQ ID NO: 3084 - DNA, 1308 bp, Saccharomyces cerevisiae
atgaccactaacgaggaattcattaggacacagatattcggtacagttttcgagatcacaaatagatacaatgatttaaaccccgttgggatgggggcatttgggttggtttgctcagccacggacactttgacatctcagccagttgccattaagaaaatcatgaaacctttttccactgcagtgctggccaaaaggacatatcgtgaactaaaactactaaaacatctaagacacgagaacttgatttgccttcaggacatatttctttctccattggaagatatatattttgtcacggaattacaaggaacagatttacatagactcttgcaaacaagacccttggaaaagcaatttgttcagtatttcctataccaaattctaaggggtttaaaatacgttcactccgcgggcgtcattcatagagatttgaaaccgagcaacattctgattaatgaaaactgtgatttgaagatttgcgatttcggtctagcaagaattcaagaccctcaaatgacaggctatgtttccactagatactacagggcacctgaaatcatgctaacgtggcaaaaatatgacgtcgaggtcgacatttggtccgctggttgtatttttgccgaaatgattgaaggtaagcctttgttccctgggaaagatcatgttcaccaattttcgatcatcactgacttgttgggatctccgccaaaggatgtgataaatactatttgttccgaaaatactctaaaatttgttacttcgttaccacacagagatccaattccattttctgaaagatttaaaacagtcgaacctgatgccgtagaccttttggaaaaaatgctggtttttgatcctaagaagagaatcactgcggcggatgccttggctcatccttattcggctccttaccacgatccaacggatgaaccagtagccgatgccaagttcgattggcactttaatgacgctgatctgcctgtcgatacctggcgtgttatgatgtactcagaaatcctagacttccataagattggtggcagtgatggacagattgatatatctgccacgtttgatgaccaagttgctgcagccaccgctgccgcggcgcaggcacaggctcaggctcaggctcaagttcagttaaacatggctgcgcattcgcataatggcgctggcactactggaaatgatcactcagatatagctggtggaaacaaagtcagcgatcatgtagctgcaaatgacaccattacggactacggtaaccaggccatacagtacgctaatgagttccaacagtaa

SEQ ID NO: 3085 - DNA, 1308 bp, Saccharomyces cerevisiae
atgcatagacgacagtttttccaagaataccgtagtcctcagcagcagcagggacacccaccaaggtcagaataccaagttctcgaagaaattgggagaggttcatttgggtctgtacgaaaagtcatccatatacctaccaagaaacttttggttagaaaggatatcaaatatggccatatgaatagcaaagagagacaacagctgatcgctgaatgtagcattctatcgcagttgaagcatgaaaatattgtagaattttataactgggacttcgatgaacaaaaagaagtgttatacctttatatggaatattgttccaggggtgatttatcccagatgattaagcactacaaacaggagcataaatatataccagaaaaaattgtgtggggtatcctggcccaattattgactgcgctctataaatgtcattatggtgttgaattgccaactttgaccacaatatatgaccggatgaaaccaccggtaaaaggcaaaaacatcgttatccatcgtgatctgaaaccaggaaatatattcttaagctatgatgatagcgattacaatattaatgaacaagtagacggtcacgaggaagtgaatagtaattattacagagaccatagagtgaattcagggaaaagggggagccctatggactatagtcaagttgtggtaaagttaggtgattttgggttagccaaatctctggaaactagtattcaatttgccacaacatacgtcggtacaccatattacatgtcgcctgaagtgttgatggaccaaccatactccccactatccgacatctggtcactaggttgtgttatttttgagatgtgttcgttgcaccccccatttcaggcaaaaaattatctcgagctacaaactaagattaaaaacgggaaatgtgacaccgtccctgagtattactctagagggcttaatgccataatacattcaatgatagatgtgaacttaagaaccaggccttccacttttgaattactgcaagatattcagatacgaactgcaagaaagtcgttgcaattagagagatttgaaaggaagttactggactatgaaaatgagctgacaaacattgaaaaaatcctcgagaagcaagctattgaatacgaaagagaactgagtcagttgaaggaacaatttacccaggcagtggaggagcgagccagggaagtaattagcggtaagaaagttggtaaggttccagaatctataaacggatattatggtaaaaaatttgccaaacctgcataccactggcaaacaagatatcgataa

SEQ ID NO: 3086 - DNA, 1308 bp, Saccharomyces cerevisiae
atggactacaacaagagatcttcggtctcaaccgtgcctaatgcagctcccataagagtcggattcgtcggtctcaacgcagccaaaggatgggcaatcaagacacattaccccgccatactgcaactatcgtcacaatttcaaatcactgccttatacagtccaaaaattgagacttctattgccaccattcagcgtctaaaattgagtaatgccactgcttttcccactttagagtcatttgcatcatcttccactatagatatgatagtgatagctatccaagtggccagccattatgaagttgttatgcctctcttggaattctccaaaaataatccgaacctcaagtatcttttcgtagaatgggcccttgcatgttcactagatcaagccgaatccatttataaggctgctgctgaacgtggggttcaaaccatcatctctttacaaggtcgtaaatcaccatatattttgagagcaaaagaattaatatctcaaggctatatcggcgacattaattcgatcgagattgctggaaatggcggttggtacggctacgaaaggcctgttaaatcaccaaaatacatctatgaaatcgggaacggtgtagatctggtaaccacaacatttggtcacacaatcgatattttacaatacatgacaagttcgtacttttccaggataaatgcaatggttttcaataatattccagagcaagagctgatagatgagcgtggtaaccgattgggccagcgagtcccaaagacagtaccggatcatcttttattccaaggcacattgttaaatggcaatgttccagtgtcatgcagtttcaaaggtggcaaacctaccaaaaaatttaccaaaaatttggtcattgacattcacggtaccaagggagatttgaaacttgaaggcgatgccggcttcgcagaaatttcaaatctggtcctttactacagtggaactagagcaaacgacttcccgctagccaatggacaacaagctcctttagacccggggtatgatgcaggtaaagaaatcatggaagtatatcatttacgaaattataatgccattgtgggtaatattcatcgactgtatcaatctatctctgacttccacttcaatacaaagaaaattcctgaattaccctcacaatttgtaatgcaaggtttcgatttcgaaggctttcccaccttgatggatgctctgatattacacaggttaatcgagagcgtttataaaagtaacatgatgggctccacattaaacgttagcaatatctcgcattatagtttataa

SEQ ID NO: 3087 - DNA, 1308 bp, Saccharomyces cerevisiae
atgggagagaaccacgaccatgagcagagtattaaaagaaattctatgatttataatgaaaatgagaggcagttgtgcaattcaaacctaaagattcttcaaaataaaagggccctttcaaaaaatgacagctctagtaagcagcaggttcaggattctaaaccaagaagggctttaacagatgtaccagtgaacaataatcctttaagccagaacaagagaatagtagcagggagcaaggcggccaaagtacgaagagaagaaaacattagacctattgttagcgccgttcaaaaaagacagatatataacgatcgaacggcagcagagcaagaagaagaagaagaagaagaaggagaagatgatgatgctgcttcgatagtgaacaaaaaacgcagaatagacgctgaaggagtgagtgaaatagtaggctggcaggacctagattatgttgaaaaagatgatactgcaatggtagcagaatattctgctgaaatttttgcatttttatatagaagagaattagaaacgttaccatcgcacaactatttactcgacaaaacgtccaagtattatttgaggccttccatgagaacaatattagtggattggctggtagaggtgcacgaaaaatttcaatgctatccggaaacgttattcctatccataaacttaatggatagatttttagctaaaaataaagttacgatgaacaagttacaattattggcagttacctcacttttcatcgcggcaaaatttgaagaggtaaatttgcccaaactagctgaatacgcttatatcactgacggcgcggcttctaaaaacgacataaaaaatgcggaaatgttcatgctcacttccttagaattcaacattggttggcccaacccactcaatttcctaaggaggatctccaaggcagatgattacgatccggttaatagaaatattggtaagtttattttagagtatgcctactgctgccaccaattcattcatttacctccatctaccgtaagcgcaatggcaatgtatatagcgagaagaatgaccaacagaaacaagaacgagctatggaatggaacactacagcattacagtggtggtatcgatccaatacacgatgaagcgtttcagtctctctgcattgatctagtcaaagacatcgctagttccaaaactcatttagattcattgattttgaagtacaagaaaccaaggtatggctctgtttatttccaaactttcaagtggtgtacatccgaaatgcatagcaactttcaaaatctatttaatcttaagtag

SEQ ID NO: 3088 - DNA, 1308 bp, Saccharomyces cerevisiae
atggtggtgaacacgatatatatcgcaaggcatggatacagatccaactggcttccggagggtccatatcctgacccacttacaggaattgatagcgatgttcctttagcagaacacggagtccagcaagccaaagagttggcccattaccttttgtccttggataatcaaccagaggccgccttcgcttctccattttatagatgtcttgagactgtacaaccgatagctaagctgttagaaatacctgtttatctagaaaggggtatcggggaatggtatagacctgatagaaaacctgttattccagtacctgctggatatgagatactaagcaaattttttccaggtgtcattagccaagaatgggactctacattaacaccaaatgaaaagggtgagacagaacaggagatgtatatgagattcaaaaaattttggcccttatttattgaacgtgtagaaaaggaatatccaaatgttgagtgcatactgttggtcacacacgctgcatctaagattgcccttggaatgagcttgctgggatacgataatcctcggatgtctttgaatgaaaatggtgataaaataagaagtggtagttgctcattagacaaatacgaaattcttaaaaaaagctacgatactatagatgaaactgatgatcaaacatcctttacctatataccatttagtgacagaaaatgggttttaacgatgaatgggaataccgagtttttgagtagtggtgaagaaatgaattggaattttgattgtgtggcagaagctggttcagatgctgatatcaaaaagagacaaatgacaaaaaaaaccagctcaccaataccagaagcagatgatcaaacggaagtagaaaccgtttatatcagtgttgatattcccagcggcaattacaaagagaggaccgagatagcaaagagcgcaattttacaatattccggtttagaaacagatgctccgttgtttagaatcggaaatagattgtatgagggaagctgggagagacttgttggcacggagcttgctttcccaaatgctgcacatgtacataaaaagacagccggtctactatcaccgactgaagagaatgaaacaacaaatgctggtcaaagtaaaggctcatcgactgccaacgacccaaacatacaaatacaagaagaagacgttggactaccggattcaactaacacaagtagagatcacacgggagataaagaagaggttcaatcagaaaagatttatagaataaaagagaggatagtgctaagcaatgtccgccctatgtaa

SEQ ID NO: 3089 - DNA, 1308 bp, Saccharomyces cerevisiae
atgtcagattcagagggaggtctagcttccgaagttgaacatgagaagcggtcaagatctactagcaacagacccaattatgcaattgatactgaggatttagatattgatgaaaatgatgagaatgaagatgatgattacagagaagaagaagccaatgagggagtgaatgaagaagaaataagtgatgaggaggaacagataaataaaagcggaagaaacaaaaggaggcacgtggacgaagaagaggatttgtcagaggataaaggcgttactagatctagaaaccgttcaaagttcaaaaaaccagtatttcccggaatcgatgatgctgaggagaacttaaatcctttgaaagtggtcaatgaagaatatgttctaccagatgatcctgaaggtgagacgaagataactgcagatggtgatctattaggaggcagagaatttttagtgcgcaccttcacattaactgagaaggggaatcgaaagtttatgctggccaccgaaccggctaggatagtgggttttagagattcatatttattttttcaaactcaccccaacctttataagttcattctgaatcaaactcaaaagaacgacttgatagaccgtggcgttttaccttattcatatagaaatagacaaatcgctctagtcaccgctagaggcgtgtttaaagaatttggtgctaaaatcattcgtggcggcaaacatataaccgatgattattatgcttctgaattaagaacaaagggaaatgtaattgaaggaaaacttgctggtgatcctattgataaatccgcaagggccttagaaaccatgatgtatcctgcttccgagaatggcataaaccctgcaaaaaaccaggtggaattctttgaacacaggccacatggtcacatgagtaattctaatattattgcatcaggtagtaagctgagctctacaaattggctctatcagcattctgctgcgtgtagtagatttaatagcgatttgttttatgatagagtgaaggttcttcttgtagatcaacaaggcttgagagatgcatacacaaatatattacacataccagaatccacacagtcaaccactgttttaggatggaggagatcaaaaaacgatagtcccagcgacacaagcattgtgtatgagaccgttatacacgataacgatttgaataaaccgaaaacgggactgtcggaaatcccgaaagagatctatgaagacgttgttgatgaagacgttttaagggctatcaccgaacaacaaaatttcgaaaaatgcaacgaatatatttag

SEQ ID NO: 3090 - DNA, 1308 bp, Saccharomyces cerevisiae
atgtccatgcaacaagtccaacattgtgtcgcagaagtacttcgactagatccacaagaaaaaccggactggtcgagcggatatttgaagaagttgactaatgcgacatcgattttatataatacttcactgaacaaggtaatgctgaaacaagatgaagaggttgctagatgtcacatatgtgcatacatagcgtcacagaaaatgaatgaaaaacacatgcctgacctttgctattatatagacagtattcccttggagccgaaaaaagccaagcatttaatgaaccttttcagacaaagtttatctaattcttcacctatgaaacaatttgcttggacaccgagccccaaaaagaacaaacgcagtccagtaaagaacggtgggaggtttacttcttctgatccgaaagagttgaggaatcaactgtttggtacaccaactaaagttaggaaaagccaaaataatgattcgttcgtaataccagaactaccccccatgcaaaccaatgaatcgccgtctattactaggagaaagttagcatttgaagaggatgaggatgaggatgaagaggaaccaggaaacgacggtttgtctttaaaaagccatagtaataagagcattactggaaccagaaatgtagattctgatgagtatgaaaaccatgaaagtgaccctacaagtgaggaagagccattaggtgtgcaagaaagcagaagcgggagaacgaaacaaaataaggcagttggaaaaccgcaatcagaattgaagacggcaaaagccctgaggaaaaggggcagaataccaaattctttgttagtaaagaagtattgcaaaatgactactgaagaaataatacggctttgcaacgattttgaattaccaagagaagtagcatataaaattgtggatgagtacaacataaacgcgtcaagattggtttgcccatggcaattagtgtgtgggttagtattaaattgtacattcattgtatttaatgaaagaagacgcaaggatccaagaattgaccattttatagtcagtaagatgtgcagcttgatgttgacgtcaaaagtggatgatgttattgaatgtgtaaaattagtgaaggaattaattatcggtgaaaaatggttcagagatttgcaaattaggtatgatgattttgatggcatcagatacgatgaaattatatttaggaaactgggatcgatgttacaaaccaccaatattttggtcacagacgaccagtacaatatttggaagaaaagaattgaaatggatttggcattaacagaacctttataa

SEQ ID NO: 3091 - DNA, 1308 bp, Saccharomyces cerevisiae
atgtctggttatttttcagggttttctctaaacaagatcaccgattcaattgccaccgctgctcacaagacccaagacactttgaacaatgcattagcaaatgcaaatgtaaacttaaatgaccctcaaacaagactatcaatcaaatcgcgaactagatttgttcaggaatcattgggtactgtatcagatataagtaaattaccaccacagtaccaattcttggagaaaaaaagtgattccttagagaaggtatgtaaaaggattctactggtgtccaaaacgttcgaagtagagggctacgactatccaccaaatttaacggagagtatttcggattggtggtctctcaataaagatggctggtttggctctaaaaaatccgaaagttccactaaaaaaaagggatctaaccatgacgatgcttttttgccaaggtcttttgctcaagccatctcaaaagccgctgttgactgcgaatgtgaatttcaaaatttagaacacaacgaaaaggcagaactaaagaagaaaaaggagtctatcaaaactgcacagacaacggaagctcagggtgccgaccataatgaagaagacgaggaagatgaagaagatgaagaagatgatgaagatttgtctaatttgatcaaagttttcgattcgtggtcgacatgctataaaaatatcgatgaagggaaggcagagatggattctatgatggtcaaggaattcaacaaaaaattagaaacattaataaaccaagacttcaagaaggtccatgacctgcgcaaaaaagtggaagaatcaagactcaaatttgatacaatgcgttatgaagtcaaagcaaaagaagcagagttagaggcgaaaaaagctgaagccacaggagaagcacatagcaaggatgttagcgcaaaggacattagcgcaaacactaccacctcttttgacgaaacgccttctaccgaggatgaaaagccaaaatcagagggtgccgaagaggaatcaaagaaagaagcgaatgagcctactgttgatgacgttgctgatagaaaagaagatttaaagagtaacaaagtaaatgatgagccaccgattgaagaatctgaggataataaattactggaaaaactggaggatgaatttgtctccaatactacagcagcagtggaaacaatggaagaaatcactgacagttctgaaattctgggcttgataaaactgttccagaatttccagttggtttactttagacaatgtgtccaagaagtggaggcaaaccttaaagttctaaatggtttggaaatttag

SEQ ID NO: 3092 - DNA, 1311 bp, Saccharomyces cerevisiae
atgaccgtgctatatgctccttcgggtgctactcagctatatttccatctgctaaggaagtcgccacacaacaggctagttgtctctcaccaaacacgtcgtcacctcatggggttcgttaggaacgcccttggattggatcctcctccctctccagaagatcctactccggagaacagattccatccatgggatcagtctccctcagtggacttgcgtgaaagggccgccaagattagaacgctagcacactgccctgttaccggcaaagatattaactacacttgtcctctgtcaggaattccgactcatcactcacgagaggcttgggagatggataaagcatatcacgattctaaaaaatatgaaatcctgaaaaaagttaatatttatgagcatgacttaagaagcggtagacccttcccggagtttgattttccccaacagcaaggctacgacaaggccgttaacctaacaaactgggatttgtttttctacacaagatcattctattccatggatacagagttccaattagccgcagtcacaaagatgctaagctatccaattacgattgggtctttgctgcacaaattttccccgtattcattgaacccaaaggggcctatcaccttagaaggtctaaaatctctggctgctctcaggtatactttatatccgttggagaatagatctttaccaaccacaactaagaaccgtgctatgagaattttcatcctaggtgcacgtgctgaagctcaattgccgggccacgtttggaaacagctccagtttcttttcccagagcagagtttcgaaatacatttcattggacccgaatgcctgtataaaagggataaacaggagtacgtcaagtctactacgccggtagtacaaagagtagacgagactctgaaattcatttatcgtacaaactttttcgaagtattccatgaggctcaagattttttcccatacgatccatacatggatgtcttttttactttccatccaggctacgcatctccagaatctcacggttcatggatgggtgaaactatgaaggcattactggaaacaaaatgtgctatcttcacaacgggtttcaataagaaagacctaacggacgacataaatcttgtcaaatccaaatacggtaaggaaatggatgtcttaatggagcccgtcagaaacgtatttggaagtacgaagtgggaattaaatgacatgaatcctcaagaagtttatcaatttaacatgtatattgccgggttcagaggtaaaaggtaccatacaatcaagagacaatga

SEQ ID NO: 3093 - DNA, 1311 bp, Saccharomyces cerevisiae
atgatattactccaagtcatatgcacgatttggacatgtctctttattccgttactcaatgcagaggaattcgtccccaaagtaacggagactctttcagaatattcatttagtctagagagctttgacgattccaacagtttaatcagattagataatcaagtcgtgtggataagttccgattctggagaaaattgggaagcggtcaaagaaattgaagggcatattctcgaattaattgttgatcctttgcatggacaggacagggcttttgtttcgatacatttatcacccaaattttacgtcaccgatgatcgtggaaaatcatggagggctctgactatacccgtctctgaaaactgtcgtttgggtacttcttgctctatagctacccatccgacagataaaaagtaccttattgcagattgcccttgctttataaacgacaatggttatatccaaatacaaaatgaaacttactttaccaacgatggggaatccttttacaatatcgaaccttccttgaaaaagaaagaagatgaccatataacaagttcaagctgcaactttgtcaaatctagcaaggattctgatattgagggtaacgacgcttcgatactatgtttgttctcgaaccatggttacgatagcgatcgtcacttaagtgccgcatatacacaattagccttaagtactgatggaggtaaaactttcaaaaaatttgatgagtttaatgataaaattatttatcaatacaagatattaaaatcacatataatcgtttcgacacaagatgatagatacaatgaaatgtcacccatggacatctggatatccaatgatgcgtctacttttcaaaaggcacgtctacctgctcaagtacggcacgtccatatgtatggaatttatgaagattctattggaagaataatcattcctatatctacgatattcacagatgaaaaaaacgaccaaccagctccctcagaaattttaatatcagattctcaagggttgaaatttttacctgttgaatggacaataaatcctcactttggttatattgatattgcttctcctcatttcttagaaggaacaataattggctcgtttcatccttcctttgactactctcataacaaaggaaaatataataaaaagatagccagatatgaaactaaaatatctgttgataacggcctcacatggtcaaatttgaaagtggttgacgaggaaaatgcagattcattcccttgtgatatcactaggcctgaaagatgttcgctccagaaccctttttatagtatctaa

SEQ ID NO: 3094 - DNA, 1311 bp, Saccharomyces cerevisiae
atggataccagcaaccacaaccaagaccacgactcccacgtggcggcacagagggagaacgacaataattatatgccaccttccccctccatgagcgagagttctatgatttttgaaagaaatgtagaggacccatcatacctttataaaacggtgtcaaacaacgctgcaaactctctctctaggcagagcagcaggaccagtttgttcaatcataataattctagtaataggaacttccataacttaagccagagatcgtctgctgtgaatctacatttgcaaccttctaggactaatgagtcaatagcatcgtaccagacatacaatccggattttgttgtgcagactccactggatcaccgtcgtaccttagagaatttcgtccctcctgcattagacgctggctgttctattgtaactgacgacacgactggccttgatgacgttgatatggtttattcgagaaggccatctaccatcggcctggatagagccctaggtaggacaagaagtctttcgtcacaatcttttgataacgaaacgtcgcctgcgcatccaagatctcccaacgaccatggttcaagactactaaggttttattcctacgctgacatgttgtccgatgacaacaataacaacgttagtaatgcgacatcaacatcatcaactgcgaaccccttgagaagacccccaatgcaaggtcactactcgttctcgtcgtcccttttgaattctccttctcatttgccttcccccccatcagcttcggcatcaccacctcagcatatgaacttcaccaaccctttcatcatatctagacgttactctaacacaacgatcaacaatgccaatgggggaaccagcgctggaagcactacgggggccgcactatcaagatcgccatcgaaccaacagtacttacttaaacaacaaaggtcaccttcagggagcgcccgttcaagaagaaacagcaataggcccggcagtgctgccaacattatgatcgggaaacctaaatccaaattccatatggaatccagtggcagtgaagggttttcttccgaagaggaggacaacactatgattgaaagagataaactcaatctaaagcaaaaattgcagtcacaactggcacaaccaccatcaattgccaacatggttaacgataatcacaataatactaataaacacaagaatactattaataataacatcaaaaatagccctgcgttcacaaactcgaatccaagttcaaaatcaaattcaaactctacaataacctctatgaatccagacacaaccaaataa

SEQ ID NO: 3095 - DNA, 1311 bp, Saccharomyces cerevisiae
atggctagaaccaaaagtaggaagcgttccggaaataaccaaaataagaatgcgtctgtggtaaataataaggctgagatcgccgccatgattgatgcaagaaggcttgagcaaaagaaaaagggtggggtgactaacagcaaaggaaagacgaataaggtagtggatgcgaagttagaaaaagagttcaaagacgttttacaacgatttcaagtgcaagagaatgatacgccgaaggaaatcacgaaagatgaaaagaacaatcatgtcgttattgttgagaaaaacccagttatgaacagaaagcatacagcagaagatgaattggaggatacaccctcggatggtattgaggagcatctatcggcaagaaaacgtaggaagactgaaaaaccttcactttcgcagttaaaaagccaggtaccgtatcctcaaattatagaatggtacgattgtgacgcaagatatccaggcttactagcgtcaattaagtgcaccaaaaatgtcattcctgttccaagccactggcagtccaagaaggaatatctatctggccgttctctgttaggtaaaagaccttttgaacttcctgacattatcaagaagacaaatatagaacaaatgagatcgacgcttccgcaaagcggactggatggtcaagatgaaaagtcactaaaggaggcctcaagagcaagagtgcagccgaaaatgggcgccttggatttggattacaagaagttacacgatgtgtttttcaagataggagccaactggaaacctgaccatttgttatgcttcggtgacgtctattatgaaaataggaatcttttcgaggaaacgaactggaaaagaatggttgatcataagagaccggggagaattagccaagagcttcgtgccataatgaatttacccgaaggtcaactaccaccatggtgtatgaagatgaaagacattggattacctacgggatatcctgatctgaaaattgccggcttgaattgggatataacgaatttaaaaggcgacgtttacggaaaaataatccctaatcaccattcaaggtccaagaaacagggtagaaactattttggcgcattgatctcatttgaaacccctgaatttgaaaattcaaaagaggatacacaggcgaatgcggaaaatgggcgccaagatgacaaaatcgatgatgaagtagagcataagttagatcacttccaggaagacatatccgaagtgacaagcgcagaagaaaaacttgagagaaacgaagaggaatcggagaagcaactatatactgtattgaaataa

SEQ ID NO: 3096 - DNA, 1311 bp, Saccharomyces cerevisiae
atggctccaccaaagaaaaccgtaaagaagatggaccttacgtcatttttaaatgatgacacctttggttcatcttgggctgaagaagatgtcgatttgaataagatcacaattcctattgaaaccgctaatgcaaacactattccattgtccgaattggctcatgctaaaaacaacagcaataacacgcgttcaggcggctttggtggcagttttggaggtagatctagattagaccctgctttggggggcggttcttccgatagaagagaggaataccctgttccagatgctccaccatatagggctgtcataaacaacattccatgggatattaccccagagggtgttcaagcctgggttgaagatggtttagttaagcctgaagcggttgaagaagttgttttgccaaagaatctaagagacccaacaagattaaagggtaatgctttcgttactttgaaagaaagagcagatttggtcgccgttctgaagttcaacggtactaaattgaatgagagaactgtttacgtttctgttgcggctccaagaagagggggaggtgcagatgttgattggagtagtgctagaggctccaatttccaaggtgatggaagagaagatgcaccagatcttgattggggtgccgctagaggttctaacttcagaggtccaagaagagaaagagaagaagttgatattgactggactgctgcaagaggttccaatttccaaggctcttccagaccaccaagaagagaaagagaagaagttgatatcgactggagcgctgcaagaggctccaatttccaaggctcttccagaccaccaagaagagaaagagaagagccagatattgactggagtgcagctagaggctctaactttcaaagctcctcgaggccaccaagaagagaaagagaagagccagatattgactggagtgcagccagaggttccaacttccaaagctcctcaagaccaccaagaagagaaagagaaaaggaagaaccagctttggattggggtgctgccagaggtgctcagtttggtaagcctcaacaaaccaaaaatacctacaaggataggtctctaactaacaaaaagactactgatgagcaaccaaaaatccagaagtctgtttatgatgttttacgtactgaagatgatgatgaagatgaagaggctgaaaagcaaaatggagacgcaaaagaaaacaaagttgatgcggcagttgaaaagctacaggataaaactgctcaattgactgttgaagatggtgacaattgggaagttgttggtaagaaatag

SEQ ID NO: 3097 - DNA, 1311 bp, Saccharomyces cerevisiae
atgtcaaccaaaccagagaagccaatatggatgtcacaagaagactatgaccgtcagtacggctcaattactggtgatgaatcgtccacagtctcaaaaaaagactccaaagttactgccaatgcgcctggtgatggtaatggatcattaccagttttgcaaagcagctctatccttacttctaaggtgtctgatctacccattgaggcagaatccgggtttaaaatccaaaagagaagacatgaaaggtatgatcaagaggaaagattacgcaaacagcgtgctcaaaaattgagagaagagcaactaaagagacatgaaatagagatgactgcaaatagatccataaatgttgaccagattgtccgagagcactataatgaacgtacaataatcgccaatcgcgctaagaggaatctatcgcctattattaagcttcgtaattttaacaatgcgattaagtatatgttaattgacaaatatacaaaacctggagatgtcgttttagaactcggatgtggcaaaggtggtgatttaagaaaatatggtgctgcaggtatttcacagtttattggtattgacatttccaatgcctctatccaagaagctcataagagataccggtccatgagaaatttggactaccaagttgtgctaattactggggattgctttggcgaatcattaggtgttgcagtagagcccttcccagactgtagatttccgtgtgatatcgtttcgacgcaattttgcttgcattatgcttttgagaccgaagaaaaagcaaggagagctttactgaatgtcgccaaatcactcaaaattggtggtcacttttttggcacgataccagattcagaattcattcgttataaactgaataaatttcccaaagaagtggaaaagccatcttggggaaactccatttataaagtgacatttgagaataattcataccaaaagaatgattatgagttcacatcgccttatggtcaaatgtatacttattggctagaagatgctatagataatgttcctgaatatgttgtgccattcgaaaccttaagaagtttggctgatgaatacggtttggaactagtatcgcaaatgccttttaataaattttttgtccaagaaattcccaaatggattgagaggttttcgcctaaaatgagggaaggtttacaaagatctgatggtagatatggtgttgaaggggatgaaaaggaagcggcatcatatttctataccatgtttgcattccgtaaggtaaaacagtatatcgaaccggaaagcgtaaagcccaactga

SEQ ID NO: 3098 - DNA, 1311 bp, Saccharomyces cerevisiae
atgtcactgaatgacttcctaagttccgtgctacctgtcagtgaacaatttgaatacttatcgttgcaatctattccgttagaaacccatgctgtcgtaaccccaaataaggacgacaaaagggtcccaaaaagcacgatcaagactcaacacttctttagtctatttcaccaaggaaaagtttttttttcattagaagtgtatgtgtatgtcacgctttgggatgaagcagatgccgaacggttaatatttgtatcaaaggcagacactaatggttattgtaatacgagggtaagcgttagagatattacaaaaataatattagaatttatattatcaatcgacccgaattactatcttcaaaaagtaaaaccggcaataagatcatataagaagatatcccccgagctgattagcgcagccagtacgccagcaagaactttaaggattttggctagaaggcttaaacagtcaggcagcaccgttttgaaagaaatagaatctccacgttttcaacaagatctttatctctcattcacctgtcctcgtgagattttgaccaaaatttgtttatttactagacctgcatcccagtacctcttcccagattcttcaaaaaacagcaaaaagcatatactaaatggcgaggaactaatgaaatggtggggctttattttggatagattactaattgaatgctttcaaaatgatacacaagcaaaattaaggataccgggcgaagatcctgctcgagtaagatcatacctaagagggatgaaatatccactatggcaagtgggtgatatatttacctctaaagaaaattctcttgcggtatataatattccattattcccagacgatcctaaggctagatttatacaccaattggcagaggaagatcgcctcctcaaagtaagcttatcatccttctggattgaactacaagagcgtcaagagttcaaattaagtgtcacatcatctgtaatgggtatttcgggatactctcttgccactccatctttatttccatctagtgccgatgttattgtaccgaagtcaaggaagcagtttagggcaatcaagaagtacattactggagaggaatacgatacagaggaaggcgcaatagaagctttcaccaatattcgtgattttctattgctcagaatggcaacaaatcttcaatctttaacagggaagagggagcatcgggagagaaatcagccggttcctgcaagcaacatcaacacgttggcgataacaatgctaaaaccgcgtaaaaaagctaaagccttgcctaaaacttga

SEQ ID NO: 3099 - DNA, 1311 bp, Saccharomyces cerevisiae
atgttagaagcactgtttagagattctgtggaagaagcaataaacgattccatcaaggaaggcgttgtgctggccgtttacaacactgcacgggatgaccagtggctgaaaagttggtttaaaggagatgatgtctcattagatactttagcggaacatagtatttggttgaggttggtcaaagacactgagcagttccagttatttgagcaagtatttcctaatgtagttgtacccagtatatacttgatacgtgctggaaagatagaattgattattcaaggcgaggatgaccgacattgggagaagttgctggcgtgcataggcatcaaagacaaaaaggctggtgagagttcgtccagggaaaccaatccaggtttggctagagaagaaaagtcatccagagacgtccataggaaaaatgcaagagaacggattgctgagactaccttagagatccaacgtcgtgaacaactgaaacaaagaaagctggctgaggaggaaagagaaagaattataagacttgttagggcagaccgtgcagaaagaaaagctcttgatgaaactcatcacagaacccttgatgatgataagccattggatgttcatgattacataaaagacgcacaaaaactgcacagcagcaaatgcgtcttgcaaatcaggatgactgatggcaagactctaaaacatgagttcaactcgtctgaaacattaaatgacgttagaaaatgggtggacgtcaacaggacagatggagactgcccgtactcattccacaggggcattcccagagtgacatttaaggattctgatgaattgaagacgctagagacactagaactaactccaaggtctgcattattacttaaaccactagaaactcaaaactcggggctatctgtgactgggatggagggaccaagccttttgggccgtctttataagggattctctacgtggtggcacaacgataaagatcctgaagtaacatcacaacgtgaggaaacatcgaagccgaatcgtcacgaagtgaggtcttcaacacctttatctggagctgcttcgtcaagctgtttccaatacaacaatgttcgggaaccagttcaatcatctgctcatgcatcaccaatgctgacacctagcggaaccaggtacccatcggaaaccaaccttactacgtcacgttctgtctcgccaaatgttttccaatttgttaacaacgatcatcaagaagatcctgaagacccaacaacctttaatggtaataatgtccatttagaaaagaaaaaggacgaagataaaaaataa

SEQ ID NO: 3100 - DNA, 1314 bp, Saccharomyces cerevisiae
atggctgtctctaaagtttacgctagatccgtctacgactcccgtggtaacccaaccgtcgaagtcgaattaaccaccgaaaagggtgttttcagatccattgtcccatctggtgcttctaccggtgtccacgaagctttggaaatgagagatggtgacaaatccaagtggatgggtaagggtgttttgcacgctgttaagaacgtcaacgatgtcattgctccagctttcgttaaggctaacattgatgttaaggaccaaaaggccgtcgatgacttcttgatttctttggacggtactgccaacaaatccaagttgggtgctaacgctatcttgggtgtttctttggctgcttccagagctgccgctgctgaaaagaatgtcccattatacaagcacttggctgacttgtctaagtccaagacctctccatacgttttgccagttccattcttgaacgttttgaacggtggttcccacgctggtggtgctttggctttgcaagaatttatgattgctccaactggtgctaagaccttcgctgaagctttgagaattggttccgaagtttaccacaacttgaagtctttgaccaagaagagatacggtgcttctgccggtaacgtcggtgacgaaggtggtgttgctccaaacattcaaactgctgaagaagctttggacttgattgttgacgctatcaaggctgctggtcacgacggtaagatcaagatcggtttggactgtgcttcctctgaattcttcaaggacggtaagtacgacttggacttcaagaatccaaactctgacaaatccaagtggttgactggtcctcaattggctgacttgtaccactccttgatgaagagatacccaattgtctccatcgaagatccatttgctgaagatgactgggaagcttggtctcacttcttcaagaccgctggtattcaaattgttgctgatgacttgactgtcaccaacccaaagagaattgctaccgctatcgaaaagaaggctgccgacgctttgttgttgaaggtcaaccaaatcggtaccttgtctgaatccatcaaggctgctcaagactctttcgctgccggttggggtgttatggtttcccacagatctggtgaaactgaagacactttcattgctgacttggtcgtcggtttgagaactggtcaaatcaagactggtgctccagctagatccgaaagattggctaaattgaaccaattgttgagaatcgaagaagaattaggtgacaacgctgttttcgctggtgaaaacttccaccacggtgacaaattataa

SEQ ID NO: 3101 - DNA, 1314 bp, Saccharomyces cerevisiae
atggctgtctctaaagtttacgctagatccgtctacgactcccgtggtaacccaaccgtcgaagtcgaattaaccaccgaaaagggtgttttcagatccattgttccatctggtgcctccaccggtgtccacgaagctttggaaatgagagatgaagacaaatccaagtggatgggtaagggtgttatgaacgctgtcaacaacgtcaacaacgtcattgctgctgctttcgtcaaggccaacctagatgttaaggaccaaaaggccgtcgatgacttcttgttgtctttggatggtaccgccaacaagtccaagttgggtgctaacgctatcttgggtgtctccatggccgctgctagagccgctgctgctgaaaagaacgtcccattgtaccaacatttggctgacttgtctaagtccaagacctctccatacgttttgccagttccattcttgaacgttttgaacggtggttcccacgctggtggtgctttggctttgcaagaattcatgattgctccaactggtgctaagaccttcgctgaagccatgagaattggttccgaagtttaccacaacttgaagtctttgaccaagaagagatacggtgcttctgccggtaacgtcggtgacgaaggtggtgttgctccaaacattcaaaccgctgaagaagctttggacttgattgttgacgctatcaaggctgctggtcacgacggtaaggtcaagatcggtttggactgtgcttcctctgaattcttcaaggacggtaagtacgacttggacttcaagaacccagaatctgacaaatccaagtggttgactggtgtcgaattagctgacatgtaccactccttgatgaagagatacccaattgtctccatcgaagatccatttgctgaagatgactgggaagcttggtctcacttcttcaagaccgctggtatccaaattgttgctgatgacttgactgtcaccaacccagctagaattgctaccgccatcgaaaagaaggctgctgacgctttgttgttgaaggttaaccaaatcggtaccttgtctgaatccatcaaggctgctcaagactctttcgctgccaactggggtgttatggtttcccacagatctggtgaaactgaagacactttcattgctgacttggttgtcggtttgagaactggtcaaatcaagactggtgctccagctagatccgaaagattggctaagttgaaccaattgttgagaatcgaagaagaattgggtgacaaggctgtctacgccggtgaaaacttccaccacggtgacaagttgtaa

SEQ ID NO: 3102 - DNA, 1314 bp, Saccharomyces cerevisiae
atgtccatcacgaaggtacatgctagaacggtgtatgattctcgcggcaatccgactgttgaggttgaaattacaacagagaatggtctcttcagagcgatcgtcccatctggtgcctccaccggcattcacgaagctgttgaacttagagacgggaacaagtccgaatggatgggaaaaggggtgaccaaggcagtcagtaacgtcaatagtatcatagggcctgctttaatcaagtccgaattatgtgtaaccaatcagaagggcatagacgagctcatgatatcgttagacggaacttctaacaagtcaaggttgggcgccaatgctatccttggtgtttccttgtgcgttgctcgagctgctgccgcacaaaagggaattactctctacaagtatatagccgagttagcggatgctagacaggacccctttgttattcctgttccttttttcaatgttttgaatggtggagcccacgccggtggctctttagctatgcaagaattcaagatcgcgccagtcggggctcagagctttgcagaagccatgaggatgggttcggaagtttaccatcatttgaagatattggcgaaggagcaatatggaccttccgctggaaatgttggtgacgagggtggagttgcccccgatattgacactgccgaagacgccttggacatgattgtggaagccattaacatatgcggttacgagggtagagtgaaagtaggaatcgatagtgctccttctgttttttataaggacgggaaatacgacctaaatttcaaggaaccgaactctgacccatctcactggctcagtccagcccagttagcagaatattaccattcattgctaaagaaatacccaatcatttccctggaagatccctacgccgaagatgattggtcctcgtggtctgccttcctaaagactgtcaatgttcagattattgcagatgacctgacatgcaccaacaagaccaggatcgcccgtgctatagaggagaaatgtgcgaatactctgttgctgaaactcaaccagatcggtactctgactgagtctattgaagccgccaatcaggctttcgatgctggatggggtgtaatgatatcgcatagatcaggtgaaaccgaagatccgtttatcgctgatttggtcgttggtttaagatgtggtcaaattaaatcgggcgctttgtcgagatcagaaagactggccaagtataatgaacttttgcgtatcgaagaggaactgggggacgattgtatatatgctggtcataggtttcatgatggaaacaaactataa

SEQ ID NO: 3103 - DNA, 1314 bp, Saccharomyces cerevisiae
atgagcacgggagattttttaactaagggaatagaactggttcaaaaggccattgacctggacacagccacgcagtatgaggaggcgtatacagcatactataacggattagattatttgatgttggctttgaaatacgagaaaaaccctaagtcgaaggatttgataagagcgaagtttacagagtatctaaaccgtgcagagcagttgaaaaagcacttggaaagtgaagaggcaaacgcggcaaagaaatctcctagcgctggtagtggttccaacggtggtaataagaaaatctctcaggaagagggtgaggataatggtggagaagacaacaaaaagctaagaggtgccttatcgagtgctattttgtctgagaagcccaatgttaagtgggaagacgtggctggactggaaggagccaaagaggcccttaaagaagccgttattttacctgtcaagttcccacatttgttcaaaggtaaccgtaagcccacttcgggaatcttattgtacggaccaccaggtacaggtaaatcatatttggcaaaagcagtggccaccgaggccaattctacctttttcagtgttagttccagtgatttggtttctaagtggatgggtgaatctgaaaaacttgtcaaacagttatttgcgatggcaagagaaaataaaccttctattatttttatagatgaagtggatgcgctaacaggtaccagaggagaaggagagagcgaagcaagtagaagaattaaaacagaattattggtacaaatgaatggtgttgggaatgactcccaaggtgttttggtccttggcgcaacaaatatcccatggcaactggacagtgccatcaggagaagatttgaaagaagaatatatataccattaccagatttggcggcaagaaccaccatgttcgagattaacgtcggcgacactccatgcgtattgaccaaggaagattatagaactttaggtgcaatgactgaaggttattccgggagtgatattgctgtagtggtgaaagatgcgctaatgcaaccgataagaaaaattcaaagcgcgacacatttcaaagatgtctctacggaggacgacgaaacaagaaaactaacaccatgctctccaggtgatgatggcgccatcgagatgagttggacggatattgaagctgatgaattaaaagaaccagatctcaccataaaggatttcttaaaggctatcaaatcgacgagacctaccgtgaatgaggatgacttgctgaagcaagaacagttcactagagattttggtcaagaaggtaactag

SEQ ID NO: 3104 - DNA, 1314 bp, Saccharomyces cerevisiae
atgagtgaagaacaggaccctttattagcaggattgggggaaacgtccggcgacaatcacacccaacagtcacacgaacaacaaccagaacaaccacaggaaacggaagaacatcatgaagaggagccttctagagtggatcctgaacaggaggcccataacaaggccttgaatcaattcaagagaaagctgctagaacacagaaggtatgatgatcaattgaagcagcgccgtcaaaatatacgagatctagagaagttatatgacaagactgaaaacgacataaaagctttgcaaagtattggacaattgattggcgaagtcatgaaggaattatctgaagagaaatatatagtgaaggcctcttcgggcccacgttatattgtcggagttaggaattcggtagatcgctctaaattaaagaaaggggtgagagtcaccttagatatcaccactttgactataatgagaattttgcccagagagacagatccactggtgtataatatgaccagttttgaacaaggtgaaatcacttttgatggtattggtggtttgactgagcaaatcagagaattaagggaggttatagaattaccattgaagaacccagaaattttccagagggtcggtatcaaacctccaaagggtgtgctactatatggtccccctggtactggtaaaactttactagcgaaggcagttgctgctacgattggagccaacttcattttctctccagcgtctggtattgtggataaatacattggtgagtctgctcgtattattagagaaatgtttgcatatgcaaaggaacacgaaccttgcatcatttttatggatgaagtggatgctattggtggtagaagattcagtgaaggtacttcagcagaccgtgaaattcaacgtacgttgatggagttgttgacccagatggatggttttgataatcttggacagactaaaatcatcatggctacgaatagaccagatactttagatcctgctttgttgaggcccggtagactagacaggaaagttgaaatcccattgccaaatgaggccggcagattagaaattttcaaaattcatactgcaaaagtcaaaaaaacaggggaatttgacttcgaggctgctgtaaaaatgagtgatggtttcaatggtgctgatattcgtaactgtgcaactgaagcaggttttttcgccataagagatgaccgtgatcacatcaaccctgatgatttaatgaaagccgtaagaaaagtagctgaagttaagaaattggaaggcactatagaataccaaaaattatga

SEQ ID NO: 3105 - DNA, 1314 bp, Saccharomyces cerevisiae
atgccaaaaaaggtttggaaatcatctacgccttccacttatgaacatatctccagcttaagaccaaaatttgtgtctcgtgtggacaatgttctgcaccaaaggaagtccttgacgttcagcaacgttgttgttccagataaaaaaaataacactctaacctcaagtgttatatactctcaaggtagtgatatctacgaaattgacttcgctgtaccactacaagaagccgcttcagaaccggtgaaagactatggtgacgcctttgaaggtattgaaaacacctcgttgagcccaaaattcgtgtaccagggtgaaactgtctccaaaatggcctacttagataagactggagaaactacattattgtcgatgtctaagaacgggtcgttggcttggttcaaagagggtataaaggtccctattcacattgtacaggaattgatgggtccagcaaccagctatgccagcatccattctttaaccagacctggtgatctacctgaaaaggatttctcattagccatctctgacttcggcatttccaatgataccgaaaccattgtgaagtctcagagtaatggtgatgaagaagacagtattttgaaaatcattgacaatgccggtaagcctggtgagattctacgtactgttcatgtgcctggtaccactgtgactcacaccgtaagatttttcgacaatcatatctttgcgtcttgttcagatgacaatattctgaggttctgggacactagaacttccgacaagcctatatgggtgttgggagaaccaaagaacggaaaattgacctcgtttgattgctctcaggtttccaacaacttgtttgttaccggtttcagtacgggtattatcaagttatgggatgccagagcggctgaagctgccaccactgatttgacttatagacaaaacggtgaagatccaattcagaatgaaatcgctaacttctatcatgccggcggtgattctgttgtcgacgtccaattttctgccacttcaagctctgaattctttactgtgggcggcactggtaatatttaccactggaacactgactattccttgtcaaagtacaatcctgacgataccattgctcctcctcaagatgccactgaagaatcacaaacaaaatctctgagattcttgcacaagggtggaagcagaagatctccaaaacagattggaagaagaaacaccgccgcttggcatccagttattgaaaacttggttggtactgtcgatgacgatagtttagtcagcatctacaagccctataccgaggaaagcgaatag

SEQ ID NO: 3106 - DNA, 1314 bp, Saccharomyces cerevisiae
atggataacgaggttgaaaaaaatattgagatctggaaggtcaagaagttggtccaatctttagaaaaagctagaggtaatggtacttctatgatttccttagttattcctcctaagggtcaaattccactgtaccaaaaaatgttaacagatgaatatggtactgcctcgaatattaaatctagggttaatcgtctttccgttttatctgctatcacttccacccaacaaaagttgaagctatataatactttgcccaagaacggtttagttttatattgtggtgatatcatcactgaagatggtaaagaaaaaaaggtcacttttgacatcgaaccttacaaacctatcaacacatccttatatttgtgtgataacaaatttcatacagaagttctttcggaattgcttcaagctgacgacaagttcggttttatagtcatggacggtcaaggtactttgtttggttctgtgtccggtaatacgagaactgttttacataaatttactgtcgatctgccaaaaaagcatggtagaggtggtcaatctgcgcttcgttttgctcgtttaagagaagaaaaaagacataattatgtgagaaaggtcgccgaagttgctgttcaaaattttattactaatgacaaagtcaatgttaagggtttaattttagctggttctgctgactttaagaccgatttggctaaatctgaattattcgatccaagactagcatgtaaggttatttccatcgtggatgtttcttatggtggtgaaaacggtttcaaccaggctatcgaactttctgccgaagcgttggccaatgtcaagtatgttcaagaaaagaaattattggaggcatattttgacgaaatttcccaggacactggtaaattctgttatggtatagatgatactttaaaggcattggatttaggtgcagtcgaaaaattaattgttttcgaaaatttggaaactatcagatatacatttaaagatgccgaggataatgaggttataaaattcgctgaaccagaagccaaggacaagtcgtttgctattgacaaagctaccggccaagaaatggacgttgtctccgaagaacctttaattgaatggctagcagctaactacaaaaacttcggtgctaccttggaattcatcacagacaaatcttcagaaggtgcccaatttgtcacaggttttggtggtattggtgccatgctgcgttacaaagttaattttgaacaactagttgatgaatctgaggatgaatattatgacgaagatgaaggatccgactatgatttcatttaa

SEQ ID NO: 3107 - DNA, 1314 bp, Saccharomyces cerevisiae
atggctctcaataaactaaagaatataccttctttaacaaacagttctcatagctcaattaacggcattgcatccaatgctgcaaattccaaaccaagcggagcagacacggatgatatcgatgagaatgatgaatctgggcaaagtattctattaaatattatttcccagctgaagccaggttgtgatttatctagaatcacacttccgacatttattctggaaaaaaaatcgatgttggagagaatcactaatcaattacaattcccagatgttcttttagaagcacactccaataaagacgggctgcaaaggttcgttaaagtggtagcatggtacctagcaggttggcacattgggcccagggctgtgaagaagcccctaaatcccattcttggagaacactttacagcttattgggatttgcctaacaagcaacaagccttttacattgcagaacaaacgagtcaccatcctcctgaatctgcgtatttttacatgattccagaatcgaatattagagttgatggagttgttgtgccaaaatcgaaatttttaggaaactcaagtgctgcaatgatggaggggttaactgtattgcaattccttgatatcaaggatgcaaatggtaaaccagagaaatatactctatcgcaaccaaatgtttacgcaaggggaattctgtttggcaagatgaggattgaattgggagatcacatggtcattatgggtcctaagtatcaagtggatattgagttcaaaacaaagggctttatttctggtacctatgatgcaattgaaggtacaattaaggattacgatggtaaggaatactaccaaattagtggtaagtggaatgatattatgtatatcaaagatttgagggaaaaaagctctaaaaagactgttctcttcgatactcatcagcattttcctctagctcctaaagtccgcccattggaggaacagggagaatacgaatcgagaaggctttggaagaaggttacggatgcgctggctgtacgtgaccatgaagtagctacagaagaaaagtttcagatagaaaaccgccaaagagagctggccaaaaagagggccgaagacggcgttgaatttcattcaaaactatttagaagggcagagccaggtgaggatttagattattatatttacaagcacatccctgaagggaccgacaagcatgaagaacagatcaggagcattttggaaactgccccgattttaccaggacagacattcactgaaaaattttctattccggcttataaaaagcatggaatccaaaagaattag

SEQ ID NO: 3108 - DNA, 1314 bp, Saccharomyces cerevisiae
atgggacaaggtgtatcatctggacaagacaaaaagaagaagaagggatctaatcagaaacccaaatatgaacctcccgttcaatctaaatttggtcgtaagaaaagaaagggaggtccagctactgctgaaaaattacccaacatatatccaagtactcgttgtaagttaaagcttctaaggatggaacgaattaaagaccatttgttattagaagaagaatttgtctctaactctgaaattttaaaaccctttgaaaagaagcaggaggaggaaaagaaacaattggaagaaatacgtggaaatccattgagcattgggacccttgaagaaattatagacgatgatcatgcgatagtgacaagtccaactatgcctgattattatgtatctatcttatcctttgtcgataaagagttactagagcctggatgttctgtgttattgcatcataaaaccatgtccatcgtaggtgttttacaggatgacgccgatccaatggtttcggtcatgaaaatggataagtcgccaacagaatcatacagtgatattggtggcttagaatctcaaattcaagaaataaaagagtctgtagagttaccgttaacacaccccgaactgtatgaagagatgggtatcaaacctcccaagggtgtgattctttatggtgcacccggtacaggtaagacattgctagcaaaggctgttgcaaatcaaacatctgccacattcttaaggattgttggctcagagttaattcaaaaatatttgggggatggtcctaggttgtgtaggcaaattttcaaagtagcgggtgagaatgcaccaagtattgtatttattgatgaaatagacgccattggtactaaaagatatgactccaatagtggtggtgagagagaaattcagagaaccatgctggaattgctgaaccagctggacgggttcgacgacagaggggatgtgaaggtgattatggccactaacaaaatcgagactcttgacccagcattaatcaggcctgggagaattgatcgtaaaatcttatttgaaaaccctgatctaagtactaagaaaaaaattttagggattcacacttccaagatgaatttaagtgaggacgttaatcttgaaactttagtaacaacaaaggatgatttgtcaggcgccgatatccaggcaatgtgtacagaagcaggtttgttagcccttagagagagaagaatgcaagttacagcggaggattttaaacaagccaaggagagagtcatgaaaaataaagttgaggaaaatttagaaggtttatacttgtga

SEQ ID NO: 3109 - DNA, 1314 bp, Saccharomyces cerevisiae
atgggggattctaattccagccaagaagcgtattctgatacaacatccacgaacgcttctagaatcgcagatcaaaatcaacttaatttaaacgtggatcttgaaaaaaatcaaacagtaaggaagtcaggttcactggaagcattacagaatgcaaagatacatgttcccaaacacagtgatggttcaccactagactatccaaaattaaatacttacacgtttgtgcctaccacagtgccgccttatgttttagaggcgcagtttgataaattaagacttcaggataagggcaccgttgatggaaatgttaccgatgataaaaatcttccaaaagagtttaaatggggccagtttgcatctaccatcggctgtcattctgcatacactagagaccaaaactacaatcctagtcacaaatcctacgatggttactctctatcatcatctacctcatcaaaaaatgcggctcttagagaaattttaggtgacatgtgcagcgagtggggaggtgaagaacgactagaaggtgttctacattcagaaataggtgccaatttagagttcaacacgacagaagagagaaaagagtggttacaatatatcgaaaaggtaaaagatttctattacggtgataataagaagaacccagaatcacccgaatcagtacacaacaaagtttacaagtcagattgggtaaatgagctcaataaagagagagaaaagtggcggaggttaaagcaaaggaagttacaacagtggagacctcctttgacgtcgctattacttgataatcaatatttgattttgggtttgaggattttcactggtatattatcgtgcatttcacttgctctggcaatcaagatttttcaaaactcaagatcaaataacaccatcagtgaaagtaaaatcgggcaacaaccaagcaccataatggccatctgcgtcaacgccgtggcgattgcgtatattatttacattgcacacgatgaatttgctggtaaacctgttggtttgaggaatccgttaagcaaactgaaactaattttgttggacttactttttataattttttcaagcgctaatctagcgctggcatttaatactcgtttcgacaaagagtgggtttgcacttctattcgcaggtcaaatggaagcacgtatggatacccaaaaataccgcgtatctgcagaaaacaggaagctttatccgcttttctgttcgttgccttgtttatgtgggtaatcactttctcgatcagtattgttagagtagtcgaaaaagtcagttcaattaccaacagaaactga

SEQ ID NO: 3110 - DNA, 1314 bp, Saccharomyces cerevisiae
atgtcagctttattaccaagattactcacaagaacagcttttaaagcttctgggaaacttctgaggctctcttcagtaatttctaggaccttttctcaaactactacttcctatgcagctgcttttgatcgttccaaaccgcatgtaaatataggtacgatcggccatgttgatcatgggaagacaactttaaccgcagccattacgaaaacgttagccgcaaaaggtggtgccaacttcttggactatgctgccatcgataaggctccggaagaaagagctcgtggtattacaatttctactgcacacgtggaatacgaaacggccaagagacattattctcacgtcgactgtccaggccacgctgattacatcaagaatatgattaccggtgctgctcaaatggatggtgctatcattgttgtagctgctaccgatggacaaatgccccaaactagagaacatttacttttggccagacaagttggtgtccaacatattgtcgtttttgttaacaaggttgataccattgatgatccagaaatgttagagttagtcgaaatggaaatgagagaacttttaaacgaatatgggtttgacggtgataatgctccaattatcatgggttctgccctttgcgctttggaaggtcgccaacctgaaattggggagcaggccatcatgaaacttttggatgcagtggatgagtatattcctacacctgaaagagatttgaacaagcctttcttgatgcccgttgaagatatcttctctatctccggtagaggtactgtggtcactggtcgtgtggaaaggggtaatttaaagaaaggtgaggaattggaaattgttggtcacaactccaccccattgaaaacaacagttactggtattgaaatgtttagaaaggaattggactctgctatggcaggtgacaatgccggtgttttacttagaggtatcaggagagatcaattgaagagaggtatggtcttagctaagccaggtaccgttaaagcccatacaaagattctagcctctttgtacattttatccaaagaggaaggtggtagacattctgggtttggtgaaaactacagaccacaaatgtttataagaacagctgatgttacagttgtgatgagatttcctaaggaggttgaagatcattctatgcaagttatgccaggtgacaatgttgaaatggaatgtgatttgatccatcctaccccattagaagttggtcaacgtttcaatatcagagagggtggaagaactgttggtaccggtctaatcacacgtattattgaatag

SEQ ID NO: 3111 - DNA, 1315 bp, Saccharomyces cerevisiae
atgagtagaggcaaactggaagatatggaacaaaaggaaacatcggaagttgactggataatcgtacgtgaaattgtcacatccttaacctattttctctttactaacttttagtaagaggtgtaatctcctcgaatattatctatgacagtgttttgctttaattcaatccaggaatcctacgttgtggaagagggcactttcaagaaagaaaggagatgtcgaagatgtaggtgctctcaagagtgaaaaaaatttaaaaataaatcctcgggaaaactcaaaacatatatacaaatgggttgcgcctttcgaaaatggatttttgaataataaatcactgtttgctcatctggaacctatatacaatttcctttgccagaataagtacaaaagcttcgaagatgcagttggtttaaaggagctgcaatcatttagcaaagatgtatcaactgctgatataaacaactggtttttaccgagatataaaattctgctaaaaatcctgagcttaaaaacaaaagaaattgactttagagggttatcgcaagtgtttcaaacactccaaatcttgttagtttctcattattcgcatcgcatagattctgattcttcttttaagaggacactgatagacgttcatgttttcaatttcatcgccaagtttctgtttaatagaattttattgaagaagaaccaaaacgatccaaaatggcttcaaaacttttacgaccagggagatggcaaacatttatgtgataaagttgactacaagcgcttgtgttcgttgcattttacccttatttactctattattaacattcaactcatcaaaatcaagacaaaccaaacatttgaaccgcagatattaaaatacgtatctgttctgaaattaattgaacacatacttatcatcatcgaaagtctgatacatgtacttattagatttgtatcgaagcataaactaatatgcatcaaccggaaaaaggcgtactgtcgagtatacctcgaaagagaattgagtttgaagaaaacctacttaaagaacttttacagtgtaataagcggtgtcccagaaaaagagttagggggtctattgaaaatactcaagatagttattctatcattgctcgagacatttgaaagcattgaatggcagcacttaaaacctttcctggaaaaatttccggctcatgaaatatcgcttcagaagaaaaggaaatatatacaggcggccttattaattactgccgaaagaaatttgatagcgcgctttcgattgtcaagatggttcaatgagacagaaaacatttaa

SEQ ID NO: 3112 - DNA, 1317 bp, Saccharomyces cerevisiae
atggaaacaccacccattgtgattgataatggctcatacgaaatcaagtttggtccttccacgaataagaaaccgttccgagctttaaatgcattggccaaagataaatttgggacatcgtatttatcaaatcatatcaaaaacatcaaagatatttcatctatcaccttcaggaggccacatgaactaggacagctcacattatgggaattagagagttgtatatgggattattgccttttcaatccttcagagtttgatgggtttgatctgaaagagggaaagggtcatcatttggttgctagcgagagctgtatgactttaccagaattaagtaagcatgccgaccaggtgatatttgaagaatatgaattcgacagtcttttcaagtctcctgtagcagtctttgtaccatttaccaagtcatataagggtgaaatgagaacaatttcaggtaaggacgaagatatcgatattgtccgtggcaactcagacagtacaaattccacatcaagcgagtccaagaatgcgcaggattcaggtagcgattatcatgatttccaattagttattgattccgggtttaattgtacttggataattcctgtcctgaagggaataccgtactataaagcggtaaaaaaattggacattggaggccgtttcctaactgggctactaaaggaaactctatcattcagacactacaatatgatggatgaaaccatacttgttaacaatatcaaggaacaatgcttgttcgttagcccggtgtcttattttgatagtttcaaaacgaaggataagcatgcactagaatatgtacttcctgacttccaaacaagctttcttggttacgtaagaaaccccagaaaagaaaatgtaccgttacctgaagatgcgcagatcataacactgacagatgagcttttcacaataccagaaacttttttccatccagaaatttcgcaaattactaaaccaggcattgtggaggccatcctagagagcctttccatgttgcccgaaatagtgcgacctcttatggtaggaaacattgtatgtacaggaggaaactttaatctgcccaatttcgcccaacggcttgcggcagaactacaaaggcaattacccacagattggacttgtcatgtttcggtgcccgaaggtgactgtgctctgtttgggtgggaagtgatgtcacagtttgcaaagacagattcctaccgaaaagcgagggtcacaagagaagaatactatgagcatggtcccgattggtgtacgaagcacaggtttggttaccagaattggatataa

SEQ ID NO: 3113 - DNA, 1317 bp, Saccharomyces cerevisiae
atggtatcagctttgaatcccagaactacagagtttgaatttggtgggctgattggtgccttaggcatcagcatagggctgcctgttttcactatcatcttgaatcaaatgataaggcccgattattttattaagggatttttccagaatttcgatatagttgagctttggaacggtatcaagccattgcgctactatctgggcaatcgtgaattatggactgtctattgcctgtggtatggaatactggcagttttggacgtcattttaccgggcagagtcatgaagggtgttcagttaagggatggttcgaagctttcgtataagatcaatggaattgccatgtctacaactttggtcttagttttggctatcagatggaaattgactgatggacaattgcctgaattgcaatatctgtatgaaaatcacgttagtttatgcataatatctattttgttttcgttctttttggcgacgtactgctatgttgccagcttcataccattgatcttcaagaaaaatggtaatggcaaaagggaaaagatcttagcactaggtggaaattcaggaaacatcatttacgattggtttattggtagagaactgaaccctcgtctcggcccattagatatcaagatgttttcagagttgagacccggcatgttgttatggttactgatcaatctttcctgtctgcatcaccattacctgaagactggtaaaatcaacgatgcattggtcttggttaatttcttgcaaggattttacattttcgatggagtactaaacgaggaaggtgtattaaccatgatggatatcactacagatgggtttggtttcatgctagcgtttggtgacttaagtttagttccattcacctactcattacaagcgcgttacttgagtgtttcccctgtggaattgggatgggtgaaagttgtcggtatattagccataatgtttttgggtttccacatcttccactcggcaaataagcaaaaatctgagtttagacaaggtaaattagaaaatctaaaaagtattcagacaaagcgtggtacaaagttattatgtgacgggtggtgggctaaatcacagcatatcaattactttggcgattggctgatttcattaagttggtgtttggccacctggttccaaactcccttgacatattactactcgttgtacttcgccacgttgttattacaccgtcaacaacgtgatgagcacaagtgccgcctgaaatatggcgaaaattgggaagaatacgaaagaaaagttccttacaagatcattccatatgtttattaa

SEQ ID NO: 3114 - DNA, 1320 bp, Saccharomyces cerevisiae
atgaaacggttcttactcagtcgaagacagagacaccttcgtatgatttgctttcacaatataagtctctttagagctaatggtgactccaaattgatcaaggaatatggtgatggatttataccatgtttctttatcttggaatccataagaggggagctgctttatgtgagcgaggtacaatcaggttctttgcgtaaactctcttttcaggaattaccaaaactaactggtgcatctactatgattgtcctaaaattggtaggactagttccgagtgatattttgtgtaccataagttcagataaaaatggtatcattgacgataaatggtgcgttttatgtacctacacgatagatcttaacaagttacaacccataaatgaagacacagttctaattacaggcaccaacgcaccagtacttgatttaatagatggatcctacacattggctgcagaaaaaattaagccactaaagggccttgttagttctcacaaaaggaatataagtcaagtcaagatcaaattttcattggcatatagctctttactaaaattaaacaaactattggagtattcttcccaagtccatgaggaaatcaatgaaatttccagcaaaatagaagatgactttttgtcactcaagaatcaaaatcattggtatatgagaacagtacagaagtccatagaaacgctagaaaaggaagtcctacaaaggaaaaaaagcaagaaaaatatagaaatggcgcaactcgagagtaatgatactatcaaccattctaaaacagaactgtctctgatgtcgcaggacgagtctataaatgatgactatggaagcatatattctagatttgtgcaaataaaagataggttggaccaactgaggtttaagaaactgtatcagctgatagggatcttccattcaacggatttatttaattcagatagaggctatatttactttgaaaaaccttctagcgtaaatgatgttattaataggctcaagctaaaacctttgaatatagagatattacttagacaagccggcgaatccacaaagcacagagaatatgtaaacagccagttgggttattaccttttatttctccatttgacagccatccaaattttcaaggctcctttaccctatagactaatgtattatggtagtacatcagtgatcgacagtcaatatccgttgtatttcactgatcaaatgatttctaagcatcaagcaaagctgattaaagccatacattattttaatgctgatatattgcaatttaaacagattctggagaattaccgtccaacatag

SEQ ID NO: 3115 - DNA, 1320 bp, Saccharomyces cerevisiae
atgaaactcggaagcaaacaggtaaaaattatatccttgttgctgctagacacagtgttcttcgggatcgagataactaccgggtacttgtctcactctttggctctaatcgcggactcattccatatgctaaacgatataatttctcttgtggttgcactttgggccgtaaatgttgccaaaaacagaaatccggattcaacgtacacttatggttggaaaagggcggagattttgggtgctctgattaacgccgtctttttgattgccttatgtgtctcaattttgatagaagcgctacaaagaattattgctccccccgtgattgaaaatcctaagtttgtgttgtatgtgggtgtcgcagggttgatatcgaacaccgttggacttttcttatttcacgacaatgatcaagagcatggacatggacacggacattcccatggcggtatctttgccgaccatgagatgcatatgccatcatcccacacacatacacatgcccatgttgatggaatagagaatactacaccaatggatagtacggataacattagtgagattatgcctaatgctatagtagatagttttatgaacgaaaatactagattattgacaccggaaaatgcatccaagacgccatcatactcaacgtcaagccatacgattgccagcggcggaaattacacagaacacaacaagcgcaagagatctttaaatatgcatggtgtgtttcttcacgttttgggcgatgctcttggcaacatcggcgttatgttgtctgcatttttcatttggaagaccgactattcttggaagtattatacagatccgcttgtctcattgataattaccggtataattttttcctctgcgcttcctctatcgtgcaaggcttccaaaatattgttacaagcgacaccttccactttatccggcgatcaagtagaaggtgatcttttgaaaataccaggaataatagctattcatgatttccatatttggaatttaacagagtctatttttattgcatctttgcatattcaactagatatcagcccggaacaatttactgacctggccaaaatagttagatcaaaacttcaccgctatggcattcactccgctactttgcaacctgaatttattaccagagaggttacttcaaccgaaagagccggagactcccaaggtgatcatctacaaaatgacccgctttcattaaggccaaagacatatggtactggcatttcaggttccacttgtcttatcgacgacgctgccaactgcaacacagctgattgcttagaggatcattaa

SEQ ID NO: 3116 - DNA, 1320 bp, Saccharomyces cerevisiae
atggacttactgggcgatatagtggagaaagatacatctgactctgttgaaagtaatgacaatggcactcttagtaccaacaactgtggaacgggatttcccgagttgtacaaacccaagaaaatatcatcttggaaggaaagactaagagaaaaaagagcccaaaagaaaaaaactagtggcaaggatgctgaaaagcaacaaacgagtacagacgccccactatccgaggcaaaatctatccataatgaaaatattaaagttctgcagggaatgagtgatgaacaaatcgtgcaagaacgtgaggatctgtataactctttagatcccaaactgattgccaagctattgaaaaacataaataaaagagcgaaggacgaaaacaacactccattatttgcagaaatagaaggcgcttctggtacctgggtaggtggcaacaagcaaggcatatacgatctaccaccgttagacgatgaagatgtagacgttgccttagaaattaggcctatgttaggcaaagatgcaaaacatgttcaatttgaagaagcaggaaaagaaaaagacgtggaagaagaagcaaaaactaatgatgacgtcgatgatatcgcacccttagatttccagatggcacaatgcattgatcatatgaaaaatgaagagctattcaaagacgttcattttatcaaagaggagagccaaaatgaaatcaatttagagaaacttgatataaatgatcctaatttcaacgataaattacacgaaaaatacttccctgatttgcccaaagaggtcgacaaattaaaatggatgcaaccggttcagcaaaaaacagacaagaattacatcattgaagacgtatctgaatgtaggtttgactttaatggcgaccttgttccacccacaagacaaatagactctaccattcactcagggttgcaccatcacagcgactcgcctgaactcgccggttacaccatagtggagttagaacatttagcaagatccacttttccttctcaaaggtgcattgctatacaaactttggggagaatactttataagctaggccaaaaaagctactaccagctagtgccagaaatagatgcagacacatacaaggaagacggaagcatatcgaacgttatggataagatctattccatgttttgggacttgattaaagacggaaaagtcatcgaatccttagaaatctcctctgatgagaaattcactagaaatttgtcagtcagaaattatgctattgatgcactttggttatggaaacaaggcggtggggacttccgaaccaagaaatag

SEQ ID NO: 3117 - DNA, 1320 bp, Saccharomyces cerevisiae
atggtcacaaaacatcagattgaagaggatcacttggatggagctacgacggatcccgaagttaaacgggtaaaattagaaaacaacgttgaagaaatacaacctgagcaggctgagaccaataaacaagagggcaccgataaagagaataaaggaaagttcgagaaagaaactgagagaataggaggatctgaagtggttacagatgtggaaaaaggaattgtcaaatttgaatttgatggtgttgaatacacattcaaagagagacccagtgtcgtagaggaaaatgaaggtaaaattgagtttagggtggtgaataatgataatactaaagaaaacatgatggtcctaactggattaaaaaacatttttcaaaagcaattaccaaaaatgcccaaagaatacattgccaggttagtctatgatcgaagtcatctttccatggctgtcattaggaagccattgactgtcgtaggtggcataacatatcgacctttcgataagagagaattcgcagaaattgttttctgtgccatcagttcgacggaacaggtacgcggttatggtgcgcatctaatgaatcacttaaaagactatgttagaaatacctcgaacataaaatattttttgacatatgcagataattacgctattggatactttaaaaagcaaggcttcactaaagaaatcacgttggataaaagtatatggatgggatatattaaagattatgaaggtggtacgctgatgcaatgttctatgttaccaagaatacgatatttggacgcaggtaagattctattattacaagaagcggccctgcgaagaaaaataagaacgatttcgaaatcgcatattgtaaggcctggtttagagcaattcaaagacttaaacaatatcaaaccgattgatccaatgactattcctggcttgaaagaagccggctggactcccgagatggatgcgttggcacaacgtcccaagcgtggtccacacgatgcagcaatacagaatatactcacagagctacaaaatcatgcagcagcttggcccttcttacaacccgttaataaagaggaggtccccgactattatgattttatcaaagagccaatggacttgagcaccatggaaataaaattagagagcaacaaatatcagaagatggaagacttcatatatgatgccagattggtgtttaacaattgccgaatgtacaatggcgagaatacgtcgtattacaagtatgctaataggctagagaaattcttcaataataaagtaaaagaaatacctgaatattctcaccttattgattaa

SEQ ID NO: 3118 - DNA, 1323 bp, Saccharomyces cerevisiae
atgaatgactaccatctcgaggataccacgtctgaacttgaagcattaagattggagaatgcacaattaagagagcagcttgccaagagagaagacagcagccgcgactacccattatctttggaagaataccaacgttacggaagacaaatgattgttgaagaaacaggtggtgtagcaggtcaagtcaagttgaaaaatacaaaagttttggtagttggtgctggaggtttgggatgtcccgccttgccctacttagcgggcgctggcgtgggccaaataggcatagtagataacgatgtggtggagacttccaatttgcataggcaggttcttcatgattctagcagagttggaatgttgaaatgtgagtcggccaggcaatatatcacgaaactgaacccacacattaacgtcgttacctatcccgttagattgaactccagtaatgcttttgacattttcaaaggttacaattatatattagactgcacagattctccattaacgagatacctggtgtctgatgttgcagttaatctgggaataacagtagtgtctgcatccggtttgggaacagagggccagctaactatattgaattttaacaatatagggccatgctacagatgcttttatccaacacctccgccaccaaatgccgtgacctcttgccaagaaggcggtgtgataggaccttgcattggactagttggaacaatgatggctgtagaaactttgaagcttatcctaggaatctacaccaatgaaaattttagtccctttttgatgttatattcaggtttcccacagcagagcctgcgcactttcaaaatgagaggcagacaagaaaagtgtctatgctgtggtaagaatcgaacgataacaaaagaagccatcgaaaaaggtgagatcaattacgaactgttttgtggcgcacgaaactataatgtatgcgagcctgatgagagaatcagtgtggacgcatttcagcgtatctacaaggatgatgaatttctagcaaaacatatatttcttgatgttaggccatcccatcattacgagatatctcatttccctgaagcagttaatattccaatcaaaaatctaagagatatgaacggtgatcttaagaaactgcaagaaaaacttcccagtgtagaaaaagacagtaatatagtgattctttgccgctacggtaacgactctcagctagctacaagattattgaaggataaatttgggttttctaatgtacgagacgtgagaggaggatacttcaaatacatagacgatattgatcaaaccattcctaaatattag

SEQ ID NO: 3119 - DNA, 1323 bp, Saccharomyces cerevisiae
atgatcagaacatcatctatattaaaaaactgtaactatagatacatacattgcatccatagatgcttgctgaatgaagccaatttgaaagatagaaaaactcacaacgtagaaagagtttcaaatgaaaagacatttgaacaagctctcgaagaggaacgtaaggtatttggagaactattcgaagctggagcaagggttgaaaacatgaggcacactaatgctagcaaaataattgacaagtattacaatgggctacaggacaactccgagggaactagtgtaaaaaaagaaaaaattgtttttaaccacagtcaaagagctcaaaggaagcttccaaataaggaccatgaattcctgaaggaaacagcaggcaatgactatgtctacgaacgggcagaaccttctgctattagcactaaaacgataagtgagcagacaagaactttgctggaaaagatatttgacgaagataatagcattaataaaagcaacagagaattgctgaatcttaatctgcgcaagggctcgggaatggaagctttgaggcagccagttgcacattccaacgtcaaatttagcgaggaagtgatgcaagaaattggtaataagattcggtaccaaaccacactggatcaggttttagaacctcacattgactacttgagggaagctgttaaaagtgattacgatcttttaagatacctaaagcaatcactagacatttacaagaaaaggaacaaagacctagagttaaagatgaatgcagaatcttcaaacattttcgaagacattagaagtgcgtgtataaataaaccggcagaactaccgaaaccgcttgcaatgactttaccatatattatagtcaaatcgcttagattaggtgactttgatttcccggcagacagaaagtacacattgatctcctatgtttataatgaatgtaaaaacaacatggacgcttcactgtacctaacaatttgtaatgttgatttctacaatttgctggttcagctattgtgggaaaacttccaggagattcgctacttgagacgtgtggttaccgagatgagcgttaatggtgtcatcggaaatattgaaaccgtggatatattggataagattgtcaaagaaatgagaagtttaaatgaggatgtctttcttgaagcaggagaacagctcagtgcagatgaggaagtttcgtccagcgcaaataaaatagtgaatgtaggtgttttatggaataaagacacgaataatgacttactaattgttgaaaattatctcaaaagcctcaaaaaaaatttaactagagacaggtag

SEQ ID NO: 3120 - DNA, 1323 bp, Saccharomyces cerevisiae
atgcttgctgtcagaagattaacaagatacacattccttaagcgaacgcatccggtgttatatactcgtcgtgcatataaaattttgccttcaagatctactttcctaagaagatcattattacaaacacaactgcactcaaagatgactgctcatactaatatcaaacagcacaaacactgtcatgaggaccatcctatcagaagatcggactctgccgtgtcaattgtacatttgaaacgtgcgcccttcaaggttacagtgattggttctggtaactgggggaccaccatcgccaaagtcattgcggaaaacacagaattgcattcccatatcttcgagccagaggtgagaatgtgggtttttgatgaaaagatcggcgacgaaaatctgacggatatcataaatacaagacaccagaacgttaaatatctacccaatattgacctgccccataatctagtggccgatcctgatcttttacactccatcaagggtgctgacatccttgttttcaacatccctcatcaatttttaccaaacatagtcaaacaattgcaaggccacgtggcccctcatgtaagggccatctcgtgtctaaaagggttcgagttgggctccaagggtgtgcaattgctatcctcctatgttactgatgagttaggaatccaatgtggcgcactatctggtgcaaacttggcaccggaagtggccaaggagcattggtccgaaaccaccgtggcttaccaactaccaaaggattatcaaggtgatggcaaggatgtagatcataagattttgaaattgctgttccacagaccttacttccacgtcaatgtcatcgatgatgttgctggtatatccattgccggtgccttgaagaacgtcgtggcacttgcatgtggtttcgtagaaggtatgggatggggtaacaatgcctccgcagccattcaaaggctgggtttaggtgaaattatcaagttcggtagaatgtttttcccagaatccaaagtcgagacctactatcaagaatccgctggtgttgcagatctgatcaccacctgctcaggcggtagaaacgtcaaggttgccacatacatggccaagaccggtaagtcagccttggaagcagaaaaggaattgcttaacggtcaatccgcccaagggataatcacatgcagagaagttcacgagtggctacaaacatgtgagttgacccaagaattcccattattcgaggcagtctaccagatagtctacaacaacgtccgcatggaagacctaccggagatgattgaagagctagacatcgatgacgaatag

SEQ ID NO: 3121 - DNA, 1323 bp, Saccharomyces cerevisiae
atggatagatatcaaagaaagataggatgtttcatacaaatcccaaatttggggcgcggacaactgaaatacgtgggtccagtggacacgaaagctggaatgtttgctggtgtagacttacttgccaacattggtaagaacgatggatcattcatggggaagaagtattttcaaacggagtatcctcaaagtggactatttattcagttgcaaaaagtcgcatcattgatcgagaaggcatcgatatcgcaaacctcgagaagaacgacaatggaaccgctatcaatacccaaaaacagatctattgtgaggctcactaaccagttctctcccatggatgatcctaaatcccccacacccatgagaagtttccggatcaccagtcggcacagcggtaatcaacagtcgatggaccaggaggcatcggatcaccatcaacagcaagaatttggttacgataacagagaagacagaatggaggtcgactctatcctgtcatcagacagaaaggctaatcacaacaccaccagcgattggaaaccggacaatggccacatgaatgacctcaatagcagcgaagttacaattgaattacgagaagcccaattgaccatcgaaaagctacaaaggaaacaactacactacaaaaggctactcgatgaccaaagaatggtcctcgaagaagtgcaaccgacttttgataggtatgaagccacaatacaagaaagagagaaagagatagaccatctcaagcaacaattggagctcgaacgcagacagcaagccaaacaaaagcagttttttgacgctgagaatgaacagctacttgctgtcgtaagccaactacacgaagagatcaaagaaaacgaagagagaaatctttctcataatcaacccactggtgccaacgaagatgtcgaactcctgaaaaaacagctggaacaattacgcaacatagaagaccaatttgagttacacaagacaaagtgggctaaagaacgcgaacaattgaaaatgcataacgattcgctcagtaaagaataccaaaatttgagcaaggaactatttttgacaaaaccacaagattcctcatcggaagaggtggcatccttaacgaaaaaacttgaagaggctaatgaaaaaatcaaacagttggaacaggctcaagcacaaacagccgtggaatcgttgccaattttcgacccccctgcaccagtcgataccacggcaggaagacaacagtggtgtgagcattgcgatacgatgggtcataatacagcagaatgcccccatcacaatcctgacaaccagcagttcttctag

SEQ ID NO: 3122 - DNA, 1323 bp, Saccharomyces cerevisiae
atggatgaaattcttgccaaagcaggttcacaagccgttacatttgctataaaatccggaatatcgatagcatccacatatgcgctaaagacaataacgaactttgtcgtccagattcctaaggatgatgctagaagaatagatcaactgaaatttaaactggaaagccgcatggctattgtatccagtgcaattgacctaataaagctggtagcggcgaggggaaacacgaatttgcaaatcactctgaggttaaccaaggatttaaaagaagagattgataggtttgatgagaagatcaacgaaatgacgcagaaagttgagggttccaggagcgcaaaaacacagaatgaagctattaaagcggtagaaaactatataaaggacttgctattgaggatcgaagaaatcactccattcattaatctttctttaaccacttctggtgccaacttgaacagcgcactcccatatcaactttctcctggtttattattaaaagcctccgatttcgttagcgagaacaatagaaagtatgaaaaggcaatgaagagtaatgagaaaggaacaggtgacaaggagattctaaaagttcaagtggggcctacatttgaggttacactattctctattttctataacctaacttcagaaaacaatgggcaatcaggaattgtttggaaagaggatatgaaacgtgcaaaagcaaggatatatagattgaactctacaggcagaaagtatgattattttatgaaaatagaacaagacttcaatgacggtagatatcatgaggatgatgacaaagaagacacaccacaggaacttgccatagatctgaaccatattaagaagctgtttttcagtgtttccggtaagcttctccgattagaagaacaggattctccagtgttggtattgaagattgaccggagcgatgacaaagaaaatgagagcagtgaaggagacaagggattactcgatgacattacttggtatgcggtaagcggatatgaagcgatagaggaagatgaagaggaagatgaagaggaggacgaagaggaaggaaaagacggagaagaacgaaaggaagaagaagaagaagaaaataaattggaggacaaggattcgtcgatcacactactggagtacatcattcggctgacgtccttacaaagtaacgatcagaaaagtatattggaagtgagtgatgaaaggttatctatatatttgaacgatgaaaatacgaactccagaaaggatagaataagcaattcgacaattgaagagacagaaaaaaagttaaaaaacctaaaactttag

SEQ ID NO: 3123 - DNA, 1323 bp, Saccharomyces cerevisiae
atgtcactttcaaataagactgtaaaggaattacgacaactactaaaggaaaggtacaccgtggaagatgaactaactgaatctatagcgctatcaagtatgcgattcaagccgtcgcaagaacctgaatttcatgcgctaagccaatcttccttgctcaaaactaaactaaaacaacaaagtagtacagatattccgagttacacccacgtacttatatcaaaattatcatgtgaaaagatcacccattatgcagttcgtggaggaaatattgaaatcatgggcatattaatggggttcacattaaaagataatattgttgtaatggattgtttcaatcttcccgtagtagggacagaaactcgcgtaaatgcacaattggagtcatacgaatatatggttcaatatatcgacgagatgtataatcataatgacggtggtgatgggcgagattacaagggcgctaaactgaatgttgttggctggttccattcacatcctggttacgactgttggttaagtaatatagatatccaaacccaggatttgaaccagagattccaagatccatatgtcgcaattgtggtcgatcccttgaaaagtctggaagataaaattttaagaatgggtgcatttaggacaatagaaagtaaaagtgatgataatagtgccacttcatactatgaactagaaacaatcatatttgattcagaattgaaccgagcgctatttgaaacaaagttaaacttacattgcgtaatagaggatgatgagtcagaacaaatatcattaaatagattgatcgattcaatgaagcagtatagctatttgatggattccaaaaatgttagaacaaggattaagttggctactaccagtgaacgtgttagcaacgaaaataaaaaaaacattgactatcaaaaccgttcaacaaggtctcagttctgcctcaatacgcaaaggggggatagcactgaaacaagctcctttggaagcatgttttcaggtgataatactagtgacgtagatatggaagatagaaaccttaccgagttcgacagtactgacactagtctgtgcataaacggcgaaccgagcattcatgtaaatcgcgtggaaagaagcagcaggtctaccgacaattttcacaattctaaaaaacgcatgaacagcaatcaggaaagatgtcatgatgagggcaatgatatgttacagagaaatgtcttggagacagattatgcaagagcaaaaaatcgaatacttgcgtcaaagataaaacaatatgagcggttacgtttttacaaggacacctttacattatga

SEQ ID NO: 3124 - DNA, 1323 bp, Saccharomyces cerevisiae
atgtcgaagacaagatactatttggaacaatgtattcctgaaatggatgacttggtggagaaaggactattcactaaaaatgaagtttcattaattatgaagaaaagaactgattttgagcatagattaaattccagagggtctagcataaatgactatataaaatacattaactatgaaagtaacgtcaataaattacgtgccaagcggtgtaagagaatcttacaggttaaaaagacgaacagtctatctgattggtctattcaacaaagaataggttttatttatcaaagaggaacgaacaaatttccacaagatttaaagttttgggcaatgtatttgaactacatgaaagcgagaggtaaccaaacatcatacaaaaaaattcacaacatttataatcagcttctaaagttgcacccaacgaatgtggacatttggattagttgtgcgaaatacgaatatgaagttcatgctaacttcaagagttgtagaaatatttttcagaatgggttgaggtttaaccctgatgtgcctaagctatggtatgaatatgtaaaattcgagctgaatttcatcactaagttgattaacagaagaaaagtgatgggtttaatcaatgaaagagagcaggagctcgacatgcaaaatgaacaaaagaataaccaagcccccgacgaagaaaaatctcatttacaagttccatccactggtgattcaatgaaagataaattaaacgagttaccagaggcagacatcagcgtactaggtaatgcagagaccaacccagcattacgcggtgacattgcattaactattttcgatgtgtgtatgaagactttgggcaagcattatattaataagcataagggttactatgccatctcagattccaaaatgaatattgaactaaataaggagaccttgaattacctattcagtgagtcactaaggtatattaaactatttgatgaatttttagacttggaaagagactatcttatcaatcacgtgttgcagttttggaaaaatgacatgtatgacctttcgctccgtaaggatctaccagaattgtatttgaaaacagtaatgattgacatcactctaaatatcagatatatgccagttgagaaactcgatattgatcaattacaattgtctgttaagaagtattttgcatatatatcgaaattggatagcgcatcggtgaagtcattgaaaaatgagtatcgttcatatttacaagacaattatttgaaaaagatgaatgcagaagatgatcctaggtataaaattctagatttaattatcagcaaactttaa

SEQ ID NO: 3125 - DNA, 1323 bp, Saccharomyces cerevisiae
atgtctgaaaataacgaattccagagtgtcaccgaatcgacgactgctccaaccactagtaacccatatggcccaaatcctgcggattatctatccaatgttaagaatttccagttgattgattcaacactaagagagggtgaacaatttgccaacgcattcttcgatactgaaaaaaagattgaaattgctagagccttggatgatttcggtgtggactacatcgagttaacctctcccgtagcatccgaacaatcaagaaaggactgtgaagctatatgtaaactaggtttaaaggccaagatccttacacacattcgttgtcacatggacgatgccagagtcgccgtagagactggtgtcgacggtgtcgatgttgttatcggcacctccaaatttttaagacaatattcccacggtaaggatatgaactacatcgccaagagtgctgttgaagtcattgaatttgtcaaatccaaaggtattgaaatcagattttcctctgaagattccttcagaagtgatctcgttgatcttttgaacatttataaaaccgttgacaagatcggtgtaaatagagtcggtattgccgacacagttggatgtgccaacccaagacaagtatatgaactgatcagaactttgaagagtgttgtctcatgtgacatcgaatgccatttccacaatgataccggttgtgccattgcaaacgcctacactgctttggaaggtggtgccagattgattgacgtcagtgtactgggtattggtgaaagaaacggtatcactcctctaggtgggctcatggcaagaatgattgttgccgcaccagactatgtcagatctaaatacaagctgcacaagatcagagacatcgaaaacctggtcgctgatgctgtggaagttaacattccattcaacaaccctatcaccgggttctgtgcattcacacataaagcaggtatccatgccaaggccattttggctaacccatctacctacgaaatcttggaccctcacgatttcggtatgaagagatatatccacttcgccaacagactaactggttggaatgcaatcaaatcaagagtcgaccaattgaacttgaatttgacggatgatcaaatcaaggaagttactgctaagattaagaagctgggtgatgtcagaccgctaaatattgatgatgtagactccattatcaaggacttccatgcagaattgagcaccccacttttaaaaccagtaaataagggtacagatgacgacaatatcgatatttccaatgggcatgtttctaaaaaggcaaaggtcaccaaatag

SEQ ID NO: 3126 - DNA, 1326 bp, Saccharomyces cerevisiae
atgagaatatcatcaacattgcttcaacgctcgaagcagcttatagataagtatgcattatacgtgcccaagacgggctcttttcctaaaggatttgaagtaggctacactgcatctggagtcaaaaaaaacgggagcctggacctgggtgtaatcttgaataccaataaatctcgtccttcaaccgcagcagctgttttcacgaccaataaattcaaagctgcgccagttttgacatcgaaaaaagtccttgaaactgctcgtggtaaaaacatcaacgctattgtagtcaattccggttgtgctaactcggtcacaggtgatcttggtatgaaagatgcccaagtaatgattgatttggttaacgataaaattggtcaaaaaaattctaccctagtcatgtctacaggcgttattggacaacgactacagatggacaagatcagcactggtatcaataaaatttttggagaagaaaagttcggcagtgattttaactcttggttgaacgtagccaaatcaatctgtactactgatactttcccaaaattagttacatctagattcaaattacctagtggtactgagtatactttgacaggtatggcaaagggcgcgggtatgatttgtccgaatatggctaccttattaggtttcatagttacagatcttcctattgaaagcaaggcgttgcagaagatgctgactttcgctactacccgttcatttaattgtatatcggtggacggtgatatgagcaccaatgacacaatttgcatgttggccaacggtgctattgacaccaaagaaattaacgaagactctaaagattttgaacaagtaaaattgcaggtcacagaatttgctcagcgcttggcccagttagtcgttcgcgatggtgaaggttcgacaaagtttgttactgttaacgttaaaaatgctttgcattttgaagacgccaaaataattgctgaatcaatctcaaactctatgttggtcaaaaccgcactatatgggcaagatgccaattggggaagaatattgtgcgcgatcgggtatgcaaagctgaatgacttaaaatctctagatgtcaacaaaattaatgttagctttattgctaccgacaattcagaacctcgtgagctgaagcttgtcgctaatggtgtgccacaattggagatcgatgaaacaagggcttctgaaatattggctttgaatgatttggaagtgtctgtcgacttgggaaccggtgatcaggcagcacaattttggacttgtgatttatcacatgaatatgtaacaattaacggtgattaccgttcataa

SEQ ID NO: 3127 - DNA, 1326 bp, Saccharomyces cerevisiae
atgagctcgacgatgttggatgatgtggataataatatgatgggtatcaagtctatcagcctttatgaattacttagcgatgtggtgaaacagggcgacaagacgcgattggtgacggcgggtcccgagcaagttttgcctgatttaatccggcatatcactgaaacaataccgtttgacctatttataaaccttaagaatgaaatgaacgatgcgagaaatctcgttactagattaaattggctgggtaagtttctgaatgataattttttacaaaatcatacatttccattcacaatacttcggatatgcgaattgtgttatgatcctttcaaatattacaagatcaatgaattggagaagtttgtaaatgcgctagaaaaatgttgcatggtaactagcagttggcaggtttttgataaaacacacggtgagaagcaagaggacgataaggagaaagatattaacttcatcaagaatcaagaagatgtctcactaatgaagataccgtggatgaccgaaaacaatactagggagttggcaccctttattagagaaatcgactctataatgagtgtcaacctaggctacgatgacgaggatgaagaggaaggattttttgatggtgatgaagatagggagatggggaataagagtaagcgtaatgttttgctgaaagatgaaaatttcatggtggaagaatactatgaggatgattgcgggataaacgatgataatagcgataataaaggacaaaattgtcagagcgatgttacgaagaataatagcgatgatgaagatgacgatgacaacgacgacgattatcgtgaagatggtgcagatgaagatgatgaggatgatgatcacatgggcagcacagatgacgatgaagatgatgacgaagataggcaggcgggcgaaagtaccaaggtgcaaaattttgacaagaaaaatgaaactccaaggaagaggaagcccacagatttagataactttgaatatgacgaatcaccatcattcacaaacatggatctcacgacgccaaagaaatataaacataccgcaacgggcaggttctccataatagagtcgccatcgtcttcgctcctcaatgccatggacggcagtaatgagatctcatcgagccaggaggaggagaaagaggatgctcatgaaaaccatgagggtagaagtgaaggactgttaccaggtgacgaattagtgagtccatcgatgagctcttcacaagaggataagatggttgcgattgctggtattacctaccgtgagaatattagcagtccattaggcaagaagtccagatga

SEQ ID NO: 3128 - DNA, 1326 bp, Saccharomyces cerevisiae
atgagtagcacgatattttaccgctttaagtctcaacgaaacacatcaagaattttatttgatggtaccggcctgacagtatttgatttgaaaagggaaattattcaagagaacaaactaggtgacggcacagatttccaattaaaaatttacaacccagatacagaagaggaatacgacgatgatgcctttgttatacctagatctactagtgtcatagtaaaaagatctccagcaattaaatcattctccgtacacagtcgacttaaagggaatgtgggagcagcagctcttgggaacgcaacaaggtatgttactggtaggccaagagtgttgcaaaagagacaacacactgctacaaccactgctaatgttagtggtacaacggaagaagaaagaattgctagtatgtttgccacacaagaaaatcaatgggaacaaacgcaagaagaaatgtctgcagccacacctgtttttttcaagtcacagacgaataagaattctgcacaagaaaacgaaggcccaccgccaccaggttatatgtgctatcgttgtgggggtagagaccactggattaaaaattgtccaactaacagcgatccaaattttgaaggaaaaagaatcagaagaaccacaggtattccaaagaagtttttaaaatccattgaaatagatcccgagacaatgacaccggaagagatggctcagcgaaagattatgattacggacgaaggcaagttcgtggtacaagttgaagacaaacaatcatgggaagactaccaaaggaaaagagagaaccgtcaaattgatggtgatgaaaccatttggagaaaaggccatttcaaagatcttcctgacgatttaaaatgtcccttgacaggtggtcttttgaggcagccggtaaagacaagcaagtgctgtaacatagatttctcaaaagaggcgctggaaaatgcactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatga

SEQ ID NO: 3129 - DNA, 1326 bp, Saccharomyces cerevisiae
atggccccaaatcaaagatcacgttcgcttctgcagagacatcgaggaaaggtactcatttcattgactggaatagctgctttatttaccacagggtcggtggtagtgtttttcgtgaagagatggttgtataaacagcagttacggattactgagcaacacttcatcaaagaacagatcaaaagaaggttcgagcagacacaggaagactcgttgtacacaatatacgagctacttcctgtatggagaatggttttgaatgaaaacgatttgaatttggacagcatcgttacccaattaaaggaccaaaagaaccagttgactagagcaaagtctagtgaaagcagagaaagttcgccgttaaaaagtaaagctgagttgtggaacgagttagaactaaagagtttgatcaagctggtgacagtgacgtacacagtatcgtcgctgattcttttaacaagactgcaactaaatatcctgacaagaaacgagtacctggactccgcaataaaattaaccatgcagcaggaaaactgcaacaaactacagaataggttctataactgggttacatcgtggtggagcgatccggaggacaaagcggatgatgcaatggtaatggcagcaaaaaagtcaaagaaagaaggccaggaagtgtatattaatgagcaagctttcctatcactatcatggtggattcttaacaaggggtggttgagttacaatgaaataattacaaatcaaatcgaaattgaatttgacggcatacacccaagagatactctaacgttagaagaatttagttctcgtctcacgaacatattccggaacacgaattcccaaatattccagcaaaataataataacctcacgtctattttgcttcctaaagattccagtggacaggagtttcttctgtcacagacgcttgacgcggatgctttaacaagttttcactctaacacactagtttttaatcaattggtgaatgaactgacccaatgtatcgaaagcacagcaacatccatagtgttagagtctctaataaatgaatcattccatttcataatgaacaaggtcggcataaagacaatagccaagaaaaaacctggccaagaagatcagcaacagtatcaaatggcagttttcgctatgtcgatgaaagactgttgccaagaaatgcttcaaacaactgccgggtcttcccatagcggcagcgtgaacgaatacctggccactctggattctgtgcagccgctcgatgatctgagcgccagcgtatacagcaactttggcgtctccagctcgttttccttcaagccttaa

SEQ ID NO: 3130 - DNA, 1329 bp, Saccharomyces cerevisiae
atgaataggactgtctttttggcatttgtatttggatggtatttctgttcaatagctctctccatatacaatagatggatgttcgatccgaaggacggattgggtattgggtatcccgtgttggtgacaacattccatcaggctactttatggttactatccggcatatacattaagctcaggcataagccagtgaaaaacgttttaagaaagaataatggttttaactggagtttttttctaaaatttttactccctacggcagtcgcttctgcaggtgatatcgggctcagtaacgtttccttccagtatgttcccttgacaatttatacaattatcaaatcttcgagcatagcttttgtccttttattcggctgtatcttcaagctagaaaagtttcattggaagttggcactttcagtaataattatgtttgttggtgtagcattaatggttttcaaaccaagcgattccaccagtaccaaaaacgaccaagccttggtcatttttggcagctttcttgtcctagcaagtagctgtctttctgggttaaggtgggtttatacgcagttgatgcttaggaacaacccaattcaaactaacaccgctgcagcagtagaggaatctgatggtgcccttttcacggaaaatgaagataatgtcgataatgaacctgttgttaacctcgccaataacaaaatgctggagaattttggagaatccaagcctcacccaattcatacaatccaccagttagctcctataatgggcattactctgttgcttacctcgctacttgtggaaaaaccatttcctggtatattcagctctagcatatttaggcttgatacgagcaatggcggtgtcggcacggaaactaccgtcctatccattgtgaggggtattgttttgttaattttacctggttttgcagtctttttgttgacaatttgtgagtttagtattttggagcaaacgcccgtgctgaccgtatctattgtgggtatagtgaaggaacttttgacggtaatatttggtataattattctttctgaaagattaagtggtttttacaattggttaggaatgcttattattatggcagatgtatgctattataattacttcagatataagcaagatctattacaaaaatatcattcagtttcgacacaagataatcgtaacgagttaaagggatttcaagacttcgaacagttaggaagcaagaaaatcgcaccatattctattagtgtcgacctaacaaatcaagagtatgagcttgatatgattgctcaaaacgttagtcgttcatcccagcaggtctga

SEQ ID NO: 3131 - DNA, 1329 bp, Saccharomyces cerevisiae
atgagtaatttcattagaaggctagttgggaaaatgaaagcgatttcaacaggtaccaatgctattgttagtaagaaggactccatttacgcaaactggtccaaagagcagctaatacgaaggatcactgaactagaaaacgcaaataagccacattctgaaaaattccagcacatcgaggataacaaaaagcgcaaaatttcgcaagaagaggttacgagaagcaaggcgaaaaaggctccgaagaagtttgacttttctaaacataataccaggttcatcgccttgagatttgcctatttgggatggaattacaatggcttagctgttcagaaggaatacacaccgttgcctacagtagagggtaccattttggaggccatgaataagtgtaaacttgttccctcgatggttttacaagactataaatttagcagatgtggcagaacagacaagggagttagcgccatgaaccaagttatatcgttagaagtccgttccaatttaacagatgaggaacagcgggatccgaccaacgacagcagggaaataccctatgttcacgttttaaatcaattactacccgacgatattcgtatatcagctgtctgcctcagaccgccacctaactttgacgcaagattcagctgtgttcaccggcactataagtacatctttaatggaaaaaaccttaatattgaaaaaatgtctaaagccgcatcatattttgttggagagagagacttcaggaatttttgtaagcttgatggctcaaaacaaattaccaattttaaacgaacaataataagctcaaaaattcttcccctttctgaaactttctattgttttgatctcgttggttcagcattcctatggcaccaagttcgttgcatgatggccattcttttcttagttggtcaatcacttgaagtgccggaaattgtcttgcgtctgactgatattgagaaaacccctcaaaggcctgtttacgaaatggcaaatgatataccattattgttatatgattgtaaatttcctgaaatggattggcaagaacctactgtagatgactataaggcaataaaattcacgacagctactgaagcattgacgttacactacgaacttaaggccgcagtatgcaatatttttaaagatgttttgcccacagcaaatacaaacaacttctcaaagacaattattaatttgggcgatggaagaggtaaagtagtcggtacctatgtgaaactagaggatagaagcgttatggaacctgtcgaagttgttaatgctaaatactccaagaaaaagaacaacaaaaataagtaa

SEQ ID NO: 3132 - DNA, 1329 bp, Saccharomyces cerevisiae
atgatcaccggtaaagaattgagaatcatctctcttttgaccttagacacggtttttttcctattggaaattaccataggttatatgtcacattcattggccttgattgccgattcatttcacatgttgaatgatatcatctctcttttagtggcactatgggctgtggatgtggccaaaaacaggggtccagacgctaaatacacttatggatggaaaagagcagaaattttgggtgctttaatcaatgctgtttttcttattgccctgtgtttctctattatgattgaagctttacaaagattgattgaacctcaagaaattcaaaacccaaggttggttttatacgttggtgtagcagggttaatttctaatgtcgtaggtttatttttgttccacgatcatggcagcgatagtctgcactcacactctcatggctctgtggaaagcgggaataacgatttggacatagaatctaatgcgactcattcccactctcatgcatctcttccaaacgataatttggccatcgatgaagatgctatttcgagtcctgggccctcagggcaaattggtgaagtgttgccacaatcagtagtaaacagattatcaaacgaaagccaacccttattgaaccacgatgatcatgaccacagccatgaatcgaagaaaccaggtcatcgctctttgaatatgcatggtgtcttcttacatgtactaggtgatgctctgggtaatattggtgttattgcagctgctttgtttatttggaaaactgaatattcttggagatattactcggatccaatcgtttctttaatcatcaccattattattttctcttccgctctgcccttatcacgtagagcttcaagaattttactacaggctactccttctacaatttctgctgatcagattcaaagagagattttggcagtacctggcgtgatagcggtccatgacttccacgtctggaacttaactgaatcaatatatattgcatctatccacgttcaaatagactgtgcacctgataaattcatgagctccgccaagctgataagaaaaatattccatcaacacggtattcattctgcaactgttcaaccagaatttgtttctggagatgttaatgaggatattcgcagaagattttctatcatagcaggtggttcaccatcttcgtctcaagaagcctttgacagccatggaaacactgagcatggtagaaaaaagcgttcacctactgcctatggtgctactacagcatcatctaattgtattgtagatgacgctgtaaactgcaatacttccaattgcctgtaa

SEQ ID NO: 3133 - DNA, 1329 bp, Saccharomyces cerevisiae
atgcggctggggaatgcttatgcgtattgcaagccgtcgcaaaatgttgggctgaagctggacttgttacggggtcttccagggtacgtgggtcacgccacgagtaggatcaaccggttagagaaccaggacaattactccattaaaatgatgcggtcgtggcctaatgcgtatggaagtgccctgaactgctctgtattcgatggccatggggagaaaggtgcgcaactgtcacagttgttagccgataaattgtgcagtagcctggatttccctgaaccctcctgggacaagcaggacttgaagaagttggtacaggaatatgcaagaaggtttcccgagggaaattactggaaacataagctgtccacgtttgaaaaattctacaacaagtttataaagaactgcaactcgaaacaagaactgctgctgatgaaggagggcgatagtgcgatccttggacaaaatggtggcaggatgatttttgataaaatggggaatattattgacaaaattgcactgctcactgagctagaccgtctgcgattgttctacgggtttgccaggttcgatctcgaccaatgctgcggcctgggcaccgcagcggggtccacagcgtcgtccatatttctatatccgtatgatgatccgaatgcacccattgatgaggggaaagacgatgactcgtggatcatatcgcactctggattgctcaaactcattgtcacgcaggtgggcgactctaagatcatcctctgcgatcaagacgggattgcacacgcattaacaacaactcaccacatcaattccagtagggaacgacaccgtttgagcatagacccttctcgattggacccagacgcctttggagagacaaggtttttgaataatttcgccaacactagatcgtttggtgatgtcgctgggaaaccgtatggtatatctagtgagccggatattttctcgtttcttgtcggaaataccttgcatttgccgcgatctgaaaggtcgaagctgcccttcaatggtgatgaatgcttcctggcgcttgtcaccgacggcatcaccaataaacttgcagaccaagaggttgttgacctcatcacctctacggtgaactcctggggactgaaaaaggcgactcctcaatttgttgcagaggagacaatcaaatttattcaggcaatagccactaaacactcagacaacgccacttgcgtggtggttaggctttccaattggggcaactggcccaatgttgacagaactggcccccaaagagaaaccaaactaatgaatgcacaatctaacgaaacaaaattaaactaa

SEQ ID NO: 3134 - DNA, 1329 bp, Saccharomyces cerevisiae
atggccctctttctcagtaagagactgttgagatttaccgtcattgcaggtgcggttattgttctcctcctaacattgaattccaacagtagaactcagcaatatattccgagttccatctccgctgcatttgattttacctcaggatctatatcccctgaacaacaagtcatctctgaggaaaatgatgctaaaaaattagagcaaagtgctctgaattcagaggcaagcgaagactccgaagccatggatgaagaatccaaggctctgaaagctgccgctgaaaaggcagatgccccgatcgacactaaaacaaccatggattatatcactccatcttttgctaacaaagctggtaagccaaaagcttgttacgtcactttggtgagaaacaaggagttgaaaggtttgctaagctccattaaatatgtggaaaacaaaattaacaagaaattcccatatccttgggttttcctaaacgatgaaccttttactgaagaattcaaggaagcagtcaccaaagctgtttcttccgaagttaagtttggtattttgcccaaggaacattggtcatatcctgaatggattaatcaaaccaaggctgctgaaattcgtgcagatgctgccaccaaatacatatacggtggctccgaatcttatagacacatgtgtcgttaccaatctgggtttttctggagacatgaattattagaagagtacgattggtactggcgtgtggaaccagacatcaagttatactgtgatattaattacgacgtttttaagtggatgcaagaaaacgaaaaagtttacggctttaccgtttctattcatgaatatgaagtgacgatcccaacactatggcaaacgtccatggatttcatcaaaaagaaccccgaatacttagatgaaaacaacctgatgagttttctttcgaacgataatggtaaaacatacaatctgtgccatttctggtcaaactttgaaattgcaaacttgaatttgtggaggtcaccagcctacagagagtattttgacactttggatcatcaaggtggatttttctacgaaagatggggcgatgctcccgttcattctattgctgctgctttgtttttgccaaaggataaaatccattatttttcagacattggttaccatcatccaccttatgataactgcccattggacaaggaggtctataacagtaacaactgtgaatgtgaccaaggtaatgatttcactttccaaggttactcttgtggtaaggaatattatgatgctcaagggttggtaaagccaaaaaactggaaaaaattccgtgagtag

SEQ ID NO: 3135 - DNA, 1329 bp, Saccharomyces cerevisiae
atgtcaactgaacaagatgctgttcttggattggccaaagatttagaaggtataaatttgcttactgtgcccaatctcgagagaggacaccaaagtaaattatgcaaagagaaaactacttctgattcatcttcgtcaaggaagccttcacaacagagagacaattatagaaagagacgtccgaaacttatatgtatcccatatacgtcttttctgcatactggtatgcacaattttttgacgaaaccaccaagagatatatttcatgaaagtaaagaagtagctctgtttaccaatggccgggcttatacaatcctacgcaaagaccttataccaaatttgaaagaaagtattgctgaattgtatgaaagctcgcttcttgaggcaaaaaagcggaaagtcccgtatttaggccatgacttatttgctaatattgatgagttcgttcccatgacaatatccgaattagatagtgtatcaccgtgtttttcatacattgagaactggatactagataatcctggtaaggattttaagatcggcaagaaatttactgttgtaaccacaagacatcatatcgtagatttgactatgcatctctttaacaggcgaaatagacaaacgtcactaattgtaacttatatgggggcgggccttctttcattttgcagaaatgtaaaaaaagattctcaaatgtccaaagagggcatttattcaaatgatccaaatatgaagaaaatttgctattcaggatttgaatttgaaaattgggtaaccgaaaattccaaagtcgctgatttaactggctctaaatgtcctattttttctcttgtagagagtaaactttcagaagaaattggtcttttaattcgctgcgaaatggatgcattcaatcctgtttcggagacaaacacagaactaaagtgttttgccccattatcaatgcacaattccaatcataggagaaaacttctgaaaacgtgggtacagacgggtttattaccgaactcagatatcatgataggtttgagggacagtcatagcggtcaattactagacattcaatggtactcaagggacttattatgtaagaaattcaatcacccaggtctacctacaaataaaaaggaacttaactataatgcccaaattgcggtagaatggtgtcattattgtattgaagcaatttgtaagctggtggaggcaaatatctctgactatagcagtacaaaaccagaatcatttgaaatcggtatagatactaacaacgccatcgtcatcactaaacttaagactactccaagaaacgtagaattatttggaatgtag

SEQ ID NO: 3136 - DNA, 1329 bp, Saccharomyces cerevisiae
atgtcaagaagagtggttatcacaggattgggctgtgtaacgccgttgggaagatcattaagtgagtcatgggggaatctgctctcttccaaaaatggactcacaccaatcacatctttgcccaactataatgaggactacaaactcagagaaaaaagtatcccatcaacgataacagtggggaagattccagagaattttcaaaacgaaaattcagccatcaataaactgctgttcactagccaggatgagagaagaacctcaagctttatcaagctagcactacgtacaacttatgaagcgcttcacaatgctggtctcttgaacccaaatgatataaccatcaatacatctctgtgcaatctggatcactttggttgcctgataggttctggtataggatccattcaagacatataccaaacttctctacaattccataacgacaataaaagaataaatccatatttcgtccctaaaatccttacaaatatggcagctggtaatgtttccatcaagtttaaccttagaggattatcccatagtgtttccacagcatgcgcaacaggtaataactccattggcgatgcattcaattttattcggttaggcatgcaagacatctgtgtcgccggtgcaagtgaaacgagtttgcatccgttaagtttagcaggtttcatcagagcaaagtcgattactacaaacgggatctctagaccctttgatacacaacgttctggattcgtacttggtgaaggatgcggaatgattgtcatggaatcgctagaacatgctcaaaagagaaatgcaaacataatttctgagctcgtgggctatggtttaagcagtgatgcctgccatattacctcccctcctgctgatggaaatggtgccaaaagagcaatagagatggctctaaaaatggctagattagaaccaactgatgttgactacgtcaatgcacatgctacatcaactttactaggcgataaagcagagtgtctggcagtagcctcagcactcttaccaggaagatccaaaagcaagccactgtacatatccagtaacaaaggtgcaattggccatcttttaggtgcagctggcgccgtagaaagtatatttacaatttgttccttgaaggatgataagatgccgcataccttaaacctggacaatgttctgactctagaaaataacgaggccgataagctacatttcataagagacaaacctattgtgggagctaatccgaagtacgcattatgcaacagcttcggatttggaggagttaacacatctcttctcttcaagaaatgggaagggagttaa

SEQ ID NO: 3137 - DNA, 1332 bp, Saccharomyces cerevisiae
atgaaatacaaggaaatcaatttcttcaagggccatccgagctcgaggttgctgcctcgagaagcagtaattcaagcgactgcggctatattggggcccgagaccagggagtacgataacgacccctataacaggcatccgctgacgtacggttcggacgaaggtgccctgtgggtgcgagagcagatttgtacgtttctgaatgatcagctgtttaagttcgaaaatggggctcggagcaggacacgggcagactatttgaatctgaatagcggcgcttcgtatggcatgctgaacatccttctgcaaacaaccttgccacataacgggtataccaggcaggcgttcatcatcacgccaacatatttcttgatcaacaattgcttcacagatgcgggattcaaggggaaaatgaccgccatcaacgagcagggccacgactcgattgatttcgagtcgttgatttctgcccttgagcagcacgaggcggagccgcagccccatagtaccacagagatgattcaggggccaaagttgaccaagaaggtctacaggtacgttatgtactgcatcccgacgtttgcaaacccatcgggaaacacatactcgcttgagaccagacgcagacttatcgacatcgctcggaagtacgacatgctgataatcactgatgacgtgtacgatattctagattacacgacgccctcagatgagctgccctctccgcccctaaggatggtgcacatagacagaagtacagcgccctccggtgaggactcgttcgggaatacagtgtccaacgcaactttctccaagctgatcgcccctgggctcagatttggataccatgagtcaatcaacgcgaatctcgccagacagctatctaaaggtggtgcaaacgtctctggcggaactccctcacaactgaactccatgatcgtgggtgagatgctgcgtagtggtgccgcccagagatgcattgcacatctgagatccgtatactccgagagggccactgtcttgacctcggcgcttaagaaatacatgcccctaggaaccgagattatgccattgaagggcggctattttacttggatcactctcccaccagcgtacaatgccatggagatatccactattcttgccaagaaatttaatgtcatccttgccgacggctccaatttcgaggtcatcggcgatgagaaaaactggggtcagtcatgctttaggctttctattagtttcttagaagttgatgatatcgacaggggcattgagctgtttggtgctgtttgcaaatctcatgcgatcaccaataacataactatgtag

SEQ ID NO: 3138 - DNA, 1332 bp, Saccharomyces cerevisiae
atgaacagtacacctcctacgtcacccgtcaccagggtttctgatggttcctttccatccataagtaacaatagtaagggttttgcttatcgccaaccgcaaaaacataaaagtaacttcgcatattcacatctggtatctcctgtagaggagccgacagctaaattcagtgaggcattccagacagattattctagtaaggcgcccgttgctacctcggaggcgcacctaaagaacgatttagacgtattgttcactaccccccggttttactctccggagaatttggctttaatgttccgtctttctaatacagtttcttccctagaatttctggatgagtttttgatgggcatattacttgctccagagatggattttttgtcaaatccaagttattctcttccgtctaacaaattagtgggacagggaagttattcatatgtgtaccctatatcatcaagtgcttcatcaagatgtaacaacgattcaggggttgttttaaagtttgccaaatcacagcataaaagcaaggtgattttacaggaagctttgacgctagcatatctccagtacatgagtccttcaaccaatgaaagtcatattattccattctatgggttgacatacataactaaatcccattttagaagactgaggtccaacgaatgtgttcctggccttattcttccgaaatgcgaaatgagtttatatcacttcaatacagcagtgtcacataagctttcgttgataacaaaaagaaaaatatggtggagacttatgaagcaaatgatagacgcattaaaatctttgaaaacaaatggtataattcatggtgatataaaaacagcaaatattttaataacagaaatgcatgttcttaatggaggccattgtaaggattttgacttctaccttgctgactttacgtcggcatttcacattaatcaaacaccaacagatctgaataccacggtagaatactgtgcaccagaactaattgatagctcctccgatcatgttcctacatttgaatcggatttgtatgccgtggggctttgtcttttatcatttatatcgcagcatgagccttacaacgaacttcaggcgttagtgtcgcatggatcctctccaggtattggcagttcatctatacagcagtcccaatggctgataaatgctcttttgaaaaaagatcctataaatctaaacatgttaagaaacgatttattccaggattggaagtcagaactagcattattgtccagaattctggttgatagacttcctctagaaaatctcataactatactcgatagtaactatatatga

SEQ ID NO: 3139 - DNA, 1332 bp, Saccharomyces cerevisiae
atgagaggctttagtaatgagataatcctgaagagaacgttgactttatccgatttcaccttacgttaccataaaaggggcatcacagctttgcaggtcatcaaagcaccgtcagtttcgaatgtgccagtcttgttatccggtgataactacggttatttcgttatgtgggacctggtgaccaagagaccgattacacatatagaaatcgagggcaactcgcacattatagcgttttggtgggtggaaactaccaatgtgctgtacattctttcgaaagactccatgctgcgaatttttgagcttgattcatctacacaactatctatagatttagttagaaagcttagccaagccaataaaacggatcatttacaatggactaaaatctatgaaatgcccataaacacactgaattttgcgaatttcatcatcgaagctgaagtgaaaccaaccaaagataataaaagttatagattggtttgctgtcatactgatgattcggaaactatcgatatatatcagataatagaagactccacatttaaattgaaaagaccattcaataatattaatttccccagattcttgaagcagcagaattttttaggaatttcgaaagactccaaattcggtatcataatgagatttgctaaattaaacgatgtcatatttttaggttatgaaaatgggtttgtagtcggatttaaaattacttttgatgaaggccttcaaagggacattgcagaactggtccatgtttctaacgatcattatccgaatccaatacttgatatgtgtgttagcggggatgaactttatagttgttcaacagacgatttcataaccaagtacaaaattccagtgaacttacaacttgagacgaaataccttagagatgatgcgcttttgataaaatgcccaagctcactgagagtcagtgagccatcaaaagtacatcttcccttgaagaatattggtcatattgataaagtaaaagacgattacttagtcgtgagtagttggtcaggtatgaccattgtttataatatgcggacttcagaagtggagcaaacttttgtgaaatcaaagaacaacctggtcgtgagtgatagctctatgggagacctaacaaacggtagcggctcaaataccgaatccagctcgaaatcccataactataaagtgggagccatgacatgtttggaatcgtttgatgtgcagtcagatgggttgaggttaggacaacttagacgtattaaagcgctggcgaaatgtaactggtgtttaattggatatgaagatggtaccataaagctcaataaaatataa

SEQ ID NO: 3140 - DNA, 1332 bp, Saccharomyces cerevisiae
atgagtatggataacaatgatgaccatgaatctaaattgtcaatcttgatggacatgtttccagctatttccaaatccaaattacaagtacatttacttgaaaacaataatgatttggatttaacgataggcttgctgttaaaagaaaacgacgataagtctacagttgataatgaattacatcaactgtacgacatgtttcctcagcttgattgcagcgttataaaagatcagtttgtaataaatgagaagtccgtagaatcgactatttctgatcttctgaattatgaaaccctgcaaaaacttaaagacaatcaagcaaattctcctgatagcgtaaaaaggaacgaaaagaaaaataattgggaatcaacaaacgatcacatagagagtataataaagtttaccgacgctcccaaaaatattgcgcaggaatacttagccgaaaatggttttgatacagtaaaggcgatcatcaaaatcattttggattattacgacaaaagggattttaaaaaagatgtggatactttcaaagtaaaacggagtcctaatacgactgtgagaggtggtcgagttcaatcatcgacggggcttgcccacgttttgaaaaagggtaaagaatccgcaaatgttgctcaagagagtctcaaaaggccaaggagttataagcactccttggatagtccgcagatggttgagttaaatgaattagttgcagataatcgcgatctcaaagccataaaccatgaatttttgcaaaaatgcctgcaattttatgatggagatgttgtaaaggtgttgaacatatcgtccttattgatcgaagatgacaagaatattacgaaaacttggaactttgacgaaggttttaccttgacatccagagataattgtaagcaacatttacccaaattttcaacaccgcagatttcccgcagaaatgaggtaggaaatacttataaattgccccttcatgacaaagaaacccccgagggagctgtgccggttataaataacctgtttcaaacatacagattggatttccatggttttcttcccagtgaagcggtttcaacactgaaacttgcattaaataagtggtggtccaaagaggtagcagaacgagagttgaactcccacaacataaactcatatggctcaaaagtacagtttgtaagcccgttaatcgtggtaactggtagaggtatccacagcatcggcgggatctcaaaggttcgactgcaggttaaaagttttcttgaaaaaaatcactacatattttgggaagaatcttcctacttcagaattgagggtaagaagaagaaataa

SEQ ID NO: 3141 - DNA, 1332 bp, Saccharomyces cerevisiae
atgtcaagagatgtaagggcagagaaactagccatatcactattgattttatcattgtttctaatattccaattagtggctgagatttatctcaataatggtgatcagtaccatacagagactagcccctttacaagaggaagatcacatgtaacgcgtgtgcccaaccatgatgctagtttatctataccgtttttggacaagatcaaccagttttggcatgtaggcggtgccacgcaaattaggaatattcagtcgatcaaattgactcaggaccgtgatcaagataaacatggattagtattgtccaatggaattggcgacaacaccatcaatgactttgagattgttttcactttcagaatttctcacgaccccactacacaactcactggtgatggaatgtgttttgccattacgcccgaaaatgggtttctcacacagaatttacagtcgtcgtatgcgaaaaagcaatacatgatgaattctcagggcgtcatagccgataatacagatctgatgggcttcccgaaaaatctgcctggcctatttattgtcttggatacgtatcgcaaccaaggccacgaccataaggaggtaccctttatggatgtgtttataaatgtggccccagaaagcgattggtacgatataaatagtgatggtgaactcagtacatcgctgcggcttaattcaagaggccacataaaactcaagaaaaatgccctgtggaatcgagtcacgaaactaagaataatatatttggaaagtataagcttcctgaagatcgacgtgcagtacgcaaaagagggaaactactggattgagttatttcaaacaaccgaaaatctgtacttgccgaaaaacatgcacacggggcaaagatacattggctgtagcgcattaaatggccaattaacggagacagtggagctgctggacgtatccactagcgaattccattggaacgacatggatgcgtccattgaggacacctatgattacgcaaaggaagctgagctattcctggagcaggaatttggcgaggtccttgacagggaacccgatgagttcaccaaatggaaaatgatcaaagctcaaccaaacatcaagactgggtcacagtcagctgaacagaaaacttcaaacaatcctcactctcggttgttcaaggtcgtgctgaccatatggcattatagcgagattttgctattgatcatgggcatttatcttttttctgcttgcataagagttttccaaagaaggttcaaaaaaattagatccagaagaaaaagggcaggctcgcattctgtggggctattgcccatgtag

SEQ ID NO: 3142 - DNA, 1332 bp, Saccharomyces cerevisiae
atgtcattaccgttcttaacttctgcaccgggaaaggttattatttttggtgaacactctgctgtgtacaacaagcctgccgtcgctgctagtgtgtctgcgttgagaacctacctgctaataagcgagtcatctgcaccagatactattgaattggacttcccggacattagctttaatcataagtggtccatcaatgatttcaatgccatcaccgaggatcaagtaaactcccaaaaattggccaaggctcaacaagccaccgatggcttgtctcaggaactcgttagtcttttggatccgttgttagctcaactatccgaatccttccactaccatgcagcgttttgtttcctgtatatgtttgtttgcctatgcccccatgccaagaatattaagttttctttaaagtctactttacccatcggtgctgggttgggctcaagcgcctctatttctgtatcactggccttagctatggcctacttgggggggttaataggatctaatgacttggaaaagctgtcagaaaacgataagcatatagtgaatcaatgggccttcataggtgaaaagtgtattcacggtaccccttcaggaatagataacgctgtggccacttatggtaatgccctgctatttgaaaaagactcacataatggaacaataaacacaaacaattttaagttcttagatgatttcccagccattccaatgatcctaacctatactagaattccaaggtctacaaaagatcttgttgctcgcgttcgtgtgttggtcaccgagaaatttcctgaagttatgaagccaattctagatgccatgggtgaatgtgccctacaaggcttagagatcatgactaagttaagtaaatgtaaaggcaccgatgacgaggctgtagaaactaataatgaactgtatgaacaactattggaattgataagaataaatcatggactgcttgtctcaatcggtgtttctcatcctggattagaacttattaaaaatctgagcgatgatttgagaattggctccacaaaacttaccggtgctggtggcggcggttgctctttgactttgttacgaagagacattactcaagagcaaattgacagcttcaaaaagaaattgcaagatgattttagttacgagacatttgaaacagacttgggtgggactggctgctgtttgttaagcgcaaaaaatttgaataaagatcttaaaatcaaatccctagtattccaattatttgaaaataaaactaccacaaagcaacaaattgacgatctattattgccaggaaacacgaatttaccatggacttcataa

SEQ ID NO: 3143 - DNA, 1332 bp, Saccharomyces cerevisiae
atgtctttataccctttacaaagatttgaatcaaatgacacggttttcagttacactttgaattctaagactgagctgtttaacgaaagccgcaataacgacaagcaacattttacccttcaactcataccaaatgccaacgccaatgccaaggaaattgacaataataatgtagaaattatcaacgatctaacaggcaatactattgtcgacaattgtgtaactacagctacttcatcaaatcagttggagagaaggctttcgatatccgactatcgtaccgaaaacggtaactactacgaatacgagttttttggtaggagggaacttaacgaaccattatttaataacgacatcgtagaaaatgatgatgacatcgatctaaataatgaaagtgatgtattgatggttagcgacgacgagttggaggtaaatgaaagattttcctttctcaagcaacagcctcttgacgggctgaacaggatttccagtactaataacttgaaaaatctggagatacatgaatttataatagatccaacggaaaacattgacgatgagcttgaagactcttttaccactgtgccccaatctaaaaaaaaagttagggactatttcaaattaaacatattcggcagtagtagcagtagtaataataacagtaatagccttggttgtgaacccattcagaccgaaaactcttcctcgcagaaaatgttcaaaaatagattcttcagaagtaggaaaagcactctaatcaagtctcttcctcttgagcaagaaaatgaagtgcttataaattcagggtttgatgtttcctctaatgaagaaagtgatgagagtgaccacgcgataataaatccgttaaagctggtgggaaataacaaggatatctctactcaaagcattgctaagacaacgaatccatttaagtctggcagtgattttaagatgattgagccagtttcaaaattcagcaatgattcgagaaaggacttattggctgccatatcagaaccatcctcttctccttctccttctgcaccatcaccttcagtacaatcttcctcttcttctcatggcttagtggtgaggaagaagacaggaagcatgcagaagacgcgcggaaggaagccctctttaattccggacgcttccaagcaatttggttgtgaattttgcgatagaagatttaaaagacaagagcatttgaagaggcatgtcagatctttacatatgtgcgaaaaaccatttacatgccatatctgtaataagaacttcagcagaagcgataatttgaatcagcacgttaaaactcacgcttccttatga

SEQ ID NO: 3144 - DNA, 1335 bp, Saccharomyces cerevisiae
atgaaacaacgattcattcgtcaatttacgaacctaatgtctacttcgagaccgaaagttgttgccaacaaatatttcacttctaacactgccaaagatgtttggtcgctaaccaatgaagccgctgcaaaagctgccaataactccaaaaaccaaggccgtgaacttattaatttaggccaaggctttttttcatattcccctcctcaattcgccattaaggaggctcagaaagccctagacattccaatggtcaatcaatattctccaactagaggtcgaccttcattaattaattccttgattaagttgtattctcctatttataacacagaattgaaagcggaaaatgttaccgtaacaacaggtgccaatgaaggtatactttcttgcttgatggggcttttgaacgctggcgacgaggttattgtttttgaacctttctttgaccaatatattccaaatatcgaactttgcggtggtaaagttgtttacgtccccataaatcctccaaaggaattggatcaaaggaatactagaggtgaagaatggaccattgactttgagcagttcgaaaaagcgattacatccaagacaaaagctgtcattatcaatacccctcacaacccaattggtaaagttttcacgcgcgaggaattaaccactttaggtaacatttgcgtcaagcacaacgttgtgattatatctgatgaagtctatgaacacctttacttcactgattctttcactagaattgccacactctctccagaaattgggcaactaaccttaacggtcggttctgccggtaaatcgtttgctgctactggttggagaattggttgggtcttatccttgaacgcagagttgttaagttatgcagctaaggcacatacaagaatttgttttgcatctccatcccctctacaggaagcttgtgcaaactctattaacgacgctttaaaaattgggtattttgaaaaaatgagacaggaatatatcaacaaattcaaaattttcacatcgatctttgatgaattgggactaccatatacagctccagagggtacatattttgtcctcgttgatttctctaaagtgaaaattcccgaggactatccctacccagaggagatcctgaataagggaaaagattttcgcatttctcactggttgatcaatgaattaggtgtggttgccattccaccaactgaattctatatcaaagagcacgaaaaggctgctgagaatttgttaaggtttgcagtttgtaaagatgatgcttatctagaaaatgccgtagagagattaaaactactcaaggactacttataa

SEQ ID NO: 3145 - DNA, 1335 bp, Saccharomyces cerevisiae
atgaacgtcgttgtgtgctccggtgggactgccacaaattcattgactccttgcttttctaatatttctatcttaaaaggacatgagctgacgtatatattgccaatatcagataatggcgggtccacaagtgaaattctacgaatagttggtggcccagcaattggtgatatcagatctagaatagtgagactacttcaagatgaacagcttgtcgagttgtttggccataggctacctaatgataagttattagctaagaaagaatggaatgaaatagtggaaggttcgcatcccatatggaaaaatatttcgatagaagttaaggaaatgtgtcgttcttttattatccatatgcaagcagaactcttgaaaaaaatcaaacactcgaatccatttcagtttgagagtgcatccattggaaattttttcttaactggtgctagattgtttttaggttctctagacgcatctattgaactaatgatgaggataggaaggtgcagtcctctagttcatgttattccatgtataaataccaatcacacacatcatatctcggctttgttgacgaatggtgagatgataactggccaatcacaaatatcgcatccctcgaaatctgttcctaaagataatagcatagcacattcagctaaatttattcatttacttggctcttatgacgaccatttgaaaattctcctcgacgatgaggaagaagaagcggaagaggagtatgccaatcctatctatattcttccagaactgaaaaactcccagttgcattttgacaagcttgatgaatcacagaatctacctgctccggtacataggatattgtatataaacccatatggcgaagagataaaaccaatgggaaatccaagagctatttccaaggtgaaaaaagctgacatggtcgtttattctatcggttctttaatgacaagtttactcccaatccttattcttggtaatcttgctgaagtaattttggaatctaataatacgaaaaaagttttgctcataaataataaatatgatagagaggtttttggtttagacggtttacactacgttcaaatgatcatagattctatgagtagggcaatagcaggctataggcaatctaagggtgtccattcagagaatgatgactttgaatggcaagattttattactgatattgtttacctaaaaaatggtgaaattgaaattgatgaaacgatattcgagaagcatagtattagatgccaccagatcgcgtcttcggataagatggaaagtgaagaacttgaaaaggttctgaatcaaattggccttaaaaactga

SEQ ID NO: 3146 - DNA, 1335 bp, Saccharomyces cerevisiae
atgactacaagaaagacagcttcctctcttcagcttttagggaaaatcacaggaacaaaagctggaactaagcaaaagaagatgaatttcattaatggactgatatggttatatatgtgtgtgtggatggtacacggaaaagtgacgcagaaggatgaattgaaatggaataaaggatactcgctaccaaatttgctagaagtgacagatcagcaaaaagaactttcacaatggactttgggtgacaaagtaaaacttgaagaagggaggtttgttttaactcctggaaagaacacaaagggttcactttggttgaaacctgaatattcaataaaggatgcaatgacaatagagtggacgtttagaagtttcgggttcagaggcagcacaaaggggggtcttgcattttggctgaagcaaggaaatgagggagatagtaccgagttatttggtggaagttcgaagaagtttaatggtttgatgatattgttacgattagacgataagttgggagagagcgtgacagcgtatttgaatgacggaacaaaagatcttgatattgaatcctcaccgtactttgcgtcatgtctgttccaataccaggattccatggtaccatcaacattaagattgacttacaatccactagataatcacttgttaaagttgcaaatggacaacagagtgtgtttccagacaaggaaagttaaatttatgggcagcagcccatttaggattggaacaagtgctatcaacgatgcatccaaagaatcgtttgaaatcttgaaaatgaagctttatgacggagttatagaggattcgctaattcctaacgtgaatcctatgggacaacccagagtggttactaaagtgatcaattctcaaactggtgaagagagtttcagggaaaagatgccattttctgataaggaagaaagtataacgagtaacgagcttttcgaaaagatgaacaagttggaggggaaaatcatggcaaatgatatcgatccattactccgcaagatgaacaagattgtggagaatgaacgtgaactgattcaacgtttaagaccactgttagatctgaagaaaacagccataagtgacgatagtttccaagattttctttcgatgaacgcaaacctggacagattgataaaagaacaagaaaaaattcgacaagatgccaagctgtatggcaagcagaccaaaggtcatgatgagatattttccaaaataagtgtatggttggcactgctgattttcattatgatcacattggcgtactacatgtttagaattaaccaagacatcaagaaggtcaaacttctgtaa

SEQ ID NO: 3147 - DNA, 1335 bp, Saccharomyces cerevisiae
atgagcgtcattcatcctttgcagaatttactcacctctcgtgatggctcattagttttcgccatcattaagaattgtatcttaagcttcaaatatcaatcgccaaatcattgggaatttgctggaaaatggtctgatgatttcgacaaaattcaagaatcgagaaacaccactgctaaggagcaacaaggacaatccagcgaaaacgaaaacgagaacaaaaaattgaaaagtaataaaggcgattccattaaaaggacagcagccaaggtaccatctccaggtcttggcgccccaccgatatattcgtacataagaaatctgagattaacttcggatgaatcaagactaattgcgtgcgcagattctgacaagtccctcctagttttcgatgtcgacaaaacttccaaaaatgtcttaaagttgagaaaaaggttctgcttctcaaagagaccgaatgctatttctatagccgaagatgatactacagtcataatagctgacaaatttggtgatgtatattctattgatattaattctatcccggaagaaaagtttactcaagaacctattctcggtcatgtctctatgttgactgatgtacacttgattaaagactctgacggtcatcaattcataattacaagtgatagagatgagcatattaaaatttcgcattatccccaatgtttcattgtggacaaatggctctttggtcataagcattttgtttcttccatatgctgtggcaaagactatttattattaagtgcaggtggtgacgataaaatcttcgcttgggattggaaaactggtaagaacttgtctaccttcgattataatagtttgattaaaccttatttgaatgatcagcatttagcaccaccaagatttcaaaatgaaaataatgatattattgaatttgcagttagtaaaattataaagtcaaagaacctaccgtttgttgcgtttttcgtcgaagctacaaaatgcataataattctggaaatgtccgaaaaacaaaaaggggatcttgcactaaagcaaattataacttttccatataatgttatctcattatccgcccataatgatgaattccaagtcaccctagataataaggaatcatctggtgtgcaaaaaaattttgccaaattcattgaatataacttaaatgagaatagttttgtcgtgaataatgaaaaatcaaacgaatttgacagtgccatcatacaatcagtacaaggggattctaacttggtgaccaagaaagaagaaatttacccgttatacaatgtttcctcgttaagaaaacatggagaacattactcgtga

SEQ ID NO: 3148 - DNA, 1335 bp, Saccharomyces cerevisiae
atgcaattacattcacttatcgcttcaactgcgctcttaataacgtcagctttggctgctacttcctcttcttccagcataccctcttcctgtaccataagctcacatgccacggccacagctcagagtgacttagataaatatagccgctgtgatacgttagtcgggaacttaactattggtggtggtttgaagactggtgctttggctaatgttaaagaaatcaacgggtctctaactatatttaacgctacaaatctaacctcattcgctgctgattccttggagtccatcacagattctttgaacctacagagtttgacaatcttgacttctgcttcatttgggtctttacagagcgttgatagtataaaactgattactctacccgccatctccagttttacttcaaatatcaaatctgctaacaacatttatatttccgacacttcgttacaatctgtcgatggattctcagccttgaaaaaagttaacgtgttcaacgtcaataacaataagaaattaacctcgatcaaatctccagttgaaacagtcagcgattctttacaattttcgttcaacggtaaccagactaaaatcaccttcgatgacttggtttgggcaaacaatatcagtttgaccgatgtccactctgtttccttcgctaacttgcaaaagattaactcttcattgggtttcatcaacaactccatctcaagtttgaatttcactaagctaaacaccattggccaaaccttcagtatcgtttccaatgactacttgaagaacttgtcgttctctaatttgtcaaccataggtggtgctcttgtcgttgctaacaacactggtttacaaaaaattggtggtctcgacaacctaacaaccattggcggtactttggaagttgttggtaacttcacctccttgaacctagactctttgaagtctgtcaagggtggcgcagatgtcgaatcaaagtcaagcaatttctcctgtaatgctttgaaagctttgcaaaagaaagggggtatcaagggtgaatcttttgtctgcaaaaatggtgcatcatccacatctgttaaactatcgtccacttccaaatctcaatcaagccaaactactgccaaggtttccaagtcatcttctaaggccgaggaaaagaagttcacttctggcgatatcaaggctgctgcttctgcctctagtgtttctagttctggcgcttccagctctagctctaagagttccaaaggcaatgccgctatcatggcaccaattggccaaacaacccctttggtcggtcttttgacggcaatcatcatgtctataatgtaa

SEQ ID NO: 3149 - DNA, 1335 bp, Saccharomyces cerevisiae
atgccatctcatttcgatactgttcaactacacgccggccaagagaaccctggtgacaatgctcacagatccagagctgtaccaatttacgccaccacttcttatgttttcgaaaactctaagcatggttcgcaattgtttggtctagaagttccaggttacgtctattcccgtttccaaaacccaaccagtaatgttttggaagaaagaattgctgctttagaaggtggtgctgctgctttggctgtttcctccggtcaagccgctcaaacccttgccatccaaggtttggcacacactggtgacaacatcgtttccacttcttacttatacggtggtacttataaccagttcaaaatctcgttcaaaagatttggtatcgaggctagatttgttgaaggtgacaatccagaagaattcgaaaaggtctttgatgaaagaaccaaggctgtttatttggaaaccattggtaatccaaagtacaatgttccggattttgaaaaaattgttgcaattgctcacaaacacggtattccagttgtcgttgacaacacatttggtgccggtggttacttctgtcagccaattaaatacggtgctgatattgtaacacattctgctaccaaatggattggtggtcatggtactactatcggtggtattattgttgactctggtaagttcccatggaaggactacccagaaaagttccctcaattctctcaacctgccgaaggatatcacggtactatctacaatgaagcctacggtaacttggcatacatcgttcatgttagaactgaactattaagagatttgggtccattgatgaacccatttgcctctttcttgctactacaaggtgttgaaacattatctttgagagctgaaagacacggtgaaaatgcattgaagttagccaaatggttagaacaatccccatacgtatcttgggtttcataccctggtttagcatctcattctcatcatgaaaatgctaagaagtatctatctaacggtttcggtggtgtcttatctttcggtgtaaaagacttaccaaatgccgacaaggaaactgacccattcaaactttctggtgctcaagttgttgacaatttaaagcttgcctctaacttggccaatgttggtgatgccaagaccttagtcattgctccatacttcactacccacaaacaattaaatgacaaagaaaagttggcatctggtgttaccaaggacttaattcgtgtctctgttggtatcgaatttattgatgacattattgcagacttccagcaatcttttgaaactgttttcgctggccaaaaaccatga

SEQ ID NO: 3150 - DNA, 1335 bp, Saccharomyces cerevisiae
atggagtatggacatcacgctagaccagattcaaaacgaccattggatgaaggatcaccagcagccgcaggattaacttctaagaaggcgaacgaagctttaacaagaaatagagaattaacaactgtattagtcaaaaatttgcctaagagctataatcaaaacaaagtctataagtacttcaaacattgtgggcccattatacacgttgatgttgcggattcgctgaagaagaactttcgttttgcacgtattgaatttgccaggtatgatggagccctcgctgcaataaccaaaacacacaaagttgtaggtcagaatgaaattatagtatctcatttaacagaatgcacattatggatgacgaatttccccccaagttatactcaaagaaatattagagatctattgcaagatattaacgttgttgcactcagtatacggcttcccagtttacgattcaatacaagcagaaggttcgcttacatcgatgttacttctaaagaggatgcaagatattgtgtagaaaaattgaatggactcaaaatagaaggttatactttagttactaaagtttccaatccgctggaaaagtcgaaacggaccgattctgccacactagaggggcgagagattatgatacgaaacctaagtacagaattgctcgacgaaaaccttctgagggaatcttttgagggatttggttccattgaaaaaatcaacatacctgctggacagaaagagcacagtttcaataactgttgtgcatttatggtttttgaaaataaagattctgctgaaagggcacttcaaatgaatagaagtttgttaggtaatagggaaatttccgtttccttggctgataaaaaaccattcttagaaagaaacgaagtcaaaagacttctcgcatcgcgtaacagcaaagaactagaaacactaatatgcttatttccactttcagataaggtgtcaccaagcttaatctgccaatttcttcaggaagaaatacacatcaatgaaaaagatattaggaaaatacttctcgttagcgacttcaatggcgccattattatatttagagatagtaagtttgcagcaaaaatgctaatgatactaaatggatctcaatttcagggaaaggtgatacgttcaggtactattaatgacatgaaaagatattataacaatcaacagaatcacagcatgaaacacgtcaaacctagttgtataaacatgatggaaaaaggaccaaatcttcaagtaaagaaaaaaattcctgacaaacaagagcagatgtccaacgacgattttcgcaagatgtttctaggtgagtag

SEQ ID NO: 3151 - DNA, 1335 bp, Saccharomyces cerevisiae
atgggaaagctattacaattggcattgcatccggtcgagatgaaggcagctttgaagctgaagttttgcagaacaccgctattctccatctatgatcagtccacgtctccatatctcttgcactgtttcgaactgttgaacttgacctccagatcgtttgctgctgtgatcagagagctgcatccagaattgagaaactgtgttactctcttttatttgattttaagggctttggataccatcgaagacgatatgtccatcgaacacgatttgaaaattgacttgttgcgtcacttccacgagaaattgttgttaactaaatggagtttcgacggaaatgcccccgatgtgaaggacagagccgttttgacagatttcgaatcgattcttattgaattccacaaattgaaaccagaatatcaagaagtcatcaaggagatcaccgagaaaatgggtaatggtatggccgactacatcttagatgaaaattacaacttgaatgggttgcaaaccgtccacgactacgacgtgtactgtcactacgtagctggtttggtcggtgatggtttgacccgtttgattgtcattgccaagtttgccaacgaatctttgtattctaatgagcaattgtatgaaagcatgggtcttttcctacaaaaaaccaacatcatcagagattacaatgaagatttggtcgatggtagatccttctggcccaaggaaatctggtcacaatacgctcctcagttgaaggacttcatgaaacctgaaaacgaacaactggggttggactgtataaaccacctcgtcttaaacgcattgagtcatgttatcgatgtgttgacttatttggccggtatccacgagcaatccactttccaattttgtgccattccccaagttatggccattgcaaccttggctttggtattcaacaaccgtgaagtgctacatggcaatgtaaagattcgtaagggtactacctgctatttaattttgaaatcaaggactttgcgtggctgtgtcgagatttttgactattacttacgtgatatcaaatctaaattggctgtgcaagatccaaatttcttaaaattgaacattcaaatctccaagatcgaacagtttatggaagaaatgtaccaggataaattacctcctaacgtgaagccaaatgaaactccaattttcttgaaagttaaagaaagatccagatacgatgatgaattggttccaacccaacaagaagaagagtacaagttcaatatggttttatctatcatcttgtccgttcttcttgggttttattatatatacactttacacagagcgtga

SEQ ID NO: 3152 - DNA, 1335 bp, Saccharomyces cerevisiae
atgtttcatggcgctaaaggacctttattgatagaacgcattggtcatttactttctatcaattatggcgagaaagaggaacgaaaacgatgggccatgcaaggcattagttatttacaggaagtccagtgtacaagcactccctatttggaaattttggtagaagagagcggattaagacctgtgagcctactaaacagccaactagtaggaaaacctcatttttcattgcttggaggattcgatgaaaacatcgcacgagatataatttcacataattttcagaacgcaatatttcaaatggagtcagaagaggttccattgactaaacgatatcagcatttagaaaaaattacccaaatatccctactatgcaagaatttcaaaggcattgaagaaatagaatataatgtgaaaaatatcattcaaggccgtaaaaattttgatatgttaaattccatggaaaaagatcggataagtcatgaagttgttcaagatgattccttctcacttctcaggatacaaatgttgctttgcgtctcatatttccttcaggaaaggtattttgactgttgcacaaaattttttacaatgatgacttcggaacctttaacattgaaagttctgtcagaacacttagactgcatgaattttatatcgaaagaggagtttataatgatggtgaatatatccgtacttatttcaatacctttggataattatgatgattttatctatttgagtgatttaaagcaattttttcagatgacacccttattggttaattgtctcgaactgttgataaacactaatttcaacaaatttttcaaaatttggcatggtgaaataaataaaatatgcatggaaagcctttttttggaacctagctggtcgtcgtcggctgctgttatcatgaggtgcaaaatatatttcttttacttaaggatatcaaaaaagctacagttttcttatttatcatctacactaggtattgatttggaggatattaaggaagaattgacaaagttaataatatcagggcagttaaatttcgaaattgacggggacgtgatacactttgaggatagttctattttacaaagtattgttaacgaaattagcagaaatggcaccatgataaacgaggttatagataaactaaaaaatgaaaacacggatttgaaagacattatccaaggtaatccactaatgtatagcggtggaaacaatacagcgactattatcaataatgaaagcagtgacgatatggacatagatgaagttaacgatagaagtgatattagtgattcagagggaggtttgtttgaatgctga

SEQ ID NO: 3153 - DNA, 1335 bp, Saccharomyces cerevisiae
atgtttgtttcaccacctccagcaacagcgaggaaccaagtattagggaaaagaaaatcgaaaagacatgacgaaaatccaaagaatgttcaacccaacgctgacacagaaatgacaaatagcgttccttctattggattcaacagcaatcttccacataataaccaagaaataaacacaccaaatcactataatttgagttccaattcaggaaatgttaggagcaacaacaattttgttactacaccaccagaatatgcagacagggcaagaatagaaatcataaaaaggttattgcctactgcaggaactaaacctatggaagtgaacagtaatactgcagaaaatgcaaatatccaacacataaataccccggacagtcaaagttttgtttcagaccattcatcttcatacgaatcgagtatattttcacagccatctactgctcttacggacatcaccacaggcagctcgttaattgatacaaaaacacctaagttcgtcacagaagtaacacttgaagacgctttacccaaaacattctatgatatgtattctcccgaagttctgatgtctgatccagcaaatatactttataacggacgtcctaagtttacaaagcgcgaattgctggactgggatctaaacgatatacgatccttgttaattgtggaacaattaaggccagaatggggttcccagttaccgacggtagtgacctccggtataaacttaccgcaattcagactacaattacttcccctaagttccagtgatgagtttataatagcgacattggttaactcagacttatacatagaagcaaatctagaccgcaattttaagttgacaagcgcaaaatatacagttgcatcagcaagaaaaagacatgaagaaatgactgggtcaaaggaacccattatgcgtctatcaaagcctgaatggagaaatataattgagaactatttattaaatgttgccgtcgaggcccaatgcagatatgactttaaacaaaagcgctccgaatacaagagatggaaattactaaattcaaatttgaaaaggcctgacatgccgcctccaagcctcataccgcatggttttaaaatacatgactgcactaactctggtagtcttttaaaaaaggctttaatgaaaaatttgcaactaaaaaattataaaaatgatgctaagacattaggtgctggtacacagaaaaatgtcgttaataaggtttctctaacttcagaggagagggctgccatctggtttcaatgccaaacacaggtttatcaaaggttggggttagattggaagcctgatggaatgtcctag

SEQ ID NO: 3154 - DNA, 1338 bp, Saccharomyces cerevisiae
atgatgatgttaattactatgaaaagtacagtactgttgagtgtttttaccgtcttagcgacatgggctggattgctagaagctcatccattgggtgacacttcagatgcatccaaattaagctcagactactcgctccctgatctcattaatgcacgtaaagtgcccaataactggcaaactggagaacaagctagtctagaggaagggagaattgtattgacttctaagcaaaattccaagggttcactttggttgaagcaaggattcgatttgaaggattcttttactatggagtggacatttaggagtgttggttattctggccaaaccgacggtggcatatcattttggtttgttcaagattctaacgtaccacgcgataagcagttatacaatgggccagtgaactatgatggtttacaattattagtggataacaatggtccattgggcccaacacttcgtggtcaactaaatgatggtcaaaagcctgtagataagacgaaaatctatgatcagagttttgcatcttgtttgatgggttatcaggattcctccgttccttccacgatcagagtaacttatgatttggaagacgacaacttattaaaagttcaggtggacaataaagtctgtttccaaactaggaaggttcgctttccctctgggtcttaccgtattggtgtcaccgctcaaaatggagcagtgaataataatgcagagtcttttgaaatattcaaaatgcaattttttaatggcgtgattgaagattctttgatccctaatgtgaatgcaatgggtcagccaaaactgatcaccaaatacattgaccaacaaaccggcaaagaaaaattgattgaaaaaacagcatttgacgctgacaaagacaaaattacaaactatgaattgtataagaaactggatagagttgaaggtaaaattcttgcgaacgatatcaatgctttagaaacaaagctaaatgatgtcattaaggtccaacaagagctattatcattcatgactacgataactaaacagctctcttctaagccaccagctaataatgaaaagggaacgtccaccgatgatgcaatcgctgaggataaagaaaatttcaaagacttcttatcaatcaatcagaaattggagaaagtcctggttgaacaagaaaagtatagggaagctaccaaacgtcatggacaagatggtcctcaggtcgacgaaattgccagaaaactaatgatttggttacttccattaattttcattatgttggttatggcatattacacattcagaatcagacaagagatcataaagaccaaactgctatga

SEQ ID NO: 3155 - DNA, 1338 bp, Saccharomyces cerevisiae
atggcaagtctacctggtattgatgagcatactacctctgaagaattgataactggtgataacgaatggcacaagttggttattcccaagggcagtgattggcaaattgatcttaaagcagagggaaaactgatagtcaaggtaaactcgggcatagttgagatatttggcaccgagttggcagtagatgatgagtacacttttcagaactggaagtttcccatatacgctgtcgaagaaacagaattattatggaaatgtcctgatttaactacgaatacaataactgtcaagcctaaccatactatgaaatatatttataatctacacttcatgttggagaagatacgaatgtctaactttgaaggccctcgagtggtgattgttggtggttcgcaaaccgggaagacttccctatcgaggacactatgttcttacgctttgaaattcaacgcttaccaaccactatacatcaatcttgaccctcaacagcccatttttactgttcctggatgcatatctgccaccccaatatcagatatacttgatgcacaactacccacttggggtcagagtctcactagtggtgccacactactacataataagcagccaatggtgaaaaattttggcctggaaaggattaatgagaacaaagatctataccttgagtgtataagccagttaggtcaagtagtaggtcaaaggttacatttggatcctcaagtcaggagatcagggtgcattgtcgatacgccatcaatatcacaactggatgaaaatttggctgaactgcaccatatcattgagaaactcaatgttaacattatgctagtactatgttctgaaacggatcctctttgggagaaagtaaaaaagacatttggtccagaattgggaaataataatatttttttcattcctaaattggatggtgtatccgcagttgatgatgtatacaaaagatccttgcagaggacatccataagagagtacttttacggctctcttgatacagccttgagtccttatgctattggtgttgattatgaggatttaactatttggaaacctagcaatgttttcgataacgaggtcggtagggtggaactgttccccgtcactataactccaagtaacctacagcacgctattatagccataacgttcgcagaaagaagggcagatcaggcaacagtaataaaatcgcctattttaggattcgctttgattacagaagttaatgaaaaaaggcgtaaattaagggttttactacctgtcccaggccgacttcccagcaaggcgatgattctaacttcatatagatatttagagtaa

SEQ ID NO: 3156 - DNA, 1338 bp, Saccharomyces cerevisiae
atggtttcgttcagagggctgactacactaacactactttttaccaaattagtaaactgtaatcctgtttccacaaaaaatagggactctatacagtttatttataaagaaaaggatagtatatactctgccatcaacaatcaagccatcaatgaaaaaattcatggagtcaatttgggtgggtggctagtattggagccgtatattacaccttctttattcgagactttccgtactaatccgtacaacgatgacggtattcctgttgatgaataccatttttgtgaaaaattaggctatgaaaaggcaaaggaacgcctttatagtcattggtcgacgttctataaagaggaagacttcgcgaaaattgcttctcaaggcttcaatttggttagaattcctattgggtattgggcctttacaacgttgagtcatgatccctatgttaccgccgagcaggaatattttctagaccgggctatcgattgggctaggaaatatggtttgaaagtatggattgatcttcatggagccgctggttcacaaaacggatttgataactcagggttgagggattcatataagtttctggaagatgaaaatttaagcgccaccatgaaagctttaacgtatattttaagcaaatactcaacagacgtatacctggacaccgttattggaatcgaattgctcaatgaaccgttaggtccagttattgacatggaaagattgaaaaatttgcttttgaagccggcttatgactatttgagaaataaaattaatagcaaccagatcattgtaatacatgatgcttttcaaccttaccattattgggatgggtttttgaatgatgaaaagaacgaatatggcgtcataattgaccatcatcattatcaggtgttctcgcaggtggaattaacaagaaaaatgaatgaacgtatcaaaatcgcctgccaatgggggaaagatgccgtaagcgagaagcattggtccgtagcaggcgaattttcagcggccttaacagattgtacaaagtggttaaatggggttggtctaggtgccagatatgatggaagttggaccaaagacaatgaaaaatctcattacataaatacgtgtgcaaacaacgagaatattgccttgtggcccgaagagagaaaacagaacactagaaagtttatcgaggctcaattagatgcttttgaaatgactggtggatggataatgtggtgttacaagacagagaatagtatcgaatgggatgttgaaaaattgattcaactcaacatttttccgcaacctatcaacgataggaaatatcctaaccaatgtcattga

SEQ ID NO: 3157 - DNA, 1338 bp, Saccharomyces cerevisiae
atgtcaagagatgcaccaattaaggctgacaaggattatagccaaattttgaaggaagagtttcctaagatcgattcgctcgctcaaaatgattgtaactctgctttagaccaactgttagtgttggagaagaaaaccagacaagcttcagatctggcctcctcgaaagaagttttggccaagattgtagatctgctagcatcaaggaataagtgggacgacctaaatgagcaattgactctactctcaaaaaagcatggtcagttgaaattgtcaattcagtatatgatacaaaaggttatggaatatttgaaaagctcgaaatctttggatttaaacaccagaattagtgtcattgaaactatcagggtggttacagagaacaaaatatttgtagaagtggaaagagctagggtcaccaaagatttggtggaaattaagaaagaagagggtaagattgatgaagctgcagacatcttgtgtgagttacaggttgagacctatggctccatggaaatgtctgagaaaattcagtttatattagagcaaatggaattgagtatattaaaaggtgattattcccaagccacggtgctttcaagaaaaattctgaaaaaaacttttaaaaatccaaaatacgagtcattgaagctagaatattataatcttctggtaaaaattagtttgcacaagagagaatacctagaagttgcgcagtatctgcaagaaatttatcaaacagacgccattaaatcagatgaggctaagtggaaacctgttttatcgcacattgtatatttcttagtcctttcaccttacggcaatttacaaaatgatttaattcacaaaatccagaatgataacaacctgaaaaaattagaaagccaagaatctttagtaaaattgtttactacgaatgagttgatgagatggccaattgttcaaaaaacctatgagcccgtcttaaatgaggatgatttggcatttggtggagaagctaataagcatcactgggaagatttacaaaaaagggtcatcgagcacaatttaagagtcatttccgaatactattccagaattactttactaagattgaatgaattgctggacctaacggagagccagacggaaacatacatcagtgatttggtaaaccagggcatcatatacgctaaagttaatcgcccagccaaaatcgtgaattttgaaaaaccaaaaaactcaagccaattattgaacgaatggtcacataatgttgacgaactattagaacatatagaaacaataggccatttaattacaaaagaggaaatcatgcacggtttgcaagctaaatga

SEQ ID NO: 3158 - DNA, 1338 bp, Saccharomyces cerevisiae
atgtccaaaaaacaggaatatattgcaccaataaaataccaaaacagcttgcctgtgccacaattacctcctaaacttctggtttaccccgagtctccggagacgaatgcagactcctcccaactaatcaattcactatacatcaaaacaaacgtcactaatctaattcaacaggatgaagatttaggtatgccggttgatttgatgaaattcccaggcctattgaacaaattagattctaaactgctttacggctttgataatgtgaaattggacaaagatgatcgaattttactgagggaccctagaatagatagactgaccaagactgatatatcaaaggttaccttcttgagacgcaccgaatatgtctccaatacaattgcagcccatgataacacatcgttgaaaaggaaaaggcgcttggatgatggagattcggatgatgaaaaccttgatgttaatcatataattagtagggtcgaaggaacattcaataagacggacaaatggcaacatccggtgaagaagggtgtcaagatggttaaaaaatgggacctattgcccgacacagcttcaatggaccaggtgtattttatcctaaaattcatgggcagtgcatcattggatactaaagaaaaaaaatctttaaatacaggaattttcaggccagtggaactggaagaagacgaatggatttccatgtatgccacagatcataaggactctgccattctggaaaacgaattggaaaagggtatggatgaaatggatgatgactctcatgaaggtaaaatatacaagtttaaaaggataagagactacgacatgaaacaagtggctgaaaagccaatgacagagttagctatacgtttgaatgataaggacggcatagcttactacaaacccctacgttcaaagatcgaattaagacgtaggagagtaaacgacatcattaaacctttggtgaaggagcacgatatagaccaacttaatgttactttgagaaaccctagcactaaggaagctaacataagggacaagttaagaatgaagtttgaccccataaatttcgccactgtagatgaagaagacgatgaagacgaggagcaaccagaagacgttaagaaagaatcggaaggcgattcaaaaacagaaggttctgagcaagaaggagaaaatgagaaggatgaagaaatcaaacaggaaaaagagaatgaacaagatgaagaaaataaacaagatgaaaaccgtgcagctgatacgcccgaaacttcagatgctgttcatactgaacaaaaaccagaggaagaaaaggaaactttacaagaagaatag

SEQ ID NO: 3159 - DNA, 1338 bp, Saccharomyces cerevisiae
atgtcccatgacggaaaagaagaacctggtattgccaaaaagataaactcagtagatgatattattatcaaatgtcaatgctgggtccaaaaaaatgatgaagaacgattagctgaaattttatccataaacacaagaaaagcaccaccaaaattctatgttcactatgttaattacaacaagcgtttagatgagtggattaccactgacagaataaacctggataaagaagtactatatccgaaactaaaggctactgatgaagataataagaaacaaaaaaagaagaaggcaacaaatactagtgaaacgccacaagactctctgcaagatggtgtagatggtttctcaagagaaaatacggatgttatggacttagataatctaaatgtacagggaataaaagatgagaacatatcacacgaggatgagataaaaaagcttagaacctccggctctatgacacaaaatccacatgaggtggctcgagttagaaatctcaatcgaatcattatggggaaatatgaaatagaaccatggtacttttctccatatcctattgaattaactgatgaagattttatatatatcgacgatttcacgttgcagtattttggatctaagaaacaatacgaacgctacaggaagaaatgtacattaagacatccgccaggaaatgaaatctacagagacgattatgtttcattctttgaaatcgatggtagaaagcaaaggacttggtgtcgaaacttgtgtttactttccaaacttttcctagatcacaaaacattatactatgacgttgatccgtttttgttttattgcatgacgagacgagatgagttgggtcaccatctggtgggatatttttccaaggaaaaagaatccgcggatggttacaatgttgcatgtatcttaacactaccacaataccaaaggatgggatatggtaagttattgattgaattttcgtatgaattgtcgaaaaaggaaaacaaagttggttctcccgagaaacctttgtctgatttgggtctcttatcctatagagcctattggtcggacactctcataacgctattagtggaacaccagaaggaaattactatagacgaaataagctccatgacttcgatgaccactacagatatattacacacagcaaagacactgaatatcctgcgatattacaagggtcagcatattattttcctgaatgaagatattttagataggtacaatcgacttaaagccaaaaagagaaggacaatagaccctaatagactcatatggaaaccaccggtatttactgcctctcagttacgctttgcctggtaa

SEQ ID NO: 3160 - DNA, 1338 bp, Saccharomyces cerevisiae
atgttcaagtcaactttaaactccataataagaagacccttgaaaggttttcaacttcttagaggggctgactcatcgaatacacggccacagtcccctagagcctccgcaagagatgttacagagaaacagatattaagaactccgtcagcaccaactgcaataccattaagggagattatctatagagtcccaagcttgtttcctcgccctttagaagattctgttaaggacttccgagattttatcaagaacgaggatgcattccagactgaacttttgaaaacgctgccattctaccccactccttcggaatcaaaaacagcaagacttataagaactgttgttgatgatgagggcaattacatcaatgaattttgcatacgccctcgaaaaacctcagtgcctgaggctgacttaaaacatctggttttcattcatgggtatggcgccggattgggttttttcatcaagaattttgaggatattccactattggataacgagtggtgcatacatgccatcgatttgcctgggtatggtttttcttcaagacctaagtttccgttcgagtatccgagagataatattcacagcgttcaagattggtttcacgaaagaatacacacatggtttagtaaaagaaatcttttgaaccgacctgagaaaaacattgttatggcacattctttagggtcttacttgatggctttatatttgcaaaaatataaggaatctccatcttttaaaaagctgatcctttgttccccagcaggcgtgtcttatagagatttcaacaatactgcttcagaggttgaaaaatggaaaccgcctccttggtggtatgtcaagctttgggacagaaatatctcgccttttacactagtaagaaattttcgccagttaggttcgaagattacaagtggatggtcatatcggcgctttaagcacattttgaatggtgatccagaacagtcaaaacggtttgaagccttgcatagatacgcatatgctattttcaataaacgtggttcaggtgaatacttattaagctttgctttgaaatgtggtggtgaaccaagactatcattggagcagcagctattcgatggcaaaaagtctgatattttaaagaatagtaattgtgactggctttggctttatggcgatgacgattggatggatgtgaatggtggacttagagtatcaagattcttgaaagagaagttgaaacaaaaaagtaacgtcatcattgttcctcattcagggcatcacttgtacctggataactataagtttttcaataatattcttacgaaagaaatgcaaaaaatataa

SEQ ID NO: 3161 - DNA, 1341 bp, Saccharomyces cerevisiae
atgaatgccctaaaatatttctcaaatcatttaataactacaaagaaacaaaaaaaaatcaatgttgaggtgacaaagaatcaagatctactaggcccttcaaaggaagtttcgaacaaatatactagccacagcgaaaatgattgcgttagtgaggtggaccaacagtacgaccactcctcaagccacttaaaagaatctgatcaaaatcaagagcgcaaaaattctgttcctaaaaaaccaaaagctttacgttccatcctaatagagaaaatagcgtcaattttgtgggcactactactttttcttccgtattatctgataatcaagcccttgatgtctttatggtttgtttttaccttcccactaagtgtcatcgagcgtcgtgtaaaacacaccgataagagaaacaggggttcaaatgctagtgagaatgagctgcctgtcagttcaagcaatattaacgattctagcgagaaaacaaatcctaaaaattgcaatctaaatacgattcccgaggcagttgaggatgacttaaatgccagtgatgagataattctacaaagggataatgttaaaggctcattacttagagctcaatctgtcaaatcaaggccaagaagttattccaaatcagaactatcactttctaatcattcaagttctaataccgtatttggtacaaaacgaatgggaaggttcttatttccaaagaagctgatacctaaatccgtgcttaacacacaaaagaaaaagaaactggttatagatctcgatgagaccttaattcactcggcttctcgaagtacaacgcatagtaattcttctcagggtcacttggtggaagtgaagtttggattgagcggaattcgtacactatactttattcacaagaggccttactgtgatttatttttgacaaaagttagcaaatggtacgaccttatcatttttacagcatccatgaaagaatacgctgatcctgtgatagattggttagaaagctccttcccatccagtttttcaaaaagatattaccgttctgattgcgttctaagggatggtgttggatacattaaagatttgagcattgtcaaggactccgaagaaaacgggaaaggcagctcctcttctttggatgatgtcattattatagataacagcccggtaagttacgcaatgaatgtagataacgctattcaagtagaaggatggataagtgatccaactgatacggacttactgaacctgttacctttcttggaggctatgaggtattcaacagatgtcaggaatatactggcattgaaacatggagagaaggcattcaacataaactga

SEQ ID NO: 3162 - DNA, 1341 bp, Saccharomyces cerevisiae
atgattataaggcgcttattttcaatttcaaatcgctcattcttcttgaagaaacctcaatttgatgtaaaaaaaataatagagatgattcctcagtaccaaacttctatccagaatagagagctgatagaggcggatagtattatacgaagcttacaactgttgggtgaacggtatcaaaatataaaagagattgataaagttattgcggatattcaaatacagaggaaatcaattgaggctcaaatcaaaaaggataaaacaaaaattacggaatactcagctgcgctgaaggccctgaaagaacagtacaacgatcaaaatagcaaatcgtcggagctgaaaaagaaaatcttggagacctgcaaatcacttccaaataccttggatcctacggtcccattagatgccccacagattgaacaatggataaaccctttaaaaacacataaaacttcagaagctcaggcgcatgttgatatcatgcttaaaaagaatatgttagacctacagactgcctcgaacgttacaggaatgtcatggtactatctattgaatgacggagcacgtctcgaacaagcattggtagcatatgcattgaaaaaggcaaacgaaaatgggttttcaagctgcgtaccgccaagcatcacgaagaaggagttaatagatgcatgtggatttaatccaagagatatgaataatgaaaggcaaatttacgctcttcaagacaccaatttaggattggtggctaccgcggagatacctttggcaggtctaggggcaaacaaagttctagagttaaactcgggagaatgttctaagaaactagttggagtaagtagatgttacagagctgaggcaggtgccaggggaaaagatacgaaaggtctctatcgcgttcatgagtttactaaagtagaattattttgctggagcaagccagaaaccagtgcaaaggtccttgaggaaataaagcaatttcagatttctgtagttgaggaattaggaataccggccaaagtactaaatatgccatcaaacgatcttggtaatcccgctttcaagaaatacgacatcgaagcttggatgccaggaagggggaaatttggcgagataagtagtgcctccaattgtaccgatttccaaagtagaagattaaatacaaagtacagggacgataacacaggaaagctagaatatgtgcacacgctgaatggcacagcaatggctatcccaagagtgatagtagcactagtagaaaatttctatgacccaagcaccggtaagatatctgttcctgaatgtttgagggagtttatgaatggccaacgatacatttaa

SEQ ID NO: 3163 - DNA, 1341 bp, Saccharomyces cerevisiae
atgcacgtactgctgagcaaaaaaatagcacgctttctgttgatttcgtttgttttcgtgcttgcgctaatggtgacaataaatcatccaaaaacaaagcagatgtctgaacagtatgttacaccataccttccgaaatctttgcaacctattgcaaaaattagtgcagaggaacaaaggcgtatacaaagtgaacaggaagaagccgaattgaagcaatctttagagggagaggccattagaaatgccaccgtgaatgccattaaggaaaagatcaaatcttatggtggtaatgaaacgacgctagggttcatggtgccatcgtatatcaatcatagaggatcaccaccaaaggcgtgctttgtctcactaattactgaaagggattccatgacccaaatcttacaatctattgatgaagtgcaggtgaagtttaacaaaaattttgcttatccttgggtttttattagtcagggggagcttgacggaatgaagcaagaaatgattcgtcaagccataactgattctatgaatggtgatcctgagttaattaatattaaatttgctgaaattcctgcagacgaatgggtataccctgaatggattgatgaaaataaagcagcagaatcgctaatttcattagcaaatgtaccggatggtgattctagagctgtaagatatcaagctagatattttgcagggtttttttggaggcatccagttctggatgagtttgattggtactggagagtagaccctggtattaaattgtactgtgatattgatcatgacctttttaggtggatgcaagatgaaggcaaagtgtttggtttcacattgagtatgagtgaagctaaggaagccaatgagaagatttgggatgttacgaaaaaatttgcaaaggattttccaaagtttatttccgagaataatttcaagtcatttattacaaaaaaggactctgaagattttaacaactgtgaattcacatcaaattttgaaattggtaatttgaacttttatagatcgccagcttacaggaaattttttaattacatcgacgaagagggcggtattttctactggaaatggtctgattccatcatccacacaattgggttatcgatgctgttgccaaaggataaaatacattttttcgaaaatataggattccattatgacaagtacaataactgtcccctaaacgatgatatatggaaccaatataattgtaactgtgaccagggtaacgatttcacgtttagaagtggttcatgtggcggacattacttcgacattatgaagaaagataagccagaaggttgggataggttaccataa

SEQ ID NO: 3164 - DNA, 1341 bp, Saccharomyces cerevisiae
atggacgacaaagtttcagaaaaggagagctccccaaaacaaacagaggaggattctgaaggtaaaatggcacatgtgcagcctgcttcgtacgtgaataaaaaaaaatatgtttttgggaagacattaggtgctggtacatttggtgtggtgagacaagccaaaaacactgaaacaggggaggacgtggccgttaaaatcctgatcaagaaagcactaaagggaaacaaggttcagctagaggctttatacgacgagttagacattttacaaagactgcatcatccaaatatagtggcatttaaggattggtttgaatcaaaagacaagttctacattatcacgcaattagccaaagggggtgaattgttcgataggattttgaagaagggtaagttcactgaggaagatgcagtgagaattttggttgaaatattgagcgcagtcaaatatatgcattctcagaatattgttcatagggacttgaaaccggaaaatttactgtatatagataaaagtgacgaatctccactggtagttgctgattttggtatcgcaaagagattgaaaagtgatgaggaactcctctataagccggcaggctcactgggttacgtggctccagaggtacttactcaggacggtcatggtaaaccttgcgacatttggtcgataggtgtcattacgtatactttgctttgcggttattcggcgtttagagccgaaagggttcaagatttccttgacgaatgcacaactggtgagtatccagtgaagtttcataggccttattgggattccgtttccaataaagcaaaacaattcatcttgaaggctcttaatttggatccttcaaagagaccgaccgccgcagaactcttggaagatccatggattatttgtaccgaattgaagacgcacaatttattgcctgggttaaaggaaggattggatgctcgtcaaaagttccgtaattctgttgagagagtcagattaaacatgaagatccagaaattaagagatctgtatcttgaacagacagagagtgattcagattttgacgaaggaagtcaagcaaacggttcagttcctccattgaaagcaacggataccagtcaactatccaagaagctatcagaagaagaacagtctaagttgaagtccgagttaaccagcaaagcttttgcacaattagttaacacagtgcttgccgaaaaggaaaaatttttaaatattaacagagtctgtagttctgatagcgatcttcctgggagtgatataaagtctttggatgaggcgaaggagaaaccagaggggaaggataccaaaacagaagaatga

SEQ ID NO: 3165 - DNA, 1341 bp, Saccharomyces cerevisiae
atgggaaagaacgttttgttgctaggatctggttttgttgcacaacctgttatcgacacattggctgctaatgatgacatcaatgtcactgtcgcatgtagaacattagccaatgcgcaagcattggccaagccctctggatccaaggctatttcattggatgttaccgatgacagtgccttagacaaagttctggctgataacgatgttgtcatctctttgattccatacaccttccatccaaatgtggtaaagagcgccatcagaacaaagaccgatgtcgtcacttcctcttacatctcacctgccttaagagaattggaaccagaaatcgtaaaggcaggtattacagttatgaacgaaattgggttggatccaggtatcgaccacttgtatgcggtcaagactattgatgaagttcacagagctggtggtaagctaaagtcattcttgtcatactgtggtggtttaccagctcctgaagactctgataatccattaggatacaaattttcatggtcctccagaggtgtgctactggctttaagaaactctgctaaatactggaaagacggaaagattgaaactgtttcttccgaagacttaatggccactgctaagccttacttcatctacccaggttatgcattcgtttgctacccaaatagagactctacccttttcaaggatctttatcatattccagaagccgaaacggtcattagaggtactttgagatatcaaggtttcccagaatttgttaaggctttagttgacatgggtatgttgaaggatgatgctaacgaaatcttcagcaagccaattgcctggaacgaagcactaaaacaatatttaggtgccaagtctacttctaaagaagatttgattgcttccattgactcaaaggctacttggaaagatgatgaagatagagaaagaatcctttccgggtttgcttggttaggcttgttctctgacgcaaagatcacaccaagaggtaatgctttagacactctatgtgcacgtttagaagaactaatgcaatatgaagacaatgaaagagatatggttgtactacaacacaaattcggtattgaatgggctgatggaactaccgaaacaagaacatccactttagttgactatggtaaggttggtggttacagttctatggccgctactgttggttatccagttgccattgcaacgaaattcgtcttagatggtacaatcaagggaccaggcttactagcgccatactcaccagagattaatgatccaatcatgaaagaactaaaggacaagtacggcatctatctaaaggaaaagacagtggcttaa

SEQ ID NO: 3166 - DNA, 1341 bp, Saccharomyces cerevisiae
atgtcacacgaaggtgaagaagatttattggagtactccgataacgaacaagaaattcaaattgatgcctctaaggccgctgaagctggagaaactggcgccgccacttctgcaactgaaggtgataataataacaacactgcagctggcgacaagaaaggttcctatgttggtatccattccaccggtttcaaagatttcttgctaaagccagaactatcaagagccatcattgactgtggttttgaacatccttctgaggtccagcaacataccattcctcagtcaattcatggtaccgatgtcttgtgtcaagcaaagtctggtttaggtaagacagctgtctttgtcttatccactctgcaacaattggaccctgttccaggtgaagttgccgttgttgtcatttgtaatgctagagaactggcctatcaaattcgtaacgagtatttgagattttccaaatatatgccagacgttaagacagcagtcttttacggtggtactccaatttctaaggatgctgaacttttaaagaataaagatactgctcctcacattgttgttgcaactccaggtcgtttaaaagcgttagtgagagaaaaatacattgatttgtcacacgtcaagaactttgtcatagatgaatgtgataaggttttagaagaattagacatgagaagagatgtgcaagaaattttcagagctactccaagagacaaacaagtcatgatgttttcagccacactttctcaagaaattagaccaatttgtagacgcttcttacagaatccattggaaattttcgtcgatgatgaagctaagctaaccttgcacgggttgcaacaatattatatcaaattagaagaacgtgaaaagaaccgtaaattggctcaattattagatgatttggagttcaatcaagtcattattttcgttaaatctaccacaagagctaatgagttgaccaaactattaaacgcctctaactttccggctatcaccgttcatggtcatatgaaacaagaagaacgtattgctcgttacaaggctttcaaagattttgaaaaacgtatttgcgtgtccacagatgtttttggtagaggtatcgatattgaacgtattaatttagccatcaattacgatttgactaatgaagctgaccaatatttacatcgtgtcggtagagctggtagatttggtactaagggtttggctatttcattcgtttcttcaaaggaagatgaggaagtcttggctaagatccaagagcgtttcgatgtcaaaatcgctgaattcccagaagaaggcattgatccgtccacttatttgaataattaa

SEQ ID NO: 3167 - DNA, 1341 bp, Saccharomyces cerevisiae
atgtcagcaaacagtggtgtaaaacgagccagtaaggcttttaaaacatgtttattttgtaaacggtcacatgttgtatgtgataagcaacgtccatgttctaggtgcgtcaagagggatattgcccatttatgcagggaagatgatattgcggttccaaatgagatgccatcacagcacgaaagttctccgaatgataataatatacagggcaaatatgcaaataaagcacacactggaattccgtctgactatcagaatgaaccagtcaataaaagtggatccacatatggagaggaactgtcaccgaaactagactcctctcttgtaaatgatacaaccagcttgctgcttccgcaacaacctgtatttgtgtccgagaatgttggttcggaattcagttctttgaatgaatttctttctatgctagaaaatcctctattgactcaaacatcactaagttccagcagtgcgagcaatgttcatttggaaaatggctcacaaaccacacaatcgccattagagtaccaaaacgacaatcgtagggatgaaataggagtggcaagacaagaaaataggtcgcctactattatgtcaggttcttccaatagtatctcgaaaggggataaacaagatcaagaaaaggaagagtctcgaattctagcgaatgcaaacgaaaacagtgcaccgacaccgaaggaacaattctttttaacagcggcggatccgtcaacagagatgacaccagaacaccggctgaagttggtcataaatgcgaagcttgaagcaggattattgaagccgtataattatgccaaggggtatgcaagactacaagactacatggacaaatatatgaatcagtcttccaagcaaaggattctgaaaccactatccaccattagaccggcgtttagaaccattgcgcgttcattgaaggatgttgacttagttttagtggaggagagcttcgagaggatgttattatcttatgatcgtgttttcacctctatgagcatgccagcgtgcttgtgtaggcgtaccggtgagatttacagagccaataaagagtttgcttcactggttgactgcacagtcgatgatttacgcgatggaaagcttgcgatctacgagttgatgacagaagaaagcgctgtgaatttctgggaaaaatacgggtccatagcgtttgataagggtcagaaggctgttttaacaagttgtagtcttcgaaccaaagatggaatccgcaaacggccatgctgttttagtttcactatcagaagggataggtacaacatcccaatttgcatcgtcgggaatttcatccctttgtcataa

SEQ ID NO: 3168 - DNA, 1344 bp, Saccharomyces cerevisiae
atgacttcagtatcgccctcgccacctgccagtcgatcgggctcaatgtgctccgacttaccgtcctctttgcagactgagaaactggcacatattataggtcttgatgccgacgatgaagttctccggcgcgtaaccaagcagttgagcagatctaggagaattgcttgtctgactggggcaggcatttcgtgcaacgcgggcattcctgactttcgctcttctgatgggctctacgacctagtgaaaaaggattgttcacagtattggtctatcaagtccggcagggaaatgtttgatatttcgctatttagagatgacttcaaaatatccatttttgctaaatttatggagaggctctattcaaatgttcaattggcaaagccgactaagacgcacaagttcattgcgcatctaaaagataggaacaaactgctgcgctgttacacgcaaaacatcgatgggctcgaagaaagcataggacttactttatcaaataggaaattaccgcttacctcatttagttcacattggaaaaatctggatgtcgttcagttgcacggcgacctgaaaactctttcgtgtacaaagtgcttccagacttttccctggagcaggtactggtctcgttgtctaagaagaggtgagttaccattgtgtccggattgcgaagcacttatcaacaagagattgaatgaaggaaagcgaactcttggttctaatgtgggtattctaagacctaatatcgtcctgtatggtgaaaaccatccatcctgtgaaattattacgcaaggcctaaatcttgacataattaaaggcaatcctgattttttgatcatcatgggtacaagtttgaaagttgatggtgtgaaacaactggtaaaaaaattaagtaagaaaattcacgatcgtggcggcctgatcattctcgtaaacaagacacccattggcgaatcctcttggcacggcattatagactaccaaatccactcagattgtgataattgggtcacatttcttgaatcccaaataccagatttcttcaagacgcaagatcaaattaagaagttaagacagttaaaaagggaggcgagcgacttgagaaagcaaatgaaggcccaaaaagactcaatcggaacccccccaacaacccctctacgaactgcccaggggattgatattcaaggaaacaacgaattgaatacaaaaataaagtcgttaaacacagttaagagaaaaatactgtcaccagaaaactccagtgaggaagacgaagaggaaaacttggatacaagaaaacgcgctaagatacgaccaactttcggtgacaaccaagcctcataa

SEQ ID NO: 3169 - DNA, 1344 bp, Saccharomyces cerevisiae
atgcccaaggagtcagaggtcataaattctgaatttcatgtagatgtccaagatccagagcgtctaaacggccaccctgtagcaaaatttatcaataaattaagcggtcaacctgaatcttacgtcaacaggactaattatattttcggtcgaacactgggtgccggttccttcggtgttgtgagacaagccagaaagttgtccacaaatgaagatgttgctataaagatcttattgaagaaggcattgcagggaaacaatgtgcaattacagatgctgtacgaagagctgtccattcttcaaaaattgagtcatccgaacattgtgtcattcaaggattggtttgaatcgaaggataagttctatattgtcactcagctggcaacaggaggtgaattatttgatagaattctgtctagagggaagttcacagaagtggatgctgttgaaatcatagttcagattcttggtgccgtggagtatatgcattccaagaatgttgttcatagggatttgaaacctgagaacgttttgtatgttgataagtcagaaaattcgcctctggtaattgcggacttcggtatagctaaacaattgaagggggaggaggatttgatatacaaagcagccggatcgttgggttatgtggcaccagaagtcctcacacaagatggacatggtaagccttgtgatatatggtccattggtgtgatcacatatactttactgtgcggttattctccttttattgccgaaagcgttgaaggattcatggaggaatgtacagcttcgagatacccggtaaccttccatatgccatattgggataacatatctattgatgttaagcgtttcatcttgaaggcattgagattgaatccagctgacagaccaactgctacggaattgctggacgatccatggattacttcaaagagagttgaaactagtaatattttaccagacgttaagaaagggttttctttgcgtaagaaattacgtgacgctattgaaattgtgaagcttaataatagaattaagaggttaagaaatatgtattcattaggggacgatggcgataacgatatagaagagaattccctcaatgaaagtcttctggacggcgtcacacattcgttggatgatttacgtctgcaatctcagaagaaagggggagaactaacagaagagcaaatgaaattgaagtctgcattaacaaaggatgcctttgttcaaattgtcaaagctgcaacaaagaataaacataaagttttggctggtgaagaggaagacgatagcaagaaaacactgcatgatgatcgggagtcgaagtcagaagactaa

SEQ ID NO: 3170 - DNA, 1344 bp, Saccharomyces cerevisiae
atggtagagaaggatacatggaaactgataactgccactgcactattcactgtggcagtgacgacgattacagattatgcttggaccagttggcaagcacaaaagcaagtaattgcgcaacaaaaaaataagaataaaggtgggcaaacaaaatctgacacggataaatatcatcaatatgatgaacagtttattcgccaatctttgaaaaacaatgttgaatttcttggtgaggacacaattgaaaaactatccaatcaatatgttgttgtcgtgggagcaggtggagttggatcttgggtggttaactctttggtgcggtccggatgccgaaagatcagggtcgttgattttgaccaggtctcactaagttcactaaatagacacagctgtgccatactaaatgatgttggcacgccaaaagtggaatgtctacgaaggcatatgcgggaaattgcaccatggtgtgagattgatccgattaatgaattatggacgttacaaaatggcgaaagactgacccttggtaatggaactcctgactttatcgtggactgcattgataatattgatacaaaggtcgacttacttgagtttgcctataatcatggtatcaaagtgatctcttccatgggtgcttccgcgaaaagtgatcctacaaaacttaatgtgggggacttggctaccacggaggaggatcctcttgcaagggtagtgagaaggaaattaaagaaaagaggtatcttatccggaattcctgtagtatttagtgccgaaaaaccagatccgaagaaggctaaattattacccttaccagatgaggaatatgaaagaggaaaggtcgacgagctgagcgccctgaaggacttccgtgtaagaatcctacccgttttaggtactatgccaagtttgtttggattgaccatcactacgtggattttatctaatatatccgataaacctctagaacctgttgagggtaagaatagaattaaggtatacgatggtatatatcaatcgttggcaggtcaaatgagcagagtcggtataccgagccaaagaatcccattggctttgaaggatgttagttaccttgtcgaagaggtgtttaagggtaaatctccaattagcggcatttccactagactaactttaaccaaatgggatccctctaaacctatctctttgcaaaatgtggtagtactaactaaaaacgaacagaaagtgcacgaagaccgtgtcttgaagggtaaggaaagcttacaagatgtttatgatgccaaagttctaaaactggtttcacaaagattcagagaagaagcttattactctcaattcagatga

SEQ ID NO: 3171 - DNA, 1344 bp, Saccharomyces cerevisiae
atgtcatcgcaaaacctcaatgataatccaaaaaatacatcctcagcagctgaagataagaagaaacaaacttcatccttaaagttggcaccaataccaaccacatcgccatggaaatcatcttcgccagatagcaatacagtaattcctgtagaggaactaagagatatatcaaagactgcaaagccaagtaaaaatggttcggggtcaattaaattaacaagcaataccaaatggactccaattacgccgtctgttataatctcaggttccaaggacacaaattcaaagtcaggaaagaactctaaaaattctaagactaataaaaaaatgaaaaagcgtggcaaatataataacgatatcaataaaaaggactttaacggtcaaaccaacagtacatcggaaataagtaacgtttccaatcttgaatccaaacctttagatgctaacgctaaagtaaacatacattcaagctcaggagcaactgccaatgggaatataaagaggataacaaacaacaacaattcaaccaacggtagacaatcaagaaattatcaaaacaggaatggcaaaacaagatacaacaacaatagtagacacagtcaggcggctaataatgccatctccttcccaaataattatcaggctagacctgaatatattcccaatgccagccactggttgaacaacaattcaagaaatagctataaacaactgtcatacttccgtcaacagcagtattataataacatcaactatcaacaacaattgcaaacaccatattattactcaatggaacctatttttaaatctatcgaaagtatcaaaaaccaaattgaattctattttagtgaagagaacttgaaaacagatgaatttttaagatctaaattcaaaaaagccaatgacggatttatccccatgagtttgatagggaaattttaccgtatggttaatttatctcttggtggagacccaaatttaattttggcatctatgagagaagttttacaacataaagaaacaaaccatttggaaattgcccttggaagcatagaaggtgctcagaagaacatggcagatgatttcaatccattggaaaactattttattaggcgcgaaaattgggctgaatacgctatggaaagtaattttgatgaaaatgatgacgaaactgaaaaatacaacattgagaaactattgggaccgaacgatttagacaattattcttatatgggctatccaaacttctttcccagtaatgaaaatgggaaaaagagtcagagctatgaccaaggtgaaattagcaggcagtttgaacaaaacttacaaataaatgattaa

SEQ ID NO: 3172 - DNA, 1347 bp, Saccharomyces cerevisiae
atgctttcgcttaaaacgttactgtgtacgttgttgactgtgtcatcagtactcgctaccccagtccctgcaagagacccttcttccattcaatttgttcatgaggagaacaagaaaagatactacgattatgaccacggttccctcggagaaccaatccgtggtgtcaacattggtggttggttacttcttgaaccatacattactccatctttgttcgaggctttccgtacaaatgatgacaacgacgaaggaattcctgtcgacgaatatcacttctgtcaatatttaggtaaggatttggctaaaagccgtttacagagccattggtctactttctaccaagaacaagatttcgctaatattgcttcccaaggtttcaaccttgtcagaattcctatcggttactgggctttccaaactttggacgatgatccttatgttagcggcctacaggaatcttacctagaccaagccatcggttgggctagaaacaacagcttgaaagtttgggttgatttgcatggtgccgctggttcgcagaacgggtttgataactctggtttgagagattcatacaagtttttggaagacagcaatttggccgttactacaaatgtcttgaactacatattgaaaaaatactctgcggaggaatacttggacactgttattggtatcgaattgattaatgagccattgggtcctgttctagacatggataaaatgaagaatgactacttggcacctgcttacgaatacttgagaaacaacatcaagagtgaccaagttatcatcatccatgacgctttccaaccatacaattattgggatgacttcatgactgaaaacgatggctactggggtgtcactatcgaccatcatcactaccaagtctttgcttctgatcaattggaaagatccattgatgaacatattaaagtagcttgtgaatggggtaccggagttttgaatgaatcccactggactgtttgtggtgagtttgctgccgctttgactgattgtacaaaatggttgaatagtgttggcttcggcgctagatacgacggttcttgggtcaatggtgaccaaacatcttcttacattggctcttgtgctaacaacgatgatatagcttactggtctgacgaaagaaaggaaaacacaagacgttatgtggaggcacaactagatgcctttgaaatgagagggggttggattatctggtgttacaagacagaatctagtttggaatgggatgctcaaagattgatgttcaatggtttattccctcaaccattgactgacagaaagtatccaaaccaatgtggcacaatttctaactaa

SEQ ID NO: 3173 - DNA, 1347 bp, Saccharomyces cerevisiae
atggaggttgataacaaaaggagacattcagaagatgagttaaaacaggaggcagtaaaaaagataaagtctcaggaaccaaactatgcctatcttgagactgtagtaagagaaaaactagatttcgattctgagaaaatttgctgcattactctgtcccctttgaatgtatattgttgcctcgtgtgtggacattattatcaggggagacatgaaaagagtcctgctttcatacattcaattgatgaaaaccatcacgtcttcttgaatttgacaagtttgaagttttacatgttgccgcaaaatgtccaaattttacatgacggtgaggttcaattgttgaacagcataaaatttgcagcttatccgacttattgtccaaaagatctagaagattttccgagacagtgttttgatttgagcaatcgcacatatctgaatggatttatagggttcaccaatgcggcaacttatgactatgcgcatagtgtattgcttttgatatcgcacatggttccagtgcgggaccacttcctactgaatcattttgataatcaaggggaatttatcaaaaggttatccatatgtgtaaagaaaatttggtcccctaaactattcaaacatcatctttcagttgacgattttgtatcctatttgaaagttagagaaggtttaaatttaaatcctatagacccgcgtctcttccttttgtggctattcaataaaatttgctcgtcctcgaacgacttaaagtcaattttaaaccattcttgtaaaggcaaagtaaagatagcaaaagttgaaaataagcctgaggccagtgagtctgttacaggaaaagtcattgtcaaaccattttgggttctgactctcgatttgccggagttttcaccctttgaagatggcaacagcgttgatgatctcccacaaataaatatcactaaattattgactaaatttactaagtcaagaagctcctctactagcaccgtttttgaactaacgcgattaccgcagtttttaatatttcatttcaataggtttgaccgtaacagtgatcatcctgtcaaaaatagaaaccaaacgttggtggaattttccagtgaacttgaaattttgcacgtcaagtatcgcttaaaagcaaatgtggtccatgtggtcattaaacaaccatccacagatggaaacgcatttaatggtgatgaaaaaagccattggattactcagctgtatgataacaaaagtgaaaaatggatagaaatagatggcataaatacgacagagagagaagccgagcttttatttttgaaggaaacgtttatacaagtatgggaaaagcaagagtga

SEQ ID NO: 3174 - DNA, 1347 bp, Saccharomyces cerevisiae
atggatgttcgtcgacctataagggaggcagtcaacaacaggaggaaaccaaaatttttgagcgtttcgtttaaccaagatgattcgtgtttcagcgtggcgttagagaatggatttcgtattttcaatacagatccattgactagtaagctatcgaaaacatttaaagagtctgcgaccaaccaatccaggggcactgggattggctataccaggatgctttatcgtacgaattacatcgcactagtcggaggtggtaaacgaccaaggcatgctctaaataaactgatcatctgggatgatcttttgcaaaaggaaacgattactttgaagtttatgtcttccattaaagacgtgtttttatctaggattcatattgtggtagtcctggagaacacaatagagatcttccaatttcaaaccaatcctcaaagaatttgtcctattttggatatccctcccaatggatcagtggactatgtcgtttgtagcagcaaacatctccagtcgcaagcatcgcagtcacagtctaaaatcttagaaatcattgcattcccatcgaataaatgcgtaggccaaattcaagtagccgacctatcacaaataaaatataattcacaaaacccgaaggaatcagcgcttttgcccacttccatcattaaagcacataaaaatcccatcaaactggttagactgaaccgtcaaggcaccatggtagcaacatgttccgtccagggtacacttataagaatcttcagtacgcataacggtactttaatcaaagaatttagaagaggggtggacaaggcggatatttacgagatgagtttcagccccaatggtagtaagttggccgtattgtcaaataagcaaacattgcatattttccaaatttttgaaacaaccaatacagaaacgaatacaccagaccactctcgtgccaatggttcgagccatcccttgaaaaattatataccgaagggcctatggaggcccaagtatttggactctgtgtggtcgatatgcaatgctcacttaaagaacccaatctttgacgctcacagaaatgacaacagtggtgatgtaactcacgataacgagttctataaagacagatgtagaattggctggtgtcaagactctaataatagagaacaagacgattcgttggttctggtgtggcaaaattctgggatatgggagaaatttgttattttggagaaggaacaacaagattcatcgaaaacgcattattcattgaatgaaagcttgaggaacgaagatacgaaatcagcgggtgagcccaccagatgggagttggtgagagaatcatggagagagctttaa

SEQ ID NO: 3175 - DNA, 1347 bp, Saccharomyces cerevisiae
atggcaccggaaatttttgttaaattcaagtgtgcaagtagagacataaagctactatgggcgtccgtctttcttagacttctatcatatggtttaacaaatcaagttttgacgctttttttaaatgccatcaatatgacagaggataaaattgggctgtttatgtcattaacactggcaggggatgtaatttgctcttacattcttacttggtatgcggattcctggggccgaagaagagtcctagtttatggttgtgcaatgatgttgttaagtgggttggttttcagttttagcgaaaatttcaccctcttgctagtatttgctatcttcggtgttatatcgccttcaagtgatgaagtcgggcctttcaaatctatagaagaggccatgattgcacatctgagtcctcataatgcaagaccagagatttatgctattcacgccttggttggaacaattggaagcgctctaggtgcaataatttgtggtatatttgtagatcttttgaaaagaactggtttagctgctactgatttgcaatgttataaattagttttcttactgtatgccttcttcgccttttgcaaaatggtcatcatgctcttattatcagatgctacagaattggacgggcattatgaacatacagattgcaatgaagaaacagctgaaccattggacgttaacgatgaaactgcaccattaatgagacaagcaactcacccagaagaaagatccaacaaactatctaaggagaccgtttcggttttgatgaaattgttagtaatcttcatggtcgactctctcgggtccgggtttatgacaagtggctggatggtttactactatagtaagcaatttttgatgggatctctggcgttgggtactttatttttcatcacgcaactggttatggcatcttccaccatcccatcatcaataattgccagatgttttggcccagtaagagccacactattggtccaaattccatcagggatattttctattctcatccctatggccaagaattacttgcccttatctattttgtttttgaatctgcattttgcaacaactgccatggacgttacaccaaggcaaattctattaacaaatatcatcaaaccaagagatttaaccaaagttatgggggtggtcaacattggaaagacatttgctcggtgtgttggtccaatattcacgggtatacttgctaacaataattatttatggctatgttacatcattagtgggtccttggtgataacggcggatctaatactggcatgcatgtttttaggagtggacgctaaaattaaaaagcaaatgaaccgccattaa

SEQ ID NO: 3176 - DNA, 1347 bp, Saccharomyces cerevisiae
atgggctccaaaaaactgaccgtaggatctgattcgcaccggttgagcaaatccagtttttcaagtaataagtcgtcacattcagcaacaaaagatcagccaattgataccgacgatattgatgaagacgatgaatctggtcataatattatcttgaacatcatctcacaattgagaccaggctgcgatttgaccaggatcaccttgcctacttttattttagaaaaaaaatcgatgcttgaacgtgtcacaaatcagttacaattccctgagtttttgttacaggcgcattcagaaaaggaccccttgaaaagatttttgtacgtaatgaaatggtatttggcaggctggcatattgctccaaaggctgtaaaaaaaccattgaacccagtccttggtgaatattttacagcttattgggatctaccaaacaagcagcaggcatattatatatctgaacagacaagtcaccatcctccagaatgtgcatatttttacatgattcctgaatcttcgattagagtggatggggtcgttattcctaaatctagatttttaggtaattcaagtgcggccatgatggatggatcaacagtcttgcaatttctggacataaaggatggaaacggaaagcccgaaaagtatgttcttacacaaccaaatgtatatgtaagaggaattctttttggaaaaatgagaatcgaacttggagatcatatgataattaaatctcctaacttccaagctgatatagagttcaagacaaagggatatgtttttggaacttacgatgcaatcgaagggactgtaaaggattatgatggcaatgcgtattacgaaatatctggtaaatggaatgacgttatgtatttaaaggacttaaagcaacctcgttcttcaccaaaagttttccttgatactcataaagagtcaccattgagaccaaaagttcggccattgagcgagcaaggtgaatatgaatccagaaaactgtggaaaaaggttacagatgcgttggccgttcgcaatcatcctgttgcgacagaagaaaaatttcagattgaagatcaccaaagacagttagccaaaaaacgcattgaagatggcgtagaatttcatccaaagttgtttagaagatcaaagcctggcgaagatcttgactattgtatttataaaaatatccctgtcgacgaggaccctgagaagcaaatacgaagcatattgcaaatagcacctattttacctggtcaacaatttaccgacaaatttttcatccccgcatttgagaaaataaaatcacaaaagaagatgattgaaaacgaaaagcagaacccagcaaaacaatag

SEQ ID NO: 3177 - DNA, 1347 bp, Saccharomyces cerevisiae
atgggcttggaccaggacaagataaagaagaggctttctcaaatagagatagatatcaaccagatgaaccagatgattgacgaaaatttacaattagttgaacctgcggaggacgaagctgtcgaagataatgtcaaggatacgggtgtggtcgacgctgtaaaggtggcagaaacggctctttttagtggcaatgatggagcggatagtaacccaggagattcagctcaggttgaagagcacaaaaccgcacaggtccatattcccactgagaatgaagcgaataagagtacggatgacccatcccagctatcggttactcaaccttttatagcgaaagagcagataactcacaccgccattgctattggtgactcctataattcatttgtcgcaaattccgctggaaatgaaaaggcaaaggactcctgcactgagaacaaagaagatggtacagtcaatatagatcaaaacaggggtgaagctgatgttgaaattatcgaaaataatgatgatgaatgggaggatgaaaaatcggatgttgaagaggggcgagtagataagggaacagaggaaaacagtgagattgaatctttcaaatcacccatgccccagaataacaccttgggcggtgagaacaagttagacgctgaacttgtattagacaaattttcttccgctaataaggatctagatatacaaccgcaaaccatagttgtaggaggtgacaatgaatacaaccatgagagcagccgtttagctgatcaaacaccccatgacgataattcagagaattgtcccaatcgctctggaggaagcactcccttagattctcaaactaaaatttttatccctaaaaagaattctaaagaagatggtaccaatataaatcactttaattcagatggtgatggacagaaaaaaatggcgaatttcgagacacgacgccctacaaatccgttcagagttatctcggtgagcagcaattccaattcaagaaacggaagtcgtaaatcttcactaaataagtatgattcgccagtctcctctcctatcacatcagcgtctgagctgggcagtattgccaagctggaaaaaagacatgattatttatccatgaaatgcattaagttacaaaaggaaattgactatctaaacaagatgaatgcacagggttctttatctatggaagacggaaagagactacatagagccgtagtgaagcttcaagaatatcttgacaagaaaacgaaggagaaatatgaggtcggagtgttattaagtagacatctgagaaagcaaattgatcgtggcgaaaatggccaattttggattggaactaaatga

SEQ ID NO: 3178 - DNA, 1347 bp, Saccharomyces cerevisiae
atggtagctagtattagatcaggtgtgctgacacttttacacacggcgtgcggtgctggtatcctggccatgccgtacgcattcaagccgtttggattaattcctggagtgataatgatagtgctgtgtggggcgtgcgctatgcaaagcttgttcatacaagctcgtgtagctaaatacgtaccacaggggagggcctcgttcagtgctctgacgcggttgattaacccaaatctaggtattgtgtttgacctagcgatcgctatcaagtgttttggtgtgggcgtctcttatatgattgtagttggggatctgatgccccaaataatgtctgtgtggaccagaaatgcttggctgttgaacaggaacgtgcaaatttcactgatcatgctttttttcgtggccccgctgtcttttctgaagaagttgaattcgttgaggtacgcttccatggtggccatctcttctgtagcgtacttgtgtgttttggtgttgttgcactatgtagcaccatcagatgagattcttcgcttgaaaggccggatctcctacctcctgccaccacaatcgcatgatttgaacgtgctaaacactcttccaatttttgtctttgcctacacatgtcaccacaatatgttttcaataatcaatgagcagaggtcaagccggttcgagcatgtgatgaagattccactgatagcaatatctttggctctcatcttatatattgcgatcggctgtgctggatacctgacattcggcgacaacatcattggaaacattatcatgctgtacccgcaagcggtctcgagcaccatcggcagaatagcgattgtgttgttggtgatgctggcgttcccactacagtgtcatcctgcaagagcttcaatccatcagattttgcaacacttcgccgaggaaaatgtaagtataagtgctacatcggcggatgaacccactgttgctaccgaaagttctccgttgattcgcgacagtagccttgacctcaatgaggtaattgaagaagaatctatttatcagcctaaggagactccattgagaggcaagagctttattgttataacgtgcagcattttagttgcatcatatcttgtcgccatttcggtttcctccttggcccgtgtactggccattgttggggccacaggctccacttctatttctttcattctgcccgggctctttggctacaagcttataggaactgagcacaagacagccgtgccattgacgacaaagattttcaaatacacaggtcttctcttgtttatctgggggctaataatcatgatcacctgcctgaccgcagctttgaagctaaactaa

SEQ ID NO: 3179 - DNA, 1347 bp, Saccharomyces cerevisiae
atggtgatgtcaagaatacgagatacaatagccaggccattccagaaccttacagcccttgagaaagtggtacagtggctaagattagggacgacattactcataatctctttcgggttggcgttgactgtcggacccctttcttcgccaagaacattgtacatgtcacgactggatacttactctgctgatattacgacgggtttatttaccgtgttgagagagtctatggagcagtcgacatctacagaagaaaataacggtgtaggcttaacaacatccgaactgtatatattgactgcttacaccgaaagtcagataaagaatgttcctcagtacatcacagtgtcgctttatgggaggtgcgattcaacatataccatggtggaagtattcgactctgaaggaaatatgcatagcgtaaagaattcgactactaagagtacctgcagtagcataggaacggactatctttttgattatcgtgaggttttagaaagcttgggtttagatatcattttagattatgcatacaacaaaatcggttcacaacaggcagaaagttctgcatacacgacctacatgaggagtttaaaacataaaaaggccaacgtgttacatttactctatgcagttattagtttccaggtgtgtatgttatttttcatgatatggtactactacataaagggaaggtttatgaacgccctcaaagaaagggcacttgttcatatcaactctctactatcgctagttgttttcattgggggcctgataagtagcataagccttgcctgggttaactacactattcagtctagaattaatacagaattagaggccttcgggttttcttaccatcttggagttacatggtttgcgcttctgtggtgttttgcaggtttgatttctgtgtcatgcttagcttggtctggcttagaatggtgtatttccgataatggcacgtcctatggaggtggaatcgatgataaattcttaggctaccaagccggtgtatttactgatgcagatctagacgatgaaacttcttacagtcaacgttatccgcaacgacagtctacttcgggcgaggctgaactgatgagaaacagtgatactatggcaacaataagaaaaacatctgatgttgacttaaatagtgaaaatgatgctaacaccagtttagaccatggaaatcccaccgcaaatataagcaatggcggcaaacacgaaccatttgctactagagaggaattcgaattgcaggacataagattccggtcaagcaacgacagtgaagaaagtatgcaaagggttatcaagccttcgtcagcattacagttttga

SEQ ID NO: 3180 - DNA, 1347 bp, Saccharomyces cerevisiae
atgttgcgacttttttcactggcacttatcacatgcttaatctactattccaaaaatcagggcccatctgctcttgttgcggccgtgggatttggtatagcaggctatttagctacagatatgttgattccacgtgtgggcaaatccttcatcaaaataggcctattcggtaaggacttgagtaaacctggccgtccggtgcttccagaaacaataggtgctatccctgctgcagtttatttatttgtaatgttcatttacattcccttcattttctacaagtatatggtcataaccacttcaggtgggggccatcgcgatgtctcagtggttgaagataacggtatgaattctaatatttttcctcatgataaactatctgaatatttgagcgctatcctatgcttggaaagtacggtcctcttgggtatcgctgatgatttatttgatttacgttggagacataagtttttcttgcctgccattgcagccatcccactgctaatggtttattatgtggattttggagttacgcatgtacttattcccggattcatggaacgctggttgaaaaagactagtgttgatttggggctgtggtattatgtttatatggcatcgatggcaattttttgccccaactccatcaacatcctggcaggtgttaatggtttagaggttggccaatgtatagtgttggccatcttagcgctattgaacgatttgctgtacttctcgatggggccattagccacaagagactcccataggttttccgctgttttgattatcccatttttgggtgtatccttggcgctatggaaatggaatcgttggcccgccacagtgtttgtgggagatacatattgttatttcgctggaatggtattcgcagtcgttggtatactgggtcatttttcaaagacgatgcttttgctattcattcctcaaatcgttaattttatttattcatgtcctcagctattcaaattggtcccctgcccgagacataggttacctaaatttaatgaaaaagacggtttaatgtatccatcaagagcaaacttaaaagaagaaccgccaaagagcatttttaaaccgatcttgaagttactatactgtctccatttgattgacctggaatttgatgaaaataatgagattattagcacctctaatatgacgttaataaacttgacattagtatggtttggccctatgagggaagacaaattgtgcaatacaatcttgaagttgcaattctgcattggaattttggctttacttggaagacacgctataggcgctatcatctttggccacgacaacctatggacagtacgttga

SEQ ID NO: 3181 - DNA, 1350 bp, Saccharomyces cerevisiae
atgcgtctaaaagaattgttacctaattttttgattgttcatcaagaggtccctgaggatcctattgcattcaagtccaccgataaacgagagaatgaaaataaagagatcaccatccctgagctaatagatactaaagttcctgaattagctgacggtgctactgacactttatatggtttactggtcaatggccatttacaaactgcatatggttcctttagacactttgacaatatatacaaagttcaatataaaagaatgataatcaaatacccacatgggggagaagggactgtggattttgctgtaaatggtagaagtaccaaaagaagaaaagtggaaaaagaatacgtgccgacaagtcaaccggtatttaacggaaacttgaaacgaagatattcgtactattcccctgatgatcctaaattgaactcagacgatgctaagcctatgcttattattctccatggattaacagggggttcgagggaaagctacgtgagggcaattgttcatgaaatcaccacgaagtatgactttgaagcatgcgtgtttaatgctagaggatgttgttattctgcaattacaacgccgctattatacaacggtggttggaccaatgatataagatattgtgttaatgacttgaggaaaagatttccgaatagaaagttttatatgatgggattttcgttaggcgcatctataatgacaaattacttgggagaagagtcagatcgtactaaaatcgaatgtgctatttccgtgagtaatccatttgacctgtacaactctgcatattttattaacagtacaccaatggggtcacgattttattcacctgctttgggtcacaacttactacgcatggttcgaaaccatctctctactctggaagaaaaccctgatttcaaagatgttatcgagaagcatttaaaaaagattcgcactgtgaggcaatttgataacttgttgacaggcccaatgtttggatataaaaatgcagaggagtattacaagaatgcttcatcatataaaagaatacccgggatcagaactccttttatagctttgcatgctcaggatgacccaattgtcggaggtgatcttcctatagaccaaataaaatccaatccatacactttgcttctagaaacttcgacgggggggcatgttggatggttcaaagacagatccggcagaaggtggtacgcagaacccttatgcagatttttgaaaatatttcacgacgaaattactgtaaagggcttaaaacctgacttggaaaatgttcaactcccagatcctaattgcgaacccatagccacaacctttcgcgcgaattag

SEQ ID NO: 3182 - DNA, 1350 bp, Saccharomyces cerevisiae
atgctagtaaataaagtgatagggttactgggtgtactcttcgcaacaagatttacaaatgccgtcgaattggatctagacaactacgaatctttgcaaaatgctacttcactaattgcctacggtttaatggattattacactggtaatcagtatggtaagacggtcggtatgttttcagatccgtactattggtgggaagccggtggtgcctggggctgtatgctagattactggtttttcatggataacgacacctataatgatgaaattatagcagcaatgatacatcaagctggtgatgataatgactatattccgctaaatcaatctaccactgaaggtaatgatgaccaagccttttggggtattgctgctatgactgccgcggagagaaactttactaatcctcccgagaatgagcctcaatggctatatttagcacaggctgttttcaataccatggctttgcgttgggatgccgattcctgtggtggtggtttgaggtggcaaattttcgtttggaactctggttacgattacaagaacaccgtttctaacggtgccttgtttcacatagctgcaagattagcaagatatacaggtaatcaaacatatgttgactgggccgaaaaagtttacgagtggatggtcggtgtgaacttaatttctaatggtacctataagtatgtttacgatggtgtcagcattgatgataattgcaccaaagtgacctcatatcaatggacatataatcaaggtttgctgttggctggctctgcctacctttacaactttacgggatcagacctctggcacacaagaaccaaagagtttttgaacgcttcccaagtgtttttccatgatggtattgtgtatgaagctgcttgtcaaggtccaaattcttgtaatacagatcaacgttccttcaaagcctattttgcccgtttcttaggtgtcactgcacaactagtgccagaaactaggaaccaaattatgtcttggttgaatacatctgccattgcggccgcgaaatcatgttctggaggtactgatggtcatacctgtggattgaattggttcaatgggacttgggatggtatgtatggtctaggtgaacaaatgtccgccttagaagtaatggtcaacacgagggccttagataaacccgcaccatacacggcagagaatggtggttcatctgttggtgatggggcagcaggtactcaagcgcaacccacaaatttggcaccattaaatatcactaagggttcaaaggcaggtgcaggtattattaccgctgtcattggtatttcaattgtcgcatgtgctctgtggttagtcttttga

SEQ ID NO: 3183 - DNA, 1350 bp, Saccharomyces cerevisiae
atgggtctctgcgcatcttcagaaaagaacggcagcactcctgacacgcagaccgccagcgctggtagtgacaacgttggcaaagcgaaggtaccaccaaagcaggagccacagaagactgtgagaacagtcaacacagcaaatcaacaagaaaagcaacaacagaggcagcagcagccgtctccgcataatgttaaggaccgcaaggagcaaaacgggagcattaataacgcgatatctcccacggctacggcaaatacaagcggatcgcaacagatcaatatcgactctgccctgagagacaggtcgagtaacgttgcagcacaaccatcattgtcggacgcttcaagtggcagcaacgacaaagaactgaaagtgctactgctgggtgccggtgaaagtggtaagtccacggtattgcagcagttgaagattttacaccagaacgggtttagcgagcaggaaattaaagagtacatccccttgatctatcagaatctattggaaattggcaggaacctcatccaggcgagaacaaggtttaacgtcaacttggaaccggagtgtgaactgacgcaacaagacctgtcgagaaccatgtcctatgaaatgcccaataactacacgggccaattcccggaagatatcgcgggcgtaatatctacgttgtgggccttgccctcaacacaagatttagtcaatgggcctaacgcatcgaagttctatctaatggactcgactccttacttcatggaaaatttcaccaggatcacttcgcccaattacagacccacccagcaggacatattaagatcgagacagatgacgtcagggatttttgacaccgtcattgatatggggtcggatatcaagatgcatatttacgacgtgggtggacagcgttccgaaagaaaaaaatggatacactgcttcgacaatgtcactctggtcatattttgcgtttctctatcggagtacgaccagacgctgatggaggacaagaaccagaacaggtttcaggaatcgctggtgcttttcgataatattgtcaacagtagatggttcgcgcgcacgtctgtcgtactctttctgaataaaatcgacctttttgctgaaaaactaagcaaagtgcctatggaaaattacttcccagactacaccggcgggtcagacatcaacaaggctgctaagtacatactctggaggtttgttcagttaaacagggcgaatctaagcatatatcctcacgtgacacaggccacagacacgtcgaatataagattagtatttgccgccatcaaagaaacaattttggaaaatacattgaaagactctggagtgttacaatga

SEQ ID NO: 3184 - DNA, 1350 bp, Saccharomyces cerevisiae
atgtcatacttaaacaatcccgctgttgtcatggacaatggtaccgggctgaccaagctcggtttcgccggtaatgattctccctcctgggtcttccctactgcaatagccacagctgcaccttcaaatacaaagaagtcctcgggcgttggtgcgccctcagcagttagtaatgaagcatcatactttggaaattccacctctgcaaccaatttcaatggtgcaacaggtggtttgctgtctaataatttatccggtaaaagaggtacagaagatttggatttctatattggaaatgaggctttagtagcatcccaaggaccctcttactctttgagctatccaatcagacacggtcaagtggaaaattgggatcacatggaaagattctgggaaaattccatcttcaagtatttaagaacagagcctgaagatcattttttcctattgaccgaaccaccactgaatcctccagaaaacagagagcaagtggcggagattttttttgaatcatttaattgtgctggtctatatattgctgtgcaagcagttttggctctggctgcgtcatggacctcttcaaaagtcacggatagatcattaactggtactgttatagattctggtgatggtgtcacccacgtcatcccagtggcggaaggttacgtcattggctcagcaattaaaaacattccaatagccggtagagacatcacattgttcatccaatccttgctaagagaacgtggtgaagcagacacttccttgagaactgccgaaaagattaagcaagaatactgttacgtctgtccagatattgtaaaggagtttaacaaattcgataaagatccttctaaatttgcccaatttgtggtggaaaaccaagaaaagacaaggagaaaagtcgtagatattggttacgaaagattcttagcacctgaaatcttcttcaatccagaaattgcatcctcagacttcttgactcctttacccacggtagtggatcaaactatccaggcttgccctattgacgtccgtaaaggtttatacaacaatattgtactatcaggtgggtctaccatgttcaaagattttggacgtcgtttacaaagagatctaaagtctatcgtaaataacagaatcgcacaaagtgagctgttaagtggaactaaatcgactggtgtagatgtttccgtgatttctcatcggaagcagagaaacgctgtctggtttggtggctcgctgctggcacaaacagccgaattcaaaggctactgtcacactaagaaagattatgaggaatatggtccggaaattgttagaaatttcagccttttcaacatggtttga

SEQ ID NO: 3185 - DNA, 1350 bp, Saccharomyces cerevisiae
atgtctgctccagctcaaaactacaaaatcgctgatatctctttggctgccttcggtagaaaggaaatcgaattggctgaacatgaaatgccaggtttgatggccatcagaaaggcttacggtgacgtccaacctttgaaaggcgcccgtattgctggttgtttgcacatgaccattcaaactgctgttttaattgaaactttagttgctttgggtgccgaagttacctggtcctcttgtaacatctattcgactcaagatcatgccgccgctgctattgccgcttccggtgttccagtttttgcctggaagggtgaaactgaagaagagtatttgtggtgtattgaacaacaattgtttgccttcaaggacaacaagaaattgaacttgatcttagatgatggtggtgatttaaccactttagttcatgaaaagcaccctgaaatgctggaagactgctttggtctttccgaagaaactaccaccggtgttcaccacttatacagaatggtcaaagaaggcaagttaaaggttcctgccattaacgttaacgactccgtcactaagtccaagtttgacaacttgtacggctgtagagaatccttagtcgacggtattaagagagccactgatgtcatgttggctggtaaggttgccgttgttgctggttacggtgatgtcggtaagggttgtgctgctgccttaagaggaatgggtgctcgtgtcttggttaccgaaattgacccaatcaacgctttacaagctgccatggaaggctaccaagttgttaccatggaagatgcatcccacattggtcaagttttcgttaccaccactggttgtagagatattatcaacggtgaacatttcatcaacatgccagaagatgccattgtttgtaacattggccatttcgatatcgaaattgatgtcgcctggttaaaggctaacgctaaagaatgtattaacatcaaaccacaagtcgaccgttacttgttgtcttctggtagacacgtcatcttgttggctaacggtagattagttaacttgggttgtgctactggtcactcatctttcgttatgtcttgttccttctctaaccaagtcttagctcaaattgctttgttcaagtctaacgataagtctttcagagaaaagcacattgaattccaaaagacaggcccattcgaagttggtgtccacgttttgccaaagatcttggatgaagctgtcgctaagttccacttgggcaacttgggtgttagattgactaaattgagtaaagtccaatctgaatacttgggtattccagaagaaggtccattcaaggccgaccactacagatattga

SEQ ID NO: 3186 - DNA, 1350 bp, Saccharomyces cerevisiae
atgtttttggaaattcctcggtggttacttgccttaataatattatacctttccataccgttagtggtttattatgttataccctacttgttttatggcaacaagtcgaccaaaaaaaggatcatcatatttgtgctgggtgatgtaggacactctccaaggatatgctatcacgctataagtttcagtaagttaggttggcaagtcgagctatgcggttatgtggaggacactctacccaaaattatttccagtgatccaaatatcaccgtccatcatatgtcaaacttgaaaagaaagggaggcggaacatcagttatatttatggtaaagaaggtgctttttcaagttttaagtattttcaaattactttgggaattgagaggaagcgattacatactagttcaaaatccaccgagcatacccattcttccgattgctgtgctatacaagttgaccggttgtaaactaattattgattggcacaatctagcatattcgatattgcaactaaaatttaaaggaaacttttaccatcctttagtgttgatatcttacatggtagagatgatattcagcaaatttgctgattataacttgactgttactgaagcaatgaggaaatatttaattcaaagctttcacttgaatccaaagagatgtgctgttctctacgaccgcccggcttcccaatttcaacctttggcaggtgacatttctcgtcaaaaagccctaactaccaaagcctttataaagaattatattcgcgatgattttgatacagaaaaaggcgataaaattattgtgacttcaacatcattcacccctgatgaagatattggtattttattaggtgccctaaagatttacgaaaactcttatgtcaaatttgattcaagtttgcctaagatcttgtgttttataacgggtaaaggaccactaaaggagaaatatatgaagcaagtagaagaatatgactggaagcgctgtcaaatcgaatttgtgtggttgtcagcagaggattacccaaagttattacaattatgcgattacggagtttccctgcatacttcaagttcagggttggacctgccaatgaaaattttagatatgtttggctcaggtcttcctgttattgcaatgaactatccagtgcttgacgaattagtacaacacaatgtaaatgggttaaaatttgttgatagaagggagcttcatgaatctctgatttttgctatgaaagatgctgatttataccaaaaattgaagaaaaatgtaacgcaggaagctgagaacagatggcaatcaaattgggaacgaacaatgagagatttgaagctaattcattga

SEQ ID NO: 3187 - DNA, 1353 bp, Saccharomyces cerevisiae
atgaaagtagatttaccagaatccagactaccatctttatatagagattttaggccattgaaagatttaaatcccgatgggtacgaagcaaacatcagtacatggagggatttcttcttgcaacaatacatcagcaactccaacagaatcatatttactatagggacaaggactttgcaagaattaactcatgaagtttatggcgtaccgaaaagcattgatatagcaattgacgttcttgttaatgaaggaaatttgatacctatggaattattcaatcttggtggaatgtacactgacaacagtagaaaaggattttggaagtgggttagaagttggaaggagtctacaaacatgtataaaagccggaaggatgaaacaaatttctacttgagagaagacaaatttattatcaaagcaaatttggaaaaagagtatcaaaggtttcatgaattactcaaaagaagtgtttttatggaggcttcatctattacagatttagtattcacaaggaatgaatttgtgaccacagaaagtttgcagtcgttcttttcaacctatgatgaagaaacgaaaaacgtgttcctgcactttatagagaattataagcacataatagtttcaaaagacaatgttatcaaagtcattgccgctgaagtagaagacattactagcaggttctccaaaggcatcacagaaaatgaccttcgaattgctagtgttaaagtgggtattataaacatcaacaaacaaattacaaggctaagaaaagaaattaatgaatctaacattaaactgagaggaccagagtttaatgagctgccgaagagaataaggattgaatataaacaggcgagattactatctgaaaaacatctttctaggttactaaagtttcaaaataacctcgctcaagtaagaactcaaatagacaccagtgctactaatgcggttttaattcaaactttaagtgaatccaacgaagtaattaagtcaattaatggatatattggttctaccgaaaaagtagaagacttactagatgagattaaagagggtcatgaccgtaccgaagaggtcaatgatttattagctcattataataaaggtcaagacgaagaagcagaagaagaaattgaaagagaattagaacaattagaacttgatgaaaagaataataataaggaagaaaataagaaccaggatttgcacgagccaaaagaaagcagtagcgaggatctattaaagagattgaataatctgaagataaatacaaatgaaggacctgtgcaagataatgaaaaccacgataatgagataagaaaaatcatgatggaagaacaaccacgttga

SEQ ID NO: 3188 - DNA, 1353 bp, Saccharomyces cerevisiae
atgacttcggataaacacctttttgtgctgattcacgggctatggggtaactatactcatatggaatctatgaggacaattttatccactacattaaaaaaggaagatgttaacgatgatatgatatattttttaccaaagcagaatgccatgtttaagacgtttgatggtatcgaaatcattgggtacaggacattgattgaagtttgtgaatttatccgagattataaagacgggaaaatcaccaaactaagcgtaatgggatattcgcaaggcggattagtggcccgatttatgatcggtaagatgttgaccgaatttaaagaactgttcgaggatattgaaccacaattattcattacaatggcaacgcctcatttgggggtagagttttacaatcctacgggcatagcatataaaagtgcgttatatagtgcgctgaggaccttgggatctactattttaggtaaaagcgggagagaaatgtttatcgcaaattctagtaacaatatattggtgaaattgagccagggtgagtaccttgaagcactctcgctatttaaatggaggatagcgtttgcgaatgtcaaaaatgaccgtacggtagccttctatacggcgtttattacggattgcgacccatttatagattttgacaacaaattgaaatatacattcgaagaaaagattccgggatctggctataaaggaatattgcctaagattgtcgacctaaacgctttaaacgttaacagccatgctcctactaaaccgaccaagacttataaaaagtggggacgcactattcttattatactagttgcaacattcttaattctcccaatagccctggttatgaatggcctgggaaccgcttatagttatattgttacttgcaagtaccgcaaaatgctctctaatggcattcttcacaatgaggtcagaggaaaattaggattgacggagcaactgaaaggctatgttacagatgcatacgggtccatcataaattcggctttagatatggatgcgaactatgaagcaagtaatagtaatcttgtaaacgaagaagagcttccttggaaggaatttatccaaaaatacacaactataaatgatggtgtttggaaatctaaatttaaaaaactgccttttgatgaaaaccgaaaggttattttgagaaatctaaacaaattgaaatggattagagttccaatatacataaaggctgtaaatgcgcatggcgtgattgtggcacgtagaggaatggacgagaatacagctgctactgggattgcttgtatcgaatttacggcccaattactagcatacttgatgcacaagagtaattga

SEQ ID NO: 3189 - DNA, 1353 bp, Saccharomyces cerevisiae
atgctacgtatgtcaacttcaagattcattgggcaaaggctgttcactacggcacgatctctccaggctgctaaaccggcaccaaaaggtaaaactcaaggattttccaaaaaatcatcttcagtctcatcttactcatctgcaaagagagttactcctggttcattgtataaaaactggacaaacaccacgcacaccgctcaattacaacagaccgccgttcctttggcattacctatcttcaactttgatgatatttccaagactttgaataaagtagtatcatattccaacaaacagtacaaatcccttcaccatttgggttccttcaagaagtcgcagttcaatgaactttttcaaaaaccggtttgtctagttcgtgaagatgcaacgaatagctttttgaagaaactagtatctcatcctgttaaaaaatttataatcactggagagccaggggtcgggaaaactgtactactctctcaagcgcatgcatatgcagttgattccaagcaaatcattattaacatatcatatcctgaattattcctgaacggtaggaatgacttttcttatgatgatgatttaaagcttttcatccaaccgatgtatttgaaaaagcttataaggaaaatattgaaggcaaatgaccctgcattgttaaaatctattgagctatccaaagactacaagttctcgaatgcaaacccaaagaatgcctctgtaaaaccatttgtcacattaaacaaaacgaaaaatacagttttagatttgttatccgtaatgacccacccgcataatcgtggaaaactaatgaaagccattattgatgagttatctgtccaatccaaggtgccaatcatgtttacagtggataatttttcaaaagtgttaactactgcatattctgcgtacagaaatacagagaataaacaaatatattccctggatttacaaatgggtaaattgatgatggacattatttcaggagagacgaaatttgctaatggtgagagttctactatattagctatatccggcgttgacaggacaaacaaaactttacccgtggcattgggcaagatcccagtagacccctatgttactagatatcactatgaaccgaagttcgtagaattgctccaaaaaggtaatgtcaccgaattcgaggttcctaaactgaacaaacaggaagttaacgaactaatcgattactacaaacaatcaaatgttttattagacaaggatatcacaggaaaaaagtgggagaacttgattgacgaaaaatatttcctaagtggtaacggtaacccaagagaattattgaaaagtttagtcctttcccataggtga

SEQ ID NO: 3190 - DNA, 1353 bp, Saccharomyces cerevisiae
atggctaaagatttattgcccaagcaagcggccaacgagccatcgttaaaggactgtacctgtaaaagatgtcttaaattgggtgcttcaaaagaaaaaaagattagaagaaagaagaaaggtgaggagaaaagagaaagacattatggaaatagacgaaagttaacattcaactttttgaagcatacgaacatggaaaatacaaattacgacgtaatcacttcggttggatatctgaatgaaaaatacggattgaaaaaatcacattacattgaaaaatttatcaaatgcatccatagaaaaataaatatcgatgttagcaaaattacggacgcctatgtaaactcgctaaacccgtgggttaaagtaaaactcttccttttattggtgacattgtctgaaaagggtggtccggaatactggctagataagacagatggtgaaaagaactcagaggcgtcttcaacagataatagtttggaaaattctactaaaggagcagatagcgctggatctactgctttgagagatgaaatggtcaaaagccataaaaaccttttcccaactcttacagagcaaatcatacagcataacatcaaccaagattttacggaatcgacttacgacgaggattatgtattttcgtcaatttgggcaaacttcatggaaggactgatcaatcactatttggaaaaagtcattgtaccttactcggaaatgaaagtctgtcagcaattatacaagcctatgatgaaaattatctccctctataacgaatacaatgagcttatggtcaaaagcgaaaagaacggattcttgccttctctacaagactccgaaaatgtccaaggtgataaaggcgaaaaagagagcaaggatgatgccgttagccaagaaagactggaaagagcgcaaaagctgttatggcaagctcgagaagatattccaaaaacaattagcaaagaattaacgttgttatcagaaatgtattctacattatctgctgatgagcaagattacgaattagatgaatttgtttgttgcgcagaggagtacattgaattggaatacctacctgcccttgtagatgtcttgtttgctaattgtggcacgaacaacttctggaaaattatgttggtgttggaaccctttttctactacattgaagacgtcggcggagatgatgatgaagatgaagataatgtggacaatagcgagggcgacgaagaaagcttacttagcaggaatgtggaaggagatgataatgtggttgagcgtcattttaagcctgatccaagggtcattacactggaaaaaatatgtgaagttgctgcaagacagaaatggatataa

SEQ ID NO: 3191 - DNA, 1353 bp, Saccharomyces cerevisiae
atggtcaatagtaagaggcagcagagaagcaagaaagtagcgtcatcctccaaagtgccccccaccaaggggaggacatttactgggtgctgggcatgcagattcaagaaacgcagatgcgacgagaatagaccaatctgttcactgtgtgccaaacatggagataattgtagttacgatatcagacttatgtggttagaggagaacatctacaaagtacgcaagcattcactgatcagttcattacaggctcgcaaatcgaaatcgaaaccattgtgccagaaaatctcaaaatcaaggtttaaacaaatgacccattttagacaactatcacccccgacaagtgactgcgaagacagcgtgcacgaggcaagtaaggaaactacgcttcctaacgataatacattcaccataagcgtacggagattgaagatatacaataacgctgtggcctctgtctttggtagcatgacaaatagagattatactcaaaagcgcatagacaagaagttggacgaattgcttaatatggtggaaaacgacatatctgtggtcaacctcaattgctccaaacacgggccttactcagttttcagggccaatccggctgcagttacctctgctcttacagatcagctgccgtcgccgggtcattcgatgtcgtcagcagaggaaaccactactgcagcgctgtcatcgccgccagaagacagcacctctttgatcgatattatccaaggcaaaattttcgggatcctatggtttaattgctacgggaacatgatattgaaccgacaagaatacacgacgtggttcatcaataagatgaggaactcgttgaccacggaattcatacgcttccttgggaaaataattgacgacccggacatcaatatggcctcgtgcctgttcaaagagtgcatcgctcgttggagttgtgtcgattggcaatccatagctataacaatgctggtcatcattcatggatatacctgccccaacttgacaaagcttctaagagtgtggtttctccagcaaaagctattgagattttcgatgtatccgctggtcaactttatcataaacaatacacaagatttagacgtcctgtaccattgtaatggattgctagggaatgccgacttattcgaggatccctaccaggacgagcttacgtcggagttacatgtcttggtcacggagcgcctagtgaatagttggaaagatacaatattgcaacaactttgctcatgtcaagataccacactttcatgttcccaactgcggtactggcagctacaactgaagtgtaatcaacaattttacaaggatgtatatgccatgcaggactag

SEQ ID NO: 3192 - DNA, 1353 bp, Saccharomyces cerevisiae
atgtcctcaagatatagagtggaatatcatttgaagagccaccgcaaggatgagtttatagattgggtaaaggggctactggcctcaccttttgttctacatgccgtctctcatgaaggtgactacaatgacgacttagcaacaactcaacgtgtaaggtcgcagtatgctgatatctttaaagacattgaagggctgattaaagataaaatagaatttgactcaagaaacatgagccaagacgaaattgaagatggcgcctcttctcaatctctgaatatattaggacaatcgcgtttaaatcttttggttccatcaattggaacattctttacggaacttccattggaacaagcttttctatgggaagactcacaacgggccatttcggcgcgtagaatggtagcacccagttttaatgatatcaggcatatcctgaatactgcacagatatttcactttaagaaacaggagaacttacataatggtaaggttttgagattagtgacttttgatggagatgtgacgctgtatgaagatggtggctccctggtttacactaatcctgtaattccttatattctcaagctgttgcggtgcggtatcaatgtgggaatagtcactgcggccggatatgatgaagctggaacctatgagaacagattgaaaggattaattgttgcattacatgattcaactgatataccagtttctcaaaagcagaatttaacaataatgggtggtgagtcgagttaccttttccgttactatgaagacccggaggaagataactttggctttagacaaattgacaaagaggaatggctattgcctagaatgaaggcttggtccctcgaggacgtggaaaagactttggactttgccgagagaactcttaacaggttaagaaaaagactaaacctaccttcagagatttctattatccgtaaagtcagggcagtgggtatcgtcccaggcgaacggtacgatgaagcttctaaaagacaagttcctgttaagcttgatagggaacaactggaggaaatagttttaacccttcaaaacactttagagtcttttgccccatctagaagaattcaatttagttgttttgatggtggtagtgatgtctggtgtgatattggggggaaagatcttggtgttcgttcattgcaacaattttataaccctgaatctcctatccaaccctctgaaaccttacacgtaggcgatcagtttgcaccggtgggatcagcaaatgattttaaggcaaggctagctggatgtaccctctggatagcatcccctcaagaaacagtgaattatcttcatagattattagaaactgattaa

SEQ ID NO: 3193 - DNA, 1356 bp, Saccharomyces cerevisiae
atgactgatgatgaaaagagggagatattgaaagaatttgatcctttcagccaattggaacaggcaaatggcaacccagataaagatgtgaagtttaaaaaggatgatcctaatagggcagcggcagaagaaactaatagggacatatccgcgcaggacaaaggagatgaggagccattttatgactttcaaatattcattaagcagcttcagactcctggtgcagatcctctggttaaatatacgaaatcattcttacgtaacttcttggcgcaaagacttctatggacggtcagcgaagaaataaaactcatcagtgactttaagaccttcatttacgataaattcactctttacgagcctttccgaagtcttgacaattccaagatgagaaatgccaaggaaggtatggaaaagttaataatggggaaactatattctcgctgtttttcaccaagtctttatgaaattctgcagaaaccattagacgatgagcatatgaaagatttaaccaacgatgacacattactagaaaagattaggcattatagattcataagccccattatgttagatattcctgatactatgccgaatgccaggctgaataagtttgtccatttggccagtaaagagttgggcaaaataaataggtttaagtcaccaagggacaagatggtttgcgttttgaatgcaagcaaggttatatttggtttactaaaacataccaagttggaacaaaatggcgctgacagctttatacctgtgctaatatactgtattttgaaaggacaagtacgatatctagtttcgaatgtgaactacatcgaaagattcagatcaccagacttcattcggggcgaagaggaatattacttgagcagtcttcaggctgctcttaacttcattatgaacttgactgaacgttctttaactatcgaagatcacgaagattttgaagaggcataccaaagaaattttaaacaactagcagaagaaaaagaggaagaagagaagaaaaaacaactagagattccggatgagttacagccaaacggcactttactgaaacccttagacgaagttaccaatattgtaatttctaaattcaatgaactgttttctccaattggagagcccacacaagaagaggcattgaaatctgaacagagcaataaagaagaagacgtttcttcgttaattaagaaaattgaagagaacgaacgaaaggacacgttgaacacattacagaatatgtttccagatatggacccaagcctgatagaggatgtttgtattgctaaaaaatcgcgtattgggccctgtgttgatgctctactttctctgtcagaataa

SEQ ID NO: 3194 - DNA, 1356 bp, Saccharomyces cerevisiae
atgagtaggaatcaagatgtgttccccattttggatctacaggaactagttatatgtttgcaaagctgtgattttgcgctagccacacaggaaaatatctctaggcccacctcagactacatggtaaccctttacaaacaaatcatcgagaacttcatgggtatttctgtagagtcgttgctgaatagtagtaaccaagaaacaggggatggtcacttacaggaagagaacgagaacatttatttggacacgttaaatgttttggtattgaacaaaatctgctttaagttctttgagaacataggtgttcaagatttcaatatgacagatttgtacaagcccgaagcccaacggacacagcgcttactgagtgctgtggtgaattacgctcgttttagggaggaacgaatgttcgactgtaattcttttattcttcaaatggaatcgttgctgggtcagcttcgctccaaattcgatgattataacttgattcagcaacagctaaagcaatacgaggacgtagatggggataatatacctgatgagcaagagctccaaaagctggaagagcaaaataaggagctggaaattcagttgaagaaattgaccaagatccaagaaacgttatccatagattataatgactataagatctccaagcagtcaatctttaaagatctggaagctctgagtttccaaatagtggaattagagtccaatcgagataaactgatcaaaatatccaatacagacatggaagagttatccgagggaatcaaagagctaaatgatctgttgatacaaaggaaaaagacgttagacgacttaaccgcacaacagaaaaacttgcaagatacagtgacgacgttcgaaaccataattagtgagctctatgatgtgctgagaataatttccagcgaggtgcaagagtctaatcgaactgaaacggaacttgtgggattaaagcaaaatttaatcaacaataagctgaaattgatgaatgtattggaaacaggtattatgtataaattagaaatcttacaagaacagttagatttgcaactcaagaatttggaaaagctatcgcaagatactaaagaagagtcgcgcctaaatgatactaaattgatggatctacaaatcaaatatgaaaatgaaatcaaacctaagattgacaaaacggacattttcattcaagaggaactgatcagtggtaaaatcaataaattaaatgatgaaattaaacaattacaaaaagatttcgaagttgaagttaaagaaattgagattgaatattctttattatctggtcatattaataaatacatgaatgaaatgctcgaatatatgcaatag

SEQ ID NO: 3195 - DNA, 1356 bp, Saccharomyces cerevisiae
atggacggaaatgatcacaaagtcgaaaatttaggagatgtagacaaattttattccagaatacgctggaataaccaattttcatatatggccactctgccgccccacctacaaagcgaaatggaaggtcagaaatcattgctaatgcgatatgatacttataggaaggaaagttcttcttttagtggtgaaggcaagaaagttactctgcagcatgttcctacagatttttcagaagcatcacaagcagtgattagcaagaaagatcacgatacgcatgcatctgcttttgtgaataaaattttccaaccagaggttgctgaagaacttatagttaatcgatacgaaaaacttctgtcacaaaggccggaatggcatgcaccctggaaactttcacgcgttatcaatggccatcttggatgggtacgatgcgttgcaatcgatcctgttgacaacgaatggttcatcaccggaagtaatgatacgacaatgaaagtttgggatcttgcaacaggaaaattaaaaactaccttagcagggcatgtaatgacagtgagagacgttgctgtgtcagatcgacatccttatttattttctgttagtgaagataagacggtcaaatgctgggacctagagaaaaaccaaattattagagattactatggacatttatcgggggttcgtacggtgagcatacatccaacgctggatctcatagctaccgcaggccgagatagcgttatcaaactctgggatatgagaaccagaatacctgttattacactagttgggcataagggtccaatcaatcaagtacagtgtactccagtagaccctcaagtggtgagttcatcgactgatgctacggtaaggttatgggatgtagttgctgggaaaacaatgaaagttctaacacatcataagaggtctgtgagagctacagcgttgcatcctaaggagttttcggtggcttctgcgtgtactgatgacatcagatcatggggattagcagaggggtctttactcaccaattttgagtctgaaaagacaggcataatcaatactttaagcattaatcaagatgatgtattattcgctggcggtgacaatggtgtgctttccttttatgattataagtctggtcacaaataccaatcgttggccacgagagaaatggtaggctctctggaaggtgaacggagtgttctttgtagcactttcgataaaacaggtttaagattaatcactggagaagcagacaaaagcataaagatttggaaacaggatgagacggctacaaaagagtcagaaccggggctagcgtggaaccccaacttaagcgccaaaagattttag

SEQ ID NO: 3196 - DNA, 1356 bp, Saccharomyces cerevisiae
atggatcaagaaacaatagacactgactacgacgtgattgtcttaggtaccggtattaccgaatgtatcttatctggtttactctctgtagatggaaaaaaggtattacatattgacaagcaagaccattatggtggcgaagctgcttctgtgaccttatctcaattgtatgaaaaatttaaacaaaatccgatcagtaaagaggaacgggagtccaagtttggtaaagatagagattggaatgtcgacttaattcctaaattcctgatggccaatggtgagctgacaaatattttaatacataccgatgtgaccagatatgtcgatttcaagcaagtttctggctcctacgtttttaagcaaggcaaaatttacaaagtgccagctaatgaaatagaagccatttcatcgccattgatgggtatttttgaaaaacgtagaatgaagaaatttttagaatggattagctcttacaaagaagatgacttgtccactcatcaaggattagacttagacaagaataccatggatgaagtgtattataaatttgggttaggcaattctaccaaagaattcatcggtcatgcaatggctttatggaccaatgatgactacttacaacaacctgctaggccatcgtttgagaggattttgttatattgccaaagtgttgcccgttacggtaaatcaccttatttgtatcctatgtatgggttaggcgaacttccacaaggatttgctcgtttgtcggctatttacggtggtacttacatgctagacactccaattgatgaagtattgtataaaaaagacacaggaaaatttgaaggggtcaagactaagctgggaactttcaaggccccattggttattgctgatccaacttattttcccgaaaaatgtaaatctactggtcaaagagttattagagccatctgtattcttaaccatccagttccgaacaccagtaacgcggattctttacaaattattatcccacaaagccaactgggaaggaaaagcgatatatacgttgcgattgtttcagatgcgcataacgtttgctccaagggtcactatttagcaattatttctacaatcattgaaactgataaaccacatatagaattagagcctgctttcaaacttctgggaccaatcgaagaaaaattcatgggaattgccgaattatttgaaccaagagaagacggctctaaggataacatttacttatccagatcatacgacgcatcctctcatttcgaatccatgactgacgatgttaaagatatttacttcagagtaacaggccacccattagttctaaaacaaagacaagaacaagaaaagcagtaa

SEQ ID NO: 3197 - DNA, 1356 bp, Saccharomyces cerevisiae
atgtcagaagtttccaaatggccagcaatcaacccattccattggggatacaatggtacagtttcgcatattgtcggtgaaaatggttccattaaactccatttaaaagacaacaaggagcaagttgattttgacgagttcgctaacaaatatgtcccaacgttgaagaatggtgcccaattcaaattgagtccttacttgttcacaggtattttgcaaactttgtacttaggtgctgctgatttctctaagaaatttcctgtattctacggcagggaaattgtcaaattctcggatggtggagtttgcaccgctgactggctcatagattcatggaaaaaggattatgaattcgatcaaagtactacgagctttgataaaaaaaaatttgataaagacgagaaggcgacacatccagaaggatggcctcgtttacaaccacgtacaaggtacctgaaagataatgagttggaagaactacgggaggttgatctacccctagtagttattctacatggtcttgctggtggtagtcatgagccgattataagatctcttgctgaaaacctgtctcgcagtgggagatttcaagtggtcgtcctaaataccagaggttgtgcacgttccaaaattaccaccagaaatttatttacagcttatcacacaatggatattcgcgagtttttgcaaagagaaaagcaaagacatccagatagaaaactatacgctgtgggatgctcttttggtgctacgatgctggcaaactatctgggagaagagggcgataaatcacctttatccgcagctgctactttgtgcaatccttgggatcttctcctttcagcaattaggatgagccaggattggtggtcaagaactttattttccaaaaatattgcgcaattcttaacaagaaccgttcaggttaatatgggtgaattaggagttccaaatggctctctccccgatcatcctcccacagtcaagaatccatctttctatatgttcacgcctgaaaatctaataaaggcaaagagctttaaatcgacccgggaatttgatgaagtgtacactgcgcctgctttaggcttcccaaatgctatggagtattataaagcggccagctcaataaacagagttgatacaattcgggttcctacccttgttatcaattccagggatgatcctgttgtcggcccagatcaaccatactcaatcgtggaaaagaatcctcgtattttgtattgtagaaccgatttaggtggtcatttagcttacctagataaagacaacaactcgtgggctaccaaggcaattgcagaatttttcactaagtttgatgaattagtcgtatga

SEQ ID NO: 3198 - DNA, 1356 bp, Saccharomyces cerevisiae
atgtcagagttgagagccttcagtgccccagggaaagcgttactagctggtggatatttagttttagatacaaaatatgaagcatttgtagtcggattatcggcaagaatgcatgctgtagcccatccttacggttcattgcaagggtctgataagtttgaagtgcgtgtgaaaagtaaacaatttaaagatggggagtggctgtaccatataagtcctaaaagtggcttcattcctgtttcgataggcggatctaagaaccctttcattgaaaaagttatcgctaacgtatttagctactttaaacctaacatggacgactactgcaatagaaacttgttcgttattgatattttctctgatgatgcctaccattctcaggaggatagcgttaccgaacatcgtggcaacagaagattgagttttcattcgcacagaattgaagaagttcccaaaacagggctgggctcctcggcaggtttagtcacagttttaactacagctttggcctccttttttgtatcggacctggaaaataatgtagacaaatatagagaagttattcataatttagcacaagttgctcattgtcaagctcagggtaaaattggaagcgggtttgatgtagcggcggcagcatatggatctatcagatatagaagattcccacccgcattaatctctaatttgccagatattggaagtgctacttacggcagtaaactggcgcatttggttgatgaagaagactggaatattacgattaaaagtaaccatttaccttcgggattaactttatggatgggcgatattaagaatggttcagaaacagtaaaactggtccagaaggtaaaaaattggtatgattcgcatatgccagaaagcttgaaaatatatacagaactcgatcatgcaaattctagatttatggatggactatctaaactagatcgcttacacgagactcatgacgattacagcgatcagatatttgagtctcttgagaggaatgactgtacctgtcaaaagtatcctgaaatcacagaagttagagatgcagttgccacaattagacgttcctttagaaaaataactaaagaatctggtgccgatatcgaacctcccgtacaaactagcttattggatgattgccagaccttaaaaggagttcttacttgcttaatacctggtgctggtggttatgacgccattgcagtgattactaagcaagatgttgatcttagggctcaaaccgctaatgacaaaagattttctaaggttcaatggctggatgtaactcaggctgactggggtgttaggaaagaaaaagatccggaaacttatcttgataaataa

SEQ ID NO: 3199 - DNA, 1356 bp, Saccharomyces cerevisiae
atgttgaggacgaggcttactaattgcagtctatggaggccctactacacgtcatcgcttagtagagtaccaagagcacctccagataaagtcttggggttatctgaacacttcaaaaaggtaaaaaatgttaacaaaattgacctgaccgtaggaatatataaagatggttggggcaaagtgacgacgtttccctccgttgcaaaagctcaaaaattgattgaatctcatttagagttgaataagaatctttcatatttaccaataacaggttccaaagaatttcaggaaaacgttatgaaatttttgttcaaggaatcatgtccgcagtttgggccattttatttagcccatgatagaatcagctttgttcagactttgagtggtacaggcgccctagctgtagcagctaaattcttggcattatttatttcaagagatatttggatacctgacccatcatgggcaaatcataagaacatttttcagaacaatggttttgaaaatatttaccggtattcctattataaggacggtcagatagacatcgacggatggattgagcaattgaaaacctttgcatataacaaccagcaagaaaacaataagaacccaccttgcataatcttgcatgcgtgttgtcacaaccctacaggtctcgacccaactaaagagcaatgggaaaagattatagatactatatatgagctaaaaatggtacccattgttgatatggcttatcagggtttagagtctggtaacttactaaaggacgcatatttattgaggctatgtctcaatgtaaataaatatccaaattggagtaacggtatctttctttgtcaatcttttgccaagaacatgggcctttatggtgaacgagttggttccttaagcgttatcacgccggcaactgcgaacaatggaaagttcaaccctctacaacagaaaaactcattgcagcaaaatattgactcccaattaaaaaagattgtcagaggtatgtattcttctccaccaggatacggttctcgtgtggtaaatgtagtattatcagatttcaaattgaaacagcaatggttcaaggatgttgatttcatggttcagagattgcatcacgtcagacaggagatgtttgaccgtctagggtggccggatcttgtaaatttcgcacaacagcacggtatgttttactatacaaggtttagtccaaagcaagtcgaaatattgagaaacaattacttcgtctatttaacaggtgatggtagattgtcgcttagcggagtcaatgattcgaacgttgattacttatgtgaatctcttgaagcagtctcgaaaatggacaaactcgcataa

SEQ ID NO: 3200 - DNA, 1359 bp, Saccharomyces cerevisiae
atggccgtatcagcccgtttgagaacgactgccgaggatacatccattgctaaatcaacacaagatccaattggtgatacagaaatcagtgtagcaaatgctaagggcagcagcgatagcaacattaagaattcgccaggcggaaacagcgttggtcaggagtcggagctagagcatgtccctgaggaggatgactctggtgacaaggaagcagatcatgaggattctgagacagccactgcgaagaagaggaaagcccaaccattgaagaatccgaagaaatcattgaagaggggcagagtcccggcgcctttgaatttatcggatagcaacactaatacacacggtggtaatattaaggacggcaacttggcttcgtctaactctgcacattttcctcctgttgctaatcaaaacgtgaaaagcgcgcccgcacaagttactcagcattccaagttccagccccgtgtccaatacttgggaaaggccagttctagacaatctatacaagtgaataatagcagcaatagttatgggaaaccacacatgccctcggcgggcatcatgagcgccatgaacccttacatgcccatgaatcgctacataatgtcaccatattataatccgtacggtatccctccacctcacatgctgaacaagcccataatgacaccctacgtgtcgtatccatatccaatgggaccgcggacctccattccttatgctatgcaaggtggcaacgctaggccctacgaagaaaatgagtatagtgctagcaattacagaaacaagagggttaacgactcatatgattcgcctttgagtggcaccgcttccactgggaaaaccagacgatccgaggaaggctcaagaaattctagcgtaggatcaagtgcgaatgccggtcctacgcaacagcgcgcggatctacgcccagcagatatgatacctgctgaagaataccactttgaacgggatgcattactctcggccaacacgaaagccagaagcgcaagcacaagcacaagtacaagcacaagcacaaaccgggacaggagttcatggcatgaggcagaacccaataaagacgaagaagagggtacggacttggccatcgaggacggagcggtccccactcccacttttactacgttccagcggacctcgcagccgcagcagcaatcacctagtcttcttcaaggcgaaatccgactctcatcgcatatttttgccttcgagttccccctgagctctagcaatgtagacaagaaaatgtttatgagcatatgtaataaagtatggaatgaatcaaaggagctgacaaaaaaatcatcatcacatcacagaaccggaaaatag

SEQ ID NO: 3201 - DNA, 1359 bp, Saccharomyces cerevisiae
atggctaatactttcaagtattatcctgaaacgatgggtaattctagtggttatccaattagtttgccttttccgaaaggttcggctacttctgctgttaatgttgctaggcaactgcctaaatatttaggtcatgttccctcgcaatcagttcatactcagttgccatccatggcttctttaggttacttcaatcagccaagttctacttactatgctcctcctgcaccacttcaacagcaccagcaaccacctatccttccccctccgggcctaatgtacactagtaacaataacagcaacgttattcctcctcctgttcaaatgattcgggatggacaacaacaaccacaacaatctaaccaagtaaatgggggcgtcagtgagaacttggactacgatatttctataatgtcaaaatttatcatggaaaatgcctttgttgccttcaacgcgaactatagtactgatgaccagaccactgatctttttttcaagggcatatcttctgtgttgaatgccacgagattgccttcagctactatttttttggctatagattatcttttcaagtatatcaataaattatctaatgggatacattcaattggtggcaattcgatcaatatcatttatcaaaatactatgattgcgttcatattagcaaacaagttcaacgatgacaaaactttcaccaataactcatggtcacaggcaacaggaatactgataaatgttatcaatgatttcgagagacaatggttgagaatatttaactgggaattgtatgatagtgcttttctttattttgagttcgtcaagaattttgagattttcaagcaaaatcaactcaaacctgctgtagcggttcctacgttattatctccaattgtcaacgttggtgatacgagaaacgtaaatttcaacttgaagcctacttccacaaacaacctattatctccagtttccaattatgaaacccccatgctgatgccgcataacatgttttcatcaccatcttatcagagtaactcaaggtctgaattttctagtatgaatggttattataactattacaactataatcagccaagattgaattactatcaacaattccccaatatatattcttcaccaatttcggaaactcagtttgattacgacttctacaatttcagtagtcaacaacaacagcaacaacaaaaacaacactcacttttacctgccgctccacaattacctccccctcacgtccataatcagtcttacggtcatcatcttggctggaagtcaatggatgacacaataaatcattcaagatttgagcgaaactactttccgtattcggcagtgtattag

SEQ ID NO: 3202 - DNA, 1359 bp, Saccharomyces cerevisiae
atggggtacagtactatttccaacgataatgatatcaaagtatgtgtgataatggttggcctaccagctagaggaaagtcttttatttcccaaaaaattatcaggtacttatcgtggttatccataaaagccaagtgttttaatgtgggaaattacagaagagacgtgagtggaaatgtcccaatggatgctgagttttttaacttcgaaaatacagataattttaaactcagagaattggctgcccaaaatgccataaaagatattgttaatttttttactaaagaagacggatctgtggcagttttcgatgctactaatagtacacgtaaaagaaggaaatggcttaaagatatatgtgaaaagaataatattcaaccgatgtttttagagagctggagtaacgatcatgaactgattataaataacgctaaggatatcggtagcacatctcctgattatgaaaactctgaacctcatgtggcggaagctgattttttggaaagaattagacaatatgaaagattttatgaacctttggacccccaaaaagataaggatatgacgttcattaagttggtcaatattattgaagaagtagtaattaataagatcagaacatatttggaaagtaggattgtattttatgttatgaatattcgtcctaaaccaaaatatatctggctctcccgtcacggcgaatcgatctataacgtagagaaaaaaattggcggggattcatcactgtctgaaagaggctttcagtacgctaaaaaattggagcagttagtgaaagagagcgcaggagaaataaatttgaccgtgtggacttccaccttaaaaagaacacaacaaacggcaaattatcttccctataagaaactgcaatggaaagcacttgatgaattagacgctggcgtttgtgacggaatgacgtatgaggaaattgaaaaagaatatcctgaagattttaaagcacgtgataatgacaaatacgagtacagatatcgtggtggagaatcatacagagatgtagtgattcgtttagagcccgtcattatggaattggagcgccaagaaaatgttctcattataactcatcaagccgtacttcggtgtatatatgcatattttatgaacgttccacaggaggaatccccttggatgtcaatcccactacacacattgatcaagctggagcctagggcctatggcacaaaggtcaccaaaattaaagcaaacatccctgcagtgagtacatataaagagaagggtacaagccaagtaggtgagctttctcaaagctcaactaaacttcatcaactgctcaatgactctcctttggaagacaaattttaa

SEQ ID NO: 3203 - DNA, 1359 bp, Saccharomyces cerevisiae
atgggtagaagaaaaattgaaattgaacctatcaaagatgatagaaatcgtacagttactttcataaagcgaaaagcaggactatttaaaaaggctcatgaattgtcagtactttgccaagtagacattgctgtcattattttaggatccaataatacattctacgaatactcttctgttgatatgagtaacctgcttaatgttcatcaaaacaacactgatcttcctcataatatcatagaaccatctgattatggtgactatgtgaaaaaaccacgtgttgttctgaatgaaaggaagcgcaggcgaagaagagcaaccgtgttgcaaccagcttcccattctgggagttgtacagtttcgagtcaagattcctccagtgtacaaaacaatgggaatttaagcgctccgttggcgtcaaatgacgccgggaacgctggtgtaagtacaccattggtgcattgccacggagcaatatcacgtagcggatccaatcattctgactgtgcaagaaatagtgcagattatcaaatgttgcaaggcggtttaaattctggtgggagttttcatgctaatgattataaagaaagcgtagaccaacagcatgttgcaaacgaggctattcataggaattttatgaacaagaggattaggccggatactcatttactactttctgaatctaaccactctaattatcataatttttacccgtcgccttacgagaatttgccaaagccttcattgcctgcaagtttagtgggcaatattccatcctttcaatcgcaatttgtacaggttattccggcaaatagtaacccaatgggaaaaggatttaatgggacgggtgacagcgagagctttgaagcaaagcaaaagatacacccgacagttgctatatcaaatactttggaaggtccagctccagtgcaggcgatggtccatcacctgcaccaactgaacagcaatagaggaaagctctcagggaagccatatttaaagctaaatattccgaaggccacaaatgacgcttgccagaggtcgccagcaatgtattcaggaaccgcatcaccgaaaacggatgtacaagccactcccaatcaaatgctcgccagcaacatgtcctcccctctttctcgttcaaagtttttgggattcaagaacaatgatatggacgacttatatcataatggccgatgtggcagcacttatgtaaataacaaaacattctttctgaaaccgccaattggaagaccgcctaaatttccgaaaagcccgtcttcatctattgtggtttttccttcctcggtagctagttcaactttgaaatccacgagttcgacaaactctccagattaa

SEQ ID NO: 3204 - DNA, 1359 bp, Saccharomyces cerevisiae
atggtatcagaggataagattgagcaatggaaagccacaaaagtcattggtataattggtctgggtgatatgggcctattatacgctaataaatttacagatgctggatggggtgttatatgttgtgatagggaagaatattatgatgaactgaaagaaaaatatgcctcagctaaattcgaactggtgaaaaatggtcatttggtatccaggcaaagcgactatattatctatagtgttgaagcatccaatattagtaagatcgtcgcaacgtatggaccatcttctaaggttggaacaattgttgggggtcaaacgagttgtaagctgccggaaatcgaggctttcgaaaagtatttacccaaggactgcgacatcattaccgtgcattcccttcatgggcctaaagttaatactgaaggccaaccactagttattatcaatcacagatcacagtacccagaatcttttgagttcgttaattctgttatggcatgtttgaaaagtaagcaagtttatttgacatatgaagagcatgacaagattaccgctgatacacaagctgtgacacatgctgctttcttaagtatgggatctgcgtgggcaaagataaagatttatccttggactctgggtgtaaacaaatggtacggtggcctagaaaatgtgaaagttaatatatcactaagaatctattcgaacaagtggcatgtttacgcaggattagccataacaaacccaagtgcacatcagcaaattcttcaatatgcaaccagtgcaacagaactatttagtttaatgatagataacaaagaacaagaacttactgatagactattaaaagctaagcaatttgtatttggaaagcatactggtctcttactattggatgacacgattttagagaaatattcgctatcaaaaagcagcattggtaacagcaacaattgcaagccagtgccgaattcacatttatcattgttggcgattgttgattcgtggtttcaacttggtattgatccatatgatcatatgatttgttcgacgccattattcagaatattcctgggtgtgtccgaatatctttttttaaaacctggcttattagaacagacaattgatgcagctatccatgataaatcattcataaaagatgatttagaatttgttatttcggctagagaatggagctcggttgtttcttttgccaattttgatatatacaaaaagcaatttcagagtgttcaaaagttctttgagccaatgcttccagaggctaatctcattggcaacgagatgataaaaaccattctgagtcattctagtgaccgttcggccgctgaaaaaagaaatacataa

SEQ ID NO: 3205 - DNA, 1359 bp, Saccharomyces cerevisiae
atgtcatcatctgcgattaaaataaggaatgcactgttgaaggcaacagatcccaagttgagaagtgataactggcaatacattttagatgtttgcgatttggtgaaggaagatcccgaagataatggacaagaggttatgtctcttatagagaagaggctagaacaacaggatgctaacgtgatcttaagaaccctctctttgacggtatctttggcagaaaattgtggttcccgcttaagacaggaaattagttcaaaaaattttacctctttgttatatgcgctcatcgagagccattctgtacacattactctaaaaaaagcggtgactgatgttgtcaagcaactgtctgattcattcaaggatgacccatcattacgcgccatgggagatctatatgacaaaattaaaagaaaggctccatatttggtacagcctaatgtaccagagaagcataacatgagtacccaggcagacaactcagatgatgaggaattacaaaaagcactaaaaatgtctttgtttgagtacgaaaagcaaaaaaagctacaagaacaggaaaaagaaagtgccgaagtccttccgcagcaacagcagcagcatcagcagcagaatcaagctcctgctcacaaaataccggcacaaaccgttgtgagaagagttcgggctctatatgacttaaccacaaacgaaccggatgaattgtcctttaggaagggcgatgttattacagtgctggaacaagtatatagagattggtggaagggagctcttcgaggaaatatgggtatatttccattaaattatgtaacaccgattgttgagccatcgaaagaagaaattgagaaggaaaaaaataaggaagccatagtattctctcaaaaaactaccatagatcaacttcataattcgcttaatgcagcttctaaaacgggaaattcaaatgaagttttgcaagatcctcatattggagatatgtacggatctgtaacgcctttgagacctcaagttacgagaatgttaggtaaatatgctaaagaaaaagaagacatgttatccctgcgtcaagtcttagcaaatgcagaacgctcatataatcaactaatggatcgtgcagctaacgcacatatctcaccaccagttccaggccctgcactctacgcaggaatgactcatgctaataatactccagtaatgccacctcagaggcagagttaccaaagcaatgagtactcaccttacccttctaatttgccaatccaacatcctacgaatagcgcaaataataccccacaatacggttatgatcttggatattcagttgttagccaaccaccacctggttatgaacaatag

SEQ ID NO: 3206 - DNA, 1359 bp, Saccharomyces cerevisiae
atgtctggaacatttagttatgatgtgaaaacaaaggagaacgaaccattatttgagtttaattctgcttattctcccagggtatcgtatcattttaactccaaagtttcacattaccattatggtgttaagcatccaatgaagccgtttcggttaatgctaacggatcacctagtttcctcttatggattgcacaagattatggacctttatgaaacaagaagcgctaccagagacgaattactacaatttcactcggaagactacgtgaattttctctcgaaggtttcaccagaaaatgcaaacaaactgcccagaggcacacttgaaaattttaacattggagacgactgtcctatttttcaaaatttatatgattatacaacactatacactggtgcgagccttgacgccaccaggaaactaatcaacaatcaatcggacatagcgataaattggtctggtggtcttcatcatgcaaaaaagaatagtccatctgggttttgctatgtaaatgatattgtgctttctattttgaacttattacgatatcacccaagaatcctttatatcgatatcgacttacatcacggcgatggtgtccaggaggcattttacaccacagatagggtcttcacgttgtcttttcataaatataatggcgaatttttcccaggaactggtgatctgacagaaattggttgcgacaaaggaaaacatttcgcattaaatgtacccctagaagatggcatagatgacgactcatatataaaccttttcaagtcaattgtagatcctctaataatgactttcaaaccaacacttattgtccaacaatgcggtgcggattccttaggtcatgatcgcttaggatgcttcaatttaaatataaaggcacatggagaatgcgtaaaatttgtcaaatcatttggtctaccaatgctagtagtgggcggtggaggttatacacctagaaatgtatcacggctttggacctacgagacaggaattttaaatgatgtcttgctaccagaagacatccccgaagatatcccattccgggactcattcgggccggattattcactttatcctatgttagatgacttatacgaaaacaaaaacagtaaaaaactactggaagacattagaatacgatgtctagaaaatatcagatacttgcaaggagcaccaagtgtcagaatggatgctgaatgcataccgacacaagatataagtgccctgacagaagaagaggataaaatcattcaagaaatgaatgaagaaacagaagcagacagttcaaataggctagaagaaatggaaaaagaaaacagtggattgattgccttttcatag

SEQ ID NO: 3207 - DNA, 1359 bp, Saccharomyces cerevisiae
atgtgcgtgtacaagtcaaattcgaacaacagcaacccttcttttatcttcgaaagaaccgtgcaagaggcaagttcaaacgatttatttcttcaacctccggtttccgcctccaacacatctcatagctcaagatctaatagtttttacaacttgcagaccatttctccgatacctatctctggtagcgaggttagaactccatcgttgaggaagaactccaataatgtttcctctccgctagataacgtcataccaacgtctaggtcggcgtcgaactccaccacaagctcgctagcacatcaagagtacatcttgaaccccatttgcaacatgcaaaatcatcaccatcgccgtcgtacgttagaaaactcggtggctccagctttagatgctagttgctcaatagtgaacgatgagaacactgacctgagcgatgtcgatatggtttattcaagaagaccttcctctgctgtgagcctaaacatggccctgttggctagaacgaatagtgccactcttccctcatcagaatcttcgccagcatcgccagatcttaaactttcgagatctcattcgcattctgcggctacacgtcccaccttgaataacatcaataacaccgggatgaccaccacaacttcaaatggcgaaccaaactccagaatactaagattctactcttacgtcgatatgttgaatgatgaaaaacttgcacaggccaataatacgcctacatctagaccacctatgaaatcccaagcgtactcatgccctttcatcctcaagaggtccccaccacaagcctattcttcatcgtcagcaacaacgacattttccaaccccttcatcaaaactacagaattaccagctacttcgccttatgtatctccgcagcaatctgcgagacaatattcaaataatgctaataacaatgcaaaatccccaaaaaaccggtcatcttcgatactatttcaaagacaatccattttatcaaacgttgaccctgttgcaaacatgcacaagaatcccaagttccaaatagaatcaagtgacagcgaagaagaagatttaaccatggacatgctagatccttcctttccgttaagttcgtctttgcgttcaagtgcaaacttggcaagtaatcccgaattagcaacccagacgcctttatcgacatcttcgtcatatacagcaataggcaagcccatgcctttatcaacagatccttcttacgtgtcttcttctaatacgttatcctccgaacatgagttaagagttgaaaaagtcagtgaagtgcttaagaaaaaagtttcaaatggtggattttcaactgaatttaatagttgtgatacataa

SEQ ID NO: 3208 - DNA, 1362 bp, Saccharomyces cerevisiae
atgaacaacacttccataaccggaccacaagtactacatagaacaaaaatgagaccactaccagtgctagaaaaatactgtatctcgccacatcatgggtttttggacgaccggttacccttgaccagactgagcagcaagaaatatatgaaatgggaagaaatcgttgctgacctgccctctcttttgcaagaggataacaaggtgcggagcgtcatcgatgggctggatgtcttggacttggatgagacgatcttgggcgacgtcagggagctcagaagagcatattccattttggggtttatggcgcacgcttatatttgggccagcggaactccccgggatgtattaccggagtgtattgcaaggccactgttggagacagcacatattttgggtgtgccaccgttagctacgtactcctcgttggtgttatggaacttcaaagtgaccgacgagtgcaagaaaacggaaaccgggtgtttggacttggaaaatattacaacgataaacacatttacgggaaccgttgacgaaagttggttttatctggtcagcgtgcggtttgaaaaaatcggcagcgcttgtttaaaccatgggttgcagatattgagagccattagaagcggtgataaaggagacgctaacgtgatagacgggttggagggcttggctgcaacgatcgaaaggttatcgaaagccttgatggaaatggagcttaagtgtgaacccaatgtattttatttcaagataagaccatttttggccgggtggacgaatatgtcgcatatggggttaccacagggtgttaggtatggagcggaaggacagtatcggatcttttctggcgggtccaatgcgcaaagctcgttgatacagacactggacatccttttgggtgtgaaacacactgcgaatgctgcgcattcttcccaaggagacagcaagatcaattatctggacgaaatgaaaaaatacatgccaagagaacatcgtgaatttctttaccatttggaatcggtatgtaatattcgcgaatacgtttctcgtaacgcttctaaccgtgcattgcaagaggcctatggacgttgcatttccatgctgaaaatatttagagataaccacattcaaattgttaccaagtacattattttgccctccaattcaaagcaacacggctccaataagccgaacgtactaagtccaatcgagcccaataccaaagcaagtggttgtttagggcataaagttgcctcatctaagactatcggaaccggtggtacaagattaatgcccttcttaaagcagtgcagggacgagactgtcgccactgcggacattaaaaatgaagataaaaattga

SEQ ID NO: 3209 - DNA, 1362 bp, Saccharomyces cerevisiae
atgatggatatcagccctacctgttatgggtacatcgacgacgagcaagatctagcccttgttttccagggcgtattcaatggaaatttgagatgcatcgaacggaggccatatgatgcagaaaaggttgaattagtcaaccccggaaacatttttgttttcaacgaagagaaatccggcatcaaaagatggacagatggtttttcttggtctccttcaagaatttcaggcaaatttctcgtatatagagagtataataggctgggttccacgcacgatctaccgctgcataatgtacctgagtataatatcttcgagagggctcataggaagtatttttatactggactactgaaaaaaacattttctctaaaattcaatatggatcccaccgacagcactaagctggaaacatttcatcttattgcgtactatacggaaaaggatattcatcaaggaagtttgaggagaccttcagaaaatcctttcttccataaatttcgaccttcacagaaactattagatgctttacaaaaagttgctgtaggaaatggcagatctaacccgtctaaaaataatgagagaggcagaaccaaagctcataattataaaacgcgcaggtctttatcatcttctccgagctattgtgatctcttgagcaattataacaaccatcctggaaatattccagttaggaccgcagttcagttacctttaaccaccttcaataacgctcctcgagaaatgcaccaacagcagcaccgacaacagcaacaatatctcttacccatagatgaacagaataaattacctctcccgtatatgcagcaccagccacaaccaattggtgtttacaatcctaactatcagcctggattgagacgtacggtctcacaacctatgattttctgcaatacatacaatactctcccgcaacaacctactgcagcaccttatgaacggcgtggcgtgtcgccttcagtgatatactcctccaatacattgagcccaataccataccaaaatatcgatccatactcttcgaggtcgggtcctgaatgcaatcactctaaggcgcctatcgccccaacaatgatgcccccagtacaccatatacttgtgcatgattaccgacaaccaaaaccagtcacagattctattaatcctccaaatgtaaacataaccacctccacaaccaacaagaacctagatggcatttatattttgccagctcctcgtatgaatcccccggctcaaacacaataccaaatgattcatgcgccagacagcatgcaacatccaccaacatttagtaaaaacaacacatcaagcaatcctaaatcccaccaatactcaaagtag

SEQ ID NO: 3210 - DNA, 1362 bp, Saccharomyces cerevisiae
atgattcaaacgcaaagtacagcgatcaaacgacgtaattctgttcataaaaacctctttgatccatcactgtatcaaataccagaaccaccacgtggggggttccaacaccaaaaaaaagaatacagtaaggagacattcagtaatcaagtctttggatatgatattactagccttaaaaaaagattcacgcaactatttcctagtaatatacaagggtacttacctgaagttgacctaagaataaccattatttgttctatatggtacgtcacgtcatctatttcaagtaacctatctaaagccattttaagaactttcaaccatcccatagctctcacagaattgcaatttcttgttagtgctgttctatgtgttggatttgcttccatcgtaaatttattccgactacctcgtttgaagcatacgaagttttcaaaggcactcaatagtttccctgacggtatccttcctgaatatctcgatggcaatttcaggagttctatcctgcacaagtttttagttccctcaaagctggttttgatgaccactttccctatgggaatattccaatttattggtcatatcacatcgcacaaggcggtatctatgataccagtatcactagtgcattccgtgaaggcattatccccaataataacagttggctactataaatttttcgaacatcgttattacaattccatgacttattataccttgttacttttaatttttggcgttatgactacttgctggtcaacacatggcagtaagagggcttcagataacaaaagcggatcttcattaatcgggttgctttttgcctttatttccatgataatatttgtagcacagaatatttttgcaaagaatattttaaccatcagaaggaaggtaggaatactgccgtcttcttctacggatgacgtcacgtcgaaggaagggcaaccgagtctagacaaaacaagattttctccattgcaagtggataagattaccatattgttctactgctcctgcattgggttttctttaaccctattaccttttttaaccggcgaattaatgcatggcggtagcgttatcaacgatttaacgctagaaacagtagcccttgtagcgattcatggaatagcccattttttccaagcaatgcttgctttccagttgatcggtttactatcttccattaattattcggtagcaaacatcatgaagaggattgttgttatatccgtggcactcttttgggaaacaaagttaaatttttttcaggtgtttggtgttatcttgacaattgccggattgtacggttatgacaaatgggggctttccaaaaaagatggacgtcaggcataa

SEQ ID NO: 3211 - DNA, 1362 bp, Saccharomyces cerevisiae
atgcctgacaataatacggagcaattgcagggatctccttcaagtgaccagagactgagggttgactgggacaacggtaaccattttgacgtctctcccgacagatacgcgcctcatctatctgaattttacccaattgtaaatagtaaaagaccagtggctagcagtgctggctcagaaaataacgaccatctggacgacatgaaccatttacgttcatccaaagtgtattcaaaggcccgtcgggcatcgagcataacttctggtacgagcacaataaacgacttgcaaacgctaatcacaaagagagatgtgaaagagacccaggaagccctatcgacattactcaggaactcgaatgcttattcggattcgttattaaagacatctcagaatggggcagaaattgcccattccttagaaaacattgccaagttgaagggttgcaatgatgaaacggcggagaaactattgagtgccagtgggttattctaccttttatctaatcatcagcttataatgtcaaagtatttcaatgacttgttgggagataatttaattgatgatattgatgaattcgaattacagaccaagataatggagaacaagttcaaagcacaaagcaaagagcaaagtttaaaattgaaattgcaggaaagacataacttcgatatctcgaaaagaaaaataaggaatttaatctcataccgagagagcctttctagcttgcaagcaaggttagatcaactggagacactaaagcacgatttttacatggattcatacgaacttgtggaaaatacatgcaacaaagtactcagcaaagttgccacggtatctagggcacaagtggaaatttctgaaaatattgcaaggaaaggttggtctggaggcgggctagacgaactactttgtgatgcagacgaccccttcagcaaaaaagcagatgggccatacgggaccatcggtggtgatggagagactgctggagaagcatacaacagcgatgaggaaacgggtgggaatgacgtggtgctcaatgaactactagaaggaaccagccaaccttccacatcaaaaacatctttacccaaatccaaggggtcctcaacggtatccacaccgaatcattcacagtcaagttcaaacaaggacggggtacgaaacaatggcggcggcaaaaatggcgaagatgaggatacagacaatttgatgggaacagaaaattcattttctttaccgcctacgagaaactctgccgaggaaaccacacaaacgtttaaacaattgtccattaaagaagataatgacaatcacagcagcgatacggacggcatgcaagaccagtcaagtaatatataa

SEQ ID NO: 3212 - DNA, 1362 bp, Saccharomyces cerevisiae
atgcttttaataaagaggtacttgatggaccctgaaagtttaaggaggcagataatgaatgtatataaatgttacatgtggaagagagcgttccacagtaatagaagcctactggaagttaaacgtcgtgaaaagagtctccagagaaaaattttggaaaggattcttagacccaaggaggaaaatgctgtcaaaaaatctggattcaagctatggtcaagccatttgaataacccacacaaaacttatatgcggctggaggaattacagagacgtattatggaagaggtacacgttgaaggtattaaaaagaatgataagttattcaacgaaataaatcaatggcatttccaaaatgaaaacacaagtactgttcgaacaccaacattgctgatacatggctatgccgcatcttcaatgtcttttttcagaaattatccaggtctgtccaagcacatccgaaatttatactcaattgacatgccagcgagcggattgtcttcagtaccgtctttagagatcaatacaacaacacctctgccgttagatatcaaatttattggagaaaataaatttaaggttccatatacaataaatgcaaatcacaataaatttgtgattcaaatgtacgaagatttctatctcgacagaatcgagcaatggcgcattgataacaaattgggcaaaatgaatgttgtggggcattcttttggcggatatttatcttttaaatatgctgttaaatatccaaactcggtaaacaaactttgcttggtatccccactaggagtggaaaggaatatctggtctgtaaataataatttccactccaacactctttatactatcgattttaaaaatccaaattccaagttttactccaaaagaaatatgattccaaaatacttatttgaacaacaatttcacattttgagaatgatgggaccattaggagctaagttatgttggaattacataatggcggcatatagccgagtcccatcgttggcatacaaagagtacatatttgaactgttttacggtaagggaggtataccggaggttacgacagatattttcaaagcgttattttcaagatgtatcctagcaaaggaccccttgatggattctctgcaatatttaaatgttaagaaattattgatagtatatgggcaatatgattggatgaataaaaaagccggtatgttcatggtcaaagagttgaacaatttaaagaactgtctagaaggagcaagttatttagaaataccttcttccggtcacaatctttttttagataacccagaatcattcaaccaatctatagtgtccttcttatcagacgaaactaaatcgccttga

SEQ ID NO: 3213 - DNA, 1362 bp, Saccharomyces cerevisiae
atggaactgaatcaggttttagaaaaaaaggagcagattctgcaatacttaggcactctggtcgggcttcacgaaaaagcgttgtctgatgtaaattcggcttcccaggtgacaagcatccggaaggatatcactatttgcttaaacgatctatgcagaattaatgatctcttagtatcccatgatggtctattgaaaagagaaattgggtccttacttcgagacaaacaagagctactagaactgaacgaaagagagcagcttctttggaaagagcggaagtcgtggcatattaagcaagaaaccgatgctgcgccggcggactatgttatcgataaggacgccataattaccatttcatcgcaccaccggacatcactaaacaaatatatcgagtcagtgggggcagaaaatacaatactatccaatacggatgattcggatgcaatgatcgaggaagtacagaacgctgaatcttctgcggatcaaatgatacgtaattacaaactgttacaattatctcataagcaagctaaatcagaaataataaggctggaaactttattaagagacttcaaaaaggacaataaattcattgaagaggagttaaaaaggcaatctggacggatacgttccgaaatgggtaatattgattttcatttgtccaagatagaggaatctaagcatcaattaatgaaaagaataggattcgagtcgcccctgacacaggaaaaatcactatcagaaaagatattcaatttaaggctgtccagcgcggatgaagattacaatgagagacaaactatcaacatgaaaaattttgttcatatgaaggatctcatagaactgaaaattgaagatctacaagagcaactaatgagaaataaaaatgagtcttctacagtactaacgcaacgtgaattatggctagattgtcaaaaaaaagtaggagatttggaaagcaaattaataaccaaacttcggagcagcagcaactccaaaatacctccaaatgaaatgtcagaaatgatcaattctacaatacagtacctaaataaccttcttgactcttctgatgaaaagctcacgacaactttaatatcaaacgaaagggacgtactttcgaaagcttgtgaagaactccatagcgaaagtaccactgcacaagatgggtcaagcgcactaccttctaaaccaattgatatacacaaaagccataaagggtcgaacgcgagttcaaatttaaaacagccctcgactccctcattcttggttgctagcaaatcgccaccaaagattggcatttctgaaagtgtagtaaacgctaataaaaatgatgccatatcaaaaaaagttgaatga

SEQ ID NO: 3214 - DNA, 1362 bp, Saccharomyces cerevisiae
atggagaaagctttggaattagacggagaatatccggaatctctgagggatgaattcaacatccctacatttaaatccatgggactatcgtccgacgataagcctgtgacgtacttatgcgggaattctttaggtttgatgccgaagtcaactaggaattcaattaatgctgagctagatgcgtggagcgattgtgctgtggaatcgcatttcaaacatcctgaagaagccagaggaaaggtgccttgggtcagcattgacttacctattcttccactactagcccccatcgtgggtgctcaagaaaatgaagttgcagtaatgaatagtctcactgcaaatttgaattcattgttaattacgttttataaacctactgagaaaagattcaagatcctttttgaaaagggctcctttccatcagactattatgctttctacaaccagtgcaaaattcatggaatttcggaacctgagaatgtttttattcagatcgagccacgcgagggagagacttatatcagaactcaagatatcctggataccatagaggtaaatcaagatgaattggcgctggtctgtttgtcaggtgttcagtattacacggggcaatatttcgatattggccgaatcacctcatttgcccaccaattccccgacatattggttggatgggatttagcacacgctgtagggaacgtcccattgcaacttcatgattggggtgttgactttgcctgttggtgttcttacaagtacttgaatgccgggcctggtggaattggtggcttatttgtccactcgaagcatactaaaccagaccctgctaaggaaagtttgccaagattagctggttggtggggcaatgatcctgctaagcgatttcaaatgctggaagtattcgagccgattccaggagcattgggattcaggcaatctaatccaagcgttattgacacagtggcattgagaagttcattggaattatttgcgaagtttaatggtattaatgaagttcgtaaaagatcgttgttgctgacgaactatatgacggaactgttggaagcctccaagtattacaaacaccctttaaggatcgagaaattaccatgtttttttacaatattaactccaacaagcacagatgaagaacatggcgcccaattgtcactttacttcgattctgacactggaaaagaggatattatgcccaaagttttccaatatttgcatgaccatggtgtcattggcgatgcaagaagaccaaacgtaattagattggctcctgctcccttatataatacattttcagatgtatacattgcggtgaatgcactaaatgaggcgatggataagttgtag

SEQ ID NO: 3215 - DNA, 1362 bp, Saccharomyces cerevisiae
atggccaagagaagacaaaagaaaagaacacatgcacagcttacacctgagcaggaacaaggtatacctaagtcaatggtaatcagagtgggtcaaacttctttggccaaccattctctgaaccaattagtaaaggacttccgccaaatcatgcaaccacatacggctataaaattgaaagagcgcaagtccaataaactgaaggatttcgttgttatgtgtggcccattaggtgttacgcatctttttatgttcactcaatctgaaaaaacaggaaatgtctccctaaagatagctagaactccgcaaggtcctactgttacttttcaagtattggactattctctgggtagagatatcaaaaaatttttgaagagacctaaatcgttgaataatgatgatgtattaaatcctccattgctagtgctaaacgggttttccacatccaaaagatctggtgaagacgaccaggatgtaaacgtggagaaggtcattgtttctatgtttcagaatattttcccacctctgaatcctgcgagaacttctttgaattctatcaaacgtgtatttatgatcaataaagacagggaaacaggggaaatttctatgcgccactattttattgacattcgagaagtagagatctctagaaacctaaaaaggctttataaagccaaaaataatctaagtaaaacagtgccgaatttgcatcgaaaagaagatatttcttctttgatattagatcacgacttaggcgcctatacatcagaatctgaaattgaagatgacgctatcgtgagagtagttgataatcaggacgtgaaggcaaagcattctcaaagtttgaagtcccaaagaacaccggtcgaaaagaaggataataaagagcgtgaaaaagaaacagaagaagaagatgtggaaatggaggaacctaagccttcagaaaacttgcaaccaaccccacgtaagaaagctatcaaactaactgaattaggaccaagattaactttaaaactggtcaagatagaagaaggtatttgttcaggtaaagtgttacatcatgaatttgttcaaaaatcaagcgaagaaatcaaagctttagaaaagagacacgctgcaaaaatgaggctgaaggaacaaagaaagaaggaacaagaagaaaacattgctaaaaagaaggctgttaaagacgctaaaaagcaacgtaaattggaaagaagaaaagctagagcagcagaaggaggtgaaggtcaaggaaaagatgatgcgatgagcgatgatgagtcttcatcaagtgacagcgaacattatggtagcgtaccagaggatctagatagtgacttatttagtgaggtcgaataa

SEQ ID NO: 3216 - DNA, 1362 bp, Saccharomyces cerevisiae
atggctaaaagaaggcagaaaaagagaacgcatgcgcagatcacacccgagcaggaacgagatattcctaaatccatggtaatcagagtgggacaaacttcattggctaaccattctctaaaccaattagtaaaggattttcgccagatcatgcaaccgcatacggccgtaaaactaaaagagcgcaagtccaataaactgaaggattttgttgttatgtgtggcccattaggtgttacgcatcttttcatgttcactcaatctgaaaaaacaggaaatgtctcgctaaagatagctagaactccacaaggtcctactgttacttttcaagtattggactattcactgggtagagatatcaaaaaatttttgaagagacctaaatcgttaaataatgatgatgtattaaatcctccattgctagtgttaaatgggttttccacatcgaaaagatctgatgaagacgatcaggatgtaaacgtggagaaggttattgtttccatgttccagaatattttcccacctctgaatcctgcaagaacttcgttgaattctatcaaacgtatatttatgatcaataaagacagagaaacgggggaaatttctatgcgccactattttattgacattcgagaagtagagatctctagaaatctaaaaaggctttataaagccaaaaataatctaagtaaaacagtgccgaatttgcatcgaaaagaagatatttcttctttgatattagatcatgacttaggcgcctatacatcagaatctgaaattgaagatgacgctattgtgagagtggttgataatcaggacgtgaaggcaaaacattctcaaacttcgctgtcgcaaaaaacacccgttaaaatgacagataacgaagaacgtgaaaaaggaattgaagaagaagatgtggaaatggaggaacctaagccttcagaaaattcgcaaccaactccacgtaagaaggctatcaaactgactgaattaggaccaagattaactctaaaactggtcaaaatagaagatggtatttgttcaggtaaagtattacatcatgaatttgttcaaaaatcaagcgaagaaatcaaagccttagaaaagagacacgctgcaaaaatgaggctgaaggaacaaagaagaaaggaacaagaagaaaacattgctaaaaaaaaggctgttaaagatgctaaaaagcaacgtaaattggaaagaagaaaagctagagcagaagaacagggtgaaggtcaagggaaagatggtgcaatgagcgatgatggatcttcatcgagtgaagatgagcattatagtgatgtaccagaggatttggatagtgacttattcagtgaagtagaataa

SEQ ID NO: 3217 - DNA, 1362 bp, Saccharomyces cerevisiae
atgtactcatttgaactggacaaattgaaaattgagctgaaaacatgggagcatgatttcattgataaaaataaaagggaacccacaagggatgacatcaagagcctgcggactgttcggcagatgtataaacaatattccacactgaagaagaaacaatctttgcaacgacaaaaagttgacactcaagagtcggttgaactcccggcacataaaaaagaccacgacgaagtcgtagagataggccctactccccaagtttacggtaaggcgattagtatctttgacatgaatttgtcgcctataaagcctatatacatgacattcacaaataatattgatgttaacaatgataactccaagacaatttctaatgaatcttctccacgaaaaactattctcctaaaatcgtcgcctgcagatcgtacgttagtggcggaaccaatatccagtgtgaaacgccaattaaactttcaaatgctaaacgcttcttctacacgtactccgacttcatcaccatgcaagaatcgcaatgggaagttggtagaaatcaagaaatgtagtccaactattaatcctccactagaatctggcaaaccatcggggtattatggacctaattccccgctaaaattggatgaagaaaacattcacctaaacatctcacttaattcaagcactaaacgccggcttcaaatagcatatccatctttacagaagactccctcaaaggatcaagcggatatttcaacttcatttagtccgtctccactcattagaagaccactgacgaaatccctgatagaattggccagggaacatactgaaattgtaaaagaatttggtgtcttacaggaagaagatattgaagaggaagaggaaggagaagaaggcgagaatggttacgatgagaaaaaccacgaagacgactttgggctagaagatgaactaattagaccaaaagttgtgaaggacatatttcaagaggatgatgataatgatgatagccaagcaagggaagataccttcataagaaagagacccaaaagaagaaaggttatcagaagattacgagacaatgatccagaaaccgagaccgcaggttttgagagagatgtccataaggagctggtgaaactcaaaagaaggaaagtggcagaatttttgggatccacctcacaaatctctgatactgaatttgaacatgatccggaggcaagcagcggcgttgtaagctcagagcaaaagcctacggctaagcgaaagggtagaaagaagtataatctagtgagcaataacttcagaagactaaaactgccaaagaaaaaccgattctctaatggacgatggggaagaaggtga

SEQ ID NO: 3218 - DNA, 1362 bp, Saccharomyces cerevisiae
atgtctgaaaataacgaagaacaacatcaacaacaacaacaacagcaacctgttgccgtcgaaactccctcggcagttgaagctccagcatcagcagatccttcttctgaacagagcgtcgctgtcgaaggcaattctgaacaagctgaagacaatcagggtgaaaatgatccttccgtagttcctgctaatgctattaccggtggtagggaaacttccgatagagttttatatgttggtaacctagacaaagctatcaccgaagacattttaaagcaatatttccaagttggcggaccaattgctaacatcaaaatcatgatcgataagaataataagaacgtcaattacgcttttgttgaataccatcaatctcacgatgccaatattgccttacaaacattgaacggcaaacaaattgaaaacaacattgtcaaaatcaactgggccttccaatcccaacagagttcctccgatgatacatttaacttgtttgtcggtgatttgaatgttaatgttgatgacgaaactttaaggaatgccttcaaagacttcccatcctacttgagtggtcatgttatgtgggacatgcaaactggtagttcaagaggttacggttttgtttcctttacttctcaagatgatgcacaaaatgccatggacagcatgcaaggtcaagatttgaatggtagaccgctaagaatcaactgggctgctaagcgtgataacaataacaataataattatcaacagcgtcgtaactacggtaacaacaaccgtggtggtttccgtcaatataacagtaacaacaataacaacatgaatatggggatgaatatgaacatgaatatgaatatgaacaacagcaggggcatgccaccaagttcaatgggaatgccaattggcgccatgccattaccatctcaaggccaaccccaacaatcccagaccattggtttacctcctcaagtaaatcctcaagctgttgaccacatcattagaagtgccccaccaagagttactactgcctatatcggtaatattccgcactttgccactgaagctgatttaattccgttgttccagaacttcggttttattttagatttcaagcactatccagaaaagggctgttgcttcataaagtatgacactcatgaacaggccgctgtttgtattgttgccttggcaaacttcccatttcaaggcagaaacttgagaaccggttggggtaaggaaagatcaaattttatgccacagcagcagcaacagggcggtcagccacttataatgaatgaccaacaacaaccggttatgtctgagcaacaacagcaacagcagcaacagcagcaacaacaataa

SEQ ID NO: 3219 - DNA, 1362 bp, Saccharomyces cerevisiae
atgtttgatcttaagacgattctcgaccatcctaatatcccgtggaaattaatcatttctgggttctcgattgcccaattttctttcgaatcttacttgacgtacagacagtaccagaagctatctgaaacaaagttgccacctgtgctggaagacgaaattgatgatgaaacttttcataaatcaaggaactactcccgggccaaggccaagttctccattttcggtgacgtctataacctagcccaaaagctagttttcatcaaatacgacctcttccctaaaatctggcacatggccgtttctttattgaatgcagtcctgccagtcagatttcatatggtctccactgtcgcacagagtttatgcttcttgggtctcttatccagtttgtctaccttggttgatttgccactctcttactatagccattttgtcctggaagaaaaatttggtttcaataaattgaccgtccaactatggatcaccgatatgatcaagagtctgactttggcgtatgctattggtggcccaatcctttacctgttccttaagatctttgataaattccctactgatttcctttggtacattatggtcttcttgttcgttgtccaaatcttagccatgacaatcattccagtcttcatcatgcccatgtttaataagttcactccattggaggacggtgaactgaaaaaatctattgaaagtttggccgatagagttgggttccctctagataagatttttgtcattgacggctcaaaaagatcttctcattcaaacgcatatttcacaggtttgccattcacctccaagagaattgttttgttcgacactttagtgaacagtaattctactgatgaaattacggctgttttggcccatgaaatcggtcactggcaaaaaaaccacatcgttaatatggtcatctttagtcaattgcacaccttcctcattttctcccttttcaccagcatctacagaaatacatcattttacaacaccttcggctttttcttagagaagtccactggcagttttgttgatcccgttatcactaaggaattccccattatcattggatttatgttatttaacgacttattaactccactcgaatgtgccatgcaattcgtgatgagtttaatttccagaactcatgaatatcaagctgatgcttatgctaaaaaattgggctacaagcaaaatctatgtagggctctaattgatctacaaatcaaaaacctttccaccatgaatgtagatcctctgtattctagctatcattattcccatccaactctagctgaaagattgaccgctctagactatgttagtgaaaagaagaaaaactaa

SEQ ID NO: 3220 - DNA, 1365 bp, Saccharomyces cerevisiae
atgcatgggcctacttcaaaagctatttcccgcaatgtgagaagcgtgaagagaccaagaagagcacctaggcccgtggtctccacgcaggctatgaacaagttgtctaacgtaacactctctgctgaacaagaaaagttgagagagcgcgttttgtcgttcatgcgttccaacttatctcagtacaagtctgactggaaacatccggccatgtttgtaatccaaggggacgcaggtacaggcaagtctgtgattctaaactccttgttcaatgaaattcagaaactatcccagttctcaccttcttctgaagatatcttacatgggacacataattatctggtagtcaaccatcccgagatgttaaagttatatatccggattagtgacagtttcaaatatatttctaaatcgtcactagaacggcccacttcgttgatcaacaatctacagaagagaaaagtcatggccgatgtagtcattgtagatgaagcacatttgttggccacttctaaggatgctttcaaaagattttatggcgaaaaccatctcaaagacttaatgtccctttgtaaagtgcttgtattggtttacgatgataagcaagctttaagaatgggttcctattgggatgaaggttctaataacggtgccactttaaaggacttttacaacgagattccaccaaaatccagagactggtacactttaaaacagcagtttagggttgctgccccacaaaacgtgttgaactggattgaccaaattagtgtcgcaggtaaaatcccaccaattgaatctgtgctatctaagggcaatgcagattgtgctgacgataaaattaagaattttgatttcaaaatttgggatgattgtggcgccatgtacgaggcaatcaaggagaaagaccgtcaatacggccaatgtaggatgctatctacttacgattttccctatcgcttggacggaaaagactattacgttgaatgtggtgacaatttcaaagttcgctgggatcgctatactccacgtgaagtgacgccttggagtgagcgttgcgacacgattgatgaggtaggtagtgtgtatactatccaagggtttgatctgaattatgctggtgtaattttgggccgttccattgggtatgatgcggctaatgactgcatcaaactaagaccagagctgtatgacgatagggccggtttcaccaaaaagaaaaacattcacaatgcagaggacgttaagcaaaagattattatgaatagcattaatgtcctcttaactcgtggcgtgcgtggtctgtatgtttatgcatacgatcctgaattaagagagagactgcttcgtccatcaaaaaaatag

SEQ ID NO: 3221 - DNA, 1365 bp, Saccharomyces cerevisiae
atgctgaaatacaggtctttgccaatcaagagagcaatccatcatccggcaccaggaattactccaatttctccccgtattatggtaagcaggttgagagtaataccatcttttaatttgaagttcaatcgttggaactcttcggtgccagaaagctcgaaaaaggagttaaaaacgacagacggaaaccaagaaagtgcgagtaaggtctctccagtaaaagagaaggaaaaagtaccctttaaggttaagatgcaaaaagcccttcgtcattattgggatggttccaaacttttggggttggagataaaaatttcttccaaattgctcatgaagagtgctgcaggctacccattgacgagaagagaaaatttacaactgaaaagaactactcaagatatcgttcggttggttccatttgctgctttcctcattataccctttgctgaacttcttcttccatttgcattaaagttattccccaatttacttccttctacttatgaatcaagtaaaaaacgcgagaataaactagaaaatttaagaaacacaaggaagttaatgtctgaaatcataaagaataacaagtcccattttaaacctaataatatttccgaggaacaaaaagctttgtttaacaggttctacacacatgtccgtgctacaggagtgccggagtctcgtcaacagctaatcgaagtagctagattattcactgatgatactgtattggataatgtgacaagaccttacttgattgcattagcgaagtatatgaatttgcaaccattcggcactgatgtgatgctacgttaccgtatcagatacaaaatgcttgaattgaaaaaagatgatctatctatatattacgaggatgcagaacaactctccctctctgaattgaaaacagcatgcgcctccagaggtattagaagtgtagacgtagagcctagcgtgttatattcgaatctaagattgtggctgaacatgaggctcaaggataagatcccatccacgctgttaatcatggctactgcctataactacggtaatgtgcaatcaaaggagtcattgtacgacgcattatgtgacgttttaatcggtatccctgatgaactataccatgaggttaaagtaaacgtcgttaaggaagatgaggcatccgctaagcaaaaattgaaacaattgagggagcaagaagaaattatgaaggaagaagagcagcaagaagagaacgccattgtgagcgtcaaggatgagttgagcttggacgaccaagacaagaacatagatgcggctgctccagacgtaaaaccgcatgacaccaagcctatcggagaagccgctgccatcaaagagaagtaa

SEQ ID NO: 3222 - DNA, 1365 bp, Saccharomyces cerevisiae
atgtcagagccagaatttcaacaagcttacgaagaagttgtctcctctttggaagactctactcttttcgaacaacacccagaatacagaaaggttttgccaattgtttctgttccagaaagaatcatacaattcagagtcacctgggaaaatgacaagggtgaacaagaagttgctcaaggttacagagtgcaatataactccgccaagggtccatacaagggtggtctacgtttccatccttccgtgaacttgtctatcttgaaattcttgggtttcgaacaaatcttcaagaactccttgaccggcctagacatgggtggtggtaaaggtggtctatgtgtggacttgaagggaagatctaataacgaaatcagaagaatctgttatgctttcatgagagaattgagcagacacattggtcaagacactgacgtgccagctggtgatatcggtgttggtggtcgtgaaattggttacctgttcggtgcttacagatcatacaagaactcctgggaaggtgtcttaaccggtaagggtttgaactggggtggttctttgatcagaccagaagccactggttacggtttagtttactatactcaagctatgatcgactatgccacaaacggtaaggaatctttcgaaggtaagcgcgtcaccatctctggtagtggtaacgttgctcaatacgctgccttgaaggttattgagctaggtggtactgtcgtttccctatctgactccaagggttgtatcatctctgaaactggtatcacctccgaacaagtcgctgatatttccagtgctaaggtcaacttcaagtccttggaacaaatcgtcaacgaatactctactttctccgaaaacaaagtgcaatacattgctggtgctcgtccatggacccacgtccaaaaggtcgacattgctttgccatgtgccacccaaaatgaagtcagcggtgaagaagccaaggccttggttgctcaaggtgtcaagtttattgccgaaggttccaacatgggttccactccagaagctattgccgtctttgaaactgctcgttccaccgccactggaccaagcgaagctgtttggtacggtccaccaaaggctgctaacttgggtggtgttgctgtttctggtttagaaatggcacaaaactctcaaagaatcacatggactagcgaaagagttgaccaagagttgaagagaattatgatcaactgtttcaatgaatgtatcgactatgccaagaagtacactaaggacggtaaggtcttgccatctttggtcaaaggtgctaatatcgcaagtttcatcaaggtctctgatgctatgtttgaccaaggtgatgtattttaa

SEQ ID NO: 3223 - DNA, 1365 bp, Saccharomyces cerevisiae
atgtcctcttccatcgatatcagtaagatcaactcttggaacaaagagtttcaatccgacttaacccatcaattggcaaccactgtccttaagaattataatgccgatgatgcactgttgaacaagactagactgcaaaagcaagataacagggttttcaacactgttgtctctactgattccactccagtcaccaaccaaaaaagctctggtagatgttggttgtttgccgctaccaatcaactgcgcttgaatgttctttctgaattgaacttaaaagaattcgaactgtcccaagcttacttgttcttttacgataagttggaaaaggccaactatttcttggaccaaatcgtctcctcggctgatcaagacatcgactcacgtctcgtgcaatacttgttagcagctccaacagaagacggtggccaatacagcatgtttttgaacctagtcaagaagtatggccttatccccaaagatttatacggggatctaccttattctactactgcgtccagaaaatggaattctctgttgactactaaactgagagaatttgccgagactctaagaacagctttgaaagagcgttctgccgatgattccataattgtcactctgagagagcaaatgcaaagagaaatcttcaggttgatgtcgttgttcatggacatacctccagtgcaaccaaacgagcaattcacttgggaatacgttgacaaagacaagaaaatccacactatcaaatcgactccgttagaatttgcctccaaatacgcaaaattggacccttccacgccagtctcattgatcaatgatccaagacacccatatggtaaattaattaagatcgatcgtttaggaaacgtccttggcggagatgccgtgatttacttaaatgttgacaatgaaacactatctaaattggttgttaagagattacaaaataacaaagctgtcttttttggatctcacactccaaagttcatggacaagaaaactggtgtcatggatattgaattgtggaactatcctgccatcggctataatttacctcagcaaaaggcatcgcgtattagataccatgaaagtttgatgactcatgctatgttgatcactggctgccacgtcgatgaaacgtctaaattaccacttcgctaccgcgttgaaaattcctggggtaaagactccggtaaagacggattatacgtgatgactcaaaagtacttcgaggagtactgctttcaaattgtggtcgatatcaatgaattgccaaaagagctggcttcaaaattcacctcaggtaaggaagagccgattgtcttgcccatctgggacccaatgggtgctttggccaaataa

SEQ ID NO: 3224 - DNA, 1365 bp, Saccharomyces cerevisiae
atgtcgaaacaatttgttagatctgcgaagaatttggtgaaagggtactcttctacccaggtcctggtaagaaatgcaacgtcaaacgacaatcatcaagtgtccaaggactcgttaattgagctggctgaaaaatcatatgatagcgcagatttcttcgaaatcatggatatgctggacaaaagacttaacgacaagggcaaatactggaggcatatcgcaaaggcattgacagtaatagattacttgatcaggtttggtagtgagaattgtgttctttggtgtagagaaaatttatacatcatcaagacattgaaggagttcaggcacgaggacgatgagggcatagatcaaggtcaaatcgttagggtcaaagcaaaagaattgactgcattactatctgatgacgaaagactgaacgaggaaaggaacatgaatatcaagggaagaaacaggaaaggaagaagaagaaggggaactgggcgcagtgatgaaaatgacgatgatttgcaaagagccattagtgctagcaggttgacggcggaagaagacgaaagaagaagaaaacaggacgaggattatgaaacagctttgcagttgagcaaagaagaagaggagctaaaaagattgcaagatttacaaagaatgcaacaacagcaaggccaacaacaattgcaacaacctatgtattatgatatttttggtaacccaatcactcctgaggaatacgcacaatttcaattgcaacaacagcaacaacagcaacaacaacagttgcaacaacaaccaatgtactacgatgtattcgggaatcctataacacccgaagaactagcacagtttcaacaacaacaacaactacaggaacaacagtacttagcttctatgcaacagcagcaacaggcaatgtccaacaatccatttgccaaatcagaacagagctcaagttcaccaaaacggaaccaactagtagcagcttcttctccacagcaactgcaacaacaaaaacaacaagagccattgattcaaaacaggacaggcaatcaatcaatgacagacaagtatagtaaactaaacgagctactagccacaggaacaggtattgatacattcggaaatgtaggggaggctcgtattcctgcccaacatacgaagacaggaacattcatcaattctcaaggaacaggatataggcaagtatcggatgatccaaaccacaatccgtttttgaacagtcagtatacaggtttaccaagcactagcgtcgtaccaacacaaacaggctatggctttggtaaccagtctcaacagcagtctcaaaataatggctcaaataaccggggatatactctaattgatttatga

SEQ ID NO: 3225 - DNA, 1368 bp, Saccharomyces cerevisiae
atgactatatctactcttagtaacgagaccacgaagagcggatcttgcagcggccaaggcaagaatggtgggaaagactttacgtatggaaagaagtgcttcacgaaggaagaatggaaggagcaggtggccaagtattctgccatgggcgagctatatgcaaataagacaatacattatccgctgaaaattcagcccaacagcagtggcggctcgcaggacgagggatttgctaccatacagaccacacccatagagcccacactgccacggcttctgttgaactactttgtttctatggcatatgaagactcgagcattaggatggccaaggagctgggatttatacggaacaacaaagacattgcggttttcaatgatttgtacaagatcaaggagcgtttccatatcaaacatcttattaagctggggcgtatcaatgaggcgatggaggagataaactctatcttcgggctggaggtgctggaagagactttcaatgctacgggaagttatacgggtagaactgacaggcagcagcagcagcagcagcagcagtttgacatagatggagatttacacttcaaactgctgttactgaatttgatcgagatgataagaagtcaccatcaacaggagaacatcaccaaggattccaacgactttatactcaatctaattcagtattctcaaaataaacttgcaataaaggcttcgtcaagtgtcaaaaagatgcaagagttagaattagcaatgactctgctgcttttccccttgtcagattcggcggacagcggcagcattaagctgcccaaatcgttacaaaatctgtactcgatatctctaagatctaagatagcagatctggttaatgagaagctgctgaagtttattcatccaaggattcaatttgagatcagcaataataattccaaatttccagatttgttaaattccgacaagaaaataattacgcagaacttcacggtgtataacaacaatctcgtcaatggttcaaatggtacaaaaataactcacatttcgtctgaccaacctatcaacgaaaagatgtcaagcaacgaggtcacggctgctgctaattcagtttggctaaatcaaagggatggaaatgttggcacaggttcagcggcgacaacttttcataacttagaaaataaaaattactggaatcaaacttctgaattgctttcctcttcaaatggaaaggaaaaaggtttagaattcaataattactactcttccgaatttccctatgaaccaagattgacgcagataatgaaactgtggtgttggtgcgaaaatcagcttcatcacaaccaaataggggttcctagggtcgaaaactga

SEQ ID NO: 3226 - DNA, 1368 bp, Saccharomyces cerevisiae
atggacatggccaaccagttgctagatgaattagcacatggaaatttttcccacctaacgctaaacttgtcccaaaatggtagggaaattgctatcttacagaagcaattgaccggatttgatgataaacagctagaaacgtttgtagaacaacacccggctatgcccaatgatacgagattcaaaatcatgtgtacatcctttttaaattatgcccgagatgtcgacccatggtcagcctggtccagttcggatctaatttttgagttttatcaatgtttaatcaactgtctcatcaacgacaatgctcctcacatagaaatgttgataccagtagcaactagagaaacagaatttatcatcaatctcgctgggaaactagactctttccacttgcaactgcatacgagaagtcaccaatttctatcacatatatcgtccatcctatcaagactatttaacagcatcaaacctccacgaggtaacgcatcttctacaaatatacctggaaaacaacgaatactgctctacctggtcaataaactaaataacatctacttcaggatcgagtcaccgcaattatgttccaatatctttaagaactttcagccaaaaagcatgcttgcacatttcaacgaataccagctcgaccagcaaatagaatacagatatctattaggaaggtactacttgttgaactctcaagtacataatgccttcgttcaattcaatgaagctttccagtccttattgaacttgccgttaacgaaccaagcgatcactaggaatggcaccagaatactaaattacatgatccctacagggctgatactgggaaagatggtcaaatggggaccgttgcgaccgttcctttcccaagaaacaattgataattggagtgttctctacaaacacgtacgttatgggaatattcaaggcgtgagtctctggctgagacaaaacgagcgtcatttgtgtgcaagacagttactgatcgtgctcctagagaaactgcccatggtaacgtacagaaatctgattaaaacggtaataaagtcctggaccaccgaatggggtcagaacaaattaccgtactccttgatagaacgggtactacagctatctattggtccgacattcgaggatcccggcgcccaggaaattaccatttataatggcattcactcccccaagaacgtcgaaaacgtacttgtgacactgattaacttgggacttttacgcgcaaactgtttcccacagttacaactgtgtgtagtgaaaaagactacaatgatacaagagattgttccgccggttaatgaacgaatcaccaagatgtttcctgcccattctcacgttctttggtga

SEQ ID NO: 3227 - DNA, 1368 bp, Saccharomyces cerevisiae
atggatatatttaggcatacttttggaaataatgatgattcctttattcgaatcccaggtgcttttagagaagaaccacctgctgatttgaatggaaggacagaagatcaaaacagcaatacaaatgaacccacacagagccgggatggacgcttaaaatcaatactccattttttatttcaagctcccctaatagttctttattatttattgaatttcattgtccgaagttcacgtcttttaaaacctctattaagacttcacggattctaccagaggaagcacaaccgtttactagaccacagttcccaattacaccgtcttttagaaaatctagaaaacgaagctcaagctgtaacgtgttctgaaggtaacgggaataatgatgatggcagcaatactgacagtacgagcaacaatgagagcagtggggtccagtttagttttggttctttatacaaccctgaaaatggaacattttccaaaagcattatgcaaaatagttacactgaattattggatgcttgtagcgaacaagtgaaatttggagtcatttatttacatgacccattgttggataatcatatggattacgttaataaaatattgtgctcagaagcctttgttaacatgataaggaagtaccaggtattactatggtatggtgacgttactacatccgaggggttgcaagtttccaatgcattaaaaattaggcaatatcccctacttggaataatttctttaaaggctgagaaaaaaatagagttaatagcaagagttgaaggttctatttctaactacaaagcccaagatttggaggccatattctccaagaattattctcgattaattcaattgcgtcagcaaagacaaaatattgaaatgcagagattaataagacaacaacaggattcaagataccaggattccttaagacgtgatcaacaaagagaatcagaaagattggaacagacccaaagagaacaaatggaaagagagcaccaaagaatagaaaaccaatggctattgtggagaaaaagccaactaaaacccgaaccctcttctgataaagatgcaagcaaagttgcgatcagactagaaaatgggcagagattagtgagaaagtttgacgcatctctaccaacggaggagatatatgccttcgtagaattacagttgcatgacatgttgaactcagaaaacgatactttacccgtataccaacctgctaattatcagcaccagtatagcttcaaattgatcacgccggtaccaagaagagagcttgatttatctaccaaaatatctgacgttagcggcatatatccatcaggaaatattgtaatggaacgcctggacgaatga

SEQ ID NO: 3228 - DNA, 1368 bp, Saccharomyces cerevisiae
atggctccaactaatctaaccaagaaaccatctcaatacaaacagtcttcaagaaagggtaagaaagcatggagaaaaaatatcgatttatctgacgtagaacaatatatggaaaagaaaattgatcatgaaattacgcatggtaccagtgatataacctctttgcaaaatgatgctctttttcatgttgatgttgagggtgatgagatattgaaaaataaattaattaaaaggaaacaaattaagaaggttctaaaaagtaaagagattttagacgccgttaaaacgaattcaaaaattgcagcactaaatcaccataagaatagtagtggaaatcctaataagattcaaggtgtttctaaacacgaattaaagaaattaatggctttggctggcagagtacacggcgaatcgaagatcaagaatagagttgccaaagacggtctagttaaaacaacggctggcgacttatggggtgaagaatccaattcaaagaaacagaaggtcaaattaccttccggtatcaaacttgatgtggaaaaaaaggaccagatacctgaagaactattgaaaaaatccacgacaagttggtctactgcttcagtcagaccaagtactttagatatagagccaattgcagtaaaagaattcacagaaattccacatgctggtaaatcctacaatcccaacaataaagcttggtcagaattgataaacaaagagtataaagaggaaaaggcaagagaagatgaaagaatcgccttggaaaagtacaaagaaagaattagacatttaatggaaactttagatgacaatgaagaggaagagtcttcatcaaacgaagaagaagaagaagaagaagaagaaaatgaaaatgaaaatgaaagtacgcaatgtagtggatctgataaggaaataaaactatcaataaataagcctgtgaagaataaaaagaaaacaaaatatcaaagaaacaaggcaaagagacatgaagagaaagtaaaattgcaacaagagttgaaagaattgagacaacgtgttaaagatttagaagaagttatcaattctgaagagactgagatactttcagccatagagtcagatagcaacaaggttaaaaaaagcaagaaaaataagaaacacaagttagggacgaaatactctgtgattgatgaaagattggagattaaattttctgacgaattatctgactcattgagaaaactgaaacctgaaggaaatctgctatatgatactgtgagaaaactacaaagttctggtaaggtcgaaacaagagtgcccgttaggaaaggtagaaagtataagcagaaaatcactgaaaagtggacacataaggacttcaaatag

SEQ ID NO: 3229 - DNA, 1368 bp, Saccharomyces cerevisiae
atgggtttagtagacggttatgacacaagctcagactctgatttgaacttcgacgaaggcaaatctgttcatgaaaagaaaaatggtaatttgcatgaagatacttcgtatgaaccttcttcaaataatattcataagagaaaatcacattttacaaagtcagaactaaaaagaagacggaaaactcgcaaaggagatgggccgtggggcagttggtcaagtagtgacgatgaaacttcacaagccagcgaaactcagaaagaagatcaggatatcttcgtgcacgcgctggctgaggacaacctagattcggaacagatagaggtagaggaagtctcccatttttatggtaaatcagaaaaggactatcaaggcagaggatatttatatccaccaaatgacgtcgatgttgatcttcgtgaggaaaggatatcctttcggtgttacttaccaaaaaaagttatacgtaattatccggggcatccagaaggaaccactgccctgaaattcttacctaaaactggacacttaattctctctggtggtaatgatcatactataaaaatttgggatttctaccatgactatgaatgcctacgagattttcaaggtcataacaagcctattaaagcattacgattcaccgaagactgtcaatcttttttgagctcttcctttgatagaagcgttaaaatttgggatactgaaactggtaaagtgaaaaccaggttgcaccttaattcaacgcctgcagatgttgaatctcggcccactaacccacatgagttcattgtaggtttatcgaattcgaaaatattacattatgatgatcgtgtttcagaaaatcaaggtcttgtgcagacatatgatcatcacctaagtagcattctggctctcaagtattttcccgatggttcgaagtttatttcttcttcagaggataagacggtaagaatttgggaaaatcagatcaatgtaccaataaaacaaataagtgacacggctcaacattctatgccatttttaaatgtacatccgtctcagaactatttctgtgcacaaagcatggataatagaatatattctttcagtttgaaacccaaatataagaggcatccaaaaaagatatttaaagggcattcatctgctggttatgggataagcttggctttttctggtgatggtcgttacatatgttcaggcgattcaaaaagcagactatttacttgggattggaatacgtcgcgcttattaaataacatcaagattccaggcaacaagcctataactcaagtggactggcatcctcaagaaacaagtaaagtcatttgcagcggagcggcaggtaagatatatgtatgtgactag

SEQ ID NO: 3230 - DNA, 1368 bp, Saccharomyces cerevisiae
atgtcaaaattgttcttagatgaactgcctgagtctctcagccgaaagattggtaccgtggttagagtgctgccaagctcattagaaatatttgaggaattgtataaatatgcattgaatgaaaatagcaacgatagaagcggacgccataaaaagcccagaatagatgtctcttctgacctgcttaaaacagatgaaatttcggaaaccaatactattttcaaattagaaggtgtttctgtactgtcaccattaaggaaaaagcttgatttggtgttctatctttccaatgttgacgggtctcccgtaataacattactgaagggaaatgacagggaattaagcatttatcagctgaacaaaaatatcaaaatggcttcgttcttgccagtgccagaaaagcctaatctaatatacctttttatgacttacacatcgtgcgaggataacaagttttctgaacctgtggtaatgaccttgaacaaagaaaacacactaaaccagtttaaaaatttagggcttcttgattccaatgtaacagactttgaaaagtgcgtcgaatatataagaaagcaagccattttgacgggttttaaaatctccaacccattcgttaacagtacactggtggataccgatgctgaaaaaataaactcatttcacctgcagtgtcatagaggtactaaagaaggcacgctatattttttaccagatcatataatttttgggtttaaaaagcccattttgttattcgacgcttctgacatcgagtctataacctattcgtctattaccagattaacattcaatgcaagcttagtgacaaaagatggtgaaaaatacgagttttccatgatagaccaaactgaatacgctaaaattgacgactacgttaaaaggaaacaaatgaaggataagtctatgtctgaggaattgaaagctaaatccaagagcaaaggccaagcaactgatggcacagccgatcagccatctattctacaggaagctacccgtcaaatgcaagacgagaaaaaggcaggtgtgttttcagacgatgatgaagaaaatgaccaaaatttcgaagctgagagcgacctttccgatgggagtggccaagaatcctcagacggtgcagaagacggagaggaagcagaagaagatgatgaagaagacgatgaagaggaagacaaaaagggccaaagcgctttgaatagagataatagttttgcttctataaatggtcaaccagaacaggaactccaatacaaagagtttaaggagccgttagaactcgaagatattccgatagaaattgataatgatgacgatgaagatgatgaggatggatccggagtagaatacgattga

SEQ ID NO: 3231 - DNA, 1368 bp, Saccharomyces cerevisiae
atgtcagaagaggataaagcgaaaaaattagagaatttattgaagttattacagttgaataatgacgatacttcaaaattcactcaagaacagaaaaaagctatgaaagaccacaaattctggagaacgcaaccggtcaaagatttcgatgaaaaggtggtggaagaaggccccattgataagccaaagacaccggaagatatatctgacaagccactacctttattgtctagcttcgaatggtgtagtattgatgtggacaacaaaaaacagcttgaagatgttttcgttctactaaatgaaaactacgtggaagaccgcgatgcaggcttcagatttaactataccaaagaattcttcaattgggctttaaagagtccaggttggaagaaggattggcatattggtgttcgcgttaaagaaacacagaaattagttgcctttatctcagccataccagtaacacttggtgttagaggtaaacaagtgcctagtgtagaaatcaatttcttgtgcgttcacaaacagctaagatcgaagagattaacacctgttctaattaaagaaattacgagacgagtgaacaaatgtgacatctggcatgcattgtacacggcaggtattgttttgccagcacctgtgagtacgtgtcgttatactcatcgtcccttgaattggaagaaactttatgaagtagatttcacagggttaccagatgggcacacagaggaggatatgattgctgagaatgcgttaccggccaaaacaaagacagcgggattgagaaaattaaagaaggaagatattgaccaagtttttgagttgttcaaaagatatcaatccaggttcgaactaattcaaattttcacaaaagaagaattcgaacataatttcattggtgaagaatcgttaccattggataaacaagtaattttctcatatgtagtcgaacagcccgatggaaaaattacagacttcttctcattttactcattgccattcacaatcctaaataacacaaaatataaggacctaggcatcgggtacttgtattattatgccaccgatgcagatttccaattcaaagacaggtttgatccaaaagctactaaggctttgaaaacaagattgtgtgaattgatttatgacgcttgtattttggccaaaaacgctaatatggatgtttttaacgcgttgacttcgcaagataatacattgttcttggatgatttgaagttcgggcccggtgacgggttcttgaacttctatttatttaattatagagcaaagccgattaccggtggcttgaatcccgacaatagtaacgacattaaaaggcgtagcaatgtcggtgttgttatgttgtag

SEQ ID NO: 3232 - DNA, 1368 bp, Saccharomyces cerevisiae
atgttacaaaagctttccatgaccgcattagtcggtttgttttcttcagttgtgtcactcgtgaacgctgattgtacttactctggcggtaattactattgtgctcaaaccgatgccatcatttactctaacgtcggtttatctgctacctaccaagatgtcaccaatatggatgaatcttcttgtgcttgtacccaagctgatttcactgcttctggtagcttggctcccttcaacgaggaactatctgttcatttcaggggtccgatcgagttactacaatttggtgtttactacccaaatggtgaatctaatgctttgaagaaaagatcagagaaacaatcaatcgagtcctgtaaggaaggtgaagctgttgtctccagacataagcatcagcacaagagggatgttgctgttgaatatgttcaagttacttccactgtttacgtcgacagtaatggtcaaacagtcacagccgattccaccaataccgttgtcggtcctgctgttccttcttcttacactaaagactctactgttttgtccagcagtgctcaagcagttgaaacgagtgaaagccagtcttccatctcttcctctaaaaccacctcttctgctgctgctgcttcatcatcttcgtcatcatcttctaacactaacggtgactggtccagaggttcctactttgtcccaggctctactagcaactgtacattcatgaacaaccaaggggggactgccggttctggtgtctggtcgagttgtttcggtaactccatctcttttgctgcttcagatggtgtttctggtgctgcctccgctcaagctcttggtgatgtcaccattaaatctggtaatgaattcatgattttctccggtgaagaatgttccggtaataacggcgattgtggttattacagagaaggcattcctgcttatcatgggtttggtggggctgataaaattttcgtcttcgaattttctatgccaagtgacaccagcggttctgcctacaatcaagatatgccagctatttggttattaaatgcaaaaatcccaagaaccttgcaatatggtgatgcatcttgttcttgttggaaaactggctgtggtgaaatggatttgttcgaaattttgaccgctggttctgataaattaatctcacacatccatgacggccaagatggtggtactcaagattacttcgagagaccaactgatggtactttaaaggctgccgtaatctttaattcaagtgataaaactattcacattatcgaagtcgacgaaagctttgatgctactttaagcgatgatgtcgttgaccaatggttgagcaagtccggttcttctgcggccttgccatag

SEQ ID NO: 3233 - DNA, 1371 bp, Saccharomyces cerevisiae
atgaccggtgattccagaagcatcagcgaaccctcaattaatctagatccagataatacaagtttttctgatgaaaacagcgatgacttctttatggacaattcctatgatatagatgaaatcgatcatagcgatgaaagtaataggcaaagtgtcatagttgactctaaagtcacggtaccgccatcaaagcattcaactctaacattatctgatagtgaagatagcgacgcaaaggaacaacatcagtccctgagcagatcatctagtaaaaatgtaaatatagaagatattacggagcccaagccagacaaaccatcgggtcgaactagaggaagatctgtgatgaaagagtctgtagttgaaataaactcatctgaatctgacttagacgaagacaaaaattttcccagatctaggtcaaggtccaggtcaagcataagatcaatatctccagcgggaaaatacaagcgacagaaaagttcattactgtatacctatgatgaaaacgatgactttttcaaggaacttgctaaagaagccaaaaaaagcaccactatttctaaagaatcgacacccgaccagcggaagcgagtttataacatcaaatttctctctaagctagaaggaactataaataaagcggtccaagtgaaggtcctcggaaaatacgaattttcaaaaatacttcctgctgctttggacggattgatgaagtcctataaaattccgaaggtaatgaaagatatatacaaggtagagaatgttactctttattggaacaatgcaaaattactcacttttatgacttgtaattcgctacatatcccacaggattttgaaaatgaagtctctgatatcgatgttactatcgtatccaaagaatacgaaaagaactttgaagcgacactggaatcaaagttaaaggaagaagaagctgctttactcataaaagaacgtcaggagatggaaaggaagttagagaaaaagagaaatgaacaagaagagtccgaatatcgcgagtttgaatccgaattaaaaaacgtagaagaaacacaagaaataaaagaaaatgatacagttatgaatacaaaacttctgcaagagggtggctctttgtcaggaaatagtagtagcatggaagaagttatgagaatcgctctcatgggtcaagataacaaaaaaatctatgtccatgttaggcgttcaacaccattttctaaaattgccgaatattacagaatccagaaacagttaccacaaaagacgagggttaaattactttttgatcatgatgaattggacatgaatgagtgtatagccgatcaggatatggaagatgaagacatggttgatgtcattattgattga

SEQ ID NO: 3234 - DNA, 1371 bp, Saccharomyces cerevisiae
atgcaacctaaaactttcgtccaccaacttcatgcaattcttctggaaccggaagtaaataaatggatatactggtctccgactgataacacggtattttttttgaagccatatgaccctaattttagtacacatgttctgaagcgttatttcaaacatggaaatgtcaatagttttgttcgtcaactacacatgtacgggtttcataaactatctcatccttccccagaccaatcttctgccaacaatggtaacgttaaagaacttgttgaatggaaatttacccacccatctggattcttcttcaaagaggccaacgccggtatcttgaataaaatccaaagaaagagcactggtgtgggaaaagatggtaaaagaaagaatatactgtcaccaatatctgtcagttacgttgatgcttcgaggttaaatgttctctctcagcaatccggaccagtttctgcaagagaaccatcaaacatgtttatgggcagtcccgtccattactcaacatcccaaagtcctccacatatcagtataccgcaacagcaacaaagtagtggaccttacctaatatcttcactgccccctcaacaacccacggtgaacatgatgcgaaggcaaagcatctcggcgaggatgatgaattcttatgactatcccaatcaattttccacccaagatagcatagtccagcctcagcagccgcaacaagtactttctccacaagcattatctggacctccgatgaagaaatcaggaacactatcttcgacagatgatctgaaaacaacttccttgccaattgttaattacccaatgccgtatcatcctggagcttttgcccagcagcagcagcagcagcagcaaccgctccctacagtcccgccatatagcagttactccactccatttccctcaatgatgaactctctttcgaactctgcttctaactcacctgctttaggagtttgtaataataatgtaacactacccaaaaaaagcaatataagtgaaaggcaagctttggataaccatatacaaactttaaagaactctctatcaacaatcactgatttgatagaaaaacatattaacagcgcatcgcaagatgaaaataaaactctaactaatgatgccatgaacaaagaccttcgaacaagcttatccctattacagaattccaaggaggaaatcattcaacttgaaagtaaatggatgtctatgcaatctgttaaaacaactgccctaccccttcaagagactacgaatacatcatcgaccttaacttctctgacgtccagcataattcccaagagtatacctataatcacgaaaggtgaagtcgccactaaaccagcatcttactga

SEQ ID NO: 3235 - DNA, 1371 bp, Saccharomyces cerevisiae
atgcccacacctatgacgcctgtcaaggtcggcgctttagcctgccagaggaactcatttctcttcgatgggttcaaaacactggttgtttcttgcgaaccaacgaagaataaaaagggagagattgaaggttatgagattgaactacaagatactattctgttccccgaaggtgggggccaaccaagtgattctggttttttgaaaattgttgaagggaatcgtaattcgtcgaaaattgagaagatattagtttcacacgtttctcgtttcggtttacatgcaaagcatcatgtcaatgactacattgagcccggaacaacagtggaagtggccgtggacgagcaaaagagaatggattatatgcaacaacatactggtcaacacttgttaagtgccattctggaacgcaactacaaagtagacactgtatcttggtcgatgggtggtatcatcacaaagaaaaaacctgttctagagcctagcgactatttcaattatatagagttgaacaggaaattgactctcgacgaaataacgaacgtatcagatgagattaatcagttgatcatcaactttcctcaggaaattattgtagaggaaagaatcggtgaagaaacagtagatgaagttagtacatccaaaattccagacgattacgacctctccaaaggtgttctacgtactatccacatcggtgacattgattctaacccatgttgtggtacacatttgaaatgtacctctcaaataggttccattttaattctttccaatcaatcagccgtaagaggttcaaactcaaggctctatttcatgtgtgggaagcgggtttctttgtatgcaaaatctgttaataaaattttactggattctaaaaacttattgagttgttcagaaactcaaatttctgagaagataacaaggcaaaccaaacaaattcaacaattaaataaaagagaacagtattggataaagagattagcacgtaccgcttctgaagaattaatgaacacactgaaagccagtggaaagaaaagggcttattttatggaagaagaatacggaacattggaactgttgctacagatccacaaggaagtatctaattttttgaaagatgatacagaaggttacgaaattatcctatgcggttatgaaagacaaacgaacactggctcactgctaattctttcggaatcgggtgaaaaaattgccaatttggctgctaacttaggttcgatactacaaaacctaaaaggcggtggtggtaagaaaggtggcaagtggcaaggtaaaattacatccatttcgaatgccgagtttgccgccctctctgattatttaagccatgatttcgcatcatgttga

SEQ ID NO: 3236 - DNA, 1371 bp, Saccharomyces cerevisiae
atgtcagagaaggcttctgaagagagacccatacggctggccgttctggggggcacttctaccggaaagacctccctggtatctaggcttactgttaatatcgtccacgaggttcattatccaacaagaaaccaaactaactggcttttcggctttgttccgtcatcgatcctggccagagctatattagacgaacaagctcacgaaagactttgccttcgttccccaagcagccaaaccttagagcctatcttcccttcacctcaggtctccaaaaatgtactgctgtcgccattggtgtttcaagcttccactgataattttcaatcagtgaggttacacaacaaaagccactccaggagatccctatctttggataaatctgattctccgctgtatcaaactttttccaatgacattaactctcaaagtgttcctaaaatcaaggcagaccagcttaacgttatcgagcattttaaattgcccctgaattacattccacccacttatgcaccaatccagattgatattattgatacgcctggcttcagtcctgataatgtggtgccgttcttagaagtttctctcttccgaaatttaggaaaatcaatcctacatggactagcagatgaaccaagacgacctgtatctactacttcactattggttgcctctggtgcctctgagttgaatggtaaagttgacggttatatcttggtgtatagcgcagtccctgaattaaaccatattggaggccctccggaatatggagatgatgtgatgaacacagatacggaaaacgtcagcgatggtggatttgaacttttaaaagtgattagaaactgcatactagatgcttggactgaatttcgaaattatgaaaaaagatgggaggaaggcaaagaggatgatatttactcattggtttacagcctgagacatctatggagtaaaaatagcaaagagaaaagcgccaaaatagagcaattgagatcctataataccaaactaaaatccatcgagttagacccctcatctcccgattcaccaccaccatgcattatcgtctgttctcacgttaatcatgaactcgcaagcccaatgttgattgaaatgggaagacaactagcaacaaaatggaaatatggatttgttggaatagacagcatggatgatttaaatgtcgatgtggcggttagcttactaataaaggaaatatcagaaaagatgaagctactggtttctaattccaatggaagtagtagtagtggtaattcaagttcaatttacaactctcatttaatgaatgacaagaagaaaaacaacaatgccggcttaaacaaaaatatgttgaagaaaattataaaataa

SEQ ID NO: 3237 - DNA, 1371 bp, Saccharomyces cerevisiae
atgtcatttcgtaaaagaggtgaaatactgaacgatagaggtagcgggctaagaggtccactgttaagaggtcctccacgaacttcctcaacgccattgaggacaggcaacagaagagcccctggaaatgtgcccttgtctgacactacagcgagattaaagaagttgaatattgcggacgaatccaagacaaaaatggggctggatagctcccatgtgggcgttagaccttctcctgcaacctctcagccgacgacatcaactgggagtgctgacctggacagtatactaggccatatggggctgccgctgggaaactctgtactagtagaggagcagagcacgacagaatttcactctattctcggtaaactgtttgccgcacagggtatcgttcataatagaatttcagatagcagtgctgataaaactagaaacggcgacactcatgtcattgtcttgtcattgaaccaaatgtttgcaaaggagctacctggtatctacaagggatcacgtaaacaaatgaagaaaaacctaatctctgaagaagaatcaaaagttactgttcaaaatttgaacgagacccagagatcgacgccttccaggtacaaagacctgaaaattgcatggaaatataaactggcagatgaaaagagattgggttctccggatcgagatgacatccaacaaaattctgagtacaaggactacaatcatcagtttgatattacaacgcgtctgatgcccgctcccatagcatctgaactgacatttatcgccccaactcaacctgtctccactattttgagccaaatagaacagactattaaaaggaatgacaagaaactgataagaattgttattccttcccttctacatccggcaatgtatccgcccaaaatgtttgaatcatctgaaataataggtttaatgcacggtgtgaggagtcttgtcaagaaatactatgagcgggttgtactgtttgcttccatatccatagacattatcactcccccattactggtattgctgagaaacatgttcgattctgttatcaatctagaaccctttaaccaggagatgactgagttcttagaacgtgtttataaatcgcaaccggggaagattcaacatgggctagtccacatattgaaattaccagttttcacggaccgtggagagatgagagttttaaagtctgaatgggcatttaagaatggcagaaaaaagtttgaaatagaacaatggggcatacccgtggatgatgctgaaggttcagctgcctcggaacagtcacattcacactcgcactcggatgaaatctcacataatatacctgcaaagaagaccaagatatctttagactattaa

SEQ ID NO: 3238 - DNA, 1371 bp, Saccharomyces cerevisiae
atgtccagttcacaacaaatagccaaaaatgcccgtaaagcagggaatattttgaaaaccatctcaaacgagggcagatcagatattttatacaaaattcacgatgccctgaaggctaatgcgcatgccattgaagaagcgaataaaatcgatttagctgttgccaaagagactggcctagcggattctttattgaaacgtctcgacctatttaaaggggacaaatttgaagttatgttacaaggtattaaggatgtagccgaactagaagaccctgttggcaaggttaaaatggccagggaattagatgatggcttgacgttgtaccaagtaaccgctccagtcggcgttttgttagttatctttgaatcccgtccagaagttattgccaatattaccgcattgagtatcaagtctggtaatgctgcaattttgaagggtggtaaagagtctgtgaacacgttcagagaaatggcaaagatcgttaacgacaccattgcacaattccaaagtgagactggtgttcctgtgggctctgtgcaattgatcgaaaccagacaggatgtttccgacttgttggatcaagatgagtacatcgacttagttgttcctcgtggttccaatgccttagtcagaaaaatcaaggacactacaaaaattcccgtgttgggtcatgcggatggtatctgctcaatttacttggatgaagacgcagatttgattaaggcaaaaagaattagtttggatgcaaagactaactacccagctggttgcaacgctatggaaacgttgttgattaacccaaaattctctaagtggtgggaagttctggaaaacttaactttggaaggcggagtgactatccacgctacaaaagatttgaaaactgcgtattttgataaactgaatgagttagggaaattgacagaagcaattcaatgcaaaaccgttgatgctgatgaggagcaagattttgataaggaatttttatccttggatttggctgccaagtttgttacatctacagaatcggccattcaacatataaatacacactcttcgagacataccgacgctattgtaacggaaaataaagcaaacgctgaaaaatttatgaagggtgtcgactcctctggtgtttactggaatgcatcaactagatttgccgatggtttcaggtacggttttggtgctgaagtgggtatttctacctctaagattcacgcccgtggtccagttggcttggacggtctggtgagttatcaataccaaataagaggtgacggccaggttgctagtgactaccttggtgctggtggtaacaaagcttttgttcacaaggatttagatataaagactgtgacattataa

SEQ ID NO: 3239 - DNA, 1371 bp, Saccharomyces cerevisiae
atgtcggataagccgattgacatacaatatgataaacaggctactccaaatctgagtggtgtaattactccgccaacaaatgaaactggtaatgactcagtccgggaaaaactttcaaaactagttggcgatgctatgtcaaacaatccctattttgccgccggcggtggtcttatgatccttggtacaggtttagctgtagctagatccggtataataaaagccagcagggtcctataccgacaaatgattgtcgacttagagattcagtcgaaggacaaatcatacgcctggtttctaacatggatggccaaacatcctcaaagggtatctagacacttatccgttaggacaaactacatacaacatgacaatggatcagttagtacaaaattttcgctggttccgggtccgggaaatcattggattcgttataagggtgcttttatcctgattaaaagagaaaggtccgcaaaaatgatagatatcgcaaacgggtcaccatttgagaccgtaaccttaactacactgtaccgtgacaaacatttgttcgatgacattttgaacgaggctaaagacatagccctgaagactactgagggcaagactgttatttacacttctttcggccctgaatggagaaagtttggtcaaccaaaagctaaaaggatgctgccctccgtcattttggacagtggcatcaaagagggtattctcgatgacgtttatgattttatgaagaacggcaaatggtactctgacaggggtatcccatatcgcaggggatatttactctatggccctcccggatctggtaagactagctttatccaggctttagcgggcgaattagactacaacatttgtattttaaacctctccgaaaataatttaacagatgacagattaaaccacttaatgaataacatgccagaaaggagcatactattactggaagatattgacgcggcgttcaacaaaagaagtcaaactggtgaacaaggttttcattctagcgtaacatttagcggtttactgaatgccctggatggcgtcacatcttctgaagaaactattacattcatgactaccaatcatcctgaaaagctagacgcggctataatgagaccaggtcgtattgactacaaagtcttcgttggtaacgcaactccataccaggtagaaaaaatgtttatgaaattttacccaggtgagactgatatatgcaaaaagtttgtaaatagtgttaaagaattggatatcaccgtaagtaccgcccagttgcaaggacttttcgttatgaataaagatgcaccacacgatgcgttgaaaatggtctccagcttacggaacgctaatcatattttctag

SEQ ID NO: 3240 - DNA, 1371 bp, Saccharomyces cerevisiae
atgttgagatactatggggcgacaagaaacttacccttagtattcagcattaacaaattaatgttgagggcgtcatctttcaccaggccatttcattatagttcatattctctacagaacggtgatactcctgataaaggcagcactaataaaaatgaaatacggacacctaataacgctgtttggaaagaaaatatagaacttcaatggcagcacttgaaaaagaaattaaatgaattgtattctaggtttaacttccaccgagatcaattatcctttcaagttaacaaggccaaaaaatcaattcaagaggcaaacaggaagttgtctgagcaagagaatgaaatcaacgattcccgtttaaactataataaagatgaattgaccagtgcgaaaattgaaggattgccctccgaaagggaacaacatagaaaaaaatggtctagaaagttagagttttattttgactcattacaggagacgttatttactgccacacgtgctttaaatgatgtgaccggttattctggaattcaaaagctcaaatctagcatcagtctaatggaaaaaaaattagaagctacaaagaaagaacacaaactgtttaaggcacagtacgctaacgccattgatgaacgtgctcaatcccaaagagaagttaacgaattattgcaaaggcaaagcgcgtggtcttcgagcgatttagagagatttacgcagctatacaaaaatgacgccttgaatgctagacaggagcaagaactaaaaaacaaggttaaagaaattgaaagcaaagaagaacaactaaatgacgacttgtatagagcaattttgaccaggtaccatgaggaacaaatatggtcagacaaaatccgaagaacatccacctggggtacattcatcttaatgggtatgaatatattcttgtttattgtcctacaattactattagaaccttggaaacggaaaaggttagtaggatcgtttgaagacaaagtcaaaagcgctctcaacgaatatgccaaggagcagaatatgaagatggataaattgttacctggaaaatcatcggaagtaacagaccaaggcaacacagaaaactcgatcgttgaagagcacatagaacagagaggtgaatgtaaaattaatacggcggaaatcgacaggcctgaagttgcaacggctgagaccactacaacagaaatgaaatccttcagagatatttgggaacgaataaaggcactttttgtcacactaaaaagcatacaatataggaaacttgacgctcccctagtctttgacaccttagagttctacttatactcaatttctttagtgagtatgacaatcttggtatccgggctgatatga

SEQ ID NO: 3241 - DNA, 1371 bp, Saccharomyces cerevisiae
atgtttcgctcgggttactatccaactgtcactcctagccattggggctataacggcaccgtcaaacatgtactgggagagaaaggaaccaagtctttggctttcagagattctaagcgccaaattcctcttcatgaattcgtaaccaaacacgtgcctacactcaaagatggtgcaaattttaggttaaacagcttgcttttcacaggttacttacagaccctttatttgtcagccggtgatttttccaaaaaatttcaggtattttatggaagagagattataaaattttctgatggaggggtctgcactgcagattgggttatgcctgaatgggagcaaacatattcattaaatgctgaaaaggctagttttaacgagaaacaattttcgaacgatgaaaaggccacccatccaaagggttggcctcgtcttcacccgagaactagatatctatcctctgaggaacttgaaaaatgtcattctaagggttattcttaccctttagtggtagtacttcatggtcttgcagggggaagccatgagcctctcatcagggcattatctgaagatctatcaaaagtcggtgacggtaaattccaagtggtagtccttaatgctagaggttgctcaagatctaaagtcaccacccgtagaatctttaccgcattacacacaggtgatgtgagagaatttttgaaccaccaaaaagctctatttccgcaaagaaaaatatatgcagtcggaacatcatttggagcagccatgctaacgaactacttaggtgaagaaggagataactgtccattaaatgctgcagtcgctctctcaaacccatgggatttcgtacacacttgggacaagttggctcatgattggtggtccaaccatattttttctagaactttaacacaatttctaacaaggactgtcaaggttaatatgaatgagttgcaggtaccagagaattttgaggtttcgcacaaaccgacagttgagaaaccagtcttttatacgtataccagagaaaatttggaaaaggctgaaaaatttacagacatattagaattcgataatcttttcactgccccatcgatgggcctgccggacgggttaacatattatagaaaggccagttcgataaatagattgcctaatatcaaaatcccaactttaataatcaacgcaacggatgatccagttacaggtgaaaacgtaattccgtacaaacaagctagagaaaatccttgtgtgttgttatgcgagactgacttgggtggacatttggcttatctcgacaatgaaagtaattcctggttaacaaagcaagctgccgagttcttgggcagctttgatgagttagttttataa

SEQ ID NO: 3242 - DNA, 1374 bp, Saccharomyces cerevisiae
atgacaagcgaaccagagtttcagcaggcttacgatgagatcgtttcttctgtggaggattccaaaatttttgaaaaattcccacagtataaaaaagtgttacctattgtttctgtcccggagaggatcattcaattcagggtcacgtgggaaaatgataatggcgagcaagaagtggctcaaggatacagggtgcagttcaattcagccaagggcccttacaagggtggcctacgcttccacccatcagtgaacctgtctatcctaaaatttttgggttttgaacagatcttcaagaatgcgctcactgggctagatatgggcggtggtaagggtggcctgtgtgtggacttgaaaggcaagtctgacaacgagatcagaaggatttgttatgcgttcatgagagaactgagcaggcatattggtaaggacacagacgtgcccgcaggagatattggtgtcggtggccgtgaaattggctacctattcggcgcttacagatcatacaagaactcctgggaaggtgtgttgactggtaagggtttaaactggggtggctcacttatcaggccggaggccaccgggttcggcttagtttactatacgcaagcaatgatcgattatgcaacaaacggcaaggagtcgtttgagggcaaacgtgtgacaatctccggaagtggcaatgttgcgcaatatgcagctttgaaagtgatcgagctgggtggtattgtggtgtctttatccgattcgaaggggtgcatcatctctgagacgggcattacttctgagcaaattcacgatatcgcttccgccaagatccgtttcaagtcgttagaggaaatcgttgatgaatactctactttcagcgaaagtaagatgaagtacgttgcaggagcacgcccatggacgcatgtgagcaacgtcgacattgccttgccctgtgccacccaaaacgaggtcagtggtgacgaagccaaggccctagtggcatctggcgttaagttcgttgccgaaggtgctaacatgggttctacacccgaggctatttctgttttcgaaacagcgcgtagcactgcaaccaatgcaaaggatgcagtttggtttgggccaccaaaggcagctaacctgggcggcgtggcagtatccggtctggaaatggctcagaattctcaaaaagtaacttggactgccgagcgggtcgatcaagaactaaagaagataatgatcaactgcttcaacgactgcatacaggccgcacaagagtactctacggaaaaaaatacaaacaccttgccatcattggtcaagggggccaacattgccagcttcgtcatggtggctgacgcaatgcttgaccagggagacgttttttag

SEQ ID NO: 3243 - DNA, 1374 bp, Saccharomyces cerevisiae
atgacagcactagattctcgaaactggggattgacacccgctatggaaacgggcttgttccagaaaccacaggaccgtatctttataatagagctggaaaattccatagtgtcattcataaactcaaacacagaatcatttcagctaagaccgatgaattcatattataggcttctatcgcaccaaatagctgagtaccacaacttgaaccatgttttggcaagaactcaagatagttgtgtgattcttttcaaaggtgagaatttccaaaagattgaaggaaagccactcttacaagagttgcagctgaacaaaaaaccggaagagtgtgcttcctcaagtgagagtattgaaaaatcgaacaataacagaatatttcgaatcttaaagcggaaagaggtaggtaacgagtgcgattataaaatcgatggcaatacacgtacaccaaatagcaatttgacagccaattcaaataaggaccaaaaaatcgaaatcgatgataaatctagtactgatttggaacaagaaagaattgagaaggaaagactttatgaacaacgtaaacaagaaatttttgataagctcaacaagagtgaagacgatgtaaagtcaaccaacagtagcggtagtagtgatagtgacaatgaatggagtgattggttgaacggagatgactctaacacacaaactagtaacggttcagttagctcttcatcaccattcaattcatctgtgacgacgatacaagtaaacaaacctcaacaacaattttatgatagtcgaagaggaagaggaggaagaagaagaggaacaaacaattacaaagatgcctatagaggccaaagtcgtcggaataaagaaaacggcggttaccaatcgggatattcttcgccatatcttgtgtatcctcctccccaaatgggtggcaatagtctgccaacctaccctctaatgtataaccccgctggtcctgcccccggtcctgcaccttcacccatggtaatgggcaataacacagtcttcatgaacccttacatgtacaatatgaatccccaagggtcctgttcgtttggcaccccaatccctatgtatcccccataccaatatcaatatcaataccaatataacactcagtatcacagcgggccatatagcaatacaccaagctataattctaacaattacacaagatcctcagcaaataagtaccaccattttcaaggaaaaaattcatattctggtgcgattccgaaacgtagtgatgacagtaacagtaataagaatgagggaattcgtagggctagtgttgagggttcgccgtcatctagggatactgattcggtagagatgaaatttgataaattaaacatttag

SEQ ID NO: 3244 - DNA, 1374 bp, Saccharomyces cerevisiae
atgagagaaatcattcatatctcgacaggtcagtgtggtaaccaaattggtgctgcattctgggaaactatctgtggtgagcacggtttggatttcaatgggacatatcacggccatgacgatatccagaaggagagactgaacgtgtacttcaacgaggcatcttctgggaagtgggttccaagatctattaacgtcgatctagaacctgggacgattgacgcagtacgcaattctgccatcgggaatttgtttagacctgacaattatatctttgggcaaagttctgcgggcaacgtgtgggccaagggtcactacacagaaggtgctgagcttgtagacagcgtcatggatgttattagacgagaggccgaaggatgcgactcccttcaaggtttccagatcacacattctcttggtggtggtaccggttccggtatgggtacgcttttgatctcgaagattagggaagagtttcctgatcgtatgatggccaccttctccgtcttgccctctccgaagacttctgacaccgttgtcgaaccatacaatgccacgttgtctgtgcaccaattggtagaacactctgatgaaacattctgtatcgataacgaagcactttatgacatctgtcaaaggaccttaaagttgaatcaaccttcttatggagatttgaacaacttggtctcgagcgtcatgtctggtgtgacaacttcattgcgttatcccggccaattgaactctgatttgagaaagttggctgttaatcttgtcccattcccacgtttacatttcttcatggtcggctacgctccattgacggcaattggctctcaatcatttagatctttgactgtccctgaattaacacagcaaatgtttgatgccaagaacatgatggctgctgccgatccaagaaacggtagataccttaccgttgcagccttctttagaggtaaagtttccgttaaggaggtggaagatgaaatgcataaagtgcaatctaaaaactcagactatttcgtggaatggatccccaacaatgtgcaaactgctgtgtgttctgtcgctcctcaaggtttggacatggctgctactttcattgctaactccacatctattcaagagctattcaagagagttggtgaccaattttccgctatgttcaaaagaaaagctttcttgcactggtatactagtgaaggtatggacgaattggaattctctgaggctgaatctaatatgaatgatctggttagcgaataccaacaataccaagaggctactgtagaagatgatgaagaagtcgacgaaaatggcgattttggtgctccacaaaaccaagatgaaccaatcactgagaattttgaataa

SEQ ID NO: 3245 - DNA, 1374 bp, Saccharomyces cerevisiae
atgctaagaacagtaacttcaaagactgtatctaaccagttcaagaggtctttggctacagctgtagcaacccccaaggccgaagtaacgcaattatctaacggtatagttgtagccactgagcataatccttccgctcacacagcctctgtcggtgttgtcttcggctccggtgctgccaacgaaaacccttataacaacggggtttccaatttatggaagaacatctttctatccaaagaaaactctgctgttgccgccaaggaaggtttggcattgtcttccaatatctccagagacttccaatcttacattgtatcttctttgccaggttctaccgataaatcactagacttcttgaatcagtctttcatccaacaaaaggctaatttgctatcttcttctaacttcgaggccacgaagaaatctgtcttgaagcaagttcaagattttgaagaaaacgaccatcccaacagagttttggaacatttacactccaccgccttccaaaacactccattatctttgcctactagaggtactttggagtccttggagaatttagttgttgctgatctggaatcttttgccaataaccatttcttgaattcaaatgctgttgttgttggtaccggtaatatcaaacatgaggatttagtaaattccatcgaatccaaaaacctaagtttgcaaaccggtaccaagcccgtactcaagaaaaaggccgctttcttgggttccgaagttagattgagagacgacaccttgccaaaggcgtggatttcgctggctgtggaaggtgaacctgtcaattcaccaaattattttgttgctaaattagccgcccaaattttcggctcatacaacgccttcgaacccgcttctagattacaaggtatcaaattgttagacaacatacaggagtaccaattatgcgacaatttcaatcatttctctctttcttacaaagattccggtttatgggggttctctacggccacgagaaacgttaccatgattgacgacctcatccatttcactttgaaacaatggaacagattgaccatttctgtcactgatactgaagttgaacgtgccaaatcgctgttgaaattacaattagggcagttatacgaatctggtaatcccgtcaatgacgctaacttgttaggcgcagaagtcctaatcaagggctccaaactgtctctgggtgaggctttcaagaaaattgatgcaatcacagtcaaagatgttaaggcttgggccggtaagagattatgggaccaagatattgctattgctggtacaggccaaattgaagggttattagattacatgagaatcagaagtgacatgtccatgatgagatggtaa

SEQ ID NO: 3246 - DNA, 1374 bp, Saccharomyces cerevisiae
atgctaatagacgcaattcatggtgctaagatgagcacaaaacttttagtatcactaaaggtactagtaattcaactcaatccgcaaattgggcaagtagatcaaacaattaagagaacatggtcaatattggataaagttacgaaaagtgccacctatgtgaaaccagacataatactattccccgaatttgcattgacaggttacagttttcatgccagaaaagatattttaccttatgttactaagaaagatgaagggccctcttttgaactggctaaatcaatatccgagaaatttcaatgctacactataataggatatcctgaagatgatgatgaacagaagctatacaattctgccctggtagtaaatccgcagggggagcagatctttaattacagaaagacttttctctatgatacagaaatgaattgggattgcgaggagaatccagagggatttcagacgtttcccatggatttttcaaagtgtgctaagctttctaatgaggactcttacaacagagatgtgactttgaaagcatcaataggtatttgtatggacttaagtccctacaaattcatggccccctttaatcactttgaattctcttctttttgcgttgacaataatgttgaattgattctatgtccaatggcgtggttaaactctacttctatcacagacaaacagacgttacataacaattcattattagaagccgctaagaacaaaatagctttcgctttaaaggagcaagggttgcctttggcaggatctcaaggaatttaccagcttaaaattggtgattcgcaacgtacgcccagagtgccttctgacgacagtacaagtgaatataaggatatggatgaaccagatatgtcaaacgtaaactactggattctacgattttttccttttttgtactttaaatccagaattaattggtttaaaaattcatctcttatcgaaagcattttgggcaaaactagaatgcccctagatcatgaatattataaagatggaaagcacaaggaggacacaatagacttattggattctgaggaagtgataaaggatacagtactggaaaagacatttttgggaacctcccttggacagccttggaagttccaaggaaagaatgcgattttggtgctagctaacagatgtggtactgaagatggtaccacgatttttgcaggaagttctggcatttataaatttaacggtaaaaaacctaaaggttcacaggatgatgatgagagttcgcttgattctctcaatgaaagcgtagagttgctgggtaatttgggcaagggtctagaaggcgctatattgcgtgaggtccaatttgaagtgtttaggtga

SEQ ID NO: 3247 - DNA, 1374 bp, Saccharomyces cerevisiae
atggttagctcactggcatcaaatataattctagcccttgtggtagtcctgatgacactgctaaggcaaaataagccgttgcagaggtggtttgtatcatatgttgaaaagctattatcaagaaaatcaaatctggcccaaaaagtcagcgttttatcgccctccttaaaattggttgatgttgagaaatcaatatctgccgatcaatcgaatctttctaaaattaattatcagattcccactcttcctgatcttacggggaatttaatccgtttacatgagtatcgagcaagaggagaaggctataatggccttttatttcggagagcaagacaattaaatggaatttcagaagatcagttgcaaaaattaggctacttcaccaaattaatgaaaaataatgagggtatccgagaaaacgcaagagttattgacaagataattgagttcactttagggaaattgattcattccaacgaacacgatgaagaatttacagaggaaattgaaaagatatgcgcggaacacggctataagattaaagatggtcaccttattcaattgaatcctgacttcgtatttccaatagtttcgtctcgaggcagccaaagtgtggtccatgaagcattagcacatttgtgtcgtgatttcagctcttactatagtgtggaaagagatcctttacaaaattttatcattagtagaatcaaccatcatgtgattagtgccggggacatgaaagagaaaattcttatcgtgaccccaggggctggtgtgggtggcctatcccatactcttgccaccactttccccaaaatacaggtggactccatcgaattatcagccttgatgtacatatgtaacctatttgcactcgaatataagcatgacgttaagatacgtccttttgtacaacaatattcatgccagacagtgtttgataatcagttgagaagtttatcggcagatttgagcaaagttggccaccgcagtaatctggacccactatggggggacttcacacgatattctcccatttccaaagactatgataaaattatcatttgtagcgcatatttcatagataccgcggaaaatatgtttgaatatctatccagtattgaagcactaaagaaatactgtaaagagctgcattgggtcaatgtaggtccattaaagtatggcaccaaacccttggtccaatttacaggagatgaattaagtcggctgcgtaaaattcgcgggtggaaggaccttgtggaggaatatgaagttgatagctcaaagggattgaatggctatttaactgattatgagtcaatgtatcaaggatactatggtctgcttaaatttcattctgtcttcgaaagctga

SEQ ID NO: 3248 - DNA, 1374 bp, Saccharomyces cerevisiae
atgtctgacaaccctgagatgaaaccacatggtacgagcaaggagattgtggagtcggttactgacgccacctcaaaggcgattgataaattgcaagaagaactccacaaggacgccagcgaatccgtcacgccggtgaccaaggaaagcactgctgctacaaaggaaagcaggaaatacaactttttcattagaacagtttggacgtttgttatgatcagtggtttcttcatcaccttagcatcgggtcatgcatggtgtatagtgctgattttgggctgccaaattgctacttttaaagagtgtattgccgtaacaagtgcatctggtcgcgaaaagaatttgccattgacaaagacgttgaactggtaccttctcttcaccactatctattacttagatgggaaatcactcttcaagtttttccaagctactttttacgagtatcctgtattgaactttatcgtaacaaatcataagtttatctgctattgtctctatcttatgggatttgttctgttcgtttgtagtttaagaaagggatttttgaaattccagttcggatcattgtgcgttactcatatggttcttcttctggtagtatttcaggctcatttgatcatcaaaaacgtgctcaatgggctattctggttcttattaccatgcgggttggtaattgttaatgatatcttcgcctacctgtgcggcattacattcggtaagactaaactaatagaaatctcgcccaagaaaactttagaaggtttccttggtgcctggtttttcactgctctagctagtattatattaacaaggattctgagcccttatacttacttgacgtgccctgttgaagatctccataccaattttttctctaatttgacatgtgaactaaacccagttttccttccacaagtttacagacttccacccatctttttcgataaagttcaaatcaattcaattacagtaaaaccaatttatttccatgctttaaacttagctacctttgcatcattatttgcgccatttggaggctttttcgcatctggtctaaagagaacttttaaagttaaagactttggccactccatcccaggccatggtggtatcacagacagggttgattgccaattcataatgggttcttttgccaatttgtactatgaaacattcatcagcgaacacagaataacagtagatacagttttatccactattttaatgaacctgaacgacaagcagattatagaattgattgatatcttgattagattcctatctaaaaaaggtataatatcagcgaagaattttgaaaagttggctgacatctttaatgtgaccaagaaatcattgaccaatcactcttga

SEQ ID NO: 3249 - DNA, 1377 bp, Saccharomyces cerevisiae
atgggtaaagagaagtctcacattaacgttgtcgttatcggtcatgtcgattctggtaagtctaccactaccggtcatttgatttacaagtgtggtggtattgacaagagaaccatcgaaaagttcgaaaaggaagccgctgaattaggtaagggttctttcaagtacgcttgggttttggacaagttaaaggctgaaagagaaagaggtatcactatcgatattgctttgtggaagttcgaaactccaaagtaccaagttaccgttattgatgctccaggtcacagagatttcatcaagaacatgattactggtacttctcaagctgactgtgctatcttgattattgctggtggtgtcggtgaattcgaagccggtatctctaaggatggtcaaaccagagaacacgctttgttggctttcaccttgggtgttagacaattgattgttgctgtcaacaagatggactccgtcaaatgggacgaatccagattccaagaaattgtcaaggaaacctccaactttatcaagaaggttggttacaacccaaagactgttccattcgtcccaatctctggttggaacggtgacaacatgattgaagctaccaccaacgctccatggtacaagggttgggaaaaggaaaccaaggccggtgtcgtcaagggtaagactttgttggaagccattgacgccattgaacaaccatctagaccaactgacaagccattgagattgccattgcaagatgtttacaagattggtggtattggtactgtgccagtcggtagagttgaaaccggtgtcatcaagccaggtatggttgttacttttgccccagctggtgttaccactgaagtcaagtccgttgaaatgcatcacgaacaattggaacaaggtgttccaggtgacaacgttggtttcaacgtcaagaacgtttccgttaaggaaatcagaagaggtaacgtctgtggtgacgctaagaacgatccaccaaagggttgcgcttctttcaacgctaccgtcattgttttgaaccatccaggtcaaatctctgctggttactctccagttttggattgtcacactgctcacattgcttgtagattcgacgaattgttggaaaagaacgacagaagatctggtaagaagttggaagaccatccaaagttcttgaagtccggtgacgctgctttggtcaagttcgttccatctaagccaatgtgtgttgaagctttcagtgaatacccaccattaggtagattcgctgtcagagacatgagacaaactgtcgctgtcggtgttatcaagtctgttgacaagactgaaaaggccgctaaggttaccaaggctgctcaaaaggctgctaagaaataa

SEQ ID NO: 3250 - DNA, 1377 bp, Saccharomyces cerevisiae
atgaaggatgtcttacaatgggcgattgaccactacgagacaagagaccaactggtgcagaagggaatttggaaaggtgaactctaccatgactctatctttaaagaaaatagtagaggctggctctggaaagctttgcttctgtgtgatgaaaacaacaactgcttgttaactgataactttaaaggtttggaccttaaccagttcggcttggtgccagtgcctatgctggcagatggcgacaactatgacgaaaatcataatgcaaatgtacctaaaagggtcttgcactcgaacgtttcctcctcagtgggaatcaggaggctgactcccgtcgaggctgttgaaaaacatcccttgtctgatgacaatgacaaaactaaaggttctttgtccaagggaagtgatgaaaagccgttgacactgagggaaactctggaaattatagatttggacctctcaaggataatgcttgacgatatatttcaggaacccaaggttcatgctcaaatgagacaacttttgtacaattacctgcttatacatcaaagcgaacacctacagtataaacaagggttccacgaaatattaagcgtcatttatctgcaattatatcacggtacagatctcgataataccgatttgcaaaacgttctgattatctttaacaagctaatgaaccaaatcgaaccgattttttataacgaagaaaatttgattaactgggataagagagtattcacgaaaatctttaggatttgtttgccagacttgttttcaaaggttttttaccaaccaccaaaaacgggcagcgggaagaaaaaaaacgtagaccatctgattcactccaacctaatctggctcatccgatggacaaggttgttatttttaagagaattacccttaaaatatgtgctaatcgtttgggaccacgtcctgacgttcaattatcccttggatattttcattgcatgcactatcatcacccttttgttatccatttacgatgagcttcacgaactagtgagccaaggtgactatgaacatacgaataataacgatgaatttgttgaattgattttgcatttcaagaaaatttttgaaaaggaagatgccagtaaagatgatgaaaagtttttagacctgtgtaaggtcactggaaatttatgtgaattgtggtatggaaaaaattacgacgatatgagattgatttgcgacacttttataaatgcgaagttcggcataaagactagtgatgttttaagtatggaaacagcaaagttgactattgatcctaatagacaatcactcgaaaacaaactgagggagagggtaaggcaaacaattttgaagaacaaaaagaaaataagccaataa

SEQ ID NO: 3251 - DNA, 1377 bp, Saccharomyces cerevisiae
atgaatatgctcattgtcggtagagttgttgctagtgttgggggaagcggacttcaaacgctttgctttgttattggttgtacgatggttggtgaaaggtcacgtccattggtgatttccatcctaagttgtgcatttgctgtagctgctatcgttggtcctataatcggaggtgcctttacaacccatgttacctggaggtggtgcttctatatcaatcttcctatcggtggtcttgccattattatgtttttactcacatataaggccgagaataagggtatacttcaacaaattaaagatgctataggaacaatctcgagctttacttttagtaagttcagacaccaagttaattttaaaagacttatgaatggcataatcttcaagtttgacttctttggttttgccctctgctctgcagggctggtccttttcctactggggctaacctttggtggtaataaatatagttggaactctggccaagtcatcgcatatttggttttgggtgtcttactttttattttttcattggtgtacgatttcttcttattcgataaattcaacccggaacctgataatatatcctacaggcctctccttctaagaagattggtagcaaaaccagccataataataataaacatggtaacatttctattatgtaccggttacaatgggcaaatgatatactctgtccagtttttccaacttatatttgcgtcgagtgcatggaaagccggtcttcacttgataccaatcgttattaccaacgttattgcggccattgcaagtggtgtgattaccaaaaagctcggtttagttaaaccactcttaatatttggaggcgttcttggggtaattggagcagggcttatgacacttatgacaaatacgtccacgaagtcaactcaaattggtgttttgctattaccggggttttcccttggatttgctctacaagcatcgctcatgagtgcacagcttcaaattaccaaagatcgtccagaagctgctatggactttattgaagtaacagctttcaatacattcatgaagtcattaggtacaactcttggtggtgtgctttcaaccactgttttttccgcctcctttcacaacaaagtatcacgagctcatctagagccttacgaaggaaaaacggttgatgacatgattttgtatcgtcttcaaaactacgacggttctcattcgactattggaaacattttaagcgactccattaagaacgtattttggatggatctagggttttatgccttaggatttttgttttgtagtttttcatccaataagaaattaatcataccaaaaaaggacgagacaccagaagataatttagaagacaagtag

SEQ ID NO: 3252 - DNA, 1377 bp, Saccharomyces cerevisiae
atgaccgatgagaaacgagcttttccaaaaggtaacaaccatataagatcagaaactttcaatggttcggtatctcacaaaatctccgaatcgattaaagatatcgctagcttaagaccacacggtaaatatacggtacaagacatcgacaacatcatagcatccacatcttcacatgaaaatagaggccaatcaggcgatagtaatggctgtataaatcacgacgaagaaggcgatattccgatgtgtgacttgaatgatgaaagcgacgttgaaatgatttctgaatatctttctagccagagggagatggaagcacaatctgtcgctaattatatgccaaaaatcaatgacgatttaccgctgttaaatccacctactttgaaaactgcctttgtagtcgacaccaactttattatttcgcatctaaacactttagaaaaattgagatcactgtccagcacttatcatcatttgattattgtaccaaccaccgtaatccaagaactggacggactaaaaaagagccctgatattgctagggacaatgacgatacaactaatcaggaacatgataggacaataggcacattggccagatgggggaacgactggatttataagaatctagccaatttagattccggtttaataggtcaaaaattgaaacaaagcttgaatccaggcagtttaaaggatgactcgatattggactgttgcttgtacttcaaagagattttaaattgttttgttattttgctttcgaatgataagaatctttgtacaaaggcattaactgaagatatattaactgtttcatttaggaagaacatggatgcgaaaataattgcaatgagagcatatgaagaaaaccaactgagatttgctaatctgcgtgactctacagtaaataatttcgatcagaatgtcacatcatatgctcatattcctggaatagaaacgccccctttgcaattcgataaagtctcacaaaatgtgtttgagcaagtaaaagaaactattttctttgctattgaccacactttaagaaaggaatatggtgaagatattggattcatagattacaacccagataaattaactaccatagaaaacgcttcgaattacatttatttgttttgggtgtctgtattttcggaacttttcacttgttcaaagataaagaagaatgagtggaagagcttaccaacagttttgaaatcaaaaccgacaaatctgaatgacttaagaacatttgaacaattttgggagactgtattgcattttttattcagcaaattcacaaatgaggagaaacaatctttagagaaacagattcatgaatggaaaacatctatcaatgctatatcaacctga

SEQ ID NO: 3253 - DNA, 1377 bp, Saccharomyces cerevisiae
atgatcgtcaatattagtgcgaagatgatcttatcgatatgctttacgtttctgtcattttttaaagccactcatgccatggatttggatactactagcaaaacgtcaatttgtgatgcgacagcgttaattcaaggtggtatgctggattactatgagggtactagatacggtggtaccgttgggatgtttcagtcaccatactattggtggcatgcaggggaagcatttggtggcatgttggaaaattggtttctttgtgagaatgatacatatcaagaattactatacgatgcactattagcgcaaactggttccaattacgattatatcccgtccaaccaaacgatggttgaggggaatgatgaccaaggtatttggggtattactgttatgggtgctgtcgagagaaattttacagaccccggtgacggcaagccaggttggttggcaatggtacaagctgttttcaacaccatgtactcaagatgggattcagagcactgtggcggtggtctgagatggcaaattttcacttggaatagtggttataattataaaaatacagtttcaaatgcatgtttgttccagattgcggcgaggttgggcagatatactggtaacactacatatttggaggttgctgaacaggttttcgactggctagtggatgtcgggtatgtggttcttaacgatactgcaaatgtctttgatggtgctgaaattgatacaaattgcactgatattacaaaaattgaatggacttataatcacggtatcgtgcttggtggtcttgcatacatgtataatgctacaaatggaacaggtgaatgggagaccagtttgacaaaaattctaaatggtgctaaatcttatttcttcaaagatagtattatgtacgaaagcgcttgtcaagactatggcacctgtaacaccgatcaaagaacattcaaaagtattttttctcgtatgcttggtcttacaagtgtcatggctccctttactagggacacaattgatgatttgataaaaacaagtgctgaggccgctgcaaaatcatgtaatggtggtacagatgggcatacatgtggtttaaattggcagaaacaaaccaatgatggctactatggattaggtgagcaaatgagtgctctagaagttattcaaaatcttttaattcatgacaggccagctccatataaggaagataatggcggtacgtcaaaaggtgacgcgaatgccggtatgaactcatcgaccactaacgtgctacaaaacaatttaaacattaagaaaggtgatcgcgctggtgccgctatcatcacagcagtcatactgagtgtgctaactggtggggctgtgtggatgctgttttaa

SEQ ID NO: 3254 - DNA, 1377 bp, Saccharomyces cerevisiae
atggaaggtgaacagtctccgcaaggtgaaaagtctctgcaaaggaagcaatttgtcagacctccgctggatctgtggcaggatctcaaggacggtgtgcgctacgtgatcttcgattgtagggccaatcttatcgttatgccccttttgattttgttcgaaagcatgctgtgcaagattatcattaagaaggtagcttacacagagatcgattacaaggcgtacatggagcagatcgagatgattcagctcgatggcatgctggactactctcaggtgagtggtggaacgggcccgctggtgtatccagcaggccacgtcttgatctacaagatgatgtactggctaacagagggaatggaccacgttgagcgcgggcaagtgtttttcagatacttgtatctccttacactggcgttacaaatggcgtgttactaccttttacatctaccaccgtggtgtgtggtcttggcgtgcctctctaaaagattgcactctatttacgtgctacggttattcaatgattgcttcactactttgtttatggtcgtcacggttttgggggctatcgtggccagcaggtgccatcagcgccccaaattaaagaagtcccttgcgctggtgatctccgcaacatacagtatggctgtgagcattaagatgaatgcgctgttgtatttccctgcaatgatgatttctctattcatccttaatgacgcgaacgtaatccttactttgttggatctcgttgcgatgattgcatggcaagtcgcagttgcagtgcccttcctgcgcagctttccgcaacagtacctgcattgcgcttttaatttcggcaggaagtttatgtaccaatggagtatcaattggcaaatgatggatgaagaggctttcaatgataagaggttccacttggcccttttaatcagccacctgatagcgctcaccacactgttcgtcacaagataccctcgcatcctgcccgatttatggtcttccctgtgccatccgctgaggaaaaatgcagtgctcaatgccaatcccgccaagactattccattcgttctaatcgcatccaacttcatcggcgtcctattttcaaggtccctccactaccagtttctatcctggtatcactggactttgcctatactgatcttttggtcgggaatgcccttcttcgttggtcccatttggtacgtcttgcacgagtggtgctggaattcctatccaccaaactcacaagcaagcacgctattgttggcattgaatactgttctgttgcttctattggccttgacgcagctatctggttcggtcgccctcgccaaaagccatcttcgtaccaccagctctatggaaaaaaagctcaactga

SEQ ID NO: 3255 - DNA, 1377 bp, Saccharomyces cerevisiae
atggttgccaattgggtacttgctcttacgaggcagtttgaccccttcatgtttatgatggtcatgggtgtcggcatttcatcgaatattctatatagcttcccatatcctgcaaggtggctaagaatatgctcctacatcatgtttgctatcgcttgccttattttcattgctgtgcaggcactacaaatattacatttgattgtctatattaaggagaaaagcttcagagaatattttaatgactttttcagaaatatgaagcacaatttattttggggtacttatcccatggggttagttacaattataaatttcttaggagcactctcgaaagcgaacacgacgaagagccccactaatgccagaaatttgatgatatttgtttacgtcttgtggtggtatgatctcgcagtctgtctagtaatagcgtggggtatctcgtttctcatctggcatgactattaccctttggaagggattgggaattatccttcatataatatcaaaatggcatccgaaaacatgaaaagtgtattgctactggatatcattccgctggttgtcgtcgcttcaagttgtggaacattcacaatgtcagaaatattcttccatgcgtttaatagaaacattcaactgataacgttggtcatatgtgccttaacgtggctgcatgccattatcttcgtcttcatactgattgcgatatacttctggagtctttatattaataagataccaccaatgacacaggttttcaccttattcctgcttttgggcccgatgggccaaggaagttttggagtcttattgcttacagataatataaaaaaatatgcgggcaaatattacccaacagataacattacaagagaacaagagatattgactattgcagttccatggtgtttcaaaattctaggcatggtttctgctatggcattgctcgctatgggctattttttcaccgtgatttctgtcgtttcaatcctgtcgtactacaataaaaaagagattgaaaacgagacaggaaaagtgaagagagtttataccttccacaaaggtttttgggggatgactttcccgatgggtactatgtctttaggaaacgaagagttatatgtgcagtataaccagtacgttcccttatatgcatttagagtcctaggaaccatatacggcggtgtttgcgtttgttggtcaattctatgccttttatgcacattgcatgagtattctaaaaagatgctgcatgctgcccgtaaatcttcattattttcagagtcaggtacggaaaagacgacagtttctccgtataacagcattgaaagcgtggaagaatcaaactcggctctagattttacgcgtttagcataa

SEQ ID NO: 3256 - DNA, 1377 bp, Saccharomyces cerevisiae
atgtaccaaggcccaccgcaaccgcctcctcaagctgtgccgatgccttacattgtgaataataacacaccaccgtacccaaatggtaatattaactttcctcccaccgcgcagcagaatataccgcccacggtttatccacaacaagtgccatttccaggtcaaccacaggggggtcaatttccacagccttcatcagaacagcaggtgtttaaccagcttccacaagtgactcaaacttttcacaactctgcgcagaatacgaatgcaactgggggccctggcagcgggtctatgccaatgtttacgccggtagcatcctttccccatcccatggctacagcagcaacggcagctgctccgttaccacggtctgcatcccaggcatctttatctatgttacgggtgccgtatcatgtaagaaaatacttatctaatttggcgatgttgaaattgtacgaaataataaatgaggtgaatacggcaatgggtaagattggcctgctttcattctggacagaattaatatcagatatttttacacctgatgcagttataaggtatagtaaaaagtctatgacagattatagagaattcgaatttatcatcccagtgttcccagttatttgctctacattaggcagatttggcatcgttagaatggaagttaaggttttacaattgaaaacacaagttctaagtaattctacgatttttttcaactgtcctcgtgtcacatttgtctattattatcctgatggttcatatattacacatttttcccaaatgaaaggtgctttcgatttggacttgaaaattaattggctggacgtatctatgcatagttttgtccctgatattgaatggaatgcagtggaacggcttttgagtgatgacacaaagtctacagaaattgaacaaatattccgtaaattgaaacaagaagatgtcaaagagcaagggaattcttttgcagaaaataatgctacgaatgttcctccgaattttgaggccatcactcagctgagatcatattttgacgtattcagaaacgtctctgtgtttggcactcaagaagggttgatgagagtcatgcaaataagtaccgttatgtctactttgaaaaaccttcgaaagtttcaaattgaaaagaacattgatagtcccgtgaccgccctaagtgcgtacattgacgccgacaagaaggacagtggaagcgagcccttgcacgcaaagaggcgacgcaacagcggtatctctcctcgcaccacgacgttggggccaaacggcaactccaatacaagcaatgaagagcttccaacaagtgatgtgaatgatattaacaaagacatgacaaaaaagaagatgaagttttaa

SEQ ID NO: 3257 - DNA, 1377 bp, Saccharomyces cerevisiae
atgtctaacgaattacggcttgaagataactatgtaccaacttccgacacactagtagttttcaaacaattgatgaagctgccggtaacggtattatatgatcttacgctatcatggttcgcaaaattcggtgggtcatttgatggtgacatatatttattgacagaaacattagacttactgattgagaaaggcgtgaggcgaaatgttatagtaaataggatattatacgtatactggccggatggcctgaatgttttccaattagcagaaatagattgccatttaatgataagtaaaccagagaaatttaagtggcttccatcaaaagctttacggggagatgggaaaccttacgtagtaaagctccaacctgccaaatttatagaaaatttacaaacagatctagcgaaaatttaccattgtcatgtttacatgtttaaacatccctctttgccagtgttaattaccagaatacagctatttgacagcaataatttatttttgagtacgcctaatatagggagtataaataaagagtctctttacaacaagttagacaaattccaagggaaaccattaatatcaaggagaccatattacgttgcattcccgctaaattctccaataattttccattcagttgacaaggatatttatgctagactagttttgcagagcattagtcgaacgatatcagaaagagaaacaatcatcttcaaaccggtacagaaaatacccgtgaaatcaatacataatataatgactttattaggaccttcgagatttgcggagtctatgggcccatgggaatgttatgctagtgctaactttgaacggtcaccactacacgactacaaaaagcaccaaggccttactggtaaaaaggtaatggttagagaatttgatgattctttcttaaatgacgatgagaatttttacggaaaagaagaacctgaaattagacgactaaggttagagaaaaacatgatcaaattcaaaggttcagcaaacggcgtaatggatcagaaatataatgatttgaaagaatttaacgaacatgtccacaatattaggaatggaaagaaaaatgaagattctggtgagccagtgtacatttctagatacagttccttagttcctattgaaaaagttggattcactttaaaaaacgaaataaacagtagaataattaccataaaattgaaatttaatggtaatgatatttttgggggattacacgaactatgcgataaaaatttaataaatattgataaagttcctgggtggttggctggagaaaatggatcgttctcaggaacgataatgaatggagattttcagcgagagcaggttgctaaaggtggtttactgtag

SEQ ID NO: 3258 - DNA, 1380 bp, Saccharomyces cerevisiae
atgacagcagctaataagaatattgtcttcggattttccagatccattagcgcaattctactaatatgctttttctttgaaaaagtctgcggtgatatggagcatgatatgggcatggatgatacttcgggatacacgaggccagaaattgtgcaggctgggtcgaaatctttccactggctctgcactttgggattcttgttgcttttaccatccgtggtgacgtgcctttcgttcgctggcaggatatattcagctaccctcttacaatgcacttgtgccgtttacgctttcttagaagctgccgtattaagatttcaagacaatgatggggtagaaaatagaacttcaaggggaaccgcatggtttttggtgggacttacttggataaccttattctttggtggattagctggaggaactggtttcttagtgaaaagcaagaggttgcaaacgttcatatcaaatgcaggtgagaaaaggttgtcatatatccatcgtggtttatcctttctaactgttctaacaggttgggttaaagtctgtttggcacctgttgcgctctttgggttttgtagagaggcacacacagggcaatgcatcgctcatggtatcatgggatccgcgtttgtgttgtacgggttcatttatgtactggttttggttataccatggattcgcagtgcccaaacctcatattcacaggattacgtcgacagttgggttatgtgcatatggggcgttgtaaatacttttactgaacacaggtggggacgtgaaggatggagtgttcacgattatcaacacacgtttatgggaattatctggtggactggtggaatactcgggattttcctttccagaaatggcagaagaacatttgtaccaagtttgattattattttcaccggatgggccatgtctgagcacgcccagcacttgataattagcacaaaagtccataatatgtttgggctagttttaatgtgtggaggcgctttaagaattatcgaaatatcttttttactacgtgataaaagaacgctggacaaaatacattcattccaataccttgctcccttttgtttagtatgttcaggtctcctatttatgggcgcaaacgaagaacaactcattttagtgttgcggttgggaggcgaccatagtgcgtacgttctaattatcgtatcaggcgcatttttggtctacttctggatgattgcatgtttggaattctacctatatctacttgaaaagggaaaacaaggattccttccgaaatcatacgaacttgaagaggaaaacaataacgtgagctttgagctagataacatatcgaacgaagatgtggatgaagataccactccctttaacgtttga

SEQ ID NO: 3259 - DNA, 1380 bp, Saccharomyces cerevisiae
atgaccgaaaaccaaaccgcacatgtaagggcgttgatattggatgccaccccattaattacgcagtcctacacacattaccagaattatgcacagtctttttatactactcccacagtttttcaagaaattaaggatgctcaagcaaggaaaaaccttgaaatttggcagagcctcggaactttgaaattagtacatccaagtgaaaactcgatagccaaagtaagtacgttcgccaaattgaccggtgactactccgtactgagtgccaatgatttgcatattcttgctttgacatacgagttagaaattaaactaaataatggcgattggagactgaggaaaaaaccaggtgatgcattagatgcgtccaaggctgacgttggtacggacggcaaacagaagctcacagaagataataaaaaggaggaggactctgaaagtgttccaaaaaaaaagaacaagagaagaggtggaaaaaagcaaaaggcaaaaagagaagcaagagaagcaagagaagctgaaaatgcaaaccttgagctagagagtaaagctgaggaacatgttgaggaggctggatccaaagagcagatatgtaatgatgaaaatataaaggaatcttccgatttaaatgaagtattcgaggatgctgatgatgatggtgattggattacccccgagaacttaacagaagcaattattaaggatagtggtgaagataccactggttcattgggtgtagaagcgtccgaagaggatcgccatgtcgcattgaatcgaccagagaatcaggtggcattggcgactggcgattttgccgtccaaaatgtagcgttgcagatgaatctaaatctaatgaatttcatgtcaggtctgaaaatcaagcgaatccgtaattatatgctaagatgccacgcctgtttcaaaatatttcctctaccaaaagacggcaagccaaagcacttctgtgcctcatgcggtggacagggtaccttattaagatgcgcagtttccgttgactcacgcacggggaacgttacaccgcacttgaagtcgaacttccaatggaacaatagaggaaacagatattctgtagccagccccttatctaagaactcccaaaaaaggtacggcaaaaagggacacgtacattctaaaccacaggaaaatgtgattctcagagaagatcaaaaggagtacgaaaaggtgataaagcaagaagaatggacaagaagacacaacgagaagattctaaacaattggattggtggcggttctgcggataactatatttctccatttgcaattactgggttgaagcagcataacgtccgcattggtaagggaaggtacgtcaacagttccaaaaggagaagttag

SEQ ID NO: 3260 - DNA, 1380 bp, Saccharomyces cerevisiae
atgagtggcagtgatagaggagaccggttatacgatgtgttgggggtgacgagagatgcgaccgtgcaagagattaaaactgcttacagaaagcttgccctgaaacatcatccggacaagtatgtggatcaagactcaaaggaggtaaatgaaatcaaattcaaagagatcactgccgcttacgagatcttgagcgatccggagaagaaatcacattacgacttgtatggtgatgataatggtgccgctagcagcggtggcgctaatggctttggagatgaagattttatgaacttctttaacaatttcttcaataatggaagtcacgatggaaataatttccctggcgagtatgatgcgtacgaagagggcaactctacaagctctaaggatatcgatatcgatatatctcttactttgaaggatttgtacatgggcaagaagctgaagtttgatttaaagagacaggtcatctgtataaagtgccacggttctggctggaaaccaaagaggaaaattcacgttacacacgatgtggaatgtgaatcatgcgctggaaagggttcaaaggaacgtctgaagaggtttggtcccggtttggtagcttcgcaatgggtggtctgtgagaaatgtaatggtaaggggaagtacactaaaagacccaagaatccaaagaacttttgccccgattgcgcaggcttggggctcctgtcaaagaaggaaatcatcacagtgaacgtggctccgggacaccactttaacgacgtaattacagtcaaggggatggcggacgaggaaatcgataagaccacatgtggtgatttaaagttccatctcactgaaaaacaagaaaacttggagcagaagcaaatctttttgaagaactttgacgacggcgccggggaagatttgtatacaagcattaccatatcgttaagcgaggccttgacgggatttgagaaatttttgacaaaaaccttcgacgacaggttactaacattgagcgttaaacctggcagagtagtaagacctggtgacaccatcaaaatcgccaatgaaggttggcccattttagataaccctcatggccggtgcggcgatctgtatgttttcgttcatattgaatttccaccagataactggttcaatgaaaaatcagaactactagcaataaaaacgaatctgccgtcatcttcatcttgtgcctcacatgcgactgtaaatactgaagatgacagcaacctgactaacaacgaaactatatcaaatttccggatcattcacacggacgatcttccagaagggataaggccgttcaagccagaagcacaggattcagcgcatcagaaagcaagaagttcgtactgctgtatccaatga

SEQ ID NO: 3261 - DNA, 1380 bp, Saccharomyces cerevisiae
atgccgtcaaacgtacgttcgggagtcttaactttgctccatacagcatgtggagcaggcgtacttgcaatgccgtttgcattcaagccatttgggttaatgcctggtctgataacgctaacattttgcggaatatgttccttatgtgggctgctattacagactcgaatagcgaagtacgtacctaaatctgagaacgcctcgtttgctaaactcacccaactaatcaatccgtcaataagtgtagtgttcgattttgccattgctgttaaatgttttggcgttggtgtatcttacttaattattgttggtgacttagtgccacagatagtgcagtcaattttttatcgtaacgatgataacatgagtggttcgcaagagcatcacatgttcttagacaggcgtttgtatataactctgatcatagtgtttgttatctcccctttatgctttaaaagaagtttgaattctctacgatatgcttctatgattgccattgttagtgtcgcatatttatctggtttgattatttaccattttgtaaatcggcatcagctagagagagggcaagtatattttatggtacctcacggagattctcagtctcattctcccctgactacattgccaatttttgtgtttgcttacacttgtcaccacaatatgttcagtgtaattaatgagcaagtggataagagcttcaaggtaatcaggaggattccgatttttgccatcgtgttggcctattttttatacatcataattggtggtacaggttatatgacatttggtgagaatattgtaggaaatatcctcactttatacccgaattccatctccaccaccatcgggaggttagcaatgctgctattagttatgttagcatttccattgcaatgccatccttgcagatcatcggtaaaaaacataattatattcattgaaaatttcagaaaaggtaagttatacgataacagagctagctttattccattagacaactttaatagtgaagatccgcaggaggcgccaacccaacaaaacaacgaagagccaaatctgcgtagtgagtctttacggcatatcaatattatcaccctttgtatcttactgttctcatatctactggctatttcaattacgtctctagcaaaagtcctagcaatagttggtgccacgggatctacgtcgatttctttcattttgccaggcctttttggttataaattaattggctcagaatttacgggcacgaatgaaagagtaccgacaagcataaaaatattcaaatacttaagtttatctctattcatctgggggatagcagtaatggtagcttcactatcagcgattgtatttttgggcacatcatcacattga

SEQ ID NO: 3262 - DNA, 1380 bp, Saccharomyces cerevisiae
atggttttagcaatggaaagtagagtggcaccggaaattcctgggctcattcaacctgggaatgtcacgcaagacttgaagatgatggtctgtaaattattgaattccccaaaacctacgaaaacattccctggttcccagcctgtgtcctttcagcattctgatgtggaagagaagctgcttgcgcatgattactacgtttgtgagaaaacagatggtctgcgggtgttgatgtttatagtgataaatcctgtgacgggtgagcaaggatgctttatgattgatagggaaaataactattatctggttaatggatttaggtttcccagattaccccaaaagaagaaagaagagctgctagagactcttcaagatggcaccttattagatggtgaacttgtcatacaaactaacccaatgacaaaattacaagagttgcgttatttaatgttcgattgtcttgctatcaatggtagatgtctcacacaatcaccaacaagttctagactagcccaccttggaaaagaattttttaaaccatacttcgatttaagagcagcgtaccctaatcgttgtactacttttccgttcaaaatttccatgaaacatatggatttcagttaccaattagtaaaagttgctaaaagtttagataaactaccacatctttctgatggtctgatatttactcctgtgaaggcaccttacactgccggcggaaaagattcattgttattaaaatggaagccagaacaagaaaacaccgtggacttcaaattgattttagatatcccaatggtggaggatccttctttgcctaaagatgatcggaacaggtggtattacaattatgacgttaagccagttttcagcttatatgtctggcaaggcggagctgatgtcaattcacgtttaaaacatttcgaccagcctttcgataggaaggaatttgaaatattagaaagaacatacagaaaatttgcagagttgagcgtttcagatgaggaatggcaaaatttgaagaacctagaacagccattaaatggtagaatagtagagtgcgcaaaaaaccaagagactggggcgtgggaaatgttaagattcagggatgataagttaaatggtaatcatacatcggtggtccagaaagttttggagagtatcaacgattcagtttcattggaggacctcgaggaaattgttggtgatattaaaaggtgctgggacgagagaagagcaaatatggctggtggtagtgggagaccactaccgtctcaaagtcaaaatgcgacattatctacctctaagccagtccattcacagcccccaagtaatgataaggagccaaaatatgtagacgaggatgattggtcggattag

SEQ ID NO: 3263 - DNA, 1380 bp, Saccharomyces cerevisiae
atgtcatttagattcaacgaagctgtgtttggtgataactctttcaatgaacgaatacgggaaaagttatctacggctttgaactcaccgtctaaaaagaaattagatatcttgaaaagcggaattaaggtacagaaggtggattttcctacaataccacagctagaaattctggacctagacattatcacgcagcccaagtctctggccaaggggatttgcaagatttcatgtaaggatgctatgttgcggatacagacagtcatagagtcgaatcttttattgattaacgaacaggatacacccagctttaccatgccccagctcatcaataatggatcgttcacaattcctataactatgacgttcagttccatcgagctagaagccatcacgaatatttttgtaaagaaccctggaattgggatatcctttaatgacgttgatttggattttaagtttgattgttctgtaaaaattctccaaagcaccattgagagaaggctaaaagagtccatgcatgtagtgttcaaggatgttcttccttctttgatcttcaacacgtcacagaactggttcaccaatcgcggcgagagcaccagtaccatccctggtaaaagagagcatcatcatcaacaaactacaatgtctaggaatgtaatcttggacggatcagattttcaagagctttctccaataaacatgctacgtctttcaagcattgtgtcgtcgaggtcaacactgtcactacattccactgtgatgaattctctttccgctatacctggttgcttggaaagacaaaacttgtacagatttatatcaaggatgccctctttaaacaattactactcttcgcaatcatttccacaaccaaagtcatcaaccgtatcatcaaaacaattggtaaagccattctactgttcccacaatctattacctaaaacagtgttagattccagccagtacgatttggctacgataaccaagattcagtctcgacttttcgataggagtaacagcaacgacgacaatgccaaaccaaggagaagaaagatcaaatgcaaaaagacccgcacaccatcgaacctacaatcacaaggagaacaggctgttgatgatagtactgctattgaaacagttacgtccacaccggtccaaacaccgatacccgagcttgaagaacaatctcccccatatttgaaaacaacagtatcgataagggataaatacgttataccagaaaaaatatcgctaaatttggactccaagaaagatacatctaaaaagaaaccgttttacttcataggtttgaactcgcaagaaccttcaaataactggaaatggggcatggaggatagccccccaccatatcattaa

SEQ ID NO: 3264 - DNA, 1380 bp, Saccharomyces cerevisiae
atgtcctctgcaattgacaatctctttggtaacattgatgagaaaaaaatagaatcttcagtagataagctatttagttcatcctgtggacctattaataaattggaagtcaaaagcaaaacacgtactgtccttcctgattcgaagaaaagggaaagagctgccgaagctgatcaagaagaaaaagaagcaagcaaacctgatgtttcagatgagcaaactgaagaagttgcccttccaaaagtaaagaaggccaaaaaaagtaaaaggaatgacgaggatgaagacttagaagcccgctattatgcgaaactactaaatgaagaagctgaggctgaggatgataaaccaacagtaacgaaaactgatgaaacttcagtaccactgacatcagcagctaagaaagttgatttcaaagaagacgagttagaaaaggcagaaagaactgttttcattggtaacatcttaagtactgtcatcacatctaaaaaggtttataaagaattcaaaaaactttttggtacaaatccgatagcagaaactgaggaatctggtaatgaaaaagaagaggaaagttctaagaaaagtgacaataacgaatttgccattgaaagcataagattcagatctatttcctttgatgaagctcttcctagaaaagttgcgtttgtccaacaaaaatttcataagtcaagggatacaataaacgcttacatcgtctataagaataagtctgctgtaagaaaaatctgctcgaatttgaatgctgtcgttttccaagatcatcacttaagagttgattcagttgctcatccagctccgcatgataagaagcgttcaatctttgtaggtaacttggattttgaagaaatagaagaaagtctttggaaacattttgaaccatgtggcgatattgaatatgtccgtattatcagagattcaaagacaaatatgggtaagggatttgcttatgttcaatttaaagatttacaaagtgtaaacaaagcacttttattgaacgaaaagcctatgaagtcacaaaaacaagaagacgaaaatacaaagaaaccaactaaaaaggcaagaaaattgcgtgtttccagatgtaagaacatgaagaagggtactactattgggaccggcttggatagaaatgggttgacagattcacaaagaaccagagcaggtagagctaaaaagattttaggtaaggctgatagagccactttgggccaagagataactatcgaaggtttaagagcaaagaaaggcgaaggttccacccatctaaaaaagaagaaacaaagatccgctacaggtagggttaccaaaagatcgatagcattcaagaaagctcaagctgaaaagagcaagaaatag

SEQ ID NO: 3265 - DNA, 1383 bp, Saccharomyces cerevisiae
atgacagaagataaatcgcaggttaaaatcaggtttttcacgcgtgagaaagatgaattactacatgtacaagatactccaatgtacgcccccatctcattaaagagatatgggttgtccgaaattgtcaatcacttgttgggctcggaaaagcctgttcctttcgatttcttgattgaaggtgaattgttacgtacttcattgcacgactatttgaccaagaaaggtttatcgagcgaagcctcgctgaatgtagaatataccagggcaattcttccaccatcctatttgaatagtttcagcaatgaggactgggttagctcattggatgtcggcgacggttccaagcatattattagtggttcttacgatggtatagttcgcacctgggatttatcaggtaatgtgcaaaagcagtacagtggtcattctggcccaatccgtgcagtaaaatacatttccaatacaaggctagtttcggctggtaacgaccgtactttgagattatggaaaaccaaaaacgatgatttgaaattaacttcacaacaacaggcacaggaagacgatgatgacgaagtaaacatagaggacggtaagacactggctatcttggaaggtcataaggcaccagtagtctctattgatgtttcagacaactcaagaatattatctgcatcatacgacaattctattgggttctggtctactatttataaggaaatgacagttgttgatccattagaagatataaacaatccaaacaataaaatatccactgctgctagaaaaaggagaaaattgacaatgaaagatggtaccattagaagacgtgcccctctgtctctgttagaatcccatacagctcctgttgagcaagtgatcttcgattctacagataataccgttggttattcagtatcacaagatcataccatcaagacatgggatttggtcaccgcgagatgtatagatacaagaacaacatcgtactcgttgctttccattgctcaattgtcgactttgaacttgttagcatgtgggtccagcgccagacacatcacattgcatgacccacgtgtgggagcgtcttccaaagttactcagcaacaactaattggtcataagaacttcgtttcctctctggacacttgtcccgagaatgagtatatattatgctcgggttctcacgatggtaccgtgaaggtatgggacgtcaggtctacttctccgatgtacaccataacaagagaagacaaatcggtccaaaagggcgtcaatgacaaagtttttgctgtcaaatgggctgaaaaagtgggtattatcagcgctggtcaagacaaaaagattcaaataaataaaggagacaacattttcaaaaactga

SEQ ID NO: 3266 - DNA, 1383 bp, Saccharomyces cerevisiae
atgacagttccttatctaaattcaaacagaaatgttgcatcatatttacaatcaaattcaagccaagaaaagactctaaaagagagatttagcgaaatctaccccatccatgctcaagatgtaaggcaattcgttaaagagcatggcaaaactaaaattagcgatgttctattagaacaggtatatggtggtatgagaggtattccagggagcgtatgggaaggttccgttttggacccagaagacggtattcgtttcagaggtcgtacgatcgccgacattcaaaaggacctgcccaaggcaaaaggaagctcacaaccactaccagaagctctcttttggttattgctaactggcgaggttccaactcaagcgcaagttgaaaacttatcagctgatctaatgtcaagatcggaactacctagtcatgtcgttcaacttttggataatttaccaaaggacttacacccaatggctcaattctctattgctgtaactgccttggaaagcgagtcaaagtttgctaaggcttatgctcaaggaatttccaagcaagattattggagttatacttttgaagattcactagacttgctgggtaaattgccagttattgcagctaaaatttatcgtaatgtattcaaagatggcaaaatgggtgaagtggacccaaatgccgattatgctaaaaatctggtcaacttgattggttctaaggatgaagatttcgtggacttgatgagactttatttaaccattcattcggatcacgaaggtggtaatgtatctgcacatacatcccatcttgtgggctcagcactatcatcaccttatctgtcccttgcatcaggtttgaacgggttggctggcccacttcatgggcgtgctaatcaagaagtactagaatggttatttgcacttaaagaagaggtaaatgatgactactctaaagatacgatcgaaaaatatttatgggatactctaaactcaggaagagtcattcccggttatggtcatgctgtgctaaggaaaactgatcctcgttatatggctcagcgtaagtttgccatggaccattttccagattatgaattattcaagttagtttcatcaatatacgaggtagcacctggcgtattgactgaacatggtaaaaccaaaaatccatggccaaatgtagatgctcactctggtgtcttattacaatattatggactaaaagaatcttctttctataccgttttatttggcgtttcaagggcatttggtattcttgctcaattgatcactgatagggccatcggtgcttccattgaaaggccaaagtcctattctactgagaaatacaaggaattggtcaaaaacattgaaagcaaactatag

SEQ ID NO: 3267 - DNA, 1383 bp, Saccharomyces cerevisiae
atgagcactttagatattgcagaagacaacaaaataaaaaatgaagaattcaaaatttggaaaaaatcaataccctcattataccaacatatttcaagtttgaagcctatctttggctcaggcgttgacgaatctccatcgacacttaggagtatagttttcactaacgatagctcatgtaataaatccaaaggtgttttgagcgtaccacttttatattctcaagggagtgaaatctttgaggtggattgtatagtgccactcggacttcattacaaaaaacctgaaagcatttcagaaccgttagtacaaccggattataccatggaatctcaaaaggtggagcagactgttttgattccaaaatgggaatttaaaggtgaaacgattgcaaagatgatttacgtggataacagcgaaataaatgtaaaggtgatagccctttctaccaatggttctttggcatggttcagagaaggtgtcaaatcgcccgtttacacaatgatggagccatccacttctctaagttcagcatcgtccggaaatcaaaataaaccctgtgttgattttgcaatttctaacgattcaaaaaccttaacagtaactaaggaaaaacatcttgataatgaaaacgctacaataaaattgatagacaactcaggtaaaataggagaagtgcttcgtacaatacctgttcctggcataaagaatattcaagaaatcaagtttttgaataatcaaatattcgccacttgttctgatgacggtatcataaggttttggggtaatgagataggcaaaaagcccctttggattctaaacgattctttggacggcaaaacaacttgttttgctgcatcaccgtttgttgatacattatttatgacgggaactagtggtggggctctcaaggtttgggatatacgtgcagttatcgctttaggggatgctgatgctgagttaaatatcaaccaaggacataataaagtcaatgaactattcaaagttcatcacttttatagcgagcaagtgtccaaaatagagttttcttccatttcgcctatggaagtggttacaattggagggttaggtaatgtttaccactggaatttcgaacctgtttttgccatttataacgagatacatgaggactttcaaggcataatatctgacgaattggaggccgaaagcatggcattttatcacactgagggctgcagaagagaaataggagaaaataataaggttaataccgttgcttatcacaaatacattgaggatctagttgctacagttgatagtgacgggttgttaactgtatataagccgtttactggaaaagttttagatggcagtagagaggttggagctgccaaaagttaa

SEQ ID NO: 3268 - DNA, 1383 bp, Saccharomyces cerevisiae
atgatgcttgaagggtatacggtacaacctccacagtctactttgataggtgacattgaaattcaggacgaaaatgcaaaccaagaagttaagaacgtactttaccaaggagttcaaaagggtataaaaaggctagaaaaaagacaaaggagggttgcattaggtgatgtaacctctcaaaaggcaaacaaaatacacaatgctatacataataaattccatcagacgaagaacaattttgaaatagagaacatacgctcatcggccttggtaaaagaacaacaacgagacgtaaggcatgaagatagcgactattttttaattgatagttctgaaggctcttctactgatgacgaacaagttaatgaagatgctattgatgatttgttaagtcgaagagtaaatgatcagcagattcaagccgatgaagtgtatgaagatttcgatggagaaatgcaagatgtcattgaagaggatgttgatagtcaaattgaaccactatcaccaataaacaacgatgaaattcagactgagctggacagggcgtttgaaaaatattttcggtcggttcccaatccgctggatgatgatacccatgatgttgtgatggttgtggagtacgcttccgacatattctattacttgagagaacttgaagtgaaatataggcctaatccctactatatgcaaaatcaagtagagcttacatggccgttcagacgaactatgatagattggctagttcaactgcattttagatttcaacttttaccagaaacgctatacctgacgattaatatagtggatagatttctgtcaaagaagaccgttactttgaacaggtttcaattggttggtgtatcggctttatttattgctgccaagtttgaagagattaactgccccactttggatgatctagtttacatgctggaaaatacatacactagagatgacattattagagcggaacagtatatgatagatactctggaatttgaaataggttggccaggacccatgccatttttaagaaggataagtaaagcagatgactatgacttcgaaccaagaacattagcaaagtacttattggaaactacaatagtagaacccaaactagtggctgcggcaccaagctggttagctgctggcgcgtattttctgagcagaacaattcttggttcaaatgattggtctttaaaacatgtattctactctggctatacatccagccaaataattcctttagcatcactgatattggagaattgcaagaacgcatctcgacgccatcattcaatttggaaaaaatactttgaccaaaagcattaccgctgttctcaaattgtagaagaatggattgtttcgacagaagcctaa

SEQ ID NO: 3269 - DNA, 1383 bp, Saccharomyces cerevisiae
atgcctagggccttatcaataaaatttgacaatacgtatatggacctttacgatgaattaccggaaagtaaactcctttatgatgaagaattttcatatcttttggatgcagtaaggcaaaatggtgtctgcgtcgtagattttttaacactcactccgaaggaattggcaaggctaatacaaaggtcgataaatgaggttttcagatttcagcaattgcttgttcatgaatataatgaaaagtacttagaaatctgtgaaaaaaactctatcagcccagataacggtcctgagtgtttcacgactgctgatgtagctatggatgaattattaggtggaggcatattcacgcatggcattacagaaatattcggagagagctctactggtaaatctcaattacttatgcagttggcgttaagtgtccaactttccgaacctgcgggagggcttggcggcaaatgtgtatatattaccactgagggcgatttaccaactcagagattggaaagtatgctatcgtctaggccggcttatgaaaaactaggtattacacaatcaaatattttcaccgtcagctgtaacgacctaataaatcaggaacacataatcaatgttcagttgcctattttattagagagatctaagggttcaataaaattggtgataatagattcgatttctcatcatttgagggtggagcttcagaacaagtccttcagagaatcccaagaaaataaaaactatctggataggatggcagagaagctccaaatactggcccacgattattcattatccgttgtggtggctaatcaagttggggataaaccactggctaacagtccagtggcacataggacatatgtaactgattatgattatcagctagggtggctagttggctggaagaactcaaccattctttatcggcagatgaattcgctgcttggagcaagttccaataacgatgaaattctatcagacgatgaagattatatgctaatcgagagagttatgagcactgtaaatgaccggaattatgattttttttcaaaaaagaaaccacccataattgagaataaaaccgttgagcgaaattcatcaagtcctatcagtcgacaaagtaagaaacggaaatttgactatcgtgtccccaatctcggtttgacttggtccaatcacgtttcaacacgaatattacttcaaaaatctttcaaggcttcaacaataattcaaagaggtgaagctcatctttataagggaggtgattcggcaagcttctggcaagttaagaggacaatgaaagtggtatattccacattcgctaagcctggtcaaattgcatatcaaattactaagcgaggaatagaaacagcctga

SEQ ID NO: 3270 - DNA, 1383 bp, Saccharomyces cerevisiae
atgcctatcaatgccatcacttccgaccatgtcattatcaatggtgcaaataaacctgcgactattgtgtattcgaccgaatcaggcacgattctggatgttttagaaggctccgtggttatggagaaaactgagataaccaaatatgaaatacatacgctggagaacgtatctccatgtacaattctgcctggacttgtggactctcatgttcacttgaacgagcccggtaggactagctgggaaggattcgaaactggaactcaagctgctattagtggcggggtcacaacggtggttgatatgccgctaaatgctattcctcccacaacaaatgtggagaatttccgaattaaattggaagctgctgagggccaaatgtggtgcgatgttgggttttggggtggactggtaccacacaacttgccagacttaattccgcttgtcaaagctggcgttcgcgggttcaaaggattcttgcttgattctggtgtggaagaattccctccaattggcaaagaatatatagaagaagccttgaaggtcttagccgaggaggataccatgatgatgtttcatgctgagttgcccaaggcacatgaggaccaacagcaacccgagcaaagccatcgtgaatattcttcgtttttgtcctcgaggccggattctttcgaaatagacgccatcaatttgattctcgaatgcttgagagccagaaatggaccagttcctcctgtacatatagttcatctggcatcaatgaaagcaattcccttgatcagaaaggcacgtgcgtcagggctaccagtcacaacagagacttgtttccactatttgtgtattgctgcagagcagatcccagacggagccacctactttaaatgttgtccacccatccgctctgagtctaatcgccaaggcctatgggacgctttgcgtgaaggtgttataggctcagtagtgagcgaccattcgccatgcacccctgagttgaagaacttgcaaaaaggtgactttttcgattcttggggaggaatcgcttccgtcggactaggtttgccattgatgtttacccaaggctgctctttggtcgatatcgttacatggtgctgtaaaaatacatcccatcaggtaggactatctcaccaaaaaggcactatagctcccgggtacgatgctgatttggtggtatttgatactgcaagtaaacataaaataagtaattcaagtgtctacttcaaaaacaaattgactgcctacaacgggatgacggtcaagggcacagttttgaaaaccatattaagaggccaggtggtatatacgaatgccaacggagtctcgaaaacaccattgggtcaaactttgcttgattctagacgttaa

SEQ ID NO: 3271 - DNA, 1383 bp, Saccharomyces cerevisiae
atgtccaacaagctgttcaggttagatgcaggtatgtgccatttttcgtcaaatattttgaatactttgagtattttttttttttttttttggtacactaactaacgcgtacgactctatgtaggctaccaacaatacgactggggtaaaatcggctcttcttcagctgtcgctcaatttgctgcccattctgacccctctgttcaaattgaacaagataaaccatatgcagagttatggatgggtacccacagcaagatgccttcctacaaccatgagtctaaggaatccctgagagatatcatctccaagaacccctctgccatgttaggtaaggacattattgataagttccacgccacaaatgaattgcccttccttttcaaagttttgtccattgaaaaagtcttgtctattcaagcacatcccgacaaagccttgggtaaaatattgcacgctcaagatcctaagaactatcctgatgataatcacaaacctgaaatggccatcgctgtgactgactttgaaggtttctgcgggttcaaacctttgcaagagattgcagatgaattgaaacgtattcctgaattacgcaacattgttggtgaagaaacttccaggaattttattgagaacattcaaccttctgctcagaaaggttccccagaagatgagcaaaacaaaaagctattgcaagctgttttcagcagggtcatgaacgcttcggatgacaaaatcaagattcaagctcgctccttggtcgaaagatcaaagaattctccatcagactttaacaaacctgatttaccagaattaattcaaagactgaataaacagttccctgatgacgtgggtttgttttgtggatgtttattgttgaatcactgcagattgaatgctggtgaagccatctttttaagagctaaggatcctcacgcctatataagcggtgatattatggaatgtatggctgcttctgacaacgtagttagagcaggcttcactccaaaattcaaggatgttaaaaacttggtctccatgttaacctatacatatgatcctgtggaaaagcaaaaaatgcagcctttaaagttcgacaggtcctctggtaacggtaagtcagttttatataaccctccaatcgaagaatttgctgtattggagactacttttgatgagaaacttggtcaaaggcattttgaaggtgttgatggtccaagtatcttaatcactacaaaaggtaatggttacattaaagcagatggccaaaaattgaaagctgaacccggttttgtctttttcatcgctccacatttgcctgttgatttggaagctgaagatgaggcgtttactacctatagagcctttgtggaaccaaattag

SEQ ID NO: 3272 - DNA, 1383 bp, Saccharomyces cerevisiae
atgtctgaatcagtggccattataggtgcaggattagtaggctgccttgcagctttggcattctccaaagaaggctacaatgtcacactatatgattttagacaagatcctcgattggacaccaccaaaaataaaaatttgaaatccattaatttggctatttctgctcgtggcattgatgctctgaaatcaatagatccggatgcttgtgaacatattctgcaagatatgattcccatgaaaggcaggatgattcatgacttgaaaggcagacaggaatcacaattgtatggcttgcatggagaagctattaattctatcaatagatctgtattaaataatagccttttggacgaattagaaaaatctacaacagaactgaagttcggtcacaaattagtcaaaatcgaatggacagatgataaacaaatctgtcattttgccattggggaagatttgaaaaccccacatactgaaaagtatgattttgtcataggttgtgacggagcatactctgcgacgagatcgcaaatgcaacgtaaagttgagatggatttttcacaagaatatatgaatttacgttacattgaactttacatcccgcctactgaggaattcaagccaaactatggcggaaattttgcaatagctcctgaccatttgcacatttggcctcgtcataaattcatgttaattgcgctcgccaacagtgacggctcgttcacttcaacctttttcggttctaaagatcaaatatcagatctgataacttccaagtcacgtgtgagggaattcttaatcgagaactttcccgatattattaatattatggatttggacgatgctgtcaaaaggtttatcacttatccaaaggaaagtcttgtctgtgtaaactgtaagccatacgatgtaccaggcggaaaggccatcctactcggcgacgctgcccatgcaatggttccattttacggccaaggtatgaattgcggatttgaagatgtgagaattcttatggcgctattgaaaaagcattcaggagatcgttcaagagcctttactgagtacactcaaacaagacataaggacctagtttctattactgagctggcaaaaaggaactataaagaaatgtcacatgacgttacatccaagcggtttttattaaggaaaaagctagatgctctctttagtattataatgaaggataagtggatacctttgtatacaatgatatctttcagatccgatatctcgtattctagagctttagaaagggctggaaagcaaacacgtatcttgaaattcttagaatctctgacactcggtatgttatctattggcggttacaagcttttcaaatttttgacaagagaacgttcctga

SEQ ID NO: 3273 - DNA, 1386 bp, Saccharomyces cerevisiae
atgatgatgttccataattgcagaattaataactacttaataacttctcaaattggcgaaggcgcgtacggtctggtttaccgtgccttagatattcgtaccgatagacaatacgctatcaaagcggttgttcaaagttacggtgttagcaaggaggctgatatgggcaatgataaaatacacaaaaatagcgtgaaattgcaaaagaagctcgctaaactgttcaaggaatcgaaaaacgttgtcagggtgccctctatagatctagaatcaattgagaatatgtcagaagaagattttaaaaagctgccccattataaagagatttcgctacacctaagagtccaccatcataagaacattgtcaccatacatgaggtgctacaatctgcagtctgcacgttcattgtcatggattattacccaacagacctattcacgtctattgtagataacagacattttgtcactaatggactgctagtaaaaaaggtttttctacagatctgttctgctcttaattattgccatgagcacggcatctaccactgtgacatcaagcctgaaaacttgctactggatacagaagataacgttttcctatgcgattttggtctatccactacttccacatatataaagccaaatgtttgcattggtagctcgtattatatgccccctgaaagaatctcatttgatgggagagtttccagctctaaaagtgggggacataagttgggtaaggtttgtccctcatgtaatggcgatttgtggtcattaggtatcatccttatcaatttgacatgcatcagaaatccctggctgaaggctgacaaaaccgaggataatacctactattatttcactaaggatcccaatatactaaagcaaatcctaccgctttccgatgacttttactcattattatctaagattttacaagtgaatccgaagaatagaatgagcttgcaagagttgatgaaagaagttagttctattacaagcttcaccaatgaaggcccgttatcaaaagtgccgcctctttccaagtctgtttatgaaaagttcgttagccccgtcgataacacgaatgagaatttgtctccaaaatcctacgtgtacatgcacgatagtaaagctgccaagaatttatcttatacatcttcaagtgaggaagaagatggaatcaaagaagggatagacgatgataatggcagtcgcagtggcagtttcggaacgctagacacagacactggattgcattcttcgttcacaagcacttcttgcgagtccgataacgaatgttctaagatttccaacaaattttccttgttcgaaaaaaaattcaacgaacttcgcatgagttcctcttctttaactaactaa

SEQ ID NO: 3274 - DNA, 1386 bp, Saccharomyces cerevisiae
atggaagaatttgaagaatttcgaaggaaaggggagatgtccagcagatgtggcaatcaccgtgtgctcagaaaatggaatagttgcgcttgcgagttggccgtgccctttgaggttcctgagcatgcgattacgaaattgcacatatacgacttcgacaatacattatttgcaacgccgggtcctacagagcaattgtatacacgtgagctactaaatttgttgacatcgagcacgctaccgaatggaggctggtggaatgagccggggtttctgcaggctgctattgagatctcgaagactaaaccgagaaggtattcgtggaatgcggatatcgttaaattggcggaggagtcatattctgccaaggatactatctcgatcgttttaacgggcagagaggaaagtaagttccataagttgattgagcatgctttacagacggcaaggagccattggaaatgctcagaaaatgagtttaggttcaatgcagtttgcctaaaaaaaagagcaatttctgagtacactagcaaatataaaaaagagttgatgcgggatttcttagaatattatccctctctgcgggagttgtccatatatgatgatagaatacaccaaatagatgcattcaagtctttcttccattctttggatctaccacgtctgaaatggtctgcgatccccgtacgaccattcaccaaatcgctgccaagagagcaggaacttgaaatggtgatggacatggtacgaaagaacaatagccaagctctcagcacttcacaaaagtttgatttaagacggactccaagacaaattggttatatcctttgcacggcatctcatcgtctattatcaatagaggtcatcaagtacttaaagcggcgtaaggggagaagaacgttcagacccaagctgtatgaacatcccttgtatataccgtgcgcagaacccggtaaagatatccctgcacttgaaatcgctaaggtatggtcaaacaatgacactcgcacgtttgattctgagaagaaagtacagcatatttcacaaattttttatctggaacagcctgggaagtgcatcgtacacttccaagtcacagaccttgccgtcatcgcgtcggcccaccacaacagaagaaagccattggaggtttatttcaaagccacacccgaaccaaacagatacactttcactctctttccagaatatatagtcactggtcatttttacaaaagagaccgaattgaagatttagaagtggtaacagagcgtctaataaactgcaaggaagatattcactgggttccgttagacaatacaataccaataaaggcatttttcgggcgatttgccaagttggcagcaataccgtgttccaatgcttaa

SEQ ID NO: 3275 - DNA, 1386 bp, Saccharomyces cerevisiae
atggctcctgtagttatttcagaatctgaagaggatgaggatagagttgccattactagaagaactaagagacaagttcattttgatggcgagggagatgatcgtgtagaccaacagcaacagcagcacagttcaagccacagggatagggataaacatgtgcagcgtaagaagaagaaaaggctctcgaatagaaacctgcaaggttcaaatggtgggtacgcttgggaggatgagatcaagagaagttgggatttggtgaaagtggacgatgaaggggatatggcatctcttgtggctagcatagtcgaggccagaaagaaacgtactgctaagaaaaacataacgccataccaaagaggtattatcagaagtttaatattaacactagattgtagtgaagctatgttggaaaaggatttgagaccaaacaggcatgccatgattatccagtacgccatagattttgtccatgaatttttcgaccaaaatccgatatctcaaatgggtattatcataatgagaaacggtttggcacaactggtcagccaagttagcggaaacccgcaggatcacattgatgcgttgaaatccatcaggaaacaagaaccgaaaggaaacccttcattgcaaaatgcattggaaatggcaagaggccttttattgcctgttcctgcgcattgtacaagggaagtactgattgtatttggtagtctttccacaactgatcctggagatattcaccaaactatcgattcgttagtttctgagaaaattagagtgaaggttttggggttatcagctcaagtggccatatgtaaagaattatgcaaggcaacgaattatggtgatgaatccttctataaaattttactcgatgaaactcacttaaaggagctatttaacgaggctgttacccctttacccgttaacaaaattaataagggtttcacactcgtaaagatggggtttccgacaaggatattcgaagatactccaactttttgttcgtgccattccaagttagtttacggcggatacttctgtcccaattgtcatagtaaagtttgttcattgcccacagtctgtccatgttgtgacttgatgctaatcctttctacccacctggccagatcatatcaccatctgatgccgttaaaaacatttgcagaagtacctacaacagaaaaatttcgatcagaagactgctttagttgccagtcaagatttcccatactgaaaaaccataaaaatggtaaactactgacaagttctcgctatcgttgtgaagattgtaaacaagaattttgtgttgactgcgatgtgttcatccatgaaatccttcataactgcccaggctgtgaatccaagcccgtaataacttaa

SEQ ID NO: 3276 - DNA, 1386 bp, Saccharomyces cerevisiae
atgggtatacctatgcaaatataccaggatgggaagggggtgcaattttaccacacgagatatcagaacgtatttgacgaacgggcgagcaagtatggcaactacacggtgaataatgattacccacagcttccagatacgataaaggaacatatcgaccagcttacctttagcaatgtcggagaggatggtggagatgttggaaactattctgaagaagacgatgatggtgacgaagaaaaggaacttgaagatgtttttcgaagtaaccgtgggttggaatttgtacggattaataactattttactacccacgatttacaaagtttcaaaagttttagaaatttcaatagcaagtactggattttttattctaatcaagcagaggacaaaaaattactgctgtatgactttaacggccaacatttgatttttattaagcagcaattttacgggcagttgaatttactgctatcggacgcaataatatgtatggactgcaattttggttataattcaaacaccattcaaattttagttggatttcagaatggaaagttgttaaagctaaactgcgacttgaacggaaacgtaaacaatcacttgcttttgaaggatccttcaacttcctctcatcaaagccacctatctatattaaatgtctgggcaggtttgttgccacatttcgttgtttcttttagtttgaaagatgggctgctaataacttctttagatcaccaacaaagcaatggaagttttcaaagtttccataccaacattgatttgcctgtagatctacgcacgaccacaaatgtcaagtccgttttaaatttccctcagtttactttatacaaaggaaatgatatgattttccactgcaagaatctattaggatcggatgcttccacgctaaacaaggaaataaactttatgcttaaaatagacgaagacgttcaaaagatcgactatcttcttaaaacgaatcacattttactcgaaaccaacatgagatatctgtccattccaacaagagaccccatagagaattcaaattcttctccacccgtctcagacagcgaggtttatccaatattttacaagacacaagaacttcatgtccatgcttcaggaacaggacgtcagatagcaaacaatgggaagtatatttttataaccgagcaacatctctacggaacagcgttatcggtatacaagtactctatatctttcaaacggtggctgttcgtgggctactcagacattagggccaaatacggtataaggagtgtcaaagatctctttgttggtaactgtccctctgtaaatagcccagtgctgacaattcttactgatgacaataacattcaaacaattcttcttaaataa

SEQ ID NO: 3277 - DNA, 1389 bp, Saccharomyces cerevisiae
atgaaaatacaacttgtaagatggcattgttctcgcaatgctctttggaatcgtgctttctactctacgagaaaggccactaagaacgcttcgtcggcgactccagctactatgacatccatggtatctcagaggcaagatcttttcatgacagatccactatctcctggatccatgttctttcttccaaatggtgctaagattttcaacaaattgatagagtttatgaagttacaacaaaagttcaaatttggttttaatgaagttgtgacgcctttgatttacaaaaagactctttgggaaaagtctggtcactgggaaaattatgctgatgacatgtttaaggtggaaactacggatgaagaaaaggaggaatacggtttaaaaccgatgaattgcccaggccattgtctgatcttcggtaaaaaggatagatcgtataacgaacttcccctacgcttctctgatttttcaccactacatagaaatgaagcttctggtgcactgtcgggattgactagactaaggaagttccatcaagacgatggtcatatcttttgcactccttcccaagtgaaatcagaaattttcaactctttaaaattaatcgacatagtttacaacaaaattttcccctttgttaaaggaggttctggagcagagagcaattattttataaacttttctacaagaccggatcacttcattggagacctcaaagtttggaatcatgctgagcaagtactcaaggaaatcttggaagaatcaggcaaaccgtggaaactgaaccctggtgatggtgcgttctatggtccaaagttggatataatggttacggaccatttacgcaaaactcatcaagtcgctactattcagttggactttcagctacctgagaggttcgatttgaaattcaaggatcaagacaactcgtacaagaggccaattatgattcatagagctacttttggttctatcgaaagatttatggctttactgatagattctaatgagggccgttggccgttttggttgaatccttaccaagctgtaattattcccgtcaatacgaaaaatgtgcaacagctagacatgtgcactgccttgcagaaaaaactacgtaatgaactggaagccgacgacatggaaccagttcctttaaatgattggcatttcaatgttgatctcgacataagaaacgaacccgtagggtataggatcaagtcggccattttgaaaaactattcctatttaattatcgtgggtgatgaggaagtacagttacagaaatacaacattcgagaacgtgataatagaaagagtttcgagaaacttacaatgtctcaaatttgggaaaaatttattgagctggaaaaaaactacaagtaa

SEQ ID NO: 3278 - DNA, 1389 bp, Saccharomyces cerevisiae
atgagcgaaataaataatgaaaatctagagccaacctcaagtacagtagctgagtctacagaaagcaagaataaacacattcgtagcgctttaagaaaacgaagaggtaaattaagcgcccaaacttatgaggaagatcaagaggctattttatcatctcctttattgacttcaacacctaaaacagtctccaggtcattagtgaggttatacccatatttaattgttgtggataactttctaagtatcatcacttggtccaatgacaatgtctctgcaaacttgcttggaatattcttatttacggtttgtgttctatattttggatttattacaaggtattttggacatttaatgatcgttggtataatatgggtatatcttttaattgacaagcacgttcaagaaacaatggcatcttgcccttcattggatgatataatacacgttatggatagggtttctatgaaatctagcgctgtgttatctcctattacgattttgagcgctcaggatgttagaagactgttatttaccattgccttcctatccccagtttatatttttctaacagtgtttgtgctatctccaaactatttaatgttaatagggggtctgtatgtgcttacgtaccattctaaactaatccgaagaatgagaagatacttgtggaaatttcgcgttgttagattacttgtatttttcataacaggattagaccttggtggaccagataataataggcgcttgtttgcttctgtcaataagaaaataaggtcctttgtttggaatgaggtagggaacacatctaacactaaaaagactgtacttttcaaggttgctctgtttgaaaaccagcgccgctggcttggcatcggatggacatcaactatgttgagttatgagcgcgcatcttggacagatgaattcctaaatacttctccaagcccagaagtgtttactttaccagaggagcagtcgggaatggcttgggaatggcacgataaagattggatgcttgacctaacaaatgatgggatcattcaacttcctgcttctgctgctaagacaaaagttaagccaggtgcagatgaaggtttcatatattatgataacacctggaataatccctctgcaacggacacatataaaaagtacacaagaagaaggaggtggatcaggactgcaacagtaacaacaacgtatgacgatgagcccactgtagaaaaagctacaccgaattctcatgctctgaagagtgaagaaaataatagagttagaaaaagaaaagtgtcatttagtacagcaaatgaagtgcatatcataccttcctcggacagtagcaaattaatacaaatatctgatgtttcaatgtctccttctctataa

SEQ ID NO: 3279 - DNA, 1389 bp, Saccharomyces cerevisiae
atgagtgacgaaaccatgcctgtagaatttttagttagtgataaaagactgttgaaaaccataaaagttaaactggaaaccaacggcctttttgttactcctatctattccgataatgataacaaagttataaaatcttctattgaggatctcaatcatccattggctgtcgaaattaacaatatagccggtgtgaaggcacgattccatgaaagtggtaacttggaacgtagtgaaggacatttgaaacaccaaagtaacagcattacggaatttacgaagagctttttaaaagatcatgggcttgctaatgacaagatatttttatctcatttattagatcatttacctctaaaatatacaatatatccaccagttgtattgttcaataattctacagtgagatcgtttaatcacccaatctggcaaaaagcattccaactgaaactcttcgatccaaatgagtattatcgtgagctgctatgtttcctttcgcccggcaaaccaagtaaaggcacgagtcttcatcctaacaatcgactactgactcatctggccataaataaccctatcacagaggcagatgtattgcgaagaccgttcaatatccaaccgctttatggcaaattgattgatgacagtattttggatgataacgataatacgttatgggaaaatcccagtcaagaacaactaaactcaagcatatggtgtaaggtcatacaaaatggtgtaacacaaatctggtcacccgtttttaccatgtttagtagagggaatatcaaggagaagaaaagagttttgactactttcccagatatttgcaataatgatgtggtcgatttatacgcaggaataggttacttcacttttagctacttaacaaagggcgctaggacactttttgcatttgaactaaacccttggagtgtagaagggttaaagcgcggcttaaaggcaaacggattcaataaatctgggaactgccacgttttccaagaatcaaatgaaatgtgcgttcaaaggcttactgaattcttatctcagaatcccggatttcggttacgtattaggcatattaatttaggtctcctgccttcaagcaaacaagggtggccattggccatcaaattaatttacttacaaggagcttctttggaaaaagtgacaatgcatatacatgaaaatgtacacatagatgcaattgaggatggaagtttcgaaaagaatgtcattgtagaactcgacgctattaatgagtcaattgcattaattagaaaccgtggcatcaaacttcagtttgtgagatctaagcttgaacgcataaaaacttttgcaccagatatttggcatgtatgcgttgatgtcgacgttatagtaagtacttaa

SEQ ID NO: 3280 - DNA, 1389 bp, Saccharomyces cerevisiae
atgagttactttcctcgaacatatgctcacttgatgagaaatgttcttgctcataataaagggaatatatacttacaaattggtacacagctgcacgatactcaaataaaaattcgatttaatggagttcgttatattagtcggaatcatggcgggaaacagcaacatataaacactgcgccgatagaatttactcccaattttggatatggtgatagaacctctaattgcaataaaaaggttgaatcgactgccatgaaaacgctaagatgcacagatgatatatcaacttcaagtggaagcgaagctactaccgatgcaagcacacaacttccatttaatgtcaaacttgtagacccgatggtaagaaaatctaagagaccatctcacgcaatcagcgaagggctgaatatgaaaactttaaagaagaaggtaattatgccatatcttcagttgaccaagccccgactcaccattctagtgatgttaagtgccatttgttcgtatgctttatctccatatccagcctccgtcaatgaattgttatgtttaacagtaggcactactttgtgttccggttctgcaaacgctataaatatgggcagagagccagaatttgatagacaaatggtgagaactcaggcgaggcccgttgttagaggtgatgttacacctacccaggcattcgagtttgccgcacttatcggaacattaggagtatctatcttgtactttggtgttaatcctaccgttgctattcttggtgcttcaaatatcgcgttatatggctgggcctatacgtctatgaaaagaaagcatatcattaacacatggttaggtgccctagtaggaatggtacctcctctaatgggatgggcagccgcaagtccgctttcacatccgggatcttggtgccttgctggtctattgtttgcttggcaattcccacactttaatacgttgagtcataacattagaaatgaatacaaaaatgccggatacgttatgactgcatggaaaaatccgctcctaaacgcccgtgtgtcgttgagatactctatcctaatgttccctttatgtttcggattgtcttattttaatatcacagattggtactaccaaatagattccggacttataaatgcctggctaacgttctgggctttcaaattctattggcaacaaagaatcaactattctgcaaaaacattaaaagataacgtcaagtttaataaaggtctaagtgtagccaacatttatgcaaggaaaacttttatggctagtgtattgcacctaccggcaattctaatcctagccattatacataaaaaaggccgctgggattggatatatcctggtgaagcaaagcgaccacaggaacgattttag

SEQ ID NO: 3281 - DNA, 1389 bp, Saccharomyces cerevisiae
atgcaaagaaataataggttaagaaatttgtttacagtgccagtaataatggctcgacaactcaaaaggaatgcattatctgcaggtcttgcttttgcaggtaatgcaacctcaaatgagtttgatgaacatttgcaaaatgaggttgaaagagagagggaaattcaaaagaaaaaaaaaataaagcgaactcaatcaaaaaaatcgccagatttgattaataaatctacttttcaatcacgaacgataggcagcaaaaaagagaaacatagacaactagatccagagtatgaaattgtcatcgatggccctctaaggaaaatcaagccctaccattttacgtacaggaccttttgcaaagagcgttggagagataaaaaattggttgatgtctttatatctgaatttcgagatcgtgaatctgaatattataaaagaacaatcgaaaacggggacgttcatataaacgatgaaactgcggacttatctactgtaattcgcaatggtgacctgattacgcatcaggtacatagacatgaacctccagtcacttccaggcctatcaaagttatttttgaagatgataacataatggttattgataaaccgagcggtatacctgttcacccaactggccgatatcggttcaatacaattacgaaaatgcttcaaaataatctcggatttgttgtgaacccatgtaataggttagataggcttacaagtggattaatgtttttggcaaaaactccgaagggagccgataatatcggcgatcaactaaaagctcgagaagtcactaaggaatacgtggccaaggtagttggagaatttccagaaacggaagtaattgttgaaaaacctctaaaactgatcgagccaaggcttgctcttaatgcagtttgtcaaatggacgagaaaggagccaaacatgcaaaaactgtttttaacagaatcagctacgacggtaaaacgagtattgtaaagtgcaaaccgcttaccgggcgatcacatcaaattagagtacatttacagtacttaggccacccaattgctaacgatcctatttattccaatgatgaagtatggggtaacaatctcggaaaaggcggccaggctgacttcgatatagttattactaagctagacgaaatagggaaaagaaaacctgctaaaagttggttccatagtaatggcgggtacggtgaggtattaaggcaagaaaaatgttctatttgtgaatctgatttgtatactgatcctggccccaatgatcttgatctgtggttacatgcctatctatacgaatcaactgagactgaagaaggaaccgaaaagaaaaagtggtgctacaaaacagagtatccagaatgggctctgagaagatag

SEQ ID NO: 3282 - DNA, 1389 bp, Saccharomyces cerevisiae
atgcccgctcgagaatataactatgtagaaggttttggtgggtacggctcgttggacgatgatgattcagatagagattctgaacgcaggaatcacgatctagggcagcgaactataaccacaagtccaacaggagtatcaagacatgctgcattaaataggtacatgatcccaggccgtatcaatcctcttttcagaccgacagacgctgctcaacctcccatagtgtctacatccacatcagcatcggcaacagaaccgaccaacagaataggccctggaaggataaaagaaacccctgaaacaaatttcaatgcatttcttatagcacaactaaccagaatggaggagcaaaatgccaatctgaaggaagaaatcagcctaatgaaaaaggaacaagaactcttctttctagagaatcaaaagaagttggagaaaggatttaaagacatcaataagtatgttgaagatgtttccgcaatgaaagaagtcttcaaagaggtagttggtattatgactggggagagaataagatttatagaccatactggggaaaatgttactcctcaggaagctgctcgtgttggaaatccatcaacaagtacgcaagctcatcaaagtcagtcaagatcaacaaactggcaagaatatagtatgcacgcaagcatattagccggcgatcctcgtatcaagcctgagccagggctgtcagactttgaaaatggggaatacgatggtaatgaaagtgatgagaacgctaccaccaggaacctacctttaaataaccccgattctgttagcaatgctgatgacagtaataaccaactcgatggaacaggaaacgagaatgatatcagaaacagaagagggtgcgttggaacgtcatataaactaaatcgtgcaatccagaacgttacagatgcggcccgtgaatactttgaaggcttaccgggccaaccgtcagttctttcccttgagaggagatatgggtccacttggaggcgatctgccaaagaaaggactttgttcactaaaagaatgaccatcataaaaagaataatagatataaaagatgatccaagcaaatatggtttgtcgctacctgagaataaaataagtagaaaccaagccatcaaggttgtcgaaaatataagattgggaaacaataccttcaaaggacatcattgccgattatcaatgtcccagttatacgaatacttctccaaaaaaatggacaaactcgaagactattcacttactctaaagagaagagggaagccaagaagaattttcttgttagaagagagagaagctagattatcattacagcagccacatagtataccaaattccagtacaggcacaccagaacatgatcaagacacttag

SEQ ID NO: 3283 - DNA, 1389 bp, Saccharomyces cerevisiae
atggaaagatatgatagacagctgagactatggggagcattgggccaagatagtttgaaccggtcccgtgtgtgcgtggtaggacctgctacacctttgctgcaggaagtttttaagaatctggtgcttgccggaatatcatctcttacttggctcaaagtagagtgtgcagttcaatcgggttctctgtttttagcagagcttaaaaaagatcttgagccattggcttctaaacagctagaatatgaggaaaatgaccttagaaagacgttacagcaacctcagtatgattggacccgcttctcggtggtgatcttgacttgtattggtgagcaaactgcgatgctcgatttaaatgagattaggcggcagagaggaacaaagtttccgcctgttctaaacactttcgtctctggattttatggatatatatatctggtactctcagaaacacattttgttttgcaagcacacccagatagtaagaagtatgatttacggttacagaacccttggcctgaactaataaattacgtagatacatttgacctaagtaaaatggatacagccacgttttctggtattccatatactgttttgctcatgaagtgtattgcaaaacttgaaagggatggtaataatgggaggataacgattgatcagatgaagaaagttttagaccaaatttgccttcctttagggaatgatgttatctacgaacccaattatgtggaagctaaacgctatgcttacttggcctgctctcaaaatgattgttgtaaagaactggaagatctgctccgaaatttggaaatatcagattatgggaacgattggcatgatacttataactacgagattctcacactattattgactttgaaaaatattgctaaagagaatggggagctcagctttcaacctttaacgggcactctcccagatatggagtcaacaacggaaaattatatcagactcaagaaactgtatgaagtaaaagcaaagcttgacaagtctcgtgtggaggaaagtttggctcgcagtaaaaaaatagtttcacaggatgtcttggagacattttgttctcattacggggaggtcaggaaaatattgccgccaaaaagtgacttgttaggtatttttagcacctcgaatgcccttttagatgcattagttatggtccaattctgggagcaaccggcagtaactgcagaggataaagatgagtttattggtttacgagtcgacgataactattccgtaatggccttttttggaggtgcagtggttcaagaggctataaagcttatcacacaccattacgttcctattgataacctatttttatataatggcattaataattcatccgcaacatataaaatataa

SEQ ID NO: 3284 - DNA, 1389 bp, Saccharomyces cerevisiae
atgttggacatcaaccaatttatcgaagataagggtggtaacccagagctaatcagacaatctcagaaagcaagaaatgccagtgttgaaatcgtcgatgaaattatttccgactacaaagattgggtcaaaacaagattcgaattagatgaattgaacaagaaattcaacaagcttcaaaaggatattggtttgaagtttaaaaacaaggaagacgcttccggattattagccgaaaaagagaagttaacccaacaaaagaaggaattgactgaaaaggagcaacaggaagataaggacttgaagaaaaaagtttttcaagtaggaaatatcgttcatccatctgttgttgtttccaacgatgaagaaaacaatgaattggtccgtacttggaaaccagaggatttagaagcggttggccccattgcttctgtgactggtaaaccagctagtttatcccatcatgaaatcttgctaagattagatggatatgatccagaccgtggtgtaaagatttgtggtcatagaggttatttcttcagaaattatggtgttttcttgaaccaagctttgattaactatggtttacagttcttagctgccaagggttatattcctttacaagctccagtcatgatgaataaagaacttatgtcaaaaactgctcaactatctgaattcgatgaagagttatacaaagttatcgatggtgaagatgaaaaatacctaattgctacctcagaacaacctatctccgcttaccacagcggtgaatggtttgaaaagccacaagagcaattgccaattcactatgtcggttactcctcttgtttccgtagagaagccggttctcacggtaaggatgcttggggtgtcttcagagttcatgctttcgaaaaaattgaacaattcgtcatcactgaacctgaaaaatcttgggaggagtttgaaaagatgatctcttactctgaggaattttataagtctttgaaattaccataccgtatcgttggtatcgtttccggtgaattaaacaatgctgccgctaaaaagtacgatttagaagcctggttcccataccaaaaggagtacaaagaactcgtctcttgctccaattgtactgattatcagtcaagaaacttagaaattagatgcggtataaagaaaatgggcgacagagaaaagaaatacgtacactgtttgaattccactttggctgctacccaaagagctttgtgctgtatcttggagaactaccaaacggaagatggtttggttgtaccagaagttttgaggaaatacattccaggtgaaccagaatttttaccattcgttaatgaattaccaaagaattccacctctagtaaagacaagaaaaagaagaattaa

SEQ ID NO: 3285 - DNA, 1389 bp, Saccharomyces cerevisiae
atgttttcaagaacagcatccaagttccgtaatacacggaggcttttaagtacaatttcctcacaaattccaggaaccagaacctctaaacttcctaatgggttgacaattgccacagagtacatccccaacacatcttcggctactgttggaatatttgtcgatgctggttctagggcagaaaacgtaaaaaacaatggtacagcgcattttctagaacacttggctttcaagggtactcagaataggtcacaacaaggaattgaattggaaattgaaaatatcggatctcatttgaatgcatatacatcaagagaaaacacagtttattatgctaagtccctacaagaagatatcccaaaggctgttgatattctaagtgatattttgactaagtcagttttagataatagtgctattgagagagaaagggatgtcatcatcagagaaagtgaagaggtggacaagatgtatgatgaagttgtttttgaccatcttcatgagattacgtataaggaccaacctttaggaagaaccattctgggtcctataaaaaacataaaatcaataacaagaactgatttgaaagactatataaccaagaactataaaggcgacagaatggtattggcaggtgcgggcgctgttgatcatgaaaaattggtacagtatgctcaaaaatactttggccatgtgcccaaatctgaatcgcctgtcccgttgggatcaccaaggggcccattaccagttttttgtagaggtgaaaggtttatcaaagaaaacacgttacctacaacacatattgctatcgcattagaaggcgtgtcatggtctgcacctgattattttgtagctctggcaacacaagcgattgttggtaactgggacagagccattggcacaggtacaaactccccctctccattagctgttgcagcaagtcaaaatggttctttggctaattcttatatgtcattttccacctcttacgctgattcaggtctgtggggaatgtacatagtaactgattctaatgagcataacgtgcagttaattgttaatgagatcctgaaagagtggaagagaataaaatctggcaaaatatcggatgcagaggtgaatagggcaaaagctcagctaaaggcagctctgttgctatcgttggatggatcgacagccattgtagaagatataggcagacaagtggtgaccacaggtaaaagattatcaccagaagaagttttcgagcaggttgataaaatcactaaggatgatattattatgtgggcaaattacagattacaaaacaaaccagtttcaatggttgccctaggaaatacatccactgtccctaatgtatcctatatcgaagaaaaactgaaccaatga

SEQ ID NO: 3286 - DNA, 1392 bp, Saccharomyces cerevisiae
atgaaccgtattactaggaaaagttgtttattcgcgattatatttgcatcattatttgtgacacatgcattgggtgccgctattgatccgccaaggcgaccacataatgtgaagccttttcataacggtaatctcgaacttcaaagaagagcaaatgaaccgttttttgaaatagatgtcaagagtctgaacacaaactcaccgatatcagagttgtgtaaaaaagatttgcacgtcattgaatcgtctcatgatctttttcatttacaaaaccaatgtgaattcatcttggggtcattaaaagtcacaaactatgattctaacattttggatttgaacagcttgagggccattggtggtgacctgattattcaggattcacctgaactgatcagaatccaagccgggaacttgaataaaatcgaagggctcttccaattacagggactaacctctttggtttctgttgaaattccaactttgaaattttgtcagtcactggagtggaaagttgttcccatcttgaactacgtctccatggattctcagaatattgagattataaaggatattgtcatatcggatacttcattagcaaacatcgagaatttcaacaaggttcaggaaattgatactttcaatatcaataataacagatttttagaaactattcattcgaacgttaaaaccattaggggacaattcagtgtacatgcgaacgctaaggagctagaacttgaaatgccacacttgagagaagtggaaaacataacgattagggacacatcattggtctaccttccacaattaacaaaagtgaaaagctctttagagttcatcgaaaattacttttacgaattgaacctgaacaatttgcagaagattggtggaacattaggaattatcaacaatgtaaatttaataaaagttaatttggagaacttaacagacattcaaggtggcttgatgatcgccgataacgaatccctcgaggatattactttcctgccaaacttgaagcagattggaggtgctattttctttgaaggttcgttcaaagatatcatgttcgatagcttgaaactggtgaaaggtagcgcttttattaagagttcatcaaacgtgttggattgcaataaatggacaaacccatcaaatggaagatcaatcatcaggggtgggaaattcacttgtatttctggtaagaaggaaaatacgctgaatgttaaacaggatggtacaatcatagaaaaagggtacaaagatttaacgcaagaaggtgaagactccaagaaaagagtgatttcaaaatacgcgaactcagcaaatccaagcatgcaattggacccccttctttttggtacatgccttgttgctatgttattgttttaa

SEQ ID NO: 3287 - DNA, 1392 bp, Saccharomyces cerevisiae
atgaggttactagtcagctgtgtggatagtggatccataaaggaagttttgtgtaacatcgggactgacacttccgtacaatcagcactgcagccttttcatgtggcacctcatctagccgaaggattgaaagcttacgttgacaggatgtgggtgatatccgaagatgaagccatcttagcaaggaattcaggggtcgtcgaacttgtaaagatttcgaaacaccttaaagaaaatgaagctctccaggtcgatcccaaaggagaaagcaaaaatgaaaagagcctttccgatgatctacccaaatttgacatatccgagtttgagataaccagctcagtttcagacctttttgatgatgccaaattggaatcactttcaagtaaatctgttaaaagaaccaagttggtggatggttttgtcacattatgtcccataaaaaaggattcgtcgaataacacattcgtagctgctaccaaatcgggattattacatattataaaaaaaggagaagataaaaagttaataaaactagcatcccttggactgaaagcaccagtagaatttcttcagttatatgatctagaagataccgatactgataaatatatatttgcatacggaggggaggagaatttaataaaattagtggaaatagattcgagtttccaatctttaaagcaaatttgggaagccaagaatgttaaaaacgacaggttggatatgagagtcccagtatggcccatggccctaagatttttggagccctcccctggtaaaactgaaaagggtaagctgaactaccagtttgcagccataacccgttggtcccacctcaccaaatacagcacacaacatggcagaaaaccgttcgctcagatagatttattacctaaccgtgaaccattatctcagatggaagtttttgatgccaagggagaaaatgttgtctcttcgttggggaattttcaatctgaaacctttaatgaactgaatgtgattactactgactacaaaaagaatgtttttaaattcgatggtaatggaagaatgttgggcaaggtgggtagagatgatatcactggttcgtcaacctatattcatgtacatgacggcaaatatcttttacaaggtggtttagataggtatgttcggatcttcgatataaaaactaacaaaatgctggtgaaggtttatgttgggtcccgtataaattttattgttatgctggatgacgttgaaatcgagatgccactaagtccaagtgcgaaagctgccaaagggaagcaaaaaaggaaggttacagaacttgaagaagacgcagatgagctttggaataaattggagggaaaggtagctgcttctaaagccagtaagaaaagcaaaatttaa

SEQ ID NO: 3288 - DNA, 1392 bp, Saccharomyces cerevisiae
atgcctaccattttatacaacaccaattccagtttaattaccaagtaccgaaggccaaatgcctcaaatcaatataaaggctttctgtcaaaaaaaggacatacacgactgaattctaaatcgagtggagatatttgggagaaagattgtagtcatacgaaaaattctggtaatgatgtttcgtttgagagtgaatttgaaaaagattcggttgagtatctaagggatttatgtttctctatatacccaaattcattacatcagaaaatcagaagcatagaagctttgccagacctacaggtaaatacctttattgccttaattttccaaaatttcgttaagtcttggtatggtatcaaaatacccactgatgattccaagtttttaaccgaactatataacttagttcaagatttaataacatatttgaagagttccaaaatcaattaccatgcccttttactcgattatattccctgcttgctttcgtctcacttgaaagcattaaatgactcatctcaaaataacgatttagtttatgaacagtactgtaagctaactttgtatgattcgaaacgatatccaatgctattcactgaaatcatacaaagtaaaatgagcaccaaatctctactacagagaagctttttggatagctttttaaatgaacttgtgttcgggcatatttttaattcaatagcggaaccatattatcttctggagggcttgaataaaatttgcataagaataaagctaaattctgcaggaaataccagaaacgaggtgactcatggaaagcctaaatgcgatccctggttgtttgtttccaatgtaaagcacaaaatattgcaaatgaccaggcttttagcttattcaacttcaacagaagcagcaaatatgaacactgccgaaattcaagaaacagcatttctacaaagatatatttttacttttttcaccgatgattttttcaaattatctatgaggaagccattcctattctcaatatgcagaacgcttcagcattggatctctaaattaaatgcgttaaacagggtcatgtatagaacatttgacaatattgttcaaactaaaattaccagccctgtgacaattggcaacttattctcattattacgacattctttgtttcctaatgacaatatgatggggccaccaagagtattaccagtgggtgatgcttttctagagttcagagaagagtgtatttccaatttatgggatgtttgtatgacttataaacttgatcatatcctcgctatcaaaaggtctgacatagcggatcttattatctgcatatcgaagaatagggattgcaataaactgctaatttatagaattattgactgtgttattgcgcagttgccgtag

SEQ ID NO: 3289 - DNA, 1392 bp, Saccharomyces cerevisiae
atgctttccagagcgacgcgtactgcagctgccaaatccttagtaaaatctaaagtggctagaaatgttatggctgcttctttcgtcaagagacatgcttctacaagtttgttcaaacaagctaacaaggtcgaatccttaggttcaatatatttatccggcaagaaaatttcagttgcggcgaatccgttctccataactagcaatcgttttaaatctacctctattgaagttcctccgatggcagagtccctgactgaaggctctttaaaggaatatactaaaaacgttggtgattttattaaggaggacgagctgttggccactattgagaccgataaaattgatattgaggtcaattcgccagtatcaggtactgttacgaagctaaatttcaaaccagaggacactgtcactgttggtgaggagttagctcaggtcgagcctggtgaagcacctgctgagggttctggagaatctaagccagagcctaccgaacaagcggagccatcgcaaggtgtcgccgcaagggaaaactcaagtgaggaaacggcttcaaagaaagaagctgctccaaagaaagaagccgctccaaagaaagaagttacagaaccaaaaaaggctgatcaaccaaagaagaccgtctctaaggcgcaggaacccccagtagcctctaactctttcacaccatttccacgtacagaaaccagggtcaaaatgaaccgtatgagattgaggattgccgaaagattaaaagagtctcaaaacactgctgcttccttaaccacattcaacgaagttgacatgtcagctttgatggaaatgaggaaactgtataaagatgagattattaagaagaccggtactaaattcggattcatgggtcttttctccaaagcatgtaccttggccgccaaggatattccagccgtcaatggtgccattgaaggtgaccagattgtttatcgtgattacacagatatttctgttgctgtggccactccaaagggtttggttacccccgtcgttcgtaatgcagagtcattgagtgttttagatattgagaacgaaattgttcgcttgagtcataaagcgcgtgatggcaaattaaccctagaagatatgacgggtggtactttcaccatatctaatggtggtgtttttggttcattatacggtactcctatcatcaattcaccacaaacagccgtcctaggcttgcatggtgtcaaagagagacctgtcactgttaatggacaaattgtctcaagaccaatgatgtacttggctttgacttatgatcatagattgctagatggtagagaagctgttaccttcttgaagactgttaaagagttgattgaagaccctagaaaaatgttgttatggtga

SEQ ID NO: 3290 - DNA, 1392 bp, Saccharomyces cerevisiae
atggtcgctatcagtgaagtcaaagaaaatcctggcgtaaacagcagtaattctggtgcagttacgagaactgcggcacatacacatattaaaggtttaggtctggatgaaagtggtgtggccaagagggttgaaggagggtttgttggacaaatagaagctcgtgaagcgtgcggtgtaattgtagatttaatcaaggctaaaaaaatgtcaggtagagctatcctattagctggtggtccttctacaggtaagacagcattggctctcgccatttcacaagagttaggcccaaaagttccattctgtcctcttgttggtagcgaattatattccgtggaggtcaaaaaaacagaaaccctaatggaaaattttagaagagcaattgggttaagaatcaaagaaactaaggaagtttatgagggtgaagtgacagaactaacccctgaagacgcagagaatccgttgggcggatatggtaaaactatctcacatgtaattgtcgggctcaagtctgccaagggtaccaagacactaagattagacccaacgatatatgaaagtattcaaagagaaaaggttagtattggtgatgtcatttatatagaggccaacaccggtgcagttaagcgagttggcagatctgatgcatacgctactgaatttgatttggaaactgaggaatacgtaccattgccaaaaggcgaagtgcataagaaaaaggaaattgtacaagatgttaccttgcacgatttggatgttgcaaacgcaagaccacaaggtggtcaagatgtcatatcaatgatgggccagttgctcaaacctaagaagactgaaataaccgagaaattaagacaagaggtgaataaagttgttgctaaatatattgatcaaggtgtcgcagaacttattccaggtgttttgttcattgatgaagttaatatgctagacattgaaatattcacgtatttgaacaaagcgcttgaatctaatatcgcccccgttgttgtattggcttctaataggggcatgactacagtccgtggcactgaggatgtgatatcaccacatggtgtgccacctgatttgatcgatagattgttaattgttcgtacattaccatatgacaaggacgagatccgtaccattatagagagaagagctaccgttgaaagattgcaagtagaaagtagcgcattggaccttttagccacgatgggtacagaaacttcgttacgttacgctttacaattattggcaccatgtggtatcctagcacaaacaagcaatcgtaaggaaattgttgttaatgacgttaatgaagccaaattgctgtttttggatgccaaaaggtcaacaaagattttagaaacttccgcaaattatttgtaa

SEQ ID NO: 3291 - DNA, 1392 bp, Saccharomyces cerevisiae
atgtcagacggcactcaaaaactatggggtgggagattcactggtgaaaccgatcctttgatgcacctttacaatgcgtctcttccgtatgattataagatgtataaggcagatttagaaggaactaaagtatacacagcgggcttgcagaagttgggtcttctaacggagacagaattggcaaagatccatgaaggtttggctgaaatcaaaaaagaatgggacgctgacaaatttgtccgtcatccaaacgacgaggatatccatactgcgaatgaaagacgtcttggtgaactaattggccgcgatattgctggtaaagtccacaccggtagatcccgtaatgatcaagttgttaccgatttgagaatatactgtcgtgacattgtcaatgacaccctctttccagctttaaagggcttggttgaagttctaattaagagggccgaaggtgagatagatgtcttaatgccaggctacacacatttacaaagggcacaacctattagatggtctcattggttgagctcttatgcaacatacttcaccgaagattacaagagactgggtcaaatactacacagattgaatcaatcaccactgggtgcaggcgctcttgctggtcatccttacggcattgatagagaatttttggctgaaggtttgggtttcaatagtgtaattggtaactccttggttgctgtttctgatagagatttcatcgtggagttgatgttttggggaactttgttcatgaaccatatttctcgttttgctgaagatttgattatatattgtacagcagaatttggtttcatacagttgagcgacgcctattcaacaggttcttctttaatgcctcagaagaagaatgcagactcgttagagttgttaagaggtaaatccggtagagtatttggtgatctgacaggattcttgatgagtttgaagggtatcccatctacttatgataaagacatgcaagaagacaaagagccactattcgattgcttaacaactgtagagcactccatgctgattgccacaggtgttatttctaccttaactgtaaataaggaaaagatggaagctgctctcacgatggatatgctagctaccgacttggcagattacttggtcagaaagggtgttccattcagagagactcatcacatatctggtgagtgtgtcgctactgctgaaagacttggtctaagcggtattgataaattaaccttggagcagtatcaaaagatcgattcgagattcggacaagatctttttgaaacttttaactttgaacaaagcgttgaaagacgagatgctactggtggaaccgctaaatctgctgtattgaagcaattggataatttgaaatcccaattaaattag

SEQ ID NO: 3292 - DNA, 1392 bp, Saccharomyces cerevisiae
atgtcgaagaaatttagctctaaaaactcccaaaggtacgtggtggtacacagaccccatgatgatccttcattttatgatacagatgcctctgcgcacgttttggttcctgtctccaatccaaataaaacttctccagaagcagatcttcgaaaaaaagacgtgagttcaacaaaaccaaagggtaggagggctcatgtgggagaagcagctttatatggtattaattttgatgattctgaatacgattatactcaacatttgaagccaataggtctcgaccctgaaaactccatctttatagcatccaaaggcaatgaacagaaggtcgaaaaaaaaaacattgaagatttattcatcgaacctaagtatagacgtgatgaaattgagaaggatgacgcgctacctgtgtttcaaagagggatggcaaagccagaatatttactacaccaacaagataccaccgatgaaattagaggtttcaaacctgatatgaatcctgcattaagagaggtgcttgaagctttagaagatgaagcatatgttgttaatgatgatgttgtggttgaagacatcagcaaaaagacacaacttcaaggcgataactatggagaagaagaaaaggaagatgacattttcgcacaattactagggagcggtgaagcaaaagatgaagacgaattcgaggatgagtttgatgagtgggatattgataatgtagaaaattttgaagatgaaaactacgttaaggaaatggcgcaatttgataacatcgaaaacctggaggacttggaaaatatcgattatcaagctgatgttcgaagatttcaaaaagataactctatactagaaaagcataactcggatgatgaattttctaatgcaggtttagacagtgtaaatccctctgaagaggaagatgtgctgggcgaattgccctctatccaagacaaaagcaagacggggaagaagaaaagaaagagccgtcaaaaaaagggtgccatgtcagatgtatctggattttccatgagttcaagtgccattgcgcgtacagagacgatgacagtactggatgatcagtacgatcaaatcatcaatggttacgaaaattatgaggaagaactagaagaggacgaagaacaaaattaccaaccatttgacatgtcagcagaaagatctgattttgagtcaatgcttgatgactttttggacaattacgaactggagagtggtggccgtaaactggctaagaaagataaagaaattgaaaggctgaaggaagctgctgatgaagtaagcaaaggtaaactgtctcagagaagaaatcgtgaaaggcaagagaaaaagaaacttgagaaggtcaccaatacactaagcagcttaaaattttag

SEQ ID NO: 3293 - DNA, 1392 bp, Saccharomyces cerevisiae
atgtggaaataccttcatagatcagtcaaaaatgaagggaccgtagaacggctcactaacctcaacttatttaccaatcaccgtttcaagttttattctacattaaaggaacaaagtttttggagaataccattcaaaagaaggagcaaattacagaaatgggtgttatcgacaggcatcgtaagtttcatcgcttttaacatatggtgggtttattggccacatcatacttttcccaaacccgttgctaaaatattaaggaaggggttacattcagaaattaagaaagaaggtgcgaactaccaaaaaagccttgagtactacctcgaagctttagaagaatgtaaagccgaaaacgtggatctactttcggatgaatataccggtattgaaatcaaaatcggagaaatgtatgagaaattacatatgtataatgatgctacagctttatatggagacatgctgaaaaagttctataatgaactaagcaaaactactgataagtcaacgaagagaaaattctttttgttgaaaagagaccttcaaattttggtaaggttcaatgaaataaataaagactctgaaactaatgcaacgttattgataatgcaccttttattagctcaacgagaatttttggagaactcaccggagttcaaaaatgttctttccaaatcagaacttttaaacaaccaacagcttgactggaagaatttcaagggtctaccatttattggtaaatccaaacctgactaccaaatgcatttaaactctaaaagaaaacaggagttgaagataaaggaacctgaaagcgaacaatgcgttttcatgaaagaacttctgactgcaagagatttatatactcgttactgtctcaatcggagtaatctttctggggccttgaatagcaaaataacaacactagaatggatgttactagcggatagtcctctggacgacatcttgcttgcccaggcagagctcgggtcgattttttatctaaattcagagaagttcgaaggaagtctatacgctattgataatgaaccgtacaaaaaatcagaacctttagaacttattcggtccaggttacaagaaaaccagaattcctgcttacagtactcggctgactgctataaaagtattatcagctttgccaatgaaaatcaatatccaaaagttgcaatggaaagcgaaatggatcagagaatacttaaggcattatcccttgctcactacggtattggtgtgataaatttgcataagggacgcttgagggcatctaagaaggaacttaaaaaggctattcgtatttcagagatgattagatttaatgaactcattgaggaagctcaacgtgaacttaaaaaggttgatggtacgcctatataa

SEQ ID NO: 3294 - DNA, 1395 bp, Saccharomyces cerevisiae
atgaggtttctttcaaaaaggatactgaaacctgtactttcagtgatcattctaatatcgattgccgtaaccgttgttctttactttttaacggcgaatgagaactatttgcaagcagtcaaggatagtgccaagtcccagtatgcttctctccgggagagctacaaaagtattacaggtaaaactgaaagcgctgatgaacttcctgatcatgatgctgaggtgttagatagcataatggacaggctacacgagcccctttatgaaaaggacacttttgacccgaatgaagtccttgctgaaaataaacagttgtacgaggagtttttacttcaagaaatttctgagccaaaggtggacaatttggtacgtagcggggatccgttagccggcaaggcaaaaggaactattttgagtttggtgagaaattctgatttagaggatataatttcttctattcaacagctagaagaggagtacaataagaattttggatatccctataccttccttaacgatgaggaatttactgacgaattcaaagatggaataaaaagtattcttcctaaggaccgtgtagtagaatttggcactattggtccagataactggaatatgcctgatagcatagatagggagagatacgaccaagaaatggacaaaatgagtaaagagaacattcagtatgcagaggtggaatcctatcataacatgtgtcgtttctattctaaagaattttaccatcatcctctgctatctaaatataaatatgtgtggagattagagccaaacgtgaatttctattgcaaaattaactatgacgttttccaatttatgaacaagaatgacaagatttatgggtttgttttgaacctctatgatagtccgcaaaccatcgaaacgctatggacttcaactatggattttgtcgaggaacacccaaactatttgaacgtcaacggagccttcgcatggctaaaagataactctcaaaatccaaaaaattatgattatactcaagggtattcaacttgtcatttctggaccaattttgaaatagtcgatttagactttttgaggtcagaaccttatgaaaaatatatgcaatatcttgaagaaaagggaggattctactatgaaaggtggggtgatgcccctgtaagaagtttggcacttgctttatttgcggataagtcaagcatccattggttcagggatataggttatcaccatactccgtacacgaactgtccaacttgtccagcagattcagataggtgtaatggaaattgtgtaccaggcaaattcactccttggagtgatctagacaaccaaaattgccaggcaacctggataagacactctatgtctgaggaagagttagaaatgtattga

SEQ ID NO: 3295 - DNA, 1395 bp, Saccharomyces cerevisiae
atgccactgaaacgctccttaaaagaatcaatcgaaagattatctagttttcaatcaaaatataatattttcactagtatcaatccatctccttattcaatcacaaataaaaaaggtacaaaagaaacattgacaggttgcgttgccagtatcaaggataatatagttacaaaagattttccaaccacatgtgcctcacatatacttgagaatttcaagtctcccttcgatgcaacagtagtgaaactattaaaacaggcaggagtgcatatcttaggcaagacaaatttagatgaatttggaatgggttctgggggagtacattcaataagagggcccgtaattaaccctttatatcctcatgaggacaagaagatcatgggaggttcatcgtctggagccgctgcaagcgttgcttgcgatctagtcgattttgccttgggaacagatactggtggctccgttaggctccccgcatgctatggatctgttttaggattcaagccgtcctatggacggttgtcaagatttggcgtaatagcgtattctcaatctttagacactgttggcatacttagcaaaaagataaacgtcttgcgaaaagtatttcatacgctcgataaatatgacatgaaagatcccacttccttaagtgtggaattgcgtgaattgatagaagggaataaaaaggttaggagacctttaaaggtaggaattgtaaaggaatttagccatgaaagtatgcccattgggttccacagattatatttatccttactagaaaagctgataaatttagggcttgaaatataccctgtatccattccatctgtaaaaaactgtttaccgatttattatacgctatcacccgctgaagcggcttccaatttatcaaggtatgatggtatcagatatggatacagagattcagaactcgatataaaagacggtattttattcgcacctactaggtccaaattcggaacagaagttaagaatagaatcattctaggtaattataatctttgttcagatgcatttaagaacaattttattaaggcagaaaagctacgagttaatttgatcgatgaatttgacgggatcttcagatttccaaatgttttaactaattctaagggaaatccagacggcctagatctactgatagttcccacatcgtccaagcttcctggatccataagggacttcgaagaagaggaagccaaatctccggctaactcgtatataaacgatgtctttactgtcccaatgtcattggctggactaccaagtttatcaatgcctttaaaagagaagaccccgattggcttacaggtagtaggtcaatatggtgatgattccactgtgttagattttgtcgagtcaatatcataa

SEQ ID NO: 3296 - DNA, 1395 bp, Saccharomyces cerevisiae
atgccagaagatacaagctatagcaactccttcgaggattattacaacaattctcacgcgatttccccttacaaggattcattttacaaagaaatgacaccatctaagccaaatgtaaggtttggtgatgatgatgttaacatttttgatcaaagaaaaaaagtaaatgaaatcaacaagaataacaccgtcaaaaggtcgatcccatcatcgataagcaccactattacccccaacaagtctagcttaaagtcaccaaggggaaaaagggcttcgaagaattcttttgataatgaaactaagttagaatcgaaaaatgaaactctgaaagaggtcaatgacgcggttaaccgttgctatgcgctttgtaacattccaactaagcatgtatccataaatagtatttctgatttggcgcagacgttcgaaacgcttgctgtagggataacccatgaaacgaacagaaaagctgagtgtgaacggagcaagaatgcaatagattcactttactaccatgaacagctagaaaaaaaagaacttaatgaaaaaagccttcaaatggcaatcgatcacttgctgaaggtcacaaagcaaaatttgagacaagctgacgatggaaacaaactgaaagaaacagaagcactcaaaagtttcattgaggaaatagaggaagttgacgataataagatttccatcaacagtttacaacaacagttgcttgaagaaaaaacggcaaacaacattttgcgaagggattattataaactccaggaacgtggaaggcgtttatgtcacgagtttcaggagttgcaagatgattattccaaacaaatgaaacaaaaggaatatgaggtgcaaaaactcaagaatgaaattaaagttttattaaacatgaacgataacttaaaggcagagaaggcccattactctcagaaagagaaacaatattttcaaaaatatacctatatagagaaatacatgaatcatgtcaaggaagagtataatagaaaagaggacgaatgcaaaaaattgaactttattattgacaagagcatgaaaaaaatagaacatttggagaggtcgcttcagactcaatttaccgctcaaaacagcttctcaactgcaatgatccaagaggaaggcccgaaagatgcccatttgaaggatcgctatcacaaagtcaaagagtttatggaacaaaagttgcagacttccaaaattaatgacccctcttgttctgaggcagaggcacttgataatgtactttgcttaatcgaaagcagtatgaaaacactggacaaaaatagtaaatgttatccaattgcgacaaaaaagtgcataaagtatgttactgactcaccaagacttaaagaaaatgaacacgttacaaattga

SEQ ID NO: 3297 - DNA, 1395 bp, Saccharomyces cerevisiae
atggctttgactcagtttgaaaatgatttggaaatattaagagatatgtacccagaactggaaatgaaatcggtaaaagtagaggaggaaggtgaattccctcaaagaattaacggaaagttactgttcaagatatcactattggccgatgtaaatattgagttcggcgagcaacatatgttactttcaaacttatctaatgaatgcgtggagttcaccatatatagctgtcattatccggacattcgacggtgtgttgttatggatatcaaatccttatggatatcaacagatgaaaagaagatgttaattgacaaagcgctgagactcgttgaagaaactgtagatatgagtattgagttcgcggattcgtttacctccatccttatcctcatctttgggtttcttatagatgatacagctatattactattccctaatggaataagaaagtgcctgacacaggatcagtatgacttgtttaagcagataagtgaggaagccaccctccaaaaagtgagcagatctaactaccattgttgtatttgtatggaaatggaaaagggtgttagaatgatcaaattgccatgtgaaaatgcgaatgtagaacactatctttgcagaggatgcgccaaatcttatttcactgcaatgattcaggaaaaccgaatatccagtgtaagatgtccacaatgcgaatacaaagaattaaaactagaagatttcaagagctataaaaaaatgctgaaggcattgtttacacctttgattccagtgtccttcttaaaagaggttatcgatacagagctatgtgaaagatacgaaaaaatgttctacaaccaggcggctacaagactctcaaaatattgtccgtatgcttgtgtgacttgtcgaagatgtgatagttggtgcacaaaagaagacctcgatgatgcgatgattcagtgtcaaaaatgtcattttgtattttgctttgactgcttgcatgcctggcatggttacaacaataaatgtggcaagaaagtttcgttatcgaccgatattattgaggaatatctagatgataccgttacttcatatgagagaaagcggaaactggaggcaaaatatgggagaagagtattagaacttgaagtcaatgattaccttgctgaaaaaatgttagatttagcgattaaaaaagagggttcgaatttgcagcgatgtccaaagtgtaaggtagttgtagaaagaagtgaaggttgcaataaaatgaaatgcgaagtatgcgggacgctgttctgttttatatgcggagtattactttatcctgaggacccttatgaacattttagagaagcatattcaggctgttatggacgattgtttgaaggtatgcctggcacagaaacttga

SEQ ID NO: 3298 - DNA, 1395 bp, Saccharomyces cerevisiae
atgggaagcgtgaactcatcaccgaatgaagagtttgaaactgtgccagattcacaaatttcagggtttgattctcctttgataccgactagtgtgggaagttactttcgcgatgacgatgacgatgagaaggtgcatcccaactttattagtgatcctgagaacgacagtttgaatagcgacgaagagttttctagcctagagaacagcgatttgaatctttctggtgccaaggcggagtctggagacgattttgatccaatcttaaaaagaaccatcatttccaaaagaaaggcaccaagtaataacgaggatgaggagattgtcaagacacccagaaaattagtcaattacgtacctttaaaaattttcaatctaggtgatagcttcgacgatacgatcactactacagtggccaagctacaagacttgaaaaaagaaatattggattcacctagaagcaacaaaagcatagttattactagtaacactgtagccaaaagtgagttacaaaaaagcataaagttttctgggtctatcccagaaatttatttggatgtggttaccaaggaaaccatatcagataaatataaagattggcatttcatctctaaaaactgccattacgagcaattgatggatttggaaatgaaagatacggcgtattcattcctgtttggtagtagtagatcgcaaggaaaagttcctgaatttgttcacttgaaatgcccaagcatcacgaatttactggtcttatttggcgtcaatcaagaaaagtgtaactcgttaaaaatcaactacgagaaaaaggaaaattctagatatgataatttatgcacaattttccccgttaacaaaatgctcaaattcctaatgtatttttatagtgatgatgataatgatgatgttagagaattctttctgaaagccttcatatgtttaatcttggatagaaaggtttttaacgctatggaatcggaccatagactgtgttttaaggtcctggaattatttaatgaggcacatttcataaattcatatttcgaaattgtggacaagaacgacttttttttacattataggctactacaaatcttccctcatttacaaagcgccttgctcaggagacgctttagtgaaaagcaaggtcggactgaaactatacagcaaaatataatcaaagagtttaacgaattttttgattgtaaaaactataaaaatctactatattttattttaacgatgtatggctcgaaatttattccttttggtcccaaatgtcaagtaacagaatatttcaaagattgtattttggatatttctaatgaaacgacaaatgatgttgaaatttctatcctgaagggaatattaaatttgttttctaaaatcaggtaa

SEQ ID NO: 3299 - DNA, 1395 bp, Saccharomyces cerevisiae
atgggacaaattctatcaaacccggtaattgataaagagagccactccggtgctgactccttgaccgcgtttggactgtgtgcaatgcaagggtggcggatgtcaatggaggattcacacattctagagcctaatgttttgacaaagtccgataaggaccatattgcattttacggtatattcgatggtcatggtggcgctaaagtagcagaatactgtggtaataaaatagtggagatcctgcaagagcagaaatcgttccatgaaggaaatttaccaagggctttgattgatactttcataaacacagacgtgaaactgttacaagatcctgtgatgaaagaagaccatagcggatgtacggctacatccatattagtatcaaagtcccagaacttgttagtatgtggtaacgctggtgacagtagaaccgtactcgccaccgacgggaacgcaaaggcattatcatacgatcacaagcccactctagcaagcgaaaaatcacgtattgtggcagctgatggcttcgtagaaatggatagggtcaacggtaacttggcgctctctcgtgccattggtgattttgagttcaaatccaaccccaaattgggccccgaggagcaaatagtgacatgtgttccggacattctcgagcattctctagattacgatagggacgagtttgtaatcttagcctgtgatggtatctgggattgtttgacttcccaagattgtgtggacttggttcatctcggccttcgcgaaggcaagacattgaatgaaatttcttcgcggatcatcgatgtctgttgtgctcccaccacagaggggacgggtattggatgcgacaacatgagtatagtggttgtcgcgctgctgaaagaaggtgaagacgtcgctcaatggagcgaccgtatgaagtccaaggcccaccgcacatcagtgcgttcttttgcagacaagagaagaagggtgtttagttactacgatttttccaaatgtaacgacgaacaggtgttcgctatcactacgaagaaacctcaggacaaattcactcgcgaccacgaagccgctgtggcctcggtgactgccgccgataacgacgatccaatggacatagacgacacggacgctgacacagatgcagaaaatcttgacccttccagccaatccaagagcaagacctccggccccattgatctagcatccttggaggcgctacttggtgctacaggaggagtgaagacagacagcaacgggaacaaagtcacctacactcttccccagtctgccttggcccaactgctccaaaccatgggccatgacccggcttcctcccatcccgagaatgacagtaacactgaccacaaggccggccgttcccacttgcaatga

SEQ ID NO: 3300 - DNA, 1395 bp, Saccharomyces cerevisiae
atgtcatctgaaagcccacaggatcaaccacagaaggagcaaatcagcaataacgtcggcgttaccaccaatagtacaagcaatgaggaaacaagccgctctcaagatgataatgtcaaggaagtcaatggaaatgatgatactaaagaagaggaacaagaagaagacgcagaactagatgatttatttggagatgacaatgatgacgatgatgatgatgatgttaaaaaatcggagactgaaaaaagtgatagtgatagtgatgaagacgacgagggagagaatatcaaccatagaagtcgtcatagagaaagtctcgggttagatgatgatgaagcagaggagcaagccatgtacacccgaaaattttatggtgaggatgctaataacttttctgatcaagatgagactactcacacttttaaagaggaaaatgtagagcttgtcagacatattattccaagtaaagctaatgtgaatgaaacggcgtctcacaacgaaattttctatgctagaattcccaactttttaactatcgatccaattcctttcgaccctccaagttttgaggccaaagtaaacgaaagggcaagcaattcagcttctagggaggatcaactggacgaccgcctgattgatgaaaacactgttagatggagatactctcgtgacaaagaccaacatgtctttaaagaatcaaatacacaaatagtgcagtggtcagacggtacatattcgctaaaagttggtgaagagtgtacagatatattggtcaacgatacgagcaacacttttttgacagtatcgcatgaccaacaagagttgatccagtgttacgaagggggtgaaataaaaaagacgttgatgtttattccaacttcgacgaattcaaaaatacatcaaaaactaagtaaagctgttataagaaggaaccaaagacaaagcaagggtcctggaacatacattgtaagtatggatcctgaagtggaaaagaaggagttagagagaaagcaaagccagattttaagagacagaaggagaagacagctcaaagaaaaggagaaacaagaatccccagatgccgcttttgagacgggatttagaaagcaaaattcacccactacctatggagcctcgagaagaaatgaatatgaagaagatgactttttagtcgacgacgatgaggaagaggaggctgcgtttgacgacgaagaggatgataatgaggaagaagaagaagaagaggacgcggatgaagagaacgcctctcgtctaagaaatttaaaaagagaaggagcagcaatgtacagagaagaggaagaagaagaaaaagataggagcgagacaaaaagaagaagggttgcggtcatcgaggacgacgaagacgaggattag

SEQ ID NO: 3301 - DNA, 1398 bp, Saccharomyces cerevisiae
atgacattattttcttgtagtgtacagatgccgctggaggaaaggtccctgacaaacttaccattaaacctattgttccgaatattgtctcacctggatatgaatgatttacaaaacatagggaaaacttgcaccttgctaaggatgctggcgaatgagaacattgtttacagaaatgctgttatcggctcaaacgggaatatgtggtggacaaaaaatgttcttgttgatgtctttgatgttttgaattttaatagaaaggcaatgaaaaccttaaatagtcacaacatatccctggtcgcatcattaagaaatgttcagcggaaatataaactaggcgttattgatccggctagaaagacaataagttatagaacaaatgaagttgagagcaaagaaaagggctctgtgaaagatttaaatatggatttgaacgaacctacagaaataacaagggagcaaatcgctcatactgcaatactacaaggaatgaatcaattcatcgaactcaatgataaagcatttaggacccattcagcggattctgatgatacatacatagaggagaataatggagaaatacattctctccacggattggaaaaaaatacaacatttgaagaagacttagtcaaaaagccaccttttatcccttctccgacattttctaattattctagaagttcaacaaattctgtattttcaagttcatcgcccaaactactggacgatgattggaataatattacaatggatttcactaagtcacgagatcctgattataaagagatgacgcctacatctactgaatcgtctgactcaatcacaagattgagaaaatctaataaagtcaaggataaagccgaactttttgagaagttaatttttagagatagcagaccattaaaaacaaagaaaaaggacaatccaagattgaaattatccagttcgttaagtgctaatgacgaagattttaggaaaatcataagtcccccttctgacatactaccgaaagttggcagaaggagcgtctcaagaggttatttagaggagattgaaaggcattatcccgattttaacggtgaaacaactaatcctctagcaattaaaagagtcaacagtacaaagatagcaaattatgaacaattaattataaaagaaaatagctcgaactgtaaaggaataacagagaaaaatgatgaaaataaatttcaaagaagtcacacttccccagtaatagaattatccaaacctcatcaaagaagcaaattaaaggcggttgttacagacggtaataagatatgctatcgcaaaatcgaattggataaccctagtgggtcgaatacgaatgatcatgtaatcaaacggcttgacgctaataccgattttaatatataa

SEQ ID NO: 3302 - DNA, 1398 bp, Saccharomyces cerevisiae
atgagtaaatatattgcacttgaaaatcttccggtagatttgcaacataaaggagctacacaaaatgaaagcaccgctgatatactgaaacagttgccacatgaacgattacaagctgtcctggagaagataccagaagaagatcttgaggtgagacgattgctttcaattttaaagaagccggaagtagtggagaatgaagatgtacaacaaagaagaatacggttggctgaaattttaatggttgatgaaattgatcttgagaacattaataacatggaaaacataaatggggaagaagtagacgaagaggacgatgaggacttcttcactccagcaacatctgagctcatttttgcgagaagatttttgataaattattcacttgaaagatctcgaaagaggctacagaaagagatggaaagacatcaaaagttcaatacaagacaggaattactcagtcggcgtacagaattacagcgtatggctaatttagagcttgctggctctcaattagtatctacgaagcctatttccgcagtttctttatctaccgatgacatggttgtcgcaacgggaagctgggcaggtgatcttcaggtattaaattctcaaacactgcagccattgacacaaaaactcgactctcatgtagggaaaatcggagctatagattggcatcctgattcaaacaatcaaatgatttcatgcgcagaagacgggctcatcaaaaactttcaatactcaaacgaagagggcggccttcgattattgggagatcttgtgggacatgaaagacgtatttctgatgtgaaataccaccctagtggcaaatttataggtagtgcctctcatgatatgacttggagactttgggatgcgtcaacacatcaagaactgctgctacaagaaggccatgataagggagtgtttagtctgtcttttcaatgcgatggatctcttgtttgtagcggtggcatggactcgctttcaatgctatgggatataagatccggaagtaaggtgatgacactcgcaggacactcaaagcctatttacaccgtagcttggtcaccaaacgggtatcaagtagccactggtggtggtgatggaatcattaatgtttgggacatcagaaaacgggatgaaggccaactaaatcaaatattggcgcatcgtaacatcgttacgcaggtaaggttttcaaaggaagacggcggaaagaaacttgtctcttgtggctatgataatttgatcaatgtgtatagtagtgatacgtggttaaaaatgggaagtttagcaggccacactgataaaattattagcttggatatttcgaataattctcattttttagtgagcggcggatgggataggtctatcaagctctggaattga

SEQ ID NO: 3303 - DNA, 1398 bp, Saccharomyces cerevisiae
atgagtagtgaactcatgttcaactatacttttagctggcctgctggtccaaaagatgttattttaacaggaacgtttgatgactggaggggcactttacccctcgtgaagaccgccaagggaaatttcgaaattactatgcccgtgaagctagccaacaaggatgatacgtttcagtttaagtttattgtggatggcgtttggtgcgttagtgattcgtataaaaaggagcatgttagtgaaggaatcgaaaacaatttcttacaaattaccgatttagttgaaacgcaggaagttgccggtgccagtagaatcccggaggcaggtggcctattatgtggtaaaccgcctcgttcagcaggtcctccttctacaagtaatagaaagaaaaacaagcgtaacaataagaaaagaagatctaaattgaagaaaaagagtactaagaacaacaagaagtcaaatgaaagtttagacgataatgaagaagaagacggggtgactggaactactactgaagatgttactggaacctctagggaagaaactccattggcggagcctactaatgtttccaaagaagctccgggcaatttccatattctgccaatcgatcaaagtgcagacacaactcaatcaaatggtataattggtggaccaggtcctgttcttgtcccaaaccctggtgaaatcaaggaatttaccgaaattagagacgttgatgctagggaattgaatgaaagacttaacaaaaaagaagaggttccagaacccgttgctggccctattgttgaatcatcagttacggaaaagagtcctgctcttccacaagctgacgacccgattgttgagaccaaggaagtggctcataatgtgcaggaacttactcctcaagtggaagcggttactccgttaataaatgagcccgaaccattaccaactccggaagcacaaatatctatacctgagtcatcgaaagttgaaccagtggaggggtctcttcaatctaagttggtggagaaacgtgagtccactgaaggtgtattagacggttccaaaaaagtagaaaataaggcaaaaaaagatgaagaggtctttacattagaccccatcgttaacaaagctcccaagctacccttgactgacgagcaaacagctgaaggtagaaaatcaccagcagtgtcagaagaaaaagaaaagaaaaagaagcaagaaaaaggctctaaagaggtcaagaggtcagaaaccagtaaagaaaaaaagccttctgccaaagaggttaagaaacaaactgtaaaagccccaaagaaacagacagcttctcctttgtcttcttcgacagaagagcccaagaagaagaaaactggtttcttcggcaaattgaagaagctatttaagtga

SEQ ID NO: 3304 - DNA, 1398 bp, Saccharomyces cerevisiae
atgccgatcaagagattagatacagttgtggtaaataccggctctcaaaatgaccaacattcagcctccgtgccaccggtgtatttgtcgactaccttcaaagtggacttgaataatgaagatgcacagaactacgattattccagatcgggaaacccgaccagaagtgtccttcaacaccagattggtaagctttatcgtgtcccacaggaaaacgtattagctgtgagcagtggtatgacggcgctagacgtcatcctgcgtgggctcgtcttacttaacggcactgacaaccatacgccaacaataatagccggcgatgatctttatggaggcacccaaaggctgctgaattttttcaagcaacagagtcatgcagtctctgttcatgtggacacttccgattttgaaaagttcaaaaccgttttccagtctttagataaagttgattgtgttcttctagagtctccgaccaatccgctttgcaaggttgtagatatccctagaatattacgttttgtgaaatgcatatctcccgacactacagttgtcgttgataatactatgatgagtggactcaattgtaatcctcttcaactgaatccaggctgcgatgtcgtatacgaatctgctaccaagtacttgaatggtcatcacgatttgatggggggtgttattatcagcaaaacaccagaaatagcctcgaagctttactttgtcattaattctacaggagctggattatccccaatggattcttggctacttgtgaggggcctaaaaactctaggagttagattatatcaacagcagagaaatgctatgatattggctcattggctagaaaattcatgcggattcaaacctaccagaacaaacaaggctacgaaaactagatttgttggattacgctccaacccggatttcaagctgcataaatcgttcaataatggcccaggtgccgtgttatccttcgaaacggggtccttcgaacattcaaagagactggtcagttccaaaaaactgagtatatgggctgtgacggtatctttcgggtgtgtaaattcgcttctatctatgccttgcaaaatgtcccatgcttccattgatcccgaattaaggaaagagagagattttcctgaagatttggttcgtctttgctgcggtatcgaaaatatagtagatttgaagaaagatttattagcggcgatggttgacgctgatattatagaagtaagagaaaatggcaaatatcttttcaacaaattgaataagaacctagctgtgaacactaccatcgatgacctgcataagcctttaagtatttacgaagaattttacaatcaagatctcatcagaaaggactcagaattgaatattaagagttcgaaattgtaa

SEQ ID NO: 3305 - DNA, 1398 bp, Saccharomyces cerevisiae
atgcgtggagaatggcaggaatttaagacacctgcaggcaaaaagtattactataataagaacacgaagcagtctcgatgggaaaaacctaatttgaagaaaggctctaacctagaaagcaatgcgaaagaatcacagacagagaggaagccaacattttcattagaactggttaatggttggcacttaataatatacaacgatggtacaaaactttactttaatgatgactctaaggagttcaaaaatgacatcagtcaagaggacgacagcaggtgtcgctcattaatcgagtcgttagataaggaaaaactggttcttctgattggcgttgccagaggttacactatgcgggaggaggacattgataaaatcctcgaatcttgcaacgaagagattcatctatttaaaagaaatcaagacgaagttgagagaaaagatgagatcagcgaagaggcgggtgacgtaaaatcccctttacaggaaagccacactgggctagtcagcgggtatggttcatcttcgggggaggaagacgaagaggaagacgaagaggaagacgaagagaatgaagaacaaattgtaaatcaagatatcagcattatcgatgatctgaatcgtattgatacagatgacattgacgagcgtaatatcttcttcgaattattcgataggtataaactagacaagttttccacgtggtcgctgcaaagcaagaaaatcgaaaacgatcctgatttttacaagatcagagatgacacagttcgtgaaagtcttttcgaagaatggtgcggcgagcgcagtggcaatgccaccgctgaagaaagcgatagcgaagataatagcgaagacgatagcgaagtactagaaccaacaaaataccattatctggcacaaattgttgctaatgcgggaacaatcgcacccgacaccatcccacaagatataaggaaacaacaaaaagcgttatacaaggcctacaaaatcaaggagtatataccgtcgaagcgcgaccaagacaaattcgtttcccaactgctgttttattataagacgttcgacttggaacagcggaaagagattttctgcgattgcctacgggatcacgaacgagactttacgggggcagtcgaatcgctgcgtcaggacaaagagcttatcgaccgatggcaaacacttctgaaagcacccgcggacagtagtagtatagaggatatattgctgagcattgagcacaggtgttgtgtcagcccaatagtggtgacggaaccacgctactacgtcgtgggcattctggagaagaccgtggtctgggtgcggtggctagccgccgaggtcgggccatcaagccggtttaccccagtgggcgcggggaacgagccgataaatccggaatag

SEQ ID NO: 3306 - DNA, 1398 bp, Saccharomyces cerevisiae
atgctaagatcaaatttatgcagaggatctcgaatccttgcaagactgaccactacaccaaggacatacacatctgcggcgacagctgcggctgcgaatcggggacatatcatcaaaacatacttcaatagagattctacgacaattacgttctccatggaggagtccagcaagccggtttccgtttgctttaacaacgtttttcttagagatgcctcccatagtgccaagctggtgaccacgggagaactgtatcataacgagaaattgaccgctcctcaggacattcaaatttctgaggacggaaaatctctagtggtgaaatggaaagatggcggtcatcaccagttccctttacaattctttatcgactataaaggttccagttttgtttcgccagcaacaagaaaacaagaatccagatatagaccccagttatggaataagcgcatcctgaaagataacgtcaaggacttactttctgtgagctacaacgagtttattgatcctaaggatgactccaagcttttccaaacgctggtcaacctacaaaagtttggtatcgctttcatttccggtactccttcatcctcctctgaaggccttaccatacaaaagatctgtgaaaggatcggacccataagatcgactgtacatggtgaaggtacatttgacgtgaatgcatcccaagcgacaagtgttaatgcccattatgccaataaagacttgccgctacatacggatttaccatttttagaaaatgtgccaggtttccagattctacaatctctacctgctacagaaggggaagatcccaatactagacccatgaattacttcgtggacgcattttatgctacccgtaatgttagagaatcggattttgaggcttatgaggctttacaaattgttcctgtaaattatatatatgaaaacggcgataagaggtactaccaatccaaacctttaatcgaacatcacgacattaacgaggacaatactcttctgggtaattatgaggccttgattaaatgcattaactactctccaccataccaagcacctttcactttcggaatttatgataagccctcagatctaaataataatctggacttgaatttaattaccaccccagcaaaactaacagagagatttttgtttaagtctttcattagggggttgaacttgttcgagagtcatatcaatgacttcaacaatcaatttagattgcagttgcccgaaaactgttgtgttatctttaacaacaggagaattttgcatgctaactctttaacaagctcaaaccagcaatggttaaagggttgctatttcgattctgatactttcaagagtaaattaaagttcttggaagagaagtttcctcatgacaaataa

(The sequence listing continues in the following parts.)

I claim:

1. A polynucleotide library comprising a plurality of polynucleotides having sequences different from each other, each polynucleotide comprising a single open reading frame encoding a single fusion polypeptide formed by fusing in-frame in a random manner two non homologous, full-length open reading frames, one open reading frame originating from a first polynucleotide collection of full-length open reading frames comprising a plurality of polynucleotides having non-homologous sequences identified and isolated from a sequenced genome of a single organism and one open reading frame originating from a second polynucleotide collection of full-length open reading frames comprising a plurality of polynucleotides having non-homologous sequences identified and isolated from a sequenced genome of a single organism, wherein at least one of the first or second collections of open reading frames comprises at least 75% of the open reading frames encoded by the single organism.

2. The library of claim 1, wherein the two full-length non-homologous open reading frames are joined via a linker sequence.

3. The library of claim 1, wherein the polynucleotide further comprises at least one regulatory sequence.

4. The library of claim 3, wherein the at least one regulatory sequence is a promoter.

5. The library of claim 3, wherein the at least one regulatory sequence is a terminator.

6. A vector comprising the single open reading frame encoding a single fusion polypeptide of claim 1.

7. A host cell comprising the single open reading frame encoding a single fusion polypeptide of claim 1.

8. A method of producing the library of claim 1 comprising:
   (a) creating a first collection comprising a plurality of polynucleotides having sequences different from each other by amplifying full-length open reading frames of an organism using a primer set, wherein the primer set comprises a 5' primer comprising 16 nucleotides of sequence homologous to the promoter region of an expression vector and a 3' primer comprising 24 nucleotides of sequence homologous to SEQ ID NO: 25103;
   (b) creating a second collection comprising a plurality of polynucleotides having sequences different from each other by amplifying full-length open reading frames of an organism using a primer set, wherein the primer set comprises a 5' primer comprising 16 nucleotides of sequence homologous to SEQ ID NO:25103 and a 3' primer comprising 24 nucleotides homologous to the terminator region of an expression vector; and
   (c) fusing the collection of step (a) with the collection of step (b) in a random manner to produce a library comprising a plurality of randomly combined polynucleotides having sequences different from each other, each randomly combined polynucleotide comprising a single open reading frame encoding a single fusion polypeptide produced by joining together in-frame two full-length non-identical open reading frames, wherein one full-length open reading frame originates from step (a) and one full-length open reading frame originates from step (b).

9. The method of claim 8, wherein the 5' primer of step (a) and step (b) further comprises an ATG start codon.

10. The method of claim 8, wherein the 5' primer of step (b) further comprises SEQ ID NO:25101.

11. The method of claim 8, wherein the 3' primer of step (b) further comprises SEQ. ID NO:25102.

12. The method of claim 8, wherein the 3' primer of step (a) further comprises SEQ ID NO:25100.

13. A method of producing a new phenotype comprising:
   (a) introducing the composition of claim 1 into yeast cells; and
   (b) isolating a cell exhibiting a different phenotype as compared to a control cell of the same species cultivated under the same conditions.

14. The library according to claim 2, wherein the linker encodes SEQ ID NO:25104.

15. The vector of claim 6, wherein the vector is an expression vector.

16. The method of claim 13, wherein the phenotype is butanol tolerance.

17. The method of claim 13, wherein the phenotype is heat tolerance.

18. The library of claim 1 obtained according to the method comprising:
- (a) creating a first polynucleotide collection of full-length open reading frames comprising a plurality of polynucleotides having non-homologous sequences by amplifying and isolating full-length open reading frames identified from a sequenced genome of a single organism;
- (b) creating a second polynucleotide collection of full-length open reading frames comprising a plurality of non-homologous polynucleotides by amplifying and isolating full-length open reading frames identified from a sequenced genome of a single organism; and
- (c) fusing in-frame in a random manner the collection of step (a) with the collection of step (b) to produce a library comprising a plurality of polynucleotides having sequences different from each other, each polynucleotide comprising a single open reading frame encoding a single fusion polypeptide formed by two full-length open reading frames, one full-length open reading frame originating from step (a) and one full-length open reading frame originating from step (b), wherein the open reading frame from step (a) and the open reading frame from step (b) are not homologous.

19. The library of claim 18, wherein the primer set of step (a) comprises a 5' primer comprising SEQ ID NO:25099 and a 3' primer comprising SEQ ID NO:25100; and the primer set of step (b) comprises a 5' primer comprising SEQ ID NO:25101 and a 3' primer comprising SEQ ID NO:25102.

20. The library of claim 18, wherein the primer set of step (a) comprises a 5'primer comprising SEQ ID NO:25127 and a 3' primer comprising SEQ ID NO:25128; and the primer set of step (b) comprises a 5'primer comprising SEQ ID NO:25129 and a 3' primer comprising SEQ ID NO:25130.

21. The method of claim 8, wherein the primer set of step (a) comprises a 5' primer comprising SEQ ID NO:25099 and a 3' primer comprising SEQ ID NO:25100 and the primer set of step (b) comprises a 5' primer comprising SEQ ID NO:25101 and a 3' primer comprising SEQ ID NO:25102.

22. The method of claim 8, wherein the primer set of step (a) comprises a 5'primer comprising SEQ ID NO:25127 and a 3' primer comprising SEQ ID NO:25128 and the primer set of step (b) comprises a 5'primer comprising SEQ ID NO:25129 and a 3' primer comprising SEQ ID NO:25130.

23. A polynucleotide library comprising a plurality of polynucleotides having sequences different from each other, each polynucleotide comprising a single open reading frame encoding a single fusion polypeptide formed by fusing in-frame in a random manner two non-homologous, full-length open reading frames, one open reading frame originating from a first polynucleotide collection of full-length open reading frames comprising a plurality of polynucleotides having non-homologous sequences identified and isolated from a sequenced genome of a single organism and one open reading frame originating from a second polynucleotide collection of full-length open reading frames comprising a plurality of polynucleotides having non-homologous sequences identified and isolated from a sequenced genome of a single organism, the one open reading frame originating from the first collection being positioned either upstream or downstream with respect to the one open reading frame originating from the second collection to which it is fused, wherein the upstream open reading frame and the downstream open reading frame are joined via a linker sequence encoding SEQ ID NO:25104.

24. The library of claim 23 obtained according to the method comprising:
- (a) creating a first polynucleotide collection of full-length open reading frames comprising a plurality of polynucleotides having non-homologous sequences by amplifying and isolating full-length open reading frames identified from a sequenced genome of a single organism;
- (b) creating a second polynucleotide collection of full-length open reading frames comprising a plurality of non-homologous polynucleotides by amplifying and isolating full-length open reading frames identified from a sequenced genome of a single organism; and
- (c) fusing in-frame in a random manner the collection of step (a) with the collection of step (b) to produce a library comprising a plurality of polynucleotides having sequences different from each other, each polynucleotide comprising a single open reading frame encoding a single fusion polypeptide formed by non-identical two full-length open reading frames, one full-length open reading frame originating from step (a) and one full-length open reading frame originating from step (b), wherein the open reading frame from step (a) and the open reading frame from step (b) are not homologous.

25. The library according to claim 23, wherein the organism is yeast, *E. coli*, or *Synechococcus*.

* * * * *